United States Patent
Chen et al.

(10) Patent No.: US 12,497,611 B2
(45) Date of Patent: Dec. 16, 2025

(54) COMPOSITIONS AND METHODS FOR HIGH-THROUGHPUT ACTIVATION SCREENING TO BOOST T CELL EFFECTOR FUNCTION

(71) Applicant: YALE UNIVERSITY, New Haven, CT (US)

(72) Inventors: Sidi Chen, Milford, CT (US); Ryan D. Chow, San Jose, CA (US); Lupeng Ye, New Haven, CT (US); Matthew Dong, San Francisco, CA (US); Jonathan Park, Scott AFB, IL (US); Lei Peng, New Haven, CT (US)

(73) Assignee: Yale University, New Haven, CT (US)

( * ) Notice: Subject to any disclaimer, the term of this patent is extended or adjusted under 35 U.S.C. 154(b) by 1241 days.

(21) Appl. No.: 17/268,928

(22) PCT Filed: Aug. 15, 2019

(86) PCT No.: PCT/US2019/046691
§ 371 (c)(1),
(2) Date: Feb. 16, 2021

(87) PCT Pub. No.: WO2020/037142
PCT Pub. Date: Feb. 20, 2020

(65) Prior Publication Data
US 2021/0269794 A1 Sep. 2, 2021

Related U.S. Application Data

(60) Provisional application No. 62/824,514, filed on Mar. 27, 2019, provisional application No. 62/719,205, filed on Aug. 17, 2018.

(51) Int. Cl.
| | | |
|---|---|---|
| C12N 15/10 | (2006.01) | |
| A61K 40/11 | (2025.01) | |
| A61K 40/31 | (2025.01) | |
| A61K 40/32 | (2025.01) | |
| A61K 40/42 | (2025.01) | |
| C12N 15/86 | (2006.01) | |
| C12N 15/90 | (2006.01) | |

(52) U.S. Cl.
CPC .......... *C12N 15/1082* (2013.01); *A61K 40/11* (2025.01); *A61K 40/31* (2025.01); *A61K 40/32* (2025.01); *A61K 40/42* (2025.01); *A61K 40/4212* (2025.01); *C12N 15/86* (2013.01); *C12N 15/907* (2013.01); *A61K 2239/48* (2023.05); *C12N 2310/20* (2017.05); *C12N 2740/15043* (2013.01)

(58) Field of Classification Search
CPC .......... C12N 15/86; C12N 2740/15043; C12N 2740/16043; C12N 2750/14143; C12N 2310/20
See application file for complete search history.

(56) References Cited

U.S. PATENT DOCUMENTS

| | | |
|---|---|---|
| 5,350,674 A | 9/1994 | Boenisch |
| 5,399,346 A | 3/1995 | Anderson |
| 5,580,859 A | 12/1996 | Felgner |
| 5,585,362 A | 12/1996 | Wilson |
| 5,589,466 A | 12/1996 | Felgner |
| 5,993,434 A | 11/1999 | Dev |
| 6,181,964 B1 | 1/2001 | Hofmann |
| 6,233,482 B1 | 5/2001 | Hofmann |
| 6,241,701 B1 | 6/2001 | Hofmann |
| 6,326,193 B1 | 12/2001 | Liu |
| 6,516,223 B2 | 2/2003 | Hofmann |
| 6,657,694 B2 | 12/2003 | Ko |
| 6,678,556 B1 | 1/2004 | Nolan |
| 7,171,264 B1 | 1/2007 | Hofmann |
| 7,173,116 B2 | 2/2007 | Fewell |
| 2004/0014645 A1 | 1/2004 | Draghia-Akli |
| 2004/0059285 A1 | 3/2004 | Mathiesen |
| 2004/0092907 A1 | 5/2004 | Mathiesen |
| 2005/0052630 A1 | 3/2005 | Smith |
| 2005/0070841 A1 | 3/2005 | Mathiesen |
| 2007/0128708 A1 | 6/2007 | Gamelin |
| 2010/0273660 A1 | 10/2010 | Zender et al. |
| 2011/0059502 A1 | 3/2011 | Chalasani |
| 2013/0280220 A1 | 10/2013 | Ahmed et al. |
| 2014/0068797 A1 | 3/2014 | Doudna |

(Continued)

FOREIGN PATENT DOCUMENTS

| | | |
|---|---|---|
| WO | 0129058 | 4/2001 |
| WO | 0196584 | 12/2001 |

(Continued)

OTHER PUBLICATIONS

Haeryfar SM, Hoskin DW. Thy-1: more than a mouse pan-T cell marker. J Immunol. Sep. 15, 2004;173(6):3581-8. doi: 10.4049/jimmunol.173.6.3581. PMID: 15356100. (Year: 2004).*

Liao HK, Hatanaka F, Araoka T, Reddy P, Wu MZ, Sui Y, Yamauchi T, Sakurai M, O'Keefe DD, Núñez-Delicado E, Guillen P, Campistol JM, Wu CJ, Lu LF, Esteban CR, Izpisua Belmonte JC. In Vivo Target Gene Activation via CRISPR/Cas9-Mediated Transepigenetic Modulation. Cell. Dec. 14, 2017 (Year: 2017).*

Wang X, Xu Z, Tian Z, Zhang X, Xu D, Li Q, Zhang J, Wang T. The EF-1α promoter maintains high-level transgene expression from episomal vectors in transfected CHO-K1 cells. J Cell Mol Med. Nov. 2017;21(11):3044-3054. doi: 10.1111/jcmm.13216. Epub May 30, 2017. PMID: 28557288; PMCID: PMC5661254. (Year: 2017).*

(Continued)

*Primary Examiner* — Fereydoun G Sajjadi
*Assistant Examiner* — Qinhua Gu
(74) *Attorney, Agent, or Firm* — Pabst Patent Group LLP

(57) ABSTRACT

The present invention includes dead-guide RNA (dgRNA) libraries and methods of use in immunology and immunotherapy thereof. Also provided are engineered primary or chimeric antigen receptor (CAR) T cells that overexpress Prodh2, Ccnblip1, Sreklip1, or Wdr37 or a fragment thereof, and methods of use in immunology and immunotherapy thereof.

19 Claims, 66 Drawing Sheets
Specification includes a Sequence Listing.

(56) References Cited

U.S. PATENT DOCUMENTS

| | | |
|---|---|---|
| 2015/0252358 A1 | 9/2015 | Maeder |
| 2016/0208243 A1 | 7/2016 | Zhang et al. |
| 2016/0375149 A1 | 12/2016 | Irvine |
| 2017/0204407 A1* | 7/2017 | Gilbert ............... C12N 15/1082 |
| 2017/0321214 A1* | 11/2017 | Zhang ................. C12N 15/115 |
| 2020/0085929 A1 | 3/2020 | Cooper et al. |
| 2021/0139583 A1 | 5/2021 | Jensen et al. |
| 2021/0388389 A1 | 12/2021 | Chen et al. |
| 2023/0302134 A1 | 9/2023 | Chen et al. |

FOREIGN PATENT DOCUMENTS

| | | | |
|---|---|---|---|
| WO | 2017127807 | A1 | 7/2017 |
| WO | 2017156484 | A1 | 9/2017 |
| WO | 2018051347 | | 3/2018 |
| WO | 2018068022 | A1 | 4/2018 |
| WO | 2019178225 | A2 | 9/2019 |
| WO | 2020028533 | A1 | 2/2020 |
| WO | 2020092057 | A1 | 5/2020 |

OTHER PUBLICATIONS

Kao R, Gschweng E, Lerman A, Larson S, Tu A, Tyagi T, Senadheera S, Hollis R, De Oliveira S, Systematic Comparison of the EF-1 Alpha Short (EFS) and Viral Promoters for Gene Modification of Human Primary Cells for Clinical Applications, Blood, vol. 124, Issue 21, 2014, p. 3497, ISSN 0006-4971 (Year: 2014).*

Milone MC, O'Doherty U. Clinical use of lentiviral vectors. Leukemia. Jul. 2018;32(7):1529-1541. doi: 10.1038/s41375-018-0106-0. Epub Mar. 22, 2018. PMID: 29654266; PMCID: PMC6035154. (Year: 2018).*

Anderson, et al., "Human Gene Therapy", Science, 256(5058):808-813 (1992).

Bray, et al., "Near-optimal RNA-Seq quantification", Nat. Biotechnol., 34(5):525-527 (2016).

Chong, et al., "MetaboAnalystR 2.0: From Raw Spectra to Biological Insights", Nuc. Acids. Res., 46(W1): W486-W494 (2018).

Cougot, et al., "Cap-tabolism", Trends in Biochem. Sci., 29(8):436-444 (2001).

Dahlman, et al., "Orthogonal gene knock out and activation with a catalytically active Cas9 nuclease", Nat. Biotechnol., 33(11): 1159-1161 (2015).

Elango, et al., "Optimized transfection of mRNA transcribed from a d(A/T) 100 tail-containing vector", Biochim. Biophys. Res. Commun., 330(3):958-966 (2005).

Ghosh, et al., "Design of liposomes for circumventing the reticuloendothelial cells", Glycobiology, 1(5):505-10 (1991).

Huang, et al., "Systematic and Integrative Analysis of Large Gene Lists Using DAVID Bioinformatics Resources", Nature Protocols, 4:44-57 (2009).

International Search Report for PCT/US2019/046691 dated Jan. 13, 2020.

Jiang, et al., "Signatures of T cell dysfunction and exclusion predict cancer immunotherapy response", Nat. Med., 24(10):1550-1558 (2018).

Kanehisa, et al., "KEGG: Kyoto Encyclopedia of Genes and Genomes", Nuc. Acids. Res., 28(1):27-30 (2000).

Kiani, et al., "Cas9 gRNA engineering for genome editing, activation and repression", Nat. Methods, 12(11):1051-1054 (2015).

Langmead, et al., "Ultrafast and memory-efficient alignment of short DNA sequences to the human genome", Genome Biol., 10(3):R25 (2009).

Nacheva, et al., "Preventing nondesired RNA-primed RNA extension catalyzed by T7 RNA polymerase", Eur. J. Biochem., 270(7):1485-65 (2003).

Pimentel, et al., "Differential analysis of RNA-seq incorporating quantification uncertainty", Nat. Methods, 14(7):687-690 (2017).

Schenborn, et al., "A novel transcription property of SP6 and T7 RNA polymerases: dependence on template structure", Nuc. Acids. Res., 13(17):6223-36 (1985).

Stepinski, et al., "Synthesis and properties of mRNAs containing the novel "anti-reverse" cap analogs 7-methyl(3'-O-methyl)GpppG and 7-methyl (3'-deoxy)GpppG", RNA, 7(10):1468-95 (2001).

Xia, et al., "MetaboAnalyst 3.0—making metabolomics more meaningful", Nuc. Acids. Res., 43(W1):W251-W257 (2015).

Xia, et al., "MetaboAnalyst: a web server for metabolomic data analysis and interpretation", Nuc. Acids. Res., 37:W652-660 (2009).

Ye, et al., "Programmable DNA repair with CRISPRa/i enhanced homology-directed repair efficiency with a single Cas9", Cell Discovery, 4:46, 12 pages (2018).

Yu, et al., "Progress towards gene therapy for HIV infection", Gene Therapy, 1(1):13_26 (1994). Abstract Only.

International Search Report received for PCT Patent Application No. PCT/US2019/057379, mailed on Feb. 18, 2020, 6 pages.

International Search Report received for PCT Patent Application No. PCT/US2021/045882, mailed on Dec. 7, 2021, 6 pages.

International Search Report received for PCT Patent Application No. PCT/US2023/064244, mailed on Jul. 13, 2023, 8 pages.

International Search Report received for PCT Patent Application No. PCT/US2023/074788, mailed on Mar. 21, 2024, 8 pages.

Barrett, et al., "Chimeric Antigen Receptor Therapy for Cancer", Annual Review of Medicine, vol. 65, No. 1, Jan. 14, 2014, pp. 333-347.

Dai, et al., "One-step generation of modular CAR-T cells with AAV-Cpf1", Nature Methods, Nature Pub. Group, New York, vol. 16, No. 3, Feb. 25, 2019, pp. 247-254.

Hale, et al., "Homology-Directed Recombination for Enhanced Engineering of Chimeric Antigen Receptor T Cells", Molecular Therapy—Methods & Clinical Development, vol. 4, 2017, pp. 192-203.

Izsvak, et al., "Sleeping Beauty Transposition: Biology and Applications for Molecular Therapy", Molecular Therapy, Elsevier Inc, US, vol. 9, No. 2, Feb. 1, 2004, pp. 147-156.

Peng, et al., "Perturbomics of tumor-infiltrating NK cells", bioRxiv, 2023.03.14.532653, Mar. 15, 2023, 62 pages.

Ruella, et al., "Dual CD19 and CD123 targeting prevents antigen-loss relapses after CD19-directed immunotherapies", Journal of Clinical Investigation, vol. 126, No. 10, Oct. 3, 2016, pp. 3814-3826.

Scholz, et al., "Langerhans Cells Suppress CD49a+ NK Cell-Mediated Skin Inflammation", J Immunol., vol. 195, No. 5, 2015, pp. 2335-2342.

Tipanee, et al., "Transposons: Moving Forward from Preclinical Studies to Clinical Trials", Human Gene Therapy, vol. 28, No. 11, Nov. 1, 2017, pp. 1087-1104.

Zetsche, et al., "Multiplex gene editing by CRISPR-Cpf1 using a single crRNA array", Nature Biotechnology, vol. 35, No. 1, 2017, 6 pages.

* cited by examiner

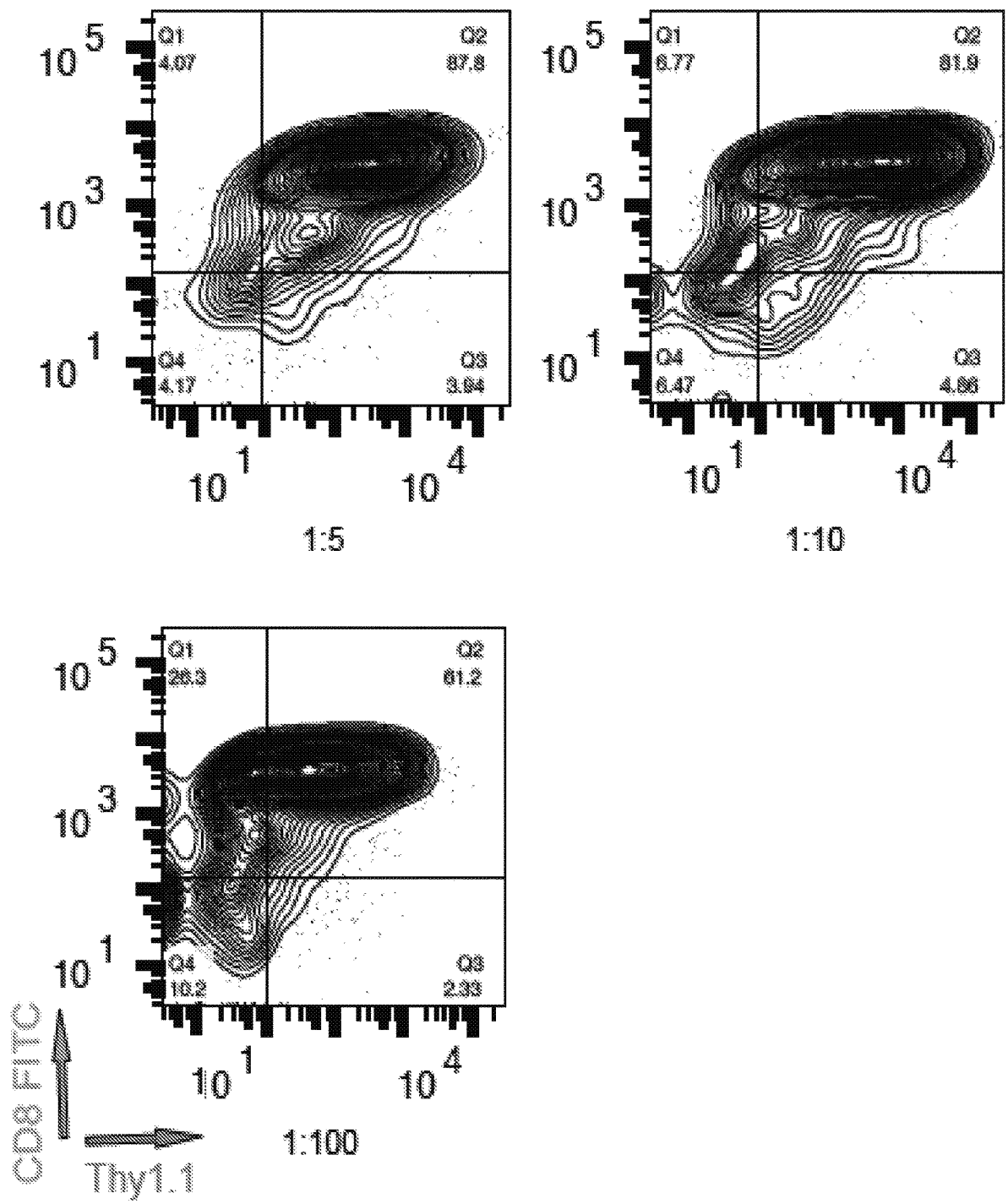
FIG. 4D, Continued

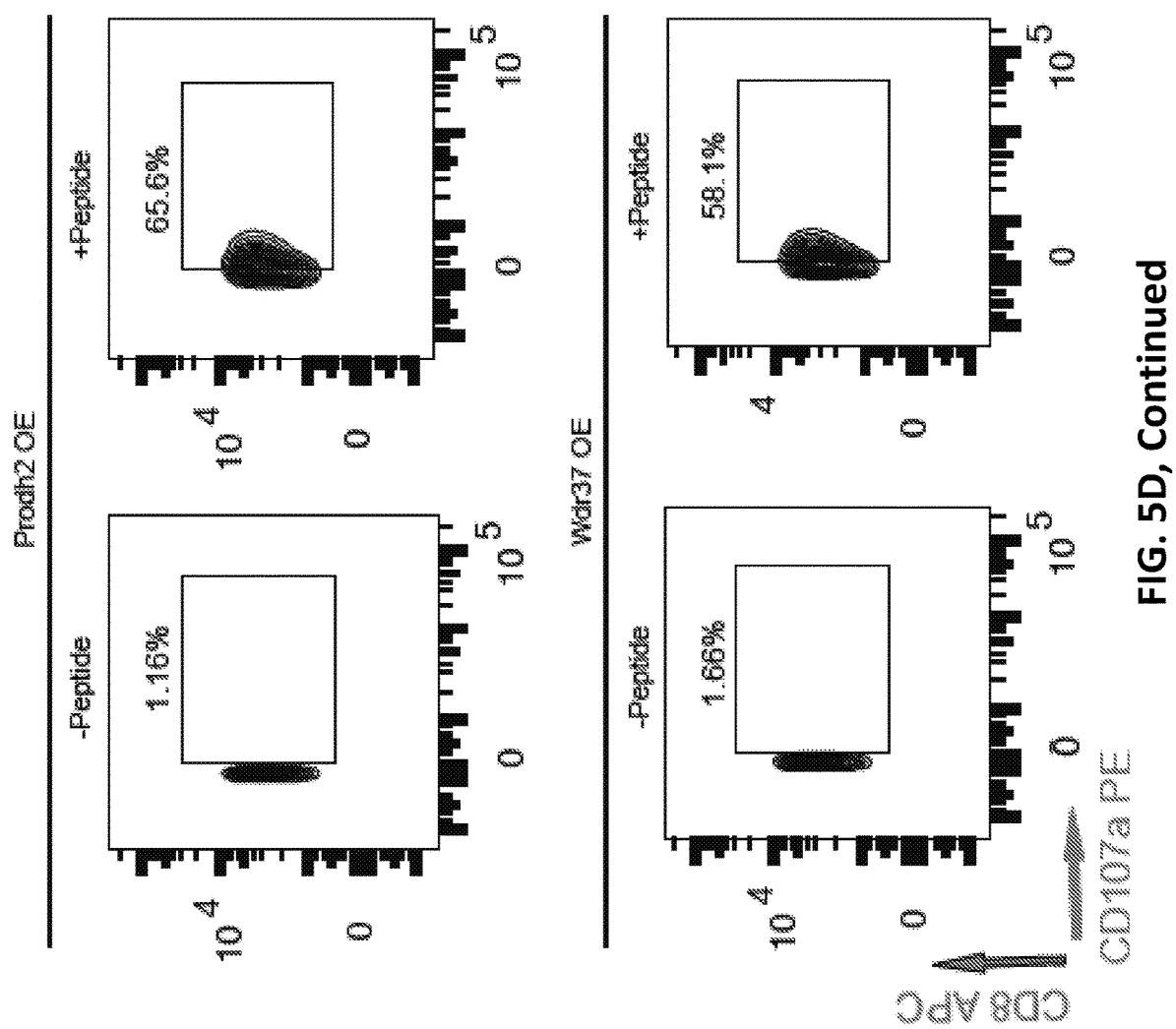
FIG. 5D, Continued

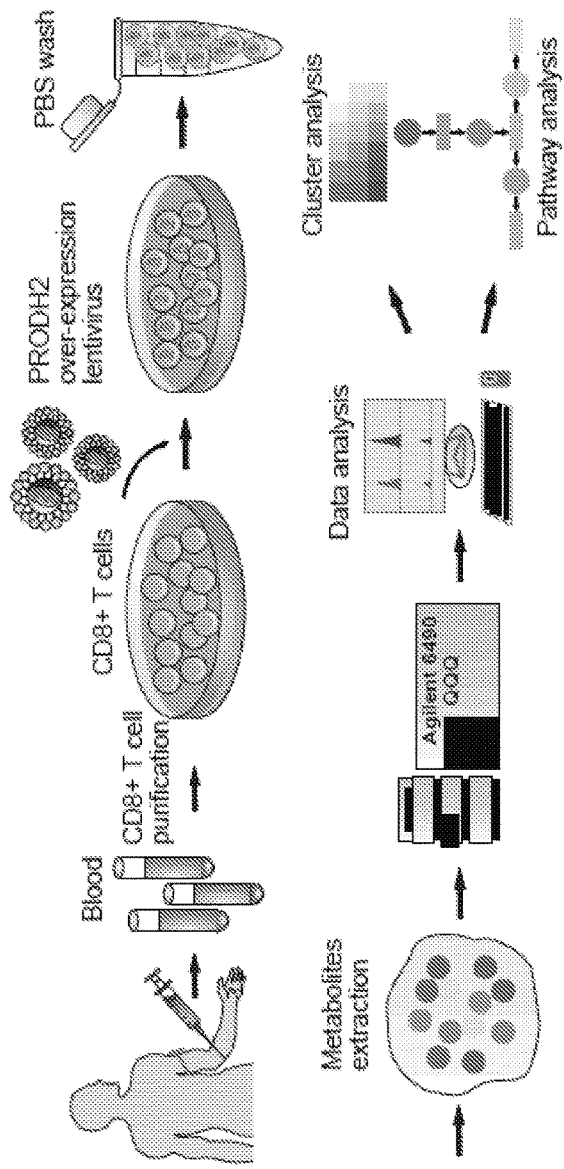
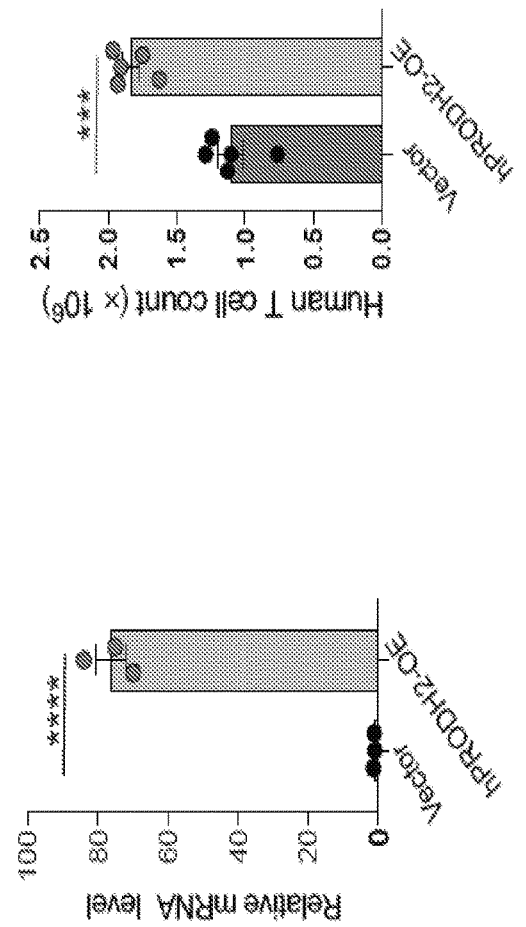
FIG. 8A
FIG. 8B
FIG. 8C

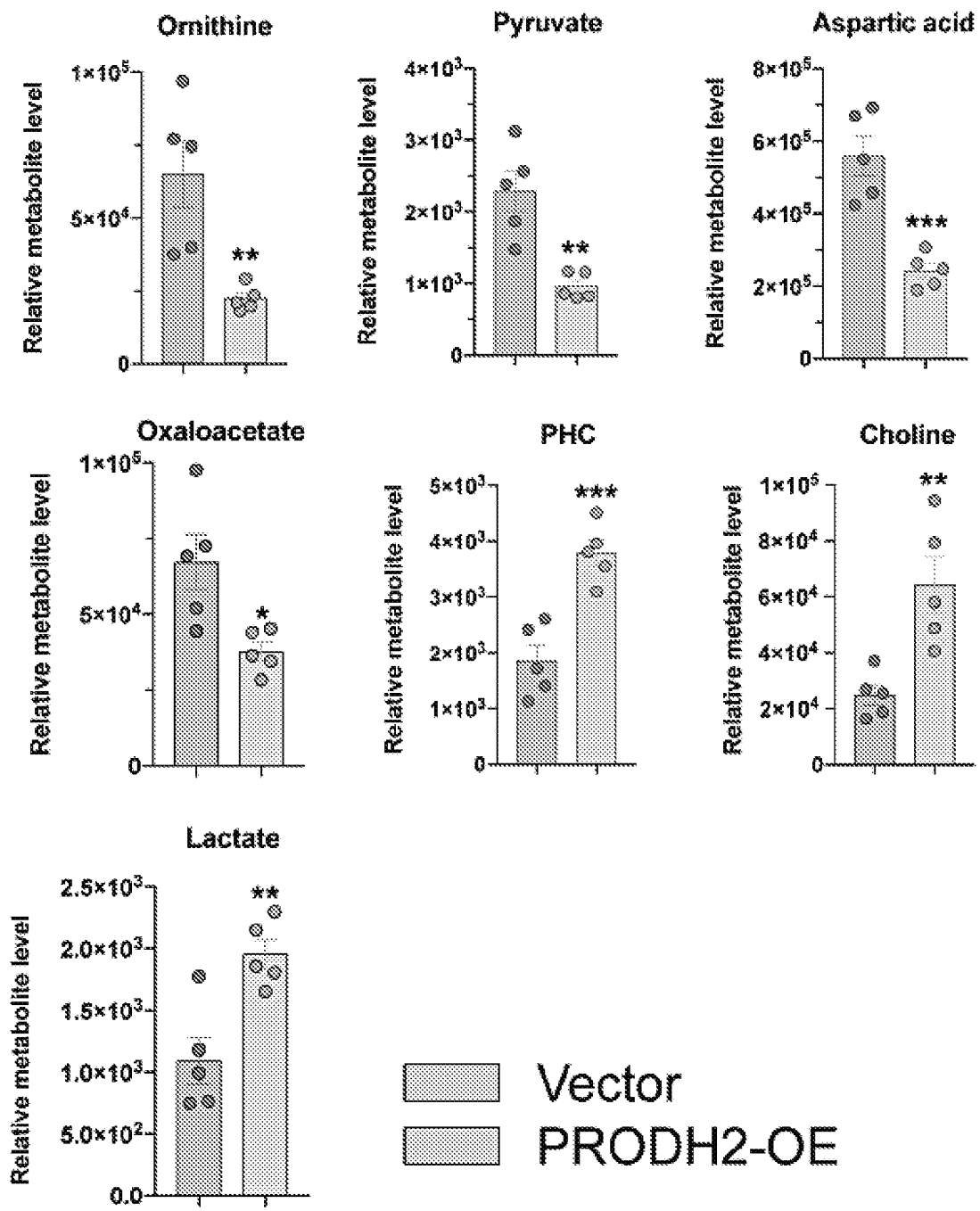
FIG. 8D, Continued

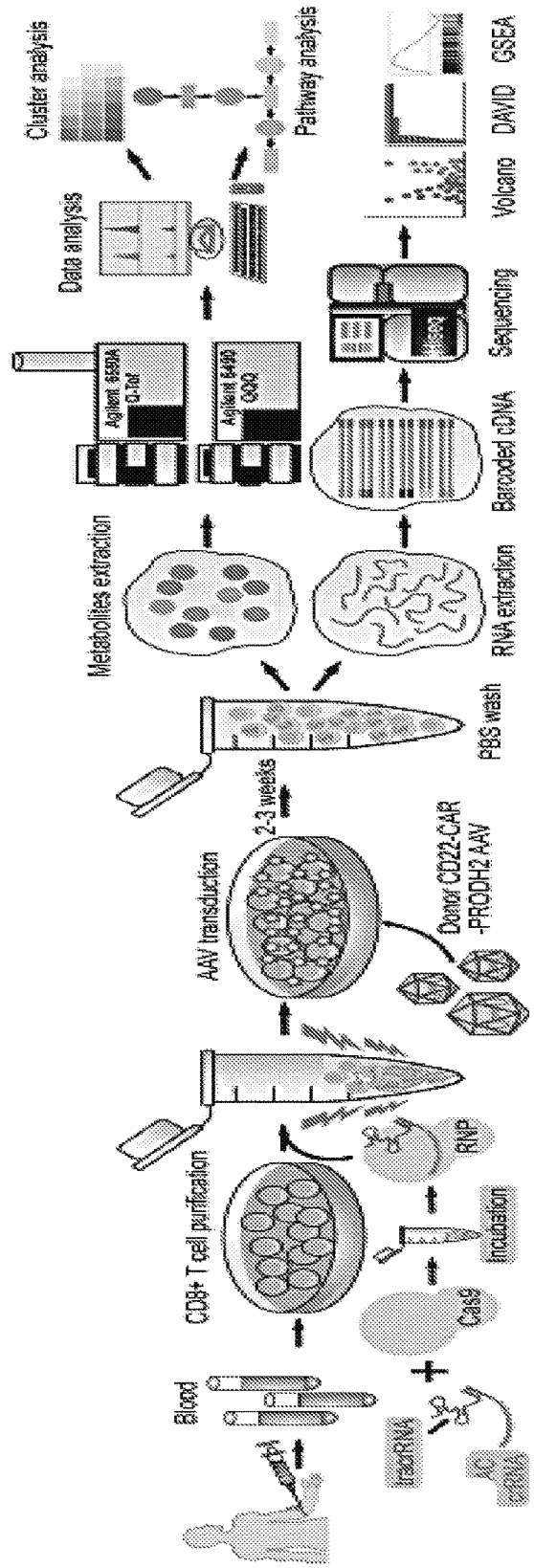
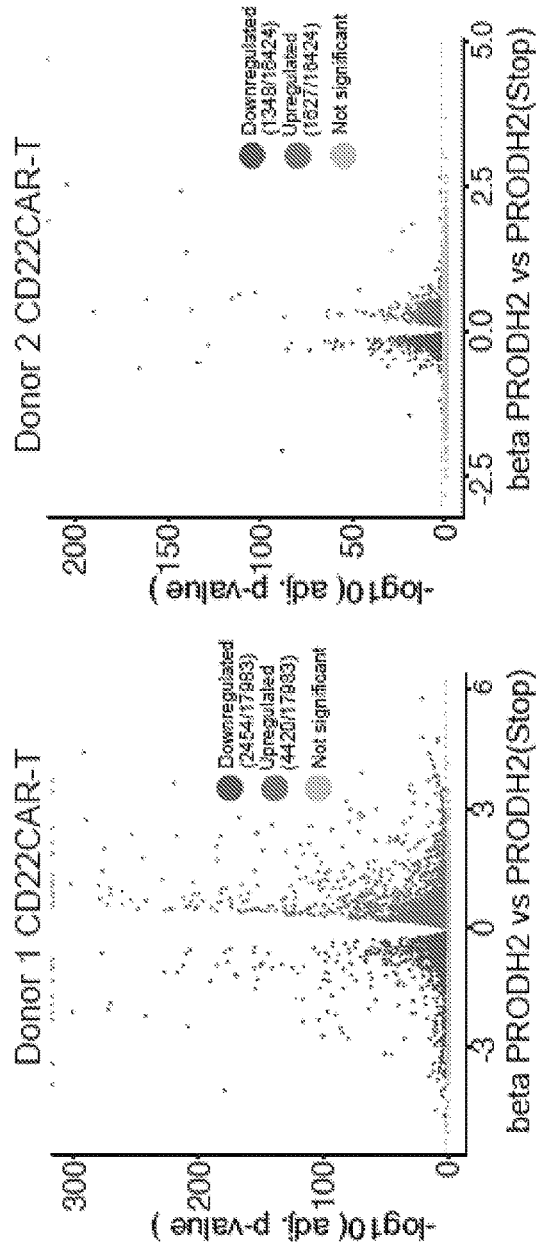
FIG. 10A
FIG. 10B

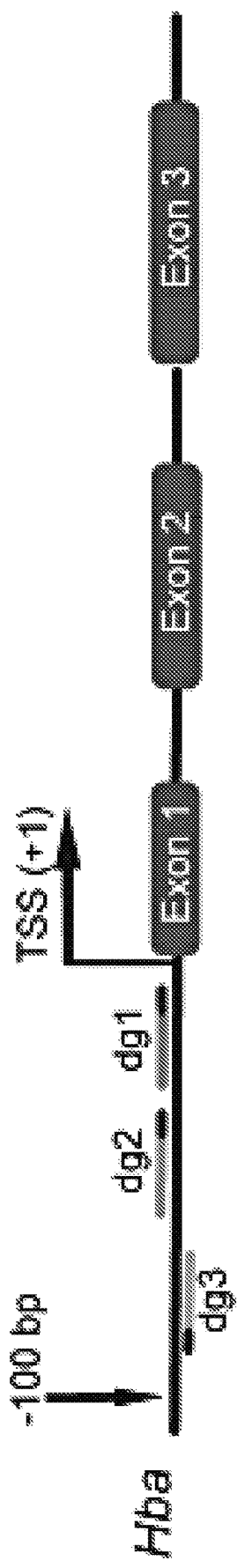
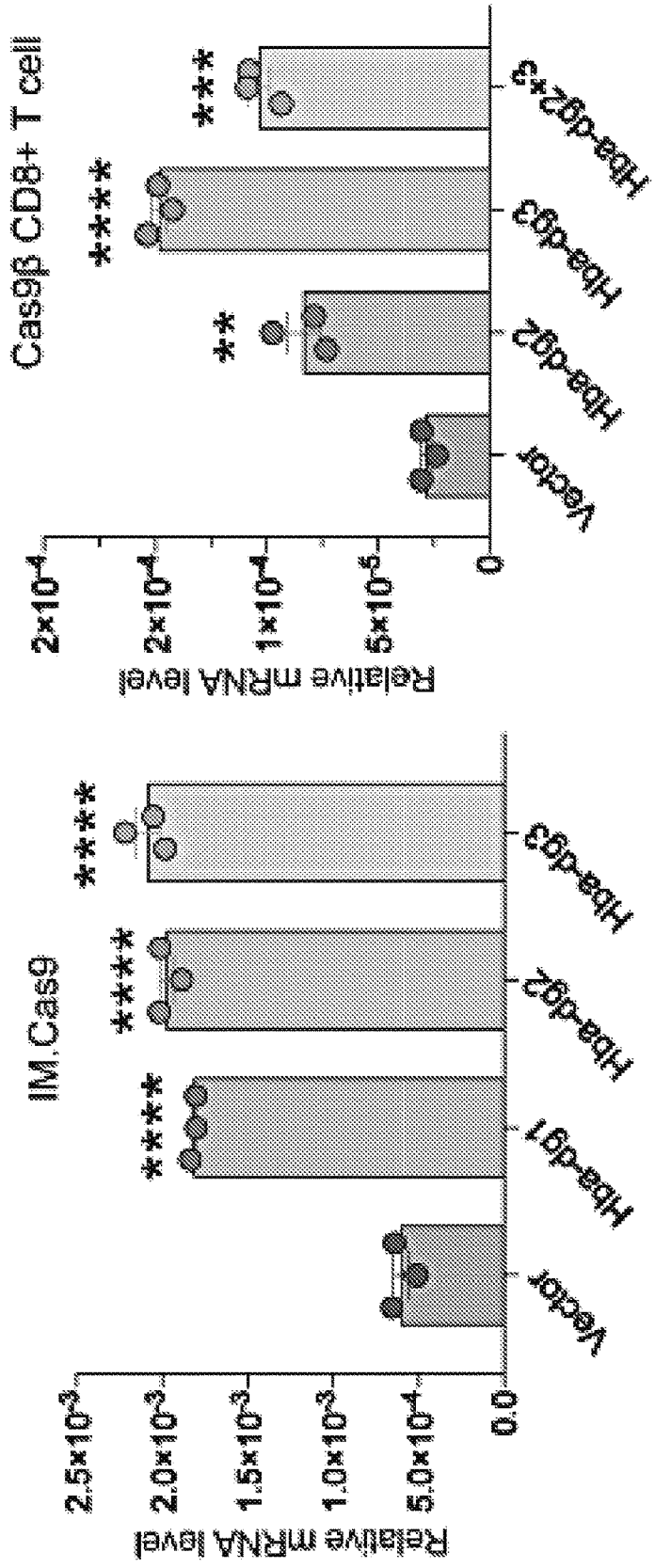
FIG. 12A
FIG. 12B
FIG. 12C

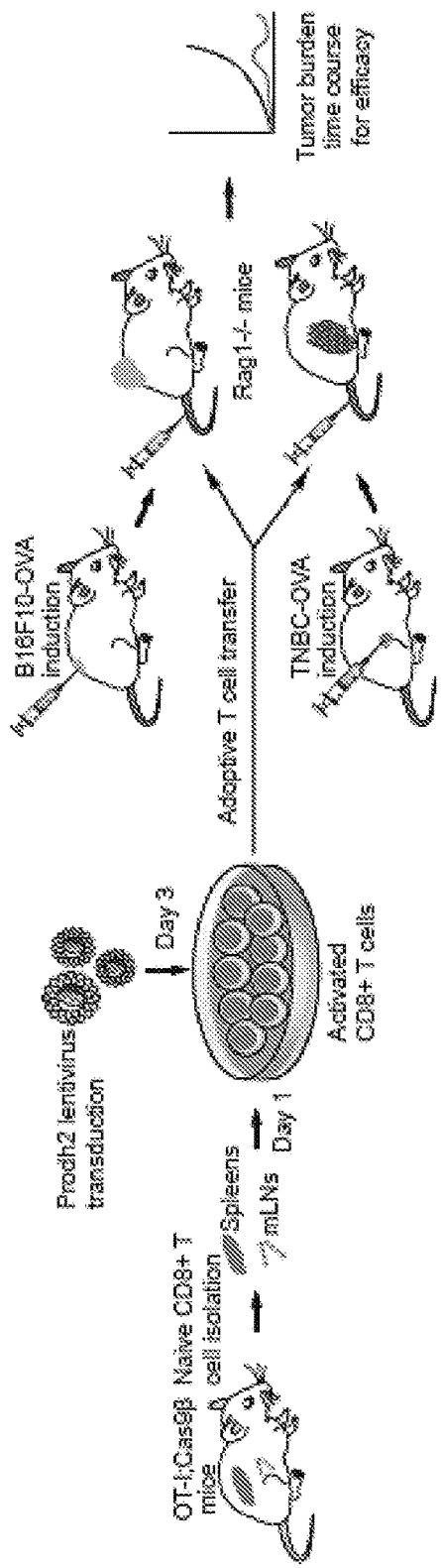
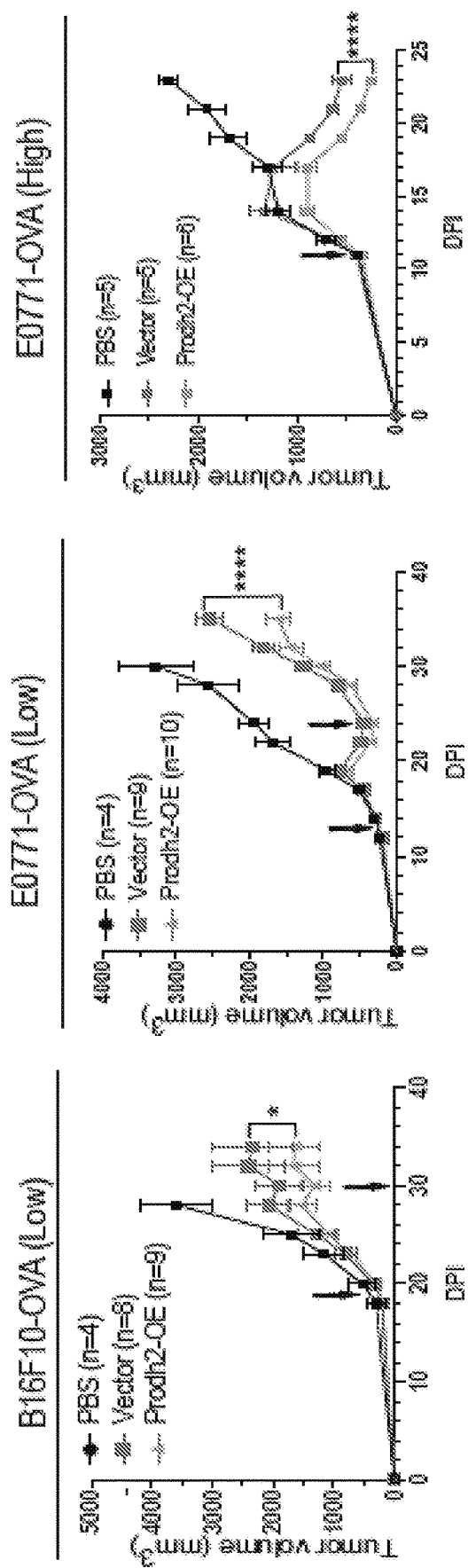
FIG. 15A
FIG. 15B
FIG. 15C
FIG. 15D

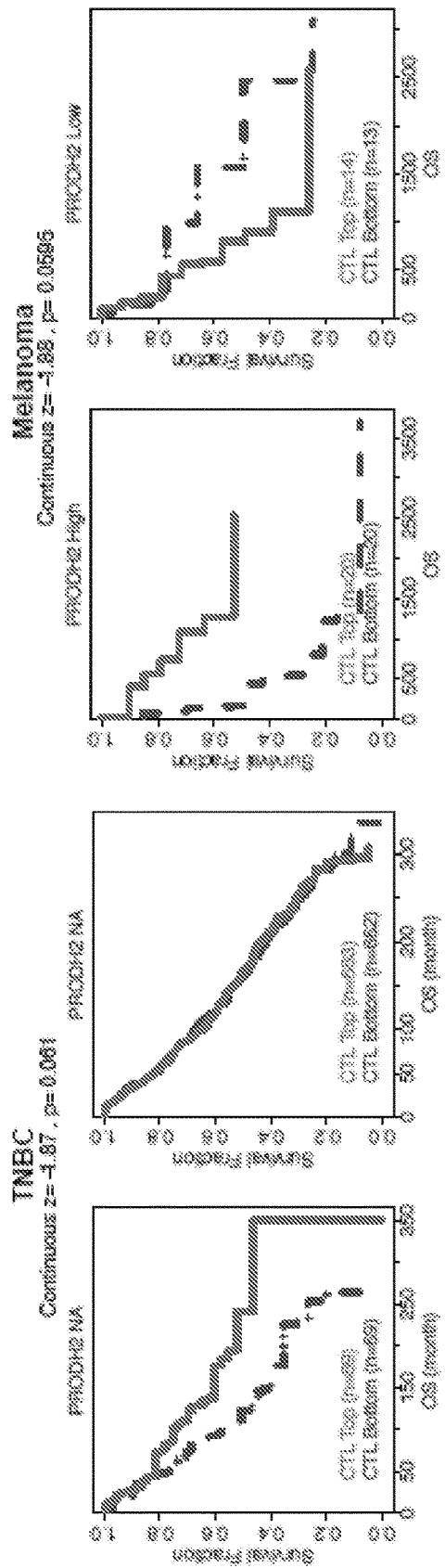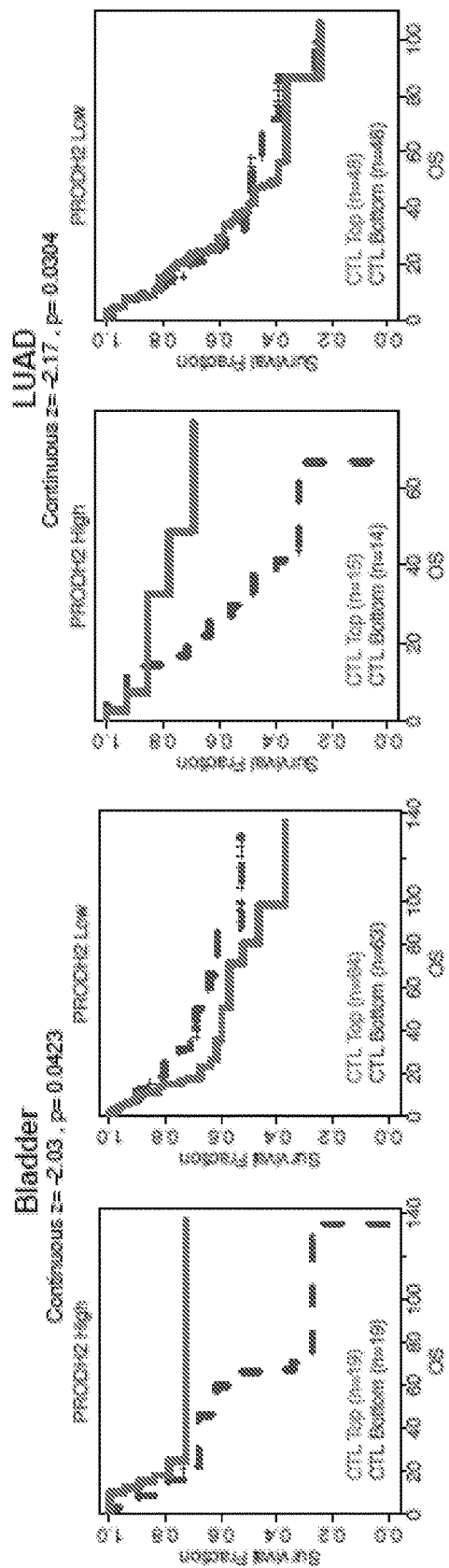
FIG. 16A
FIG. 16B
FIG. 16C
FIG. 16D

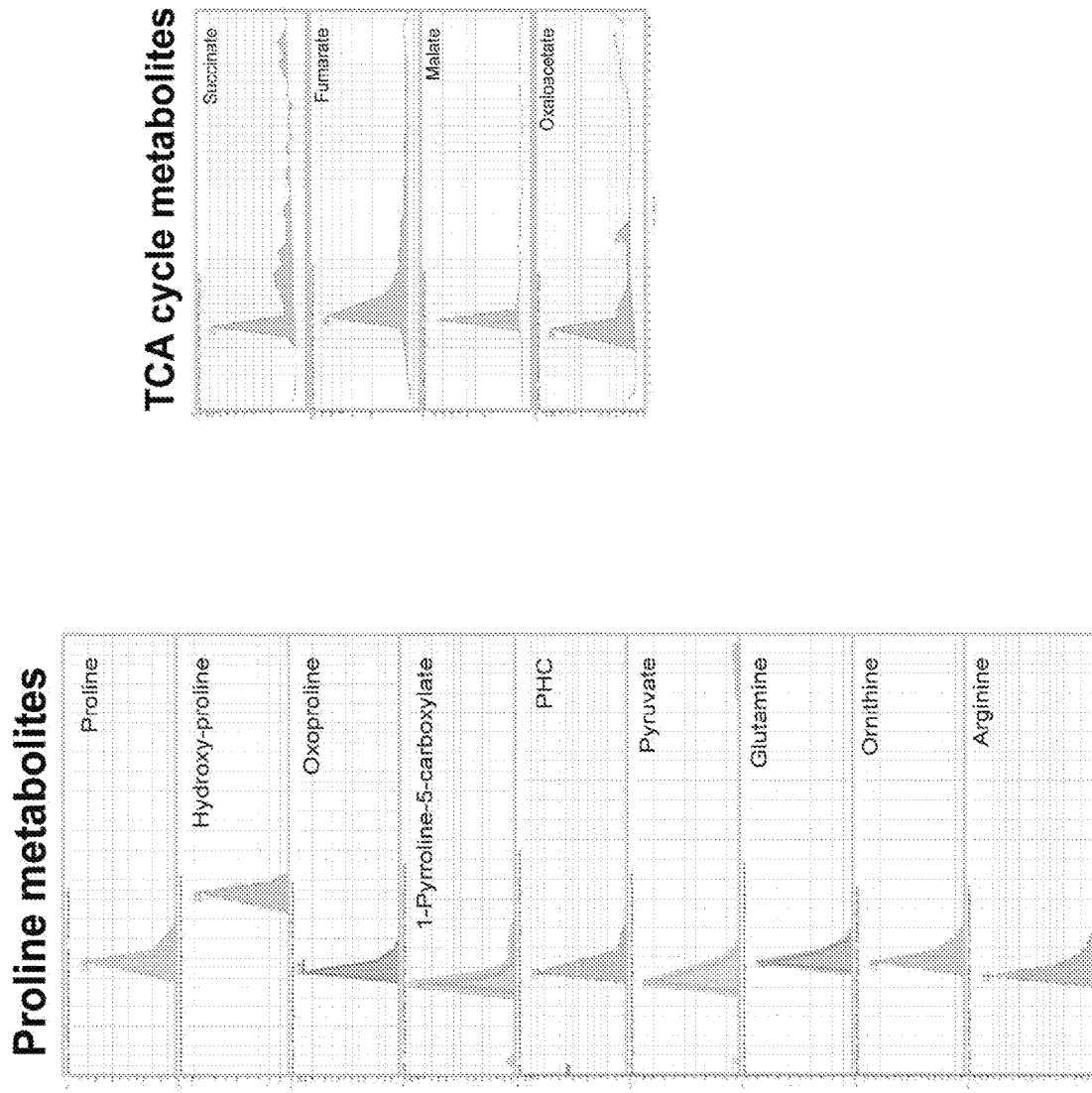
FIG. 17, Continued

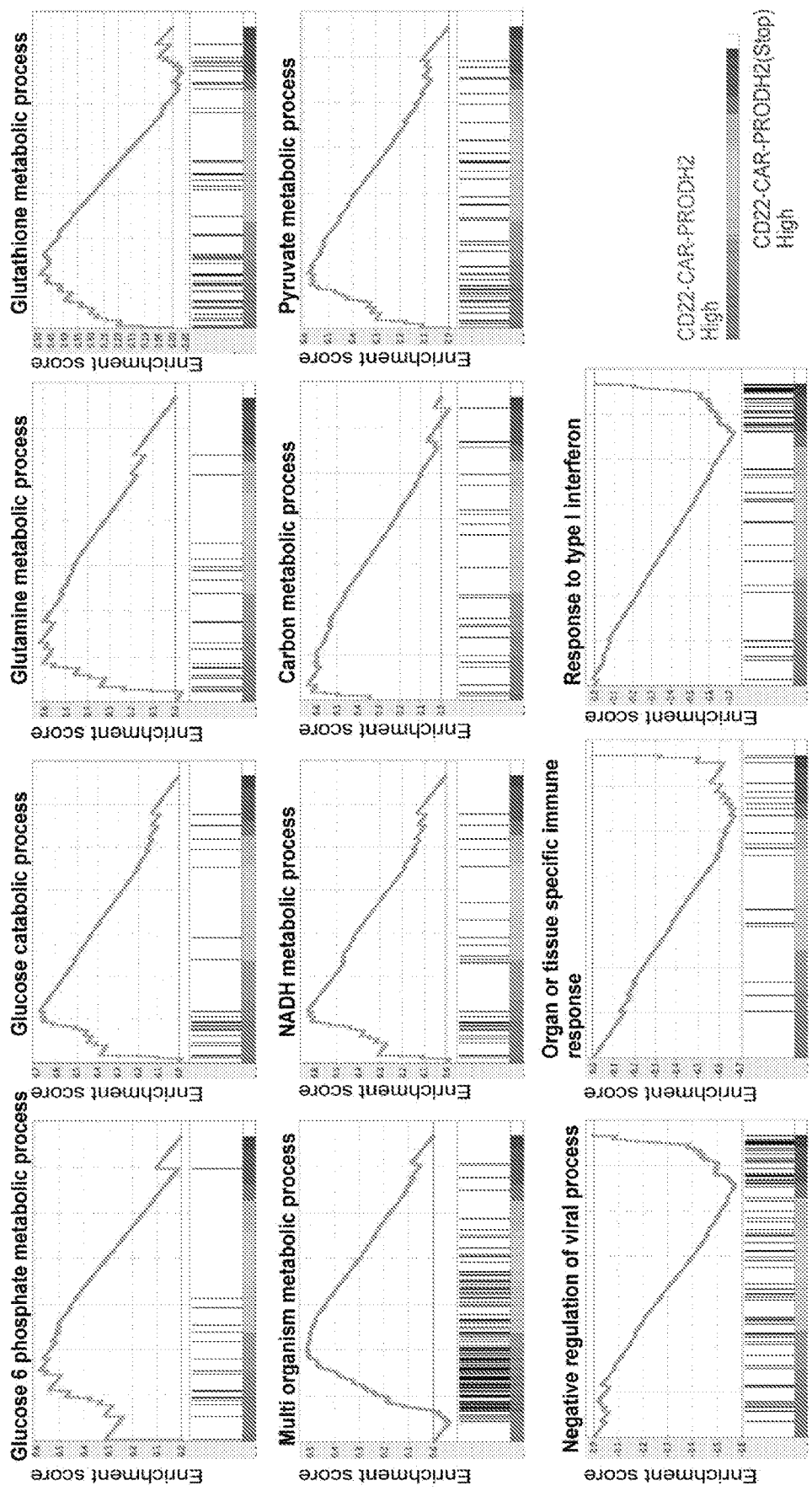
FIG. 19, Continued

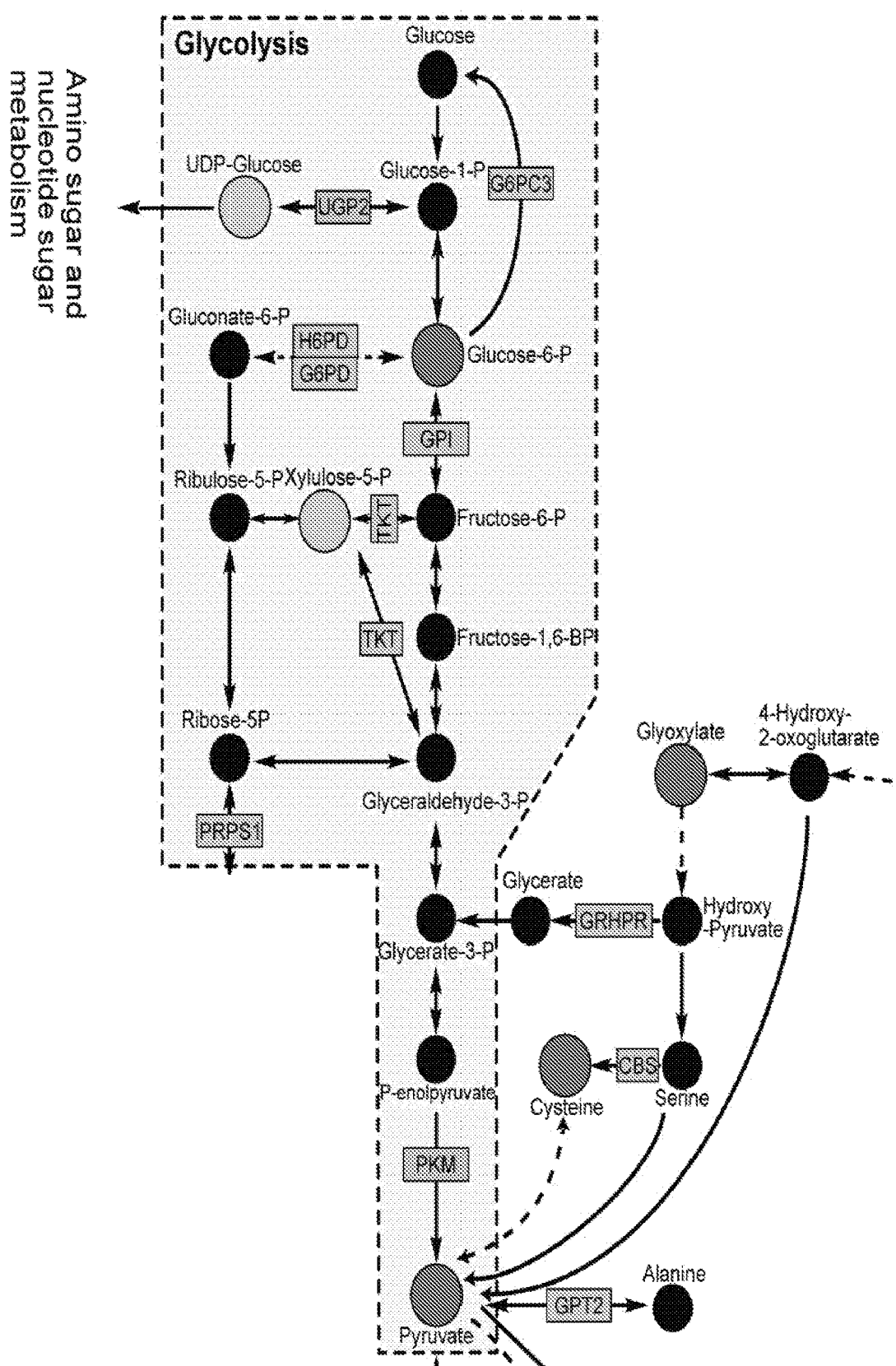
FIG. 21, Continued

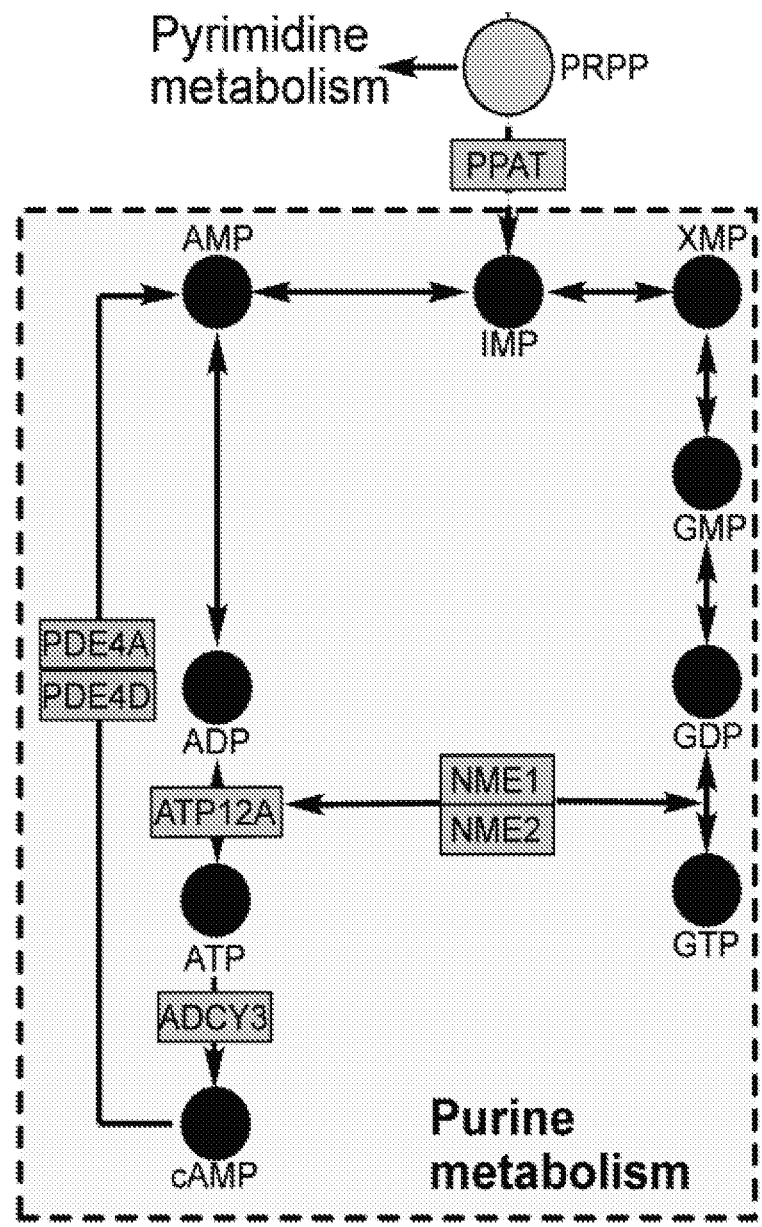
FIG. 21, Continued

COMPOSITIONS AND METHODS FOR HIGH-THROUGHPUT ACTIVATION SCREENING TO BOOST T CELL EFFECTOR FUNCTION

CROSS-REFERENCE TO RELATED APPLICATIONS

The present application is a 35 U.S.C. § 371 national phase application from, and claiming priority to, International Application No. PCT/US2019/046691, filed Aug. 15, 2019, which is entitled to priority under 35 U.S.C. § 119 (e) to U.S. Provisional Patent Application No. 62/719,205, filed Aug. 17, 2018, and U.S. Provisional Patent Application No. 62/824,514, filed Mar. 27, 2019, each of which are hereby incorporated by reference in their entireties herein.

STATEMENT REGARDING FEDERALLY SPONSORED RESEARCH OR DEVELOPMENT

This invention was made with government support under CA209992, CA231112 and CA238295 awarded by the National Institutes of Health. The government has certain rights in the invention.

BACKGROUND OF THE INVENTION $CD8^+$ T cells play a critical role in anti-tumor and anti-viral immunity because of their ability to secrete pro-inflammatory cytokines and their elaborate cytotoxic functions after detecting antigens bound to MHC class I proteins presented by antigen presenting cells (APCs). However, T cell-mediated cytotoxicity can be abolished by multiple cancer-immune mechanisms, such as reduced or lost antigen presentation, generation of an immune-suppressive tumor environment, heightened expression of immune checkpoint proteins, and T cell exhaustion. Therefore, it is important to identify genetic targets that can directly boost effector function in $CD8^+$ T cells.

To date, all genetic screens in cancer immunology are based on loss-of-function (LOF), particularly for the identification of key regulators of T cell differentiation and for modulators of cancer immunotherapy using RNA interference (RNAi) or CRISPR/Cas9 technologies. In contrast, gain-of-function (GOF) screens in cancer immunology have remained completely unexplored thus far. Thus, it is of significant clinical interest to identify specific genes that will augment the anti-tumor function of immune cells when overexpressed. However, such a screen has not been performed in T cells, perhaps due to technical challenges in genetic manipulation of primary T lymphocytes.

A need exists for compositions and methods for high-throughput activation screening to identify gain-of-function targets for enhancement of $CD8^+$ T cell activity against cancer. The present invention satisfies this need.

SUMMARY OF THE INVENTION

As described herein, the present invention relates to compositions and methods for high-throughput activation screening to boost T cell (e.g. $CD8^+$) effector function.

In one aspect, the invention includes a vector comprising a first promoter, a dgRNA expression cassette, a MS2-loop-containing chimeric backbone sequence, a second promoter, and a cassette expressing a fusion protein of Thy 1.1 and one or more transcription activators.

In some embodiments, one or more transcription activators are selected in the vector from the group consisting of MS2 bacteriophage coat protein (MCP), transcription factor p65 (P65), and heat shock factor 1 (HSF1). In further embodiments, the vector further comprises one or more additional components selected from the group consisting of an LTR seqeunce, aT2A sequence, a linker sequence, an NLS sequence, and a short PA sequence. In further embodiments the first promoter of the vector is a U6 promoter and/or the second promoter is an EFS promoter.

In some embodiments, the dgRNA expression cassette and the MS2-loop-containing chimeric backbone of the vector are driven by the U6 promoter (e.g., U6-dgRNA-MS2). In further embodiments, the cassette expressing a fusion protein of Thy 1.1 and at least one transcription activator is driven by an EFS promoter (e.g., EFS-Thy 1.1-MPH).

In some embodiments, the vector is a lentiviral vector. In further embodiments, the vector comprises SEQ ID NO: 84,602.

In one aspect, the invention includes a non-naturally occurring or engineered dgRNA library comprising a plurality of nucleic acids comprising one or more nucleotide sequences selected from the group consisting of SEQ ID NOs. 1-83,601.

In one aspect, the invention includes a non-naturally occurring or engineered dgRNA library comprising a plurality of nucleic acids comprising one or more nucleotide sequences consisting of the nucleotide sequences of SEQ ID NOs. 1-83,601.

In one aspect, the invention includes a lentiviral library comprising a plurality of vectors, wherein each vector comprises an expression cassette for a dgRNA comprising a nucleotide sequence selected from the group consisting of SEQ ID NOs. 1-83,601.

In some embodiments, one or more of the plurality of vectors of the lentiviral library comprises SEQ ID NO: 84,602.

In various embodiments of the aspects found elsewhere herein or any other aspect of the invention delineated herein, the engineered immune cell comprises the vector of any one of the preceding aspects.

In some embodiments, the cell is selected from the group consisting of a T cell, a primary cell, a $CD8^+$ cell, a $CD4^+$ cell, a T regulatory (Treg) cell, and a CAR-T cell. In further embodiments, the cell is selected from other types of T cells.

Another aspect of the invention includes a method of designing a non-naturally occurring or engineered dgRNA library comprising: identifying protein coding genes in a genome in silico, extracting 250 bp sequences upstream of the protein coding genes, identifying 18mer dgRNA spacer sequences (15mer-NGG), aligning the identified 18mers to the genome, discarding sequences with a mismatch at position 17 or 18 in in the 18mer, scoring each alignment based on the number of mismatches, disgarding sequences with a high mismatch score, and from the remaining sequences, and selecting dgRNA spacer sequences based on the shortest distance to the −200 position from the transcriptional start site.

Another aspect of the invention includes a method of generating a non-naturally occurring or engineered dgRNA library comprising: identifying protein coding genes in a genome in silico, extracting 250 bp sequences upstream of the protein coding genes, identifying 18mer dgRNA spacer sequences (15mer-NGG), aligning the identified 18mers to the genome, discarding sequences with a mismatch at position 17 or 18 in in the 18mer, scoring each alignment based on the number of mismatches, disgarding sequences with a high mismatch score, and from the remaining sequences, selecting dgRNA spacer sequences based on the shortest distance to the −200 position from the transcriptional start site, synthesizing oligonucleotides based on the selected dgRNA spacer sequences, cloning the oligonucleotides into a vector, and packaging the vector into a lentiviral library.

In some embodiments, the scoring comprises use of the formula: (# of 0 mismatch alignments*1000)+ (#of 1 mismatch alignments*50)+ (#of 2 mismatch alignments*1), wherein when the mismatch score>=2000, the sequence is discarded.

Another aspect of the invention includes a cell comprising a non-naturally occurring or engineered dgRNA library, wherein the dgRNA library is designed or generated by any one of the preceding methods.

Another aspect of the invention includes a method of identifying a genetic target that boosts T cell effector function, the method comprising: administering a composition comprising a Cas9 and a lentiviral dgRNA library to a naïve T cell, wherein the library comprises a plurality of vectors, wherein each vector comprises an expression cassette for a dgRNA, activating the T cell, incubating the activated T cell with a diseased cell or cancer cell, and measuring the T cell for degranulation, wherein when degranulation is increased relative to a control sample, the T cell is sequenced and a genetic target is identified.

In some embodiments, the T cell is selected from the group consisting of a primary cell, a CD8+ cell, a CD4+ cell, a T regulatory (Treg) cell, and a CAR-T cell.

In some embodiments, one or more dgRNAs of the library comprise a nucleotide sequence selected from the group consisting of SEQ ID NOs. 1-83,601.

In some embodiments, the dgRNA library comprises the nucleotide sequences consisting of SEQ ID NOs. 1-83,601.

Another aspect of the invention includes a method of treating a disease in a subject in need thereof, the method comprising: administering a composition comprising a Cas9 and a dgRNA lentiviral library to an immune cell from the subject, wherein the library comprises a plurality of vectors, wherein each vector comprises an expression cassette for a dgRNA, incubating the immune cell with a diseased cell from the patient, identifying one or more genes that increase degranulation in the immune cell when incubated with the diseased cell, treating the subject with an agonist to the one or more identified genes or gene products thereof.

In one aspect of the invention, the immune cell is selected from the group consisting of a T cell, a primary cell, a CD8+ cell, a CD4+ cell, a T regulatory (Treg) cell, and a CAR-T cell.

In some embodiments, the disease is cancer and the diseased cell is a cancer cell. In some embodiments, the identifying comprises sequencing the immune cell if degranulation is increased relative to a control sample.

In some embodiments, one or more dgRNAs of the library comprise a nucleotide sequence selected from the group consisting of SEQ ID NOs. 1-83,601.

In some embodiments the dgRNA library comprises the nucleotide sequences consisting of SEQ ID NOs. 1-83,601.

Another aspect of the invention includes a method of treating a disease in a subject in need thereof, the method comprising: administering a composition comprising Cas9 and a dgRNA lentiviral vector to an immune cell, wherein the vector comprises a dgRNA that targets one or more genes selected from the group consisting of Prodh2, Ccnblip1, Sreklip1, or Wdr37; and administering the immune cell to the subject.

In one aspect of the invention, the immune cell is selected from the group consisting of a T cell, a primary cell, a CD8+ cell, a CD4+ cell, a T regulatory (Treg) cell, and a CAR-T cell.

In some embodiments, the disease is cancer.

Another aspect of the invention includes a method of activating degranulation in an immune cell in a subject, the method comprising: administering a composition comprising Cas9 and a dgRNA lentiviral vector to the immune cell from the subject, wherein the vector comprises a dgRNA that targets one or more genes selected from the group consisting of Prodh2, Ccnblip1, Sreklip1, or Wdr37.

In one aspect of the invention, the immune cell is selected from the group consisting of a T cell, a primary cell, a CD8 cell, a CD4+ cell, a T regulatory (Treg) cell, and a CAR-T cell.

In some embodiments, the dgRNA comprises one or more nucleotide sequences selected from the group consisting of SEQ ID NOs. 55,168-55,171, SEQ ID NOs. 79,364-79,367, SEQ ID NOs. 55,044-55,047; SEQ ID NOs. 55,671-55,674, SEQ ID NOs. 25,546-25,549, and SEQ ID NOs. 34,631-34,634.

Another aspect of the invention includes a method of treating cancer in a subject in need thereof, the method comprising: administering to the subject a therapeutically effective amount of a pharmaceutical composition comprising an agonist of one or more genes or gene products thereof selected from the group consisting of Prodh2, Ccnblip1, Sreklip1, or Wdr37.

Another aspect of the invention includes a method of activating degranulation in a CD8+ T cell in a subject, the method comprising: administering to the subject a therapeutically effective amount of a pharmaceutical composition comprising an agonist of one or more genes or gene products thereof selected from the group consisting of Prodh2, Ccnblip1, Sreklip1, or Wdr37.

Another aspect of the invention includes an engineered immune cell, wherein one or more genes or gene products thereof selected from the group consisting of Prodh2, Ccnblip1, Sreklip1, or Wdr37 has been activated.

In one aspect, the the gene or gene product that has been activated is Prodh2.

In some embodiments, the cell is selected from the group consisting of a primary cell, a CD8+, a CD4+, a T regulatory (Treg) cell, and a CAR-T cell.

In some embodiments, the activation of the gene within the engineered immune cell occurs through use of a dgRNA library and a Cas9.

In some embodiments, one or more dgRNAs of the engineered immune cell comprise a nucleotide sequence selected from the group consisting of SEQ ID NOs. 1-83, 601.

In some embodiments, the dgRNA library comprises the nucleotide sequences consisting of SEQ ID NOs. 1-83,601.

Another aspect of the invention includes a kit comprising Cas9 and a dgRNA lentiviral library, wherein the library comprises a plurality of vectors, wherein each vector comprises an expression cassette for a dgRNA, and instructions for use thereof.

In some embodiments, one or more dgRNAs of the library comprise a nucleotide sequence selected from the group consisting of SEQ ID NOs. 1-83,601.

In some embodiments, the dgRNA library comprises the nucleotide sequences consisting of SEQ ID NOs. 1-83,601.

Another aspect of the invention includes an engineered immune cell comprising a vector encoding one or more genes or gene products thereof selected from the group consisting of Prodh2, Ccnblip1, Sreklip1, Wdr37 or a fragment thereof.

In one aspect, the gene or gene product thereof is Prodh2.

In some embodiments the vector is a lentiviral vector or an adenoviral vector.

In some embodiments, the vector further comprises a promoter.

In some embodiments, the engineered immune cell further comprises a chimeric antigen receptor (CAR).

In some embodiments, the CAR of the engineered immune cell further comprises an antigen binding domain, a transmembrane domain, and an intracellular domain.

In some embodiments, the antigen binding domain binds CD22.

In some embodiments, the immune cell further comprises a co-stimulatory domain.

Another aspect of the invention includes an engineered immune cell, wherein the cell is selected from the group consisting of a primary cell, a CD8$^+$, a CD4$^+$, a T regulatory (Treg) cell, and a CAR-T cell.

Another aspect of the invention includes a vector comprising a promoter, a CAR expression cassette and a nucleic acid sequence encoding Prodh2, Ccnblip1, Sreklip1, Wdr37 or a fragment thereof.

In some embodiments, the nucleic acid sequence of the vector encodes Prodh2.

In some embodiments, the vector further comprises a T2A sequence and/or a short PA sequence.

In some embodiments, the vector further comprises a TRAC locus homology-directed repair (HDR) 5' arm and a TRAC locus HDR 3' arm.

In another aspect, the engineered immune cell comprises the vector of any one of preceding aspects.

In another aspect, the invention includes a composition comprising the engineered immune cell of the preceding aspect.

In another aspect, the invention includes a method of treating a disease in a subject in need thereof, the method comprising: administering to the subject a therapeutically effective amount of the engineered cell the preceding aspects.

In another aspect, the invention includes a method of generating an engineered immune cell comprising introducing into the immune cell the vector of any one the preceding aspects.

In some embodiments, the method further comprises introducing into the immune cell a CRISPR system.

In some embodiments, the vector of the method is inserted in the TRAC locus by HDR repair mediated by the CRISPR system.

Another aspect of the invention includes a method of treating a disease in a subject in need thereof, the method comprising: administering to the subject a therapeutically effective amount of a composition comprising a recombinant PRODH2, CCNBlIP1, SREKlIP1, or WDR37 peptide or a fragment thereof.

In some embodiments, the disease is cancer or an immunological disorder or disease.

In some embodiments, the cancer is a leukemia.

In some embodiments, the leukemia is Acute Lymphocytic Leukemia (ALL).

Another aspect of the invention includes a method of altering primary T cell metabolism in a subject in need thereof, the method comprising: administering to the subject a therapeutically effective amount of a composition comprising a recombinant PRODH2 peptide or a fragment thereof.

Another aspect of the invention includes a method of altering a phenotype of a primary T cell in a subject in need thereof, the method comprising: administering to the subject a therapeutically effective amount of a composition comprising a recombinant PRODH2 peptide or a fragment thereof.

Another aspect of the invention includes a method of altering an anti-tumor function of a primary T cell in a subject in need thereof, the method comprising: administering to the subject a therapeutically effective amount of a composition comprising a recombinant PRODH2 peptide or a fragment thereof.

Another aspect of the invention includes a method of altering CAR-T cell metabolism in a subject, the method comprising: administering a therapeutically effective amount of a recombinant PRODH2 peptide or a fragment thereof to a subject having received CAR-T therapy.

Another aspect of the invention includes a method of altering a phenotype of a CAR-T cell in a subject, the method comprising: administering a therapeutically effective amount of a recombinant PRODH2 peptide or a fragment thereof to a subject having received CAR-T therapy.

Another aspect of the invention includes a method of altering CAR-T cell anti-tumor function in a subject, the method comprising: administering a therapeutically effective amount of a recombinant PRODH2 peptide or a fragment thereof to a subject having received CAR-T therapy.

BRIEF DESCRIPTION OF THE DRAWINGS

The following detailed description of specific embodiments of the invention will be better understood when read in conjunction with the appended drawings. For the purpose of illustrating the invention, there are shown in the drawings exemplary embodiments. It should be understood, however, that the invention is not limited to the precise arrangements and instrumentalities of the embodiments shown in the drawings.

FIG. 1A illustrates a dead-guide RNA (dgRNA) activation lentiviral vector (TdgA), which contains a human U6 promoter, a dgRNA scaffold, and Thy1.1-MPH (MCP-p65-HSF1) expression cassette driven by an EFS promoter. FIG. 1B illustrates a mouse genome-scale dead-guide RNA library (mm10dgLib), which was designed by identifying all 15-bp spacers in the protein coding gene promoters and ranking based on off-target scores. Top 4 dgRNAs were chosen for each transcript, except the ones without enough scoring dgRNAs that passed the same criteria. The library was pool-synthesized and cloned into TdgA vector for CD8$^+$ T cell activation screening. FIG. 1C shows mm10dgLib composition analysis. Most coding transcripts (19,440/26,205) have 4 dgRNAs. Small portions of coding transcripts only have ≤3 dgRNAs that passed the same criteria (3,814, 1,010, 992 and 949 transcripts have 0, 1, 2, 3 dgRNAs, respectively). FIG. 1D shows mm10dgLib plasmid library representation analysis. 82,197/83,601 (98.3%) of gene-targeting spacers (GTSs) and 988/1,000 (98.8%) of NTCs were successfully cloned. Both GTSs and NTCs in the mm10dgLib showed a log-normal distribution.

FIG. 2A is a schematic illustrating genome-scale dgRNA library based CD8+ T cell kill assay activation screen (dgTKS) to identify essential genes for the effector function of CD8+ T cells. The main procedure includes naïve CD8+ T cell isolation, mm10dgLib transduction, kill assay (CD8+ T cell degranulation), CD8+; CD107a+ T cell sorting, genomic DNA preparation, dgRNA library readout, and dgRNAs enrichment. FIG. 2B shows representative flow cytometry results of kill assays. FACS gating plot showing the fraction of CD107a+ cells among all CD8+ cells in vector and mm10dgLib transduced CD8+ T cells co-culture with E0771 cancer cells pulsed with ovalbumin 257-264 (SIIN-FEKL) peptide (SEQ ID NO. 84,614). (Vector vs mm10dgLib, p=0.000866). Two-tailed, unpaired t test was used to assess the significance. FIG. 2C is a scatterplot of relative dgRNA abundance in the entire mm10dgLib library, with CD107a+-high FACS sorted CD8+ T cells, as compared to unsorted T cells. Blue dots are NTCs; brown dots are scoring GTSs that passed FDR 0.1% cutoff, with gene name labeled; orange dots are scoring GTSs that passed FDR 0.2% cutoff but did not pass FDR 0.1%; grey dots are remaining GTSs. Black dashed regression line of 1,000 NTCs represents a neutral baseline. GTSs deviating from the baseline showed enrichment in the CD107a+-high FACS as compared to the behavior of NTCs. FIG. 2D is a dotted waterfall plot of mm 10dgLib library differentials between the CD107a+-high FACS sorted CD8+ T cells and the unsorted T cells (delta). Blue dots are NTCs; yellow dots are scoring GTSs that passed FDR 1% cutoff; grey dots are remaining GTSs. Note that only 9/1,000 NTCs have a positive delta value. Representative top scoring genes were shown, such as Prodh2, Ccnblip1, Srekplip1 and Wdr37. Significance note, * p<0.05,  p<0.01, * p<0.001.

FIG. 3A is a schematic of the validation strategy for top candidates for dgTKS. FIG. 3B shows representative results of RT-qPCR for overexpression of Prodh2 (Vector vs Prodh2 OE (48 h), p=0.0003; Vector vs Prodh2 OE (72 h), p=0.0010), Ccnblip1 (Vector vs Ccnblip1 OE (48 h), p=0.0026; Vector vs Ccnblip1 OE (72 h), p=0.0059) and Wdr37 (Vector vs Wdr37 OE (48 h), p=0.0004; Vector vs Wdr37 OE (72 h), p=0.0005) both at 48 h and 72 h. Paired t test was used to assess the significance. FIG. 3C shows representative flow cytometry results of kill assay for validation. The fraction of CD107a+ cells (CD107a+%) among all CD8+ T cells were significantly increased with overexpression of Prodh2, Ccnblip1, Srekplip1 or Wdr37. FIG. 3D shows quantitative analysis of flow cytometry results from FIG. 3C, Vector vs Prodh2 OE (+pep), p=0.0049; Vector vs Ccnblip1 OE (+pep), p=0.0004; Vector vs Sreklip1 OE (+pep), p=0.0101; Vector vs Wdr37 OE (+pep), p=0.0015. Statistical comparisons were made using the Holm-Sidak method. Significance note, * p<0.05,  p<0.01, * p<0.001.

FIG. 4A is a schematic representation of a single gene activation experiment using Hba dgRNAs. FIGS. 4B-4C show RT-qPCR results of CRISPR/dgRNA activations in IM. Cas9 (Vector vs Hba-dg1, p=0.0011; Vector vs Hba-dg2, p=0.0033; Vector vs Hba-dg3, p=0.0056) and Cas9β CD8+ T cells (Vector vs Hba-dg2, p=0.0299; Vector vs Hba-dg3, p=0.0020; Vector vs Hba-dg2+dg3, p=0.0071). Paired t test was used to assess the significance. FIG. 4D shows representative flow cytometry results of the mm10dgLib lentivirus titration by detecting Thy 1.1 expression at day 3 after lentivirus transduction. The results showed that the mm10dgLib lentivirus was successfully produced with high titer. FIG. 4E shows quantitative analysis of flow cytometry results from FIG. 4D. Each group had three independent replicates. Significance note, * p<0.05,  p<0.01, * p<0.001.

FIG. 5A shows RT-qPCR for mRNA levels of candidate genes. The results showed that all candidates' mRNA levels were lower than house-keeping gene Gapdh, and most of them had low expression or were not expressed at all in primary CD8+ T cells. FIG. 5B shows CRISPR/dgRNA activation of representative candidates in mouse CD8+ T cells. Vector vs dgSreklip1, p=0.0298; Vector vs dgWdr37, p=0.0186; Vector vs dgSdhaf2, p=0.0396. Paired t test was used to assess the significance. * p<0.05. FIG. 5C shows representative flow cytometry gating for kill assay. FIG. 5D shows representative flow cytometry results of kill assay for validation using 10 ng/μL SIINFEKL (SEQ ID NO. 84,614) peptide. The CD107a+ CD8+ T cells were significantly increased after overexpression of Prodh2, Ccnblip1, Srekplip1 or Wdr37. FIG. 5E shows quantitative analysis of flow cytometry results from FIG. 5D, Vector vs Prodh2 OE (+pep), p=0.0062; Vector vs Ccnblip1 OE (+pep), p=0.0618; Vector vs Sreklip1 OE (+pep), p=0.0028; Vector vs Wdr37 OE (+pep), p=0.0135. Multiple comparisons using the Holm-Sidak method. Significance note, * p<0.05,  p<0.01, * p<0.001.

FIG. 6A is a schematic representation of a T cell dead-guide RNA (dgRNA) activation lentiviral vector (TdgA), which contains a human U6 promoter, a dgRNA scaffold, and Thy1.1-MPH (MCP-p65-HSF1) expression cassette driven by an EFS promoter. FIG. 6B shows schematics of experiment: mouse genome-scale dead-guide RNA library (mm10dgLib) design, including 15nt proximal promoter spacer identification, on-target and off-target mapping, scoring, filtering, and prioritization of final spacers (details in Methods). FIG. 6C shows schematics of genome-scale dgRNA library based mouse primary CD8+ T cell kill assay activation screen (dgTKS) to identify genes that boost effector functions of CD8+ T cells. The main procedure includes naïve CD8+ T cell isolation, mm10dgLib transduction, kill assay (CD8+ T cell degranulation, as measured by CD107a level in CD8 T cells in a T cell: cancer cell co-culture), CD8+;CD107a+ T cell sorting, genomic DNA preparation, dgRNA library readout, and dgRNAs enrichment. FIG. 6D shows representative flow cytometry results of kill assay in the dgTKS experiment. FACS gating plot showing the fraction of CD107a+ cells among all CD8+ cells in vector and mm10dgLib transduced CD8+ T cells co-culture with E0771 cancer cells pulsed with SIINFEKL (SEQ ID NO. 84,614) peptide. (n=3 biological replicates). FIG. 6E shows quantification of CD107a in the mm10dgLib screen (n=3 biological replicates). FIG. 6F shows A dotted waterfall plot of mm 10dgLib library differentials between the CD107a+-high FACS sorted CD8+ T cells and the unsorted T cells (delta). Blue dots are NTCs; yellow dots are scoring GTSs that passed FDR 1% cutoff; grey dots are remaining GTSs. Representative top scoring genes were shown, such as Prodh2, Ccnblip1, Srekplip1 and Wdr37. Additional high-rank genes were shown in FIG. 13. FIG. 6G shows RT-qPCR for mRNA level of high-ranked hit genes from dgTKS primary screen (n=2-3 biological replicates, variable between genes, see figure for datapoints). Higher CT values indicate the candidates' mRNA levels as lower than house-keeping gene Gapdh in primary murine CD8+ T cells. FIG. 6H shows time-course qPCR detection of Prodh2 mRNA level in Prodh2-OE mouse CD8 T cells (n=3 biological replicates). FIG. 6I shows quantitative analysis of flow cytometry for kill assay for individual genes overexpressed by lentiviral vectors, where representative FACS plots were shown in FIG. 14D. FIG. 6J shows mouse T cell number quantification at day 4 after IL-2 withdrawal. FIG. 6K shows quantification of mouse T cell apoptosis in an IL-2 withdrawal assay. Cleaved caspase 3 was detected by flow cytometry at day 1 and day 4 after IL-2 withdrawal. In this figure, two-tailed, unpaired t test was used to assess statistical significance for all two-group comparisons, unless otherwise noted. Multiple comparisons were performed using the Holm-Sidak method where applicable. Significance notes for all panels in this figure:  $p<0.01$,  $p<0.001$, **** $p<0.0001$.

FIG. 7A shows a volcano plot of all differentially expressed genes between Vector control and Prodh2-OE mouse primary CD8 T cells (n=3 biological replicates). FIG. 7B shows a color-coded volcano plot of representative top enriched pathways between Vector control and Prodh2-OE CD8 T cells, highlighting upregulated pathways such as cell cycle, DNA replication, and glycolytic process; and downregulated pathways such as negative regulation of cell death, apoptotic process, and immune system process. Upregulated and downregulated pathways were annotated from Database of Annotation, Visualization and Integrated Discovery (DAVID) analysis of the biological processes of upregulated and downregulated genes, respectively. FIG. 7C shows a barplot of DAVID analysis of most significantly enriched biological processes in upregulated genes. FIG. 7D shows a barplot of DAVID analysis of most significantly enriched biological processes in downregulated genes. FIG. 7E shows Gene Set Enrichement Analysis (GSEA) plots of individual pathways from the representative upregulated and downregulated gene sets between Vector control and Prodh2-OE groups. FIG. 7F shows qPCR validation of the representative highly significantly differentially expressed (DE) individual genes. (n=3 biological replicates). Two-tailed, unpaired t test was used to assess statistical significance for all two-group comparisons. Significance note, * $p<0.05$, ** $p<0.01$.

FIGS. 8A-8D illustrate that mass-spec analysis revealed metabolites altered by PRODH2-OE in human primary CD8 T cells. FIG. 8A shows schematics of human CD8 T cell lentivirus transduction, metabolites extraction, LC/MS analysis, and data analysis. FIG. 8B shows the transcriptional level of human PRODH2 in primary CD8 T cells after PRODH2-OE lentivirus transduction (n=3 biological replicates). FIG. 8C shows human T cell number quantification after PRODH2-OE lentivirus transduction (n=5 biological replicates). FIG. 8D shows quantification of significantly changed metabolites after PRODH2-OE (n=5 biological replicates). In this figure, two-tailed, unpaired t test was used to assess statistical significance for all two-group comparisons, unless otherwise noted. Significance notes for all panels in this figure: * $p<0.05$,  $p<0.01$, * $p<0.001$.

FIG. 9A shows schematics of human CD22-CAR-PRODH2 and CD22-CAR-PRODH2 (Stop) CD8 T cell generation. In the CD22-CAR-PRODH2 (Stop) construct, three artificial pre-mature stop codons were inserted between 318-319 bp position of the PRODH2 CDS to generate a truncated mutant version. Knockin (KI) constructs consist of TRAC locus homology-directed repair (HDR) 5' and 3' arms, an EFS promoter, a CD22-CAR expression cassette, a T2A sequence, a PRODH2 CDS or a PRODH2 (Stop) CDS, and a short polyA. AAV6-packaged KI constructs were introduced into T cells by viral transduction after TRAC first-exon targeting Cas9: crRNA RNP electroporation. FIG. 9B shows a PRODH2 immunoblot of untransduced, CD22-CAR-PRODH2 KI, and CD22-CAR-PRODH2 (Stop) KI T cells. FIG. 9C shows a representative flow cytometry plots of CD22-CAR-PRODH2 and CD22-CAR-PRODH2 (Stop) KI human primary CD8 T cells from two independent donors. FIG. 9D shows a kill assay of CD22-CAR-PRODH2 and CD22-CAR-PRODH2 (Stop) KI T cells with NAML6-GL (NAML6 with GFP and Luciferase reporters) cancer cells, with a titration series of Effector: Target (E:T) ratios, and at two timepoints (24 h and 48$h$). Individual replicate datapoints were shown (Donor 1:n=4 biological replicates; Donor 2: n=6 biological replicates) ($p<0.0001$ for all two group comparisons). 2-way ANOVA. Significance note, **** $p<0.0001$.

FIGS. 10A-10F illustrate whole transcriptome profiling of PRODH2 knockin CD22 CAR-T cells. FIG. 10A shows schematics of CAR-T multi-omics experiments: T cell electroporation, PRODH2/PRODH2 (Stop) CD22 CAR-T KI construct AAV transduction, metabolites preparation, metabolomics data collection, mRNA-seq library preparations, mRNA-seq, and data analyses. FIG. 10B shows volcano plots of mRNA-seq differential expression between PRODH2 vs. PRODH2 (Stop) CD22-CAR-T cells from 2 different human donors (n=3 biological replicates) (FDR adj. q<0.05). FIG. 10C shows a Venn diagram of PRODH2-vs-PRODH2 (Stop) upregulated genes among human donor 1/donor 2 CAR-T cells, and Prodh2-OE-vs-Vector upregulated genes in mouse CD8 T cells. P values for statistical significance of gene set overlap was calculated by hypergeometric test and indicated. FIG. 10D shows a bubble plot of GO pathways enriched in upregulated genes (upregulated pathways) in both donor 1 and donor 2. Color scale, average fold enrichment score; bubble size scale, average percentage of DE genes found in the pathway. Figure labels: A. Cellular component biogenesis. B. Macromolecular complex subunit organization. C. Protein complex assembly. D. Protein complex biogenesis. E. Ribonucleoprotein complex biogenesis. F. Mitochondrion Organization. G. Cellular component assembly. H. Biosynthetic process. I. Cellular macromolecule metabolic process. J. Nuclear mRNA splicing via spliceosome. K. RNA splicing via transesterification reactions. L. RNA splicing via transesterification reactions with bulged adenosine as nucleophile. M. Cellular macromolecular complex subunit organization. N. Interspecies interaction between organisms. O. Macromolecular complex assembly. FIG. 10E shows a Venn diagram of PRODH2-vs-PRODH2 (Stop) downregulated genes among human donor 1/donor 2 CAR-T cells, and Prodh2-OE-vs-Vector upregulated genes in mouse CD8 T cells. P values for statistical significance of gene set overlap was calculated by hypergeometric test and indicated. FIG. 10F shows a bubble plot of GO pathways enriched in downregulated genes (downregulated pathways) in both donor 1 and donor 2. Color scale, average fold enrichment score; bubble size scale, average percentage of DE genes found in the pathway.

FIG. 11A shows a heatmap of the relative abundance of top 40 QTOF/QQQ detected metabolites of PRODH2 vs. PRODH2 (Stop) CD22-CAR-T cells (n=5 biological replicates). FIG.

11B shows a volcano plot of differentially represented (DR) metabolites between PRODH2 vs. PRODH2 (Stop) CD22-CAR-T cells. Blue dots indicate decreased metabolites, pink dots indicate increased metabolites. FIG. 11C shows a summary illustration highlighting representative enzymes encoded by DE genes, as well as DR metabolites on a simplified metabolic map adapted from KEGG metabolic pathways. As in legend, blue circles indicate decreased metabolites; pink circles indicate increased metabolites; green squares indicate enzymes of downregulated genes; orange squares indicate enzymes of upregulated genes. Solid arrows indicate direct biochemical reactions; dashed arrows indicate indirect or multi-step biochemical reactions; bi-directional arrows indicate reversible reactions. All arrows were drawn according to the known reactions in KEGG. Only reactions related to DE genes or DR metabolites were shown. A more detailed version is shown in FIG. 21. FIG. 11D shows scatter plots of multi-omics analysis of RNA-seq upregulated genes vs. DR metabolomics metabolites (both increased and decreased) between PRODH2 vs. PRODH2 (Stop) CD22-CAR-T cells. Each dot represents a metabolic pathway, with those enriched in multi-omics analysis text-labeled. The upregulated genes and the DR metabolites associated with each significant pathway were labeled inside a box scaled to the number of metabolic hits. FIG. 11E shows scatter plots of multi-omics analysis of RNA-seq downregulated genes vs. DR metabolomics metabolites (both increased and decreased) between PRODH2 vs. PRODH2 (Stop) CD22-CAR-T cells. Each dot represents a metabolic pathway, with those enriched in multi-omics analysis text-labeled. The downregulated genes and the DR metabolites associated with each significant pathway were labeled inside a box scaled to the number of metabolic hits.

FIGS. 12A-12H illustrate setup experiments for TdgA vector and mm 10dgLib library screening. FIG. 12A shows a schematic representation of single gene activation experiment using Hba dgRNAs. FIG. 12B shows RT-qPCR results of dgRNA based CRISPR activation of Hba gene in IM.Cas9 cells. (n=3 biological replicates). FIG. 12C shows RT-qPCR results of dgRNA based CRISPR activation of Hba gene in Cas9β CD8$^+$ T cells. (n=3 biological replicates). FIG. 12D shows schematics of detailed mm 10dgLib design process, library cloning, and lentivirus production following FIG. 6B. FIG. 12E shows mm10dgLib designed composition. Most coding transcripts (19,440/26,205) have 4 dgRNAs. Small portions of coding transcripts only have ≤3 dgRNAs that pass the same criteria (3,814, 1,010, 992 and 949 transcripts have 0, 1, 2, 3 dgRNAs, respectively. FIG. 12F shows mm 10dgLib plasmid library representation analysis by Illumina sequencing of dgRNA spacers from plasmid. 82,197/83,601 (98.3%) of gene-targeting spacers (GTSs) and 988/1,000 (98.8%) of NTCs were successfully cloned. Both GTSs and NTCs in the mm10dgLib showed a log-normal distribution. FIG. 12G shows representative flow cytometry results of the mm10dgLib lentivirus titration by detecting Thy 1.1 expression at day 3 after lentivirus transduction. The results showed that the mm10dgLib lentivirus was successfully produced with high titer. FIG. 12H shows Quantitative analysis of flow cytometry results from FIG. 12G. Each group has three independent replicates. In this figure, two-tailed, unpaired t test was used to assess statistical significance for all two-group comparisons, unless otherwise noted. Significance notes for all panels in this figure:  p<0.01, * p<0.001, **** p<0.0001.

FIG. 14A shows representative results of RT-qPCR for overexpression of Prodh2 (n=3 biological replicates). FIG. 14B shows schematics of the validation strategy for of individual genes from top candidates in dgTKS. FIG. 14C shows representative flow cytometry gating for kill assay of individual genes. FIG. 14D shows representative flow cytometry results of kill assay for validation (n=3 biological replicates each group). The fraction of CD107a$^+$ cells (CD107a %) among all CD8$^+$ T cells were shown with or without SIINFEKL (SEQ ID NO. 84,614) peptide, in mouse CD8 T cells with overexpression of Prodh2, Ccnblip1, Sreklip1, or Wdr37. The quantification data was in a main figure panel. FIG. 14E shows representative flow cytometry of apoptosis analysis of mouse CD8$^+$ T cells after Prodh2-OE (n=3 biological replicates each group). Cleaved caspase 3 staining was performed at day 1 and day 4 after IL-2 depletion. The quantification data was in a main figure panel. In this figure, two-tailed, unpaired t test was used to assess statistical significance for all two-group comparisons. Significance notes for all panels in this figure: **** p<0.0001.

FIGS. 15A-15D illustrate Prodh2 in vivo validation using melanoma and TNBC cancer models. TIDE analyses of PRODH2 expression signatures linked to in cytotoxic T lymphocyte (CTL)—associated survival benefits in patients, where high-level of PRODH2 improves the overall survival benefit of CTL-high patients with TNBC (FIG. 15A), melanoma (FIG. 15B), bladder cancer (FIG. 15C) or LUAD (FIG. 15D).

FIG. 16A-16D illustrates TIDE analysis of human patient data of PRODH2 expression signatures linked to in cyto-toxic T lymphocyte (CTL)—associated survival benefits in patients, where high-level of PRODH2 improves the overall survival benefit of CTL-high patients with TNBC (FIG. 16A), melanoma (FIG. 16B), bladder cancer (FIG. 16C) or LUAD (FIG. 16D).

FIGS. 18A-18B show color-coded volcano plots of representative top enriched pathways between CD22-CAR-PRODH2 (Stop) and CD22-CAR-PRODH2 cells (FIG. 18A, donor 1; FIG. 18B, donor 2). Upregulated and downregulated pathways were annotated from DAVID analysis of the biological processes of upregulated and downregulated genes, respectively (n=5 biological replicates).

DETAILED DESCRIPTION

Definitions

Figure 1A:
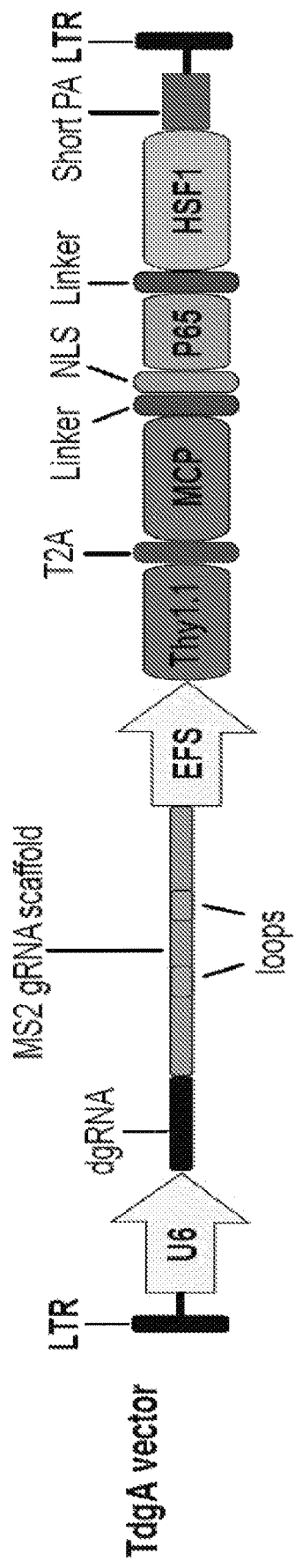
FIGS. 1A-1D illustrate the design and generation of a genome-scale dead-guide RNA activation screen system for primary T cells.

Unless defined otherwise, all technical and scientific terms used herein have the same meaning as commonly understood by one of ordinary skill in the art to which the invention pertains. Although any methods and materials similar or equivalent to those described herein can be used in the practice for testing of the present invention, the preferred materials and methods are described herein. In describing and claiming the present invention, the following terminology will be used.

It is also to be understood that the terminology used herein is for the purpose of describing particular embodiments only, and is not intended to be limiting.

The articles "a" and "an" are used herein to refer to one or to more than one (i.e., to at least one) of the grammatical object of the article. By way of example, "an element" means one element or more than one element.

"About" as used herein when referring to a measurable value such as an amount, a temporal duration, and the like, is meant to encompass variations of ±20% or ±10%, more preferably ±5%, even more preferably ±1%, and still more preferably ±0.1% from the The term "agonist" refers to a substance that acts like another substance and therefore stimulates an action. For example, an agonist can be a molecule capable of binding a specific protein and initiating the same reaction or activity typically produced by the binding endogenous substance. An agonist can be any molecule that increases transcription, increases translation, or increases the activity of the cognate molecule. For example, a Prodh2 agonist can be a small molecule that binds the Prodh2 protein and causes increased activity of the protein. Other examples of immunooncology agonists include, but are not limited to OX40, 4-1BB, GITR, CD27, IL2R, CD134, CD137, ICOS, TNFR, VISTA, TNFRSF9, IL15R, IL7R.

"Allogeneic" refers to any material derived from a different animal of the same species.

As used herein, the term "autologous" is meant to refer to any material derived from the same individual to which it is later to be re-introduced into the individual.

As used herein, the term "bp" refers to base pair.

The term "complementary" refers to the degree of antiparallel alignment between two nucleic acid strands. Complete complementarity requires that each nucleotide be across from its opposite. No complementarity requires that each nucleotide is not across from its opposite. The degree of complementarity determines the stability of the sequences to be together or anneal/hybridize. Furthermore various DNA repair functions as well as regulatory functions are based on base pair complementarity.

The term "CRISPR/Cas" or "clustered regularly interspaced short palindromic repeats" or "CRISPR" refers to DNA loci containing short repetitions of base sequences followed by short segments of spacer DNA from previous exposures to a virus or plasmid. Bacteria and archaea have evolved adaptive immune defenses termed CRISPR/CRISPR—associated (Cas) systems that use short RNA to direct degradation of foreign nucleic acids. In bacteria, the CRISPR system provides acquired immunity against invading foreign DNA via RNA-guided DNA cleavage.

The "CRISPR/Cas9" system or "CRISPR/Cas9-mediated gene editing" refers to a type II CRISPR/Cas system that has been modified for genome editing/engineering. It is typically comprised of a "guide" RNA (gRNA) and a non-specific CRISPR-associated endonuclease (Cas9). "Guide RNA (gRNA)" is used interchangeably herein with "short guide RNA (sgRNA)" or "single guide RNA (sgRNA). The sgRNA is a short synthetic RNA composed of a "scaffold" sequence necessary for Cas9-binding and a user-defined ~20 nucleotide "spacer" or "targeting" sequence which defines the genomic target to be modified. The genomic target of Cas9 can be changed by changing the targeting sequence present in the sgRNA.

"CRISPRa" system refers to a modification of the CRISPR-Cas9 system that functions to activate or increase gene expression. In certain embodiments, the CRISPRa system is comprised of dCas9, at least one transcriptional activator, and at least one sgRNA that functions to increase expression of at least one gene of interest.

"dCas9" as used herein refers to a catalytically dead Cas9 protein that lacks endonuclease activity.

"dgRNA" or "dead guide RNA" refers to a guide RNA which is catalytically inactive yet maintains target-site binding capacity.

A "disease" is a state of health of an animal wherein the animal cannot maintain homeostasis, and wherein if the disease is not ameliorated then the animal's health continues to deteriorate. In contrast, a "disorder" in an animal is a state of health in which the animal is able to maintain homeostasis, but in which the animal's state of health is less favorable than it would be in the absence of the disorder. Left untreated, a disorder does not necessarily cause a further decrease in the animal's state of health.

The term "downregulation" as used herein refers to the decrease or elimination of gene expression of one or more genes.

"Effective amount" or "therapeutically effective amount" are used interchangeably herein, and refer to an amount of a compound, formulation, material, or composition, as described herein effective to achieve a particular biological result or provides a therapeutic or prophylactic benefit. Such results may include, but are not limited to, anti-tumor activity as determined by any means suitable in the art.

The term "therapeutic" as used herein means a treatment and/or prophylaxis. A therapeutic effect is obtained by suppression, remission, or eradication of a disease state.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

As used herein "endogenous" refers to any material from or produced inside an organism, cell, tissue or system.

As used herein, the term "exogenous" refers to any material introduced from or produced outside an organism, cell, tissue or system.

The term "expression" as used herein is defined as the transcription and/or translation of a particular nucleotide sequence driven by its promoter.

"Expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., Sendai viruses, lentiviruses, retroviruses, adenoviruses, and adeno-associated viruses) that incorporate the recombinant polynucleotide.

"Homologous" as used herein, refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

"Identity" as used herein refers to the subunit sequence identity between two polymeric molecules particularly between two amino acid molecules, such as, between two polypeptide molecules. When two amino acid sequences have the same residues at the same positions; e.g., if a position in each of two polypeptide molecules is occupied by an Arginine, then they are identical at that position. The identity or extent to which two amino acid sequences have the same residues at the same positions in an alignment is often expressed as a percentage. The identity between two amino acid sequences is a direct function of the number of matching or identical positions; e.g., if half (e.g., five positions in a polymer ten amino acids in length) of the positions in two sequences are identical, the two sequences are 50% identical; if 90% of the positions (e.g., 9 of 10), are matched or identical, the two amino acids sequences are 90% identical.

As used herein, an "instructional material" includes a publication, a recording, a diagram, or any other medium of expression which can be used to communicate the usefulness of the compositions and methods of the invention. The instructional material of the kit of the invention may, for example, be affixed to a container which contains the nucleic acid, peptide, and/or composition of the invention or be shipped together with a container which contains the nucleic acid, peptide, and/or composition. Alternatively, the instructional material may be shipped separately from the container with the intention that the instructional material and the compound be used cooperatively by the recipient.

"Isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "knockdown" as used herein refers to a decrease in gene expression of one or more genes.

The term "knockout" as used herein refers to the ablation of gene expression of one or more genes.

A "lentivirus" as used herein refers to a genus of the Retroviridae family. Lentiviruses are unique among the retroviruses in being able to infect non-dividing cells; they can deliver a significant amount of genetic information into the DNA of the host cell, so they are one of the most efficient vectors for gene delivery. HIV, SIV, and FIV are all examples of lentiviruses. Vectors derived from lentiviruses offer the means to achieve significant levels of gene transfer in vivo.

By the term "modified" as used herein, is meant a changed state or structure of a molecule or cell of the invention. Molecules may be modified in many ways, including chemically, structurally, and functionally. Cells may be modified through the introduction of nucleic acids.

By the term "modulating," as used herein, is meant mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

A "mutation" as used herein is a change in a DNA sequence resulting in an alteration from a given reference sequence (which may be, for example, an earlier collected DNA sample from the same subject). The mutation can comprise deletion and/or insertion and/or duplication and/or substitution of at least one deoxyribonucleic acid base such as a purine (adenine and/or thymine) and/or a pyrimidine (guanine and/or cytosine). Mutations may or may not produce discernible changes in the observable characteristics (phenotype) of an organism (subject).

By "nucleic acid" is meant any nucleic acid, whether composed of deoxyribonucleosides or ribonucleosides, and whether composed of phosphodiester linkages or modified linkages such as phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages. The term nucleic acid also specifically includes nucleic acids composed of bases other than the five biologically occurring bases (adenine, guanine, thymine, cytosine and uracil). In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "oligonucleotide" typically refers to short polynucleotides, generally no greater than about 60 nucleotides. It will be understood that when a nucleotide sequence is represented by a DNA sequence (i.e., A, T, G, C), this also includes an RNA sequence (i.e., A, U, G, C) in which "U" replaces "T".

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

"Parenteral" administration of an immunogenic composition includes, e.g., subcutaneous (s.c.), intravenous (i.v.), intramuscular (i.m.), or intrasternal injection, or infusion techniques.

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

The term "polynucleotide" as used herein is defined as a chain of nucleotides. Furthermore, nucleic acids are polymers of nucleotides. Thus, nucleic acids and polynucleotides as used herein are interchangeable. One skilled in the art has the general knowledge that nucleic acids are polynucleotides, which can be hydrolyzed into the monomeric "nucleotides." The monomeric nucleotides can be hydrolyzed into nucleosides. As used herein polynucleotides include, but are not limited to, all nucleic acid sequences which are obtained by any means available in the art, including, without limitation, recombinant means, i.e., the cloning of nucleic acid sequences from a recombinant library or a cell genome, using ordinary cloning technology and PCR™, and the like, and by synthetic means. Conventional notation is used herein to describe polynucleotide sequences: the left-hand end of a single-stranded polynucleotide sequence is the 5'-end; the left-hand direction of a double-stranded polynucleotide sequence is referred to as the 5'-direction.

As used herein, a DNA or RNA nucleotide sequence as recited refers to a polynucleotide molecule comprising the indicated bases in a 5' to 3' direction, from left to right.

A "sample" or "biological sample" as used herein means a biological material from a subject, including but is not limited to organ, tissue, exosome, blood, plasma, saliva, urine and other body fluid. A sample can be any source of material obtained from a subject.

As used herein, the terms "sequencing" or "nucleotide sequencing" refer to determining the order of nucleotides (base sequences) in a nucleic acid sample, e.g. DNA or RNA. Many techniques are available such as Sanger sequencing and high-throughput sequencing technologies (also known as next-generation sequencing technologies) such as Illumina's HiSeq and MiSeq platforms or the GS FLX platform offered by Roche Applied Science.

The term "subject" is intended to include living organisms in which an immune response can be elicited (e.g., mammals). A "subject" or "patient," as used therein, may be a human or non-human mammal. Non-human mammals include, for example, livestock and pets, such as ovine, bovine, porcine, canine, feline and murine mammals. Preferably, the subject is human.

As used herein, a "substantially purified" cell is a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cell that have been separated from the cells with which they are naturally associated in their natural state. In some embodiments, the cells are cultured in vitro. In other embodiments, the cells are not cultured in vitro.

A "target site" or "target sequence" refers to a genomic nucleic acid sequence that defines a portion of a nucleic acid to which a binding molecule may specifically bind under conditions sufficient for binding to occur.

The term "therapeutic" as used herein means a treatment and/or prophylaxis. A therapeutic effect is obtained by suppression, remission, or eradication of a disease state.

The term "transfected" or "transformed" or "transduced" as used herein refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

To "treat" a disease as the term is used herein, means to reduce the frequency or severity of at least one sign or symptom of a disease or disorder experienced by a subject.

A "vector" is a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. The term should also be construed to include non-plasmid and non-viral compounds which facilitate transfer of nucleic acid into cells, such as, for example, polylysine compounds, liposomes, and the like. Examples of viral vectors include, but are not limited to, Sendai viral vectors, adenoviral vectors, adeno-associated virus vectors, retroviral vectors, lentiviral vectors, and the like.

As used herein, the term "T cell receptor" or "TCR" refers to a complex of membrane proteins that participate in the activation of T cells in response to the presentation of antigen. The TCR is responsible for recognizing antigens bound to major histocompatibility complex molecules. TCR is composed of a heterodimer of an alpha ($\alpha$) and beta ($\beta$) chain, although in some cells the TCR consists of gamma and delta ($\gamma/\delta$) chains. TCRs may exist in $\alpha/\beta$ and $\gamma/\delta$ forms, which are structurally similar but have distinct anatomical locations and functions. Each chain is composed of two extracellular domains, a variable and constant domain. In some embodiments, the TCR can be modified on any cell comprising a TCR, including, for example, a helper T cell, a cytotoxic T cell, a memory T cell, regulatory T cell, natural killer T cell, and/or gamma delta T cell.

The term "immune response" as used herein is defined as a cellular response to an antigen that occurs when lymphocytes identify antigenic molecules as foreign and induce the formation of antibodies and/or activate lymphocytes to remove the antigen.

"Chimeric antigen receptor" or "CAR" refers to an engineered receptor that is expressed on a T cell or any other effector cell type capable of cell-mediated cytotoxicity. The CAR comprises an extracellular domain having an antigen binding domain that is specific for a ligand or receptor. The CAR optionally also includes a transmembrane domain, and a costimulatory signaling domain. In some embodiments, the CAR comprises a hinge. In some embodiments, the antigen binding domain is specific for EGFRvIII. In some embodiments, the costimulatory signaling domain is a 4-1BB signaling domain. In some embodiments, the CAR further comprises a CD3 zeta signaling domain. A CAR-T cell is a T cell engineered to express a CAR.

"Costimulatory ligand," as the term is used herein, includes a molecule on an antigen presenting cell (e.g., an aAPC, dendritic cell, B cell, and the like) that specifically binds a cognate costimulatory molecule on a T cell, thereby providing a "second" signal which, in addition to the primary signal provided by, for instance, binding of a TCR/CD3 complex with an MHC molecule loaded with peptide, mediates a T cell response, including, but not limited to, proliferation, activation, differentiation, and the like.

A "costimulatory molecule" refers to the cognate binding partner on a T cell that specifically binds with a costimulatory ligand, thereby mediating a costimulatory response by the T cell, such as, but not limited to, proliferation. Costimulatory molecules include, but are not limited to CD28, CD27, and OX40.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

DESCRIPTION

Catalytically-dead guide RNAs (dgRNAs) can be used to mediate robust gene activation with catalytically active Cas9. Herein, this system was leveraged for high-throughput GOF screens in conjunction with primary T cells isolated from Cas9 transgenic mice. A mouse genome-wide dgRNA library (mm 10dgLib) was designed, cloned, and produced. This can serve as a versatile tool for GOF screens in any catalytically active Cas9 expressing cell, which is particularly useful for applications in primary immune cells, as they are less amenable to viral transduction and genetic manipulation. This system was utilized to screen for genes that can directly boost the effector function of CD8$^+$ T cells when overexpressed. Several genes that have not been previously documented in CD8$^+$ T cell function were identified and subsequently validated, such as Prodh2, Ccnblip1, Sreklip1, and Wdr37. Overexpression of these genes in CD8$^+$ T cells significantly enhanced their activity to release cytotoxic granules. This study opens an entirely new avenue for cancer immunotherapy target discovery.

Mounting an effective T cell response against cancer is critical for cancer immunotherapy. This invention achieved (1) conception, design, and generation of a dead-guide RNA-based CRISPR activation screening system using catalytically active Cas9; (2) completion of a gain-of-function screen that identified target genes that promote CD8$^+$ T cell effector function; (3) demonstration that overexpression of novel candidates including Prodh2, Wdr37, Sreklip1 and Ccnblip1 significantly augmented the degranulation ability of CD8$^+$ T effector cells against cancer cells. The composition of genome-wide catalytically dead guide RNA library and methods for its use in conjunction with catalytically active Cas9-expressing CD8$^+$ effector cells represent a new avenue for the direct discovery of immune regulators in primary T cells to enhance immunotherapy. The newly identified targets can also be targeted by agonists for use as immunotherapy agents.

Also provided are engineered primary or chimeric antigen receptor (CAR) T cells that overexpress Proline Dehydrogenase 2 (PRODH2/Prodh2), Ccnblip1, Sreklip1, or Wdr37, or a fragment thereof. In some embodiments, the CAR T cells overexpress Prodh2 or a fragment thereof. Augmentation of Prodh2 expression enhanced anti-tumor activity and altered transcriptional programs in CD8$^+$ T cells, as well as the metabolism of the cells. Furthermore, PRODH2 genomic knockin boosts CAR-T cell effector function.

Compositions

In certain embodiments, the invention includes use of "dead guide RNAs" (dgRNAs). Recently, these 14-nt or 15-nt guide RNAs have been shown to be catalytically inactive yet maintain target-site binding capacity (Kiani et al. (2015) *Nat Methods* 12, 1051-1054; Dahlman et al. (2015) *Nat Biotechnol* 33 (11): 1159-1161). Thus, these catalytically dead guide RNAs (dgRNAs) can be utilized to modulate gene expression using a catalytically active Cas9. Therefore, an active Cas9 nuclease can be repurposed to simultaneously perform genome editing and regulate gene transcription using both types of gRNAs in the same cell.

In one aspect, the invention includes a dead guide RNA (dgRNA) library. In some embodiments, the dgRNA library comprises a plurality of nucleic acids comprising one or more nucleotide sequences selected from the group consisting of SEQ ID NOs. 1-83,601. In further embodiments, the library further comprises a nucleotide sequence selected from the group consisting of SEQ ID NOs. 83,602-84,601. In some embodiments, the dgRNA library comprises a plurality of nucleic acids consisting of the nucleotide sequences of SEQ ID NOs. 1-83,601. In further embodiments, the library comprises a plurality of nucleic acids consisting of the nucleotide sequences of SEQ ID NOs. 83,602-84,601. In certain embodiments, the library can be packaged into a vector. Any vector known to one of ordinary skill in the art can be used, including but not limited to lentiviral vectors, adenoviral vectors, and adeno-associated viral (AAV) vectors.

Another aspect of the invention includes an lentiviral library, e.g. a mouse genome-scale dgRNA library (mm10dgLib). In one embodiment, the lentiviral library comprises a plurality of vectors, wherein each vector comprises an expression cassette for an dgRNA comprising a nucleotide sequence selected from the group consisting of SEQ ID NOs. 1-83,601. In further embodiments, the lentiviral library comprises a plurality of vectors, wherein each vector comprises an expression cassette for an dgRNA comprising a nucleotide sequence selected from the group consisting of SEQ ID NOs. 83,602-84,601. In one embodiment, one or more of the vectors comprises SEQ ID NO: 84,602.

With regard to any of the dgRNA libraries or lentiviral libraries comprising the SEQ ID NOs. 1-83,601 or 83,602-84,601, it should be understood by one of ordinary skill in the art that the invention is construed to encompassing every individual SEQ ID NO. in the two ranges and all combinations from both ranges thereof.

In some embodiments, the dgRNA library comprises about 100 or more sequences. In some embodiments, the library comprises about 1,000 or more sequences. In some embodiments, the library comprises about 10,000 or more sequences. In further embodiments, the library comprises about 20,000 or more sequences. In yet further 20 embodiments, the library comprises about 30,000 or more sequences. In yet further embodiments, the library comprises about 40,000 or more sequences.

The invention also includes a kit comprising a lentiviral library, wherein the lentiviral library comprises a plurality of vectors, wherein each vector comprises an expression cassette for a dgRNA comprising a nucleotide sequence selected from the group consisting of SEQ ID NOs. 1-83, 601. In some embodiments, the lentiviral library in the kit comprises a plurality of vectors, wherein each vector comprises an expression cassette for a dgRNA comprising a nucleotide sequence selected from the group sonsisting of SEQ ID NOs. 1-84,601. In some embodiments, the AAV library in the kit comprises a plurality of vectors, wherein each vector comprises an expression cassette for a dgRNA comprising a nucleotide sequence selected from the group consisting of SEQ ID NOs: 1-83,601. In some embodiments, the AAV library in the kit comprises a plurality of vectors, wherein each vector comprises an expression cassette for a dgRNA comprising a nucleotide sequence selected from the group sonsisting of SEQ ID NOs. 1-84,601. The kit also includes instructional material for use thereof. Instructional material can include directions for using the kit as well as information on interpreting results generated from the kit. In one embodiment, one or more of the vectors comprises SEQ ID NO: 84,602.

Also included in the invention is a vector, e.g. a lentiviral T cell dgRNA activation (TdgA) vector. The vector comprises a first promoter, a dgRNA expression cassette, a MS2-loop-containing chimeric backbone sequence, a second promoter, and a cassette expressing a fusion protein of Thy 1.1 and one or more transcription activators. In certain embodiments, the one or more transcription activators are selected from the group consisting of MS2 bacteriophage coat protein (MCP), transcription factor p65 (P65) (aka RELA), and heat shock factor 1 (HSF1). The vector can include additional components, including but not limited ot an LTR seqeunce, aT2A sequence, a linker sequence, an NLS sequence, and a short PA sequence. In certain embodiments, the first promoter is a U6 promoter and/or the second promoter is an EFS promoter. In certain embodiments, the dgRNA expression cassette and the MS2-loop-containing chimeric backbone are driven by the U6 promoter (U6-dgRNA-MS2). In certain embodiments, the cassette expressing a fusion protein of Thy 1.1 and transcription activators (EFS-Thy1.1-MPH) is driven by an EFS promoter. In certain embodiments, the vector is a lentiviral vector. In certain embodiments, the vector comprises SEQ ID NO: 84,602.

Any promoter known to one of ordinary skill in the art can be incorporated into any of the vectors/plasmids of the present invention. Suitable promoter and enhancer elements are known to those of skill in the art. For expression in a bacterial cell, suitable promoters include, but are not limited to, lacI, lacZ, T3, T7, gpt, lambda P and trc. For expression in a eukaryotic cell, suitable promoters include, but are not limited to, light and/or heavy chain immunoglobulin gene promoter and enhancer elements; cytomegalovirus immediate early promoter; herpes simplex virus thymidine kinase promoter; early and late SV40 promoters; promoter present in long terminal repeats from a retrovirus; mouse metallothionein-I promoter; and various art-known tissue specific promoters. Suitable reversible promoters, including reversible inducible promoters are known in the art. Such reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Other examples of suitable promoters include the immediate early cytomegalovirus (CMV) promoter sequence. This promoter sequence is a strong constitutive promoter sequence capable of driving high levels of expression of any polynucleotide sequence operatively linked thereto. Other constitutive promoter sequences may also be used, including, but not limited to a simian virus 40 (SV40) early promoter, a mouse mammary tumor virus (MMTV) or human immunodeficiency virus (HIV) long terminal repeat (LTR) promoter, a MoMuLV promoter, an avian leukemia virus promoter, an Epstein-Barr virus immediate early promoter, a Rous sarcoma virus promoter, the EF-1 alpha promoter, as well as human gene promoters such as, but not limited to, an actin promoter, a myosin promoter, a hemoglobin promoter, and a creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

In one embodiment, the vector comprises a U6 promoter and/or an EFS promoter. Certain embodiments of the invention include more than one promoter per plasmid/vector. It should be known to one of ordinary skill in the art that the when a plasmid/vector comprises more than one promoter, said promoters can include two or more of the same promoter or two or more different promoters. For example, the vector may comprise a first promoter comprising a U6 promoter and a second promoter comprising an EFS promoter.

In addition, any of the vectors/plasmids of the present invention can include additional components. For example, an antibiotic resistance gene/sequence. Any antibiotic resistance gene/sequence or selection marker known to one of ordinary skill in the art can be include in the vector. For example, the vector can comprise a Zeocin sequence. In one embodiment, the vector comprises a Hygromycin sequence.

The invention should be construed to encompass any type of vector known to one of ordinary skill in the art. For example, the vector can comprise a lentivirus, but can also comprise other viral vectors including but not limited to adenovirus, adeno-associated virus, retrovirus, hybrid viral vectors, or any combinations thereof. In one emobodiment, the vector comprises a lentiviral backbone.

In another aspect, the invention includes a cell or cell line comprising any of the vectors or libraries of the present invention. Any type of cell line known to one of ordinary skill in the art can be utilized. For example, the invention can include a CD8 T cell or cell line comprising a plasmid/vector of the present invention. In certain embodiments the cell is an engineered immune cell. The engineered immune cell can be for example, a T cell, a primary cell, a CD8$^+$ cell, a CD4$^+$ cell, a T regulatory (Treg) cell, or a CAR-T cell. In some embodiments, cell types include but are not limited to HeLa cells, T cells, autologous cells, and CAR T cells. In one embodiment, the cell is a CD8$^+$ T cell. The cell can include addition components, including but not limited to components useful for gene editing. For example, Cas9 can be included in the cell. Cas9 can be administered to the cell in any form, such as a plasmid, DNA, RNA, and protein.

In another aspect, the invention includes an immune cell or cell line comprising a vector encoding Prodh2, Ccnblip1, Sreklip1, Wdr37 or a fragment thereof. In some embodiments, the vector encodes Prodh2 or a fragment thereof.

Provided is a vector comprising a promoter, a chimeric antigen receptor (CAR) expression cassette and a nucleic acid encoding Prodh2, Ccnblip1, Sreklip1, Wdr37 or a fragment thereof. In some embodiments, the vector further comprises a T2A sequence and/or a short PA sequence. In further embodiments, the vector further comprises a TRAC locus homology-directed repair (HDR) 5' arm and a TRAC locus HDR 3' arm. In some preferred embodiments, the vector encodes Prodh2 or a fragment thereof.

In another aspect, the invention includes an engineered cell comprising any of the vectors of the invention.

In further aspects, the engineered cell further comprises a CRISPR system. In yet further aspects, the vector is inserted in the TRAC locus by HDR repair mediated by the CRISPR system.

In another aspect, the invention includes a chimeric antigen receptor (CAR), or a vector encoding a CAR. In some embodiments, the CAR comprises an antigen binding domain, a transmembrane domain and an intracellular domain. In some embodiments, the antigen binding domain binds CD22. In further embodiments, the intracellular or cytoplasmic domain comprises a costimulatory signaling region and a zeta chain portion, e.g., CD3 zeta. A costimulatory molecule is a cell surface molecule other than an antigen receptor or their ligands that is required for an efficient response of lymphocytes to an antigen. In some embodiments, the costimulatory signaling region of the CAR comprises an intracellular domain of a costimulatory molecule selected from the group consisting of CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that specifically binds with CD83, and the like. The CAR may also comprises a spacer domain between the antigen binding domain and the transmembrane domain, or between the transmembrane domain and the intracellular domain. A spacer domain may comprise up to 10, 25, 50, 100 or 300 amino acids, and preferably 25-50 or 10-100 amino acids.

In some aspects of the invention, the antigen binding moiety of the CAR is fused with one or more intracellular domains selected from the group consisting of a 4-1BB (CD137) signaling domain, a CD28 signaling domain, a CD3 zeta signaling domain, and any combination thereof. In some aspects of the invention, the CAR comprises one or more domains selected from the group consisting of ICOS, ICOSL, OX40, OX40L, GITR, GITRL, Fc Receptor, G250, MP1, VZV, FMC36, Heregulin, IL-2, IL-7, IL-12, IL-15, IL-13, Ly49H, NKG2D, 7F5-b2, BBIR, and others.

Methods

Certain aspects of the invention include methods for designing and generating a dgRNA library, as well as methods for treating a disease and identifying a genetic target that boosts CD8$^+$ T cell effector function.

In one aspect, the invention includes a method of designing a dgRNA library. The method comprises identifying protein coding genes in a genome in silico, extracting 250 bp sequences upstream of the protein coding genes, and identifying 18mer dgRNA spacer sequences (15mer-NGG). The identified 18mers are aligned to the genome and sequences with a mismatch at position 17 or 18 in in the 18mer are discarded. Each alignment is scored based on the number of mismatches and sequences with a high mismatch score are discarded. From the remaining sequences, dgRNA spacer sequences are selected based on the shortest distance to the −200 position from the transcriptional start site.

Another aspect of the invention includes a method of generating a dgRNA library. The method comprises identifying protein coding genes in a genome in silico, extracting 250 bp sequences upstream of the protein coding genes, and identifying 18mer dgRNA spacer sequences (15mer-NGG). The identified 18mers are aligned to the genome and sequences with a mismatch at position 17 or 18 in in the 18mer are discarded. Each alignment is scored based on the number of mismatches and sequences with a high mismatch score are discarded. From the remaining sequences, dgRNA spacer sequences are selected based on the shortest distance to the −200 position from the transcriptional start site. Oligonucleotides are synthesized based on the selected dgRNA spacer sequences and cloned into a vector. The vector is then packaged into a lentiviral library.

In certain embodiments, the mismatch scoring comprises use of the formula: (#of 0 mismatch alignments*1000)+(#of 1 mismatch alignments*50)+(#of 2 mismatch alignments*1). When the mismatch score>=2000, the sequence is discarded.

Yet another aspect of the inveniton includes a method of identifying a genetic target that boosts CD8$^+$ T cell effector function. The method comprises administering a composition comprising a Cas9 and a lentiviral dgRNA library to a naïve CD8$^+$ T cell. The library comprises a plurality of vectors, wherein each vector comprises an expression cassette for a dgRNA. The CD8$^+$ T cell is activated then incubated with a diseased cell or a cancer cell. The CD8$^+$ T cell is measured for degranulation and when degranulation is increased relative to a control sample, the CD8$^+$ T cell is sequenced and a genetic target is identified.

Nucleotide sequencing or "sequencing", as it is commonly known in the art, can be performed by standard methods commonly known to one of ordinary skill in the art. In certain embodiments of the invention sequencing is performed via next-generation sequencing. Next-generation sequencing (NGS), also known as high-throughput sequencing, is used herein to describe a number of different modern sequencing technologies that allow sequencing of DNA and RNA much more quickly and cheaply than the previously used Sanger sequencing (Metzker, 2010, Nature Reviews Genetics 11.1:31-46). It is based on micro- and nanotechnologies to reduce the size of sample, the reagent costs, and to enable massively parallel sequencing reactions. It can be highly multiplexed which allows simultaneous sequencing and analysis of millions of samples. NGS includes first, second, third as well as subsequent Next Generations Sequencing technologies. Data generated from NGS can be analyzed via a broad range of computational tools. The wide variety of analysis can be appreciated and performed by those skilled in the art.

Still another aspect of the invention includes a method of treating a disease in a subject in need thereof. The method comprises administering a composition comprising a Cas9 and a dgRNA lentiviral library to an immune cellcell from the subject. In some embodiments, the immune cell can be for example, a T cell, a primary cell, a CD8$^+$ cell, a CD4$^+$ cell, a T regulatory (Treg) cell, or a CAR-T cell. The library comprises a plurality of vectors, wherein each vector comprises an expression cassette for a dgRNA. The immune cell is incubated with a diseased cell from the patient. One or more genes that increase degranulation in the immune cell when incubated with the diseased cell is identified. Then, the subject is treated with an agonist to the one or more identified genes or gene products thereof. In certain embodiments, identifying comprises sequencing the immune cell if degranulation is increased relative to a control sample. In certain embodiments, the disease is cancer and the diseased cell is a cancer cell.

In certain embodiments, the dgRNA library comprises one or more nucleotide sequences selected from the group consisting of SEQ ID NOs. 1-83,601. In certain embodiments, the dgRNA library comprises the nucleotide sequences consisting of SEQ ID NOs. 1-83,601.

Another aspect of the invention includes a method of treating a disease in a subject in need thereof comprising administering a composition comprising Cas9 and a dgRNA lentiviral vector to an immune cell and administering the immune cell to the subject. The vector comprises a dgRNA that targets one or more genes selected from the group consisting of Prodh2, Ccnblip1, Sreklip1, or Wdr37. The cell can be from the subject or from another source. In certain embodiments, the cell is an autologous T cell. In some embodiments, the immune cell can be for example, a T cell, a primary cell, a CD8$^+$ cell, a CD4$^+$ cell, a T regulatory (Treg) cell, or a CAR-T cell. In certain embodiments, the disease is cancer and the diseased cell is a cancer cell. In certain embodiments, the dgRNA comprises a nucleotide sequence selected from the group consisting of SEQ ID NOs. 55,168-55,171, SEQ ID NOs. 79,364-79,367, SEQ ID NOs. 55,044-55,047; SEQ ID NOs. 55,671-55,674, SEQ ID NOs. 25,546-25,549, and SEQ ID NOs. 34,631-34,634.

Yet another aspect of the invention includes a method of activating degranulation in an immune cell in a subject. The method comprises administering a composition comprising Cas9 and a dgRNA lentiviral vector to the immune cell from the subject, wherein the vector comprises a dgRNA that targets one or more genes selected from the group consisting of Prodh2, Ccnblip1, Sreklip1, or Wdr37. In certain embodiments, the dgRNA comprises a nucleotide sequence selected from the group consisting of SEQ ID NOs. 55,168-55,171, SEQ ID NOs. 79,364-79,367, SEQ ID NOs. 55,044-55,047; SEQ ID NOs. 55,671-55,674, SEQ ID NOs. 25,546-25,549, and SEQ ID NOs. 34,631-34,634.

Yet another aspect of the invention includes a method of treating a disease in a subject in need thereof comprising administering to the subject a therapeutically effective amount of a pharmaceutical composition comprising an agonists of one or more genes or gene products thereof selected from the group consisting of Prodh2, Ccnblip1, Sreklip1, or Wdr37. In certain embodiments, the disease is cancer and the diseased cell is a cancer cell.

The invention also includes a method of activating degranulation in a immune cell in a subject comprising administering to the subject a therapeutically effective amount of a pharmaceutical composition comprising an agonists of one or more genes or gene products thereof selected from the group consisting of Prodh2, Ccnblip1, Sreklip1, or Wdr37.

In various embodiments, the methods of the invention relate to immune cells. Any type of immune cell is meant to be included, for example various subtypes of CD8$^+$ T cells such as effector T cell, memory T cell, central memory T cell, effector memory T cell; and CD4$^+$ T helper cells including Th1, Th2, Th17, and Treg. In some embodiments, the immune cell is a CAR-T cell. This system can also be applied to other types of primary immune cells including, but not limited to, hematopoietic stem cell (HSC), macrophage, natural killer (NK) cell, and dendritic cell (DC).

Another aspect of the invention includes a method of treating a disease in a subject in need thereof comprising administering to the subject a therapeutically effective amount of an engineered cell of the invention. In some aspects the engineered cell comprises a vector comprising a promoter, a chimeric antigen receptor (CAR) expression cassette and a nucleic acid encoding Prodh2, Ccnblip1, Sreklip1, Wdr37 or a fragment thereof. In some embodiments, the nucleic acid encodes Prodh2 or a fragment thereof. In some embodiments, the vector further comprises a T2A sequence and/or a short PA sequence. In further embodiments, the vector further comprises a TRAC locus homology-directed repair (HDR) 5' arm and a TRAC locus HDR 3' arm. In some embodiments, the disease is cancer.

Another aspect of the invention comprises a method of generating an engineered immune cell comprising introducing into the immune cell one or more of the vectors described herein. In some aspects the method further comprise introducing into the immune cell a CRISPR system. In yet further aspects, the vector is inserted into the TRAC locus by HDR repair mediated by the CRISPR system.

Another aspect of the invention comprises a method of treating a disease in a subject in need thereof, the method comprising: administering to the subject a therapeutically effective amount of a composition comprising a Prodh2, Ccnblip1, Sreklip1, Wdr37 peptide or a fragment thereof. In some embodiments, the composition comprises Prodh2 or a fragment thereof. In some aspects, the Prodh2, Ccnblip1, Sreklip1, Wdr37 peptide or a fragment thereof is human. In some aspects, the disease is cancer.

Cancer and Other Diseases/Disorders

Certain embodiments of the invention include compositions and methods for treating a disease. Any disease that can be targeted by a $CD8^+$ T cell and/or wherein binding to the cognate antigen causes degranulation in the $CD8^+$ T cell can be treated with the compositions of the present invention. Diseases/disorder/conditions that can be treated include but are not limited to autoimmune diseases, inflammation, neuroimmune disorders, and other immune system disorders.

Immune system disorders include, but are not limited to: 22q11.2 deletion syndrome, Achondroplasia and severe combined immunodeficiency, Adenosine Deaminase 2 deficiency, Adenosine deaminase deficiency, Adult-onset immunodeficiency with anti-interferon-gamma autoantibodies, Agammaglobulinemia, non-Bruton type, Aicardi-Goutieres syndrome, Aicardi-Goutieres syndrome type 5, Allergic bronchopulmonary aspergillosis, Alopecia areata, Alopecia totalis, Alopecia universalis, Amyloidosis AA, Amyloidosis familial visceral, Ataxia telangiectasia, Autoimmune lymphoproliferative syndrome, Autoimmune lymphoproliferative syndrome due to CTLA4 haploinsuffiency, Autoimmune polyglandular syndrome type 1, Autosomal dominant hyper IgE syndrome, Autosomal recessive early-onset inflammatory bowel disease, Autosomal recessive hyper IgE syndrome, Bare lymphocyte syndrome 2, Barth syndrome, Blau syndrome, Bloom syndrome, Bronchiolitis obliterans, C1q deficiency, Candidiasis familial chronic mucocutaneous, autosomal recessive, Cartilage-hair hypoplasia, CHARGE syndrome, Chediak-Higashi syndrome, Cherubism, Chronic atypical neutrophilic dermatosis with lipodystrophy and elevated temperature, Chronic graft versus host disease, Chronic granulomatous disease, Chronic Infantile Neurological Cutaneous Articular syndrome, Chronic mucocutaneous candidiasis (CMC)—Not a rare disease, Cohen syndrome, Combined immunodeficiency with skin granulomas, Common variable immunodeficiency, Complement component 2 deficiency, Complement component 8 deficiency type 1, Complement component 8 deficiency type 2, Congenital pulmonary alveolar proteinosis, Cryoglobulinemia, Cutaneous mastocytoma, Cyclic neutropenia, Deficiency of interleukin-1 receptor antagonist, Dendritic cell, monocyte, B lymphocyte, and natural killer lymphocyte deficiency, Dyskeratosis congenital, Dyskeratosis congenita autosomal dominant, Dyskeratosis congenita autosomal recessive, Dyskeratosis congenita X-linked, Epidermodysplasia verruciformis, Familial amyloidosis, Finnish type, Familial cold autoinflammatory syndrome, Familial Mediterranean fever, Familial mixed cryoglobulinemia, Felty's syndrome, Glycogen storage disease type 1B, Griscelli syndrome type 2, Hashimoto encephalopathy, Hashimoto's syndrome-Not a rare disease, Hemophagocytic lymphohistiocytosis, Hennekam syndrome, Hepatic venoocclusive disease with immunodeficiency, Hereditary folate malabsorption, Hermansky Pudlak syndrome 2, Herpes simplex encephalitis, Hoyeraal Hreidarsson syndrome, Hyper IgE syndrome, Hyper-IgD syndrome, ICF syndrome, Idiopathic acute eosinophilic pneumonia, Idiopathic CD4 positive T-lymphocytopenia, IL12RB1 deficiency, Immune defect due to absence of thymus, Immune dysfunction with T-cell inactivation due to calcium entry defect 1, Immune dysfunction with T-cell inactivation due to calcium entry defect 2, Immunodeficiency with hyper IgM type 1, Immunodeficiency with hyper IgM type 2, Immunodeficiency with hyper IgM type 3, Immunodeficiency with hyper IgM type 4, Immunodeficiency with hyper IgM type 5, Immunodeficiency with thymoma, Immunodeficiency without anhidrotic ectodermal dysplasia, Immunodysregulation, polyendocrinopathy and enteropathy X-linked, Immunoglobulin A deficiency 2, Intestinal atresia multiple, IRAK-4 deficiency, Isolated growth hormone deficiency type 3, Kawasaki disease, Large granular lymphocyte leukemia, Leukocyte adhesion deficiency type 1, LRBA deficiency, Lupus-Not a rare disease, Lymphocytic hypophysitis, Majeed syndrome, Melkersson-Rosenthal syndrome, MHC class 1 deficiency, Muckle-Wells syndrome, Multifocal fibrosclerosis, Multiple sclerosis, MYD88 deficiency, Neonatal systemic lupus erythematosus, Netherton syndrome, Neutrophil-specific granule deficiency, Nijmegen breakage syndrome, Omenn syndrome, Osteopetrosis autosomal recessive 7, Palindromic rheumatism, Papillon Lefevre syndrome, Partial androgen insensitivity syndrome, PASLI disease, Pearson syndrome, Pediatric multiple sclerosis, Periodic fever, aphthous stomatitis, pharyngitis and adenitis, PGM3-CDG, Poikiloderma with neutropenia, Pruritic urticarial papules plaques of pregnancy, Purine nucleoside phosphorylase deficiency, Pyogenic arthritis, pyoderma gangrenosum and acne, Relapsing polychondritis, Reticular dysgenesis, Sarcoidosis, Say Barber Miller syndrome, Schimke immunoosseous dysplasia, Schnitzler syndrome, Selective IgA deficiency, Selective IgM deficiency, Severe combined immunodeficiency, Severe combined immunodeficiency due to complete RAG1/2 deficiency, Severe combined immunodeficiency with sensitivity to ionizing radiation, Severe combined immunodeficiency, atypical, Severe congenital neutropenia autosomal recessive 3, Severe congenital neutropenia X-linked, Shwachman-Diamond syndrome, Singleton-Merten syndrome, SLC35C1-CDG (CDG-IIc), Specific antibody deficiency, Spondyloenchondrodysplasia, Stevens- Johnson syndrome, T-cell immunodeficiency, congenital alopecia and nail dystrophy, TARP syndrome, Trichohepatoenteric syndrome, Tumor necrosis factor receptor-associated periodic syndrome, Twin to twin transfusion syndrome, Vici syndrome, WHIM syndrome, Wiskott Aldrich syndrome, Woods Black Norbury syndrome, X-linked agammaglobulinemia, X-linked lymphoproliferative syndrome, X-linked lymphoproliferative syndrome 1, X-linked lymphoproliferative syndrome 2, X-linked magnesium deficiency with Epstein-Barr virus infection and neoplasia, X-linked severe combined immunodeficiency, and ZAP-70 deficiency.

Autoimmune diseases (not mutually exclusive with list of immune system disorders) include but are not limited to Achalasia, Addison's disease, Adult Still's disease, Agammaglobulinemia, Alopecia areata, Amyloidosis, Ankylosing spondylitis, Anti-GBM/Anti-TBM nephritis, Antiphospholipid syndrome, Autoimmune angioedema, Autoimmune dysautonomia, Autoimmune encephalomyelitis, Autoimmune hepatitis, Autoimmune inner ear disease (AIED), Autoimmune myocarditis, Autoimmune oophoritis, Autoimmune orchitis, Autoimmune pancreatitis, Autoimmune retinopathy, Autoimmune urticaria, Axonal & neuronal neuropathy (AMAN), Baló disease, Behcet's disease, Benign mucosal pemphigoid, Bullous pemphigoid, Castleman disease (CD), Celiac disease, Chagas disease, Chronic inflammatory demyelinating polyneuropathy (CIDP), Chronic recurrent multifocal osteomyelitis (CRMO), Churg-Strauss Syndrome (CSS) or Eosinophilic Granulomatosis (EGPA), Cicatricial pemphigoid, Cogan's syndrome, Cold agglutinin disease, Congenital heart block, Coxsackie myocarditis, CREST syndrome, Crohn's disease, Dermatitis herpetiformis, Dermatomyositis, Devic's disease (neuromyelitis optica), Discoid lupus, Dressler's syndrome, Endometriosis, Eosinophilic esophagitis (EoE), Eosinophilic fasciitis, Erythema nodosum, Essential mixed cryoglobulinemia, Evans syndrome, Fibromyalgia, Fibrosing alveolitis, Giant cell arteritis (temporal arteritis), Giant cell myocarditis, Glomerulonephritis, Goodpasture's syndrome, Granulomatosis with Polyangiitis, Graves' disease, Guillain-Barre syndrome, Hashimoto's thyroiditis, Hemolytic anemia, Henoch-Schonlein purpura (HSP), Herpes gestationis or pemphigoid gestationis (PG), Hidradenitis Suppurativa (HS) (Acne Inversa), Hypogammalglobulinemia, IgA Nephropathy, IgG4-related sclerosing disease, Immune thrombocytopenia purpura (ITP), Inclusion body myositis (IBM), Interstitial cystitis (IC), Juvenile arthritis, Juvenile diabetes (Type 1 diabetes), Juvenile myositis (JM), Kawasaki disease, Lambert-Eaton syndrome, Leukocytoclastic vasculitis, Lichen planus, Lichen sclerosus, Ligneous conjunctivitis, Linear IgA disease (LAD), Lupus, Lyme disease chronic, Meniere's disease, Microscopic polyangiitis (MPA), Mixed connective tissue disease (MCTD), Mooren's ulcer, Mucha-Habermann disease, Multifocal Motor Neuropathy (MMN) or MMNCB, Multiple sclerosis, Myasthenia gravis, Myositis, Narcolepsy, Neonatal Lupus, Neuromyelitis optica, Neutropenia, Ocular cicatricial pemphigoid, Optic neuritis, Palindromic rheumatism (PR), PANDAS, Paraneoplastic cerebellar degeneration (PCD), Paroxysmal nocturnal hemoglobinuria (PNH), Parry Romberg syndrome, Pars planitis (peripheral uveitis), Parsonnage-Turner syndrome, Pemphigus, Peripheral neuropathy, Perivenous encephalomyelitis, Pernicious anemia (PA), POEMS syndrome, Polyarteritis nodosa, Polyglandular syndromes type I, II, III, Polymyalgia rheumatica, Polymyositis, Postmyocardial infarction syndrome, Postpericardiotomy syndrome, Primary biliary cirrhosis, Primary sclerosing cholangitis, Progesterone dermatitis, Psoriasis, Psoriatic arthritis, Pure red cell aplasia (PRCA), Pyoderma gangrenosum, Raynaud's phenomenon, Reactive Arthritis, Reflex sympathetic dystrophy, Relapsing polychondritis, Restless legs syndrome (RLS), Retroperitoneal fibrosis, Rheumatic fever, Rheumatoid arthritis, Sarcoidosis, Schmidt syndrome, Scleritis, Scleroderma, Sjögren's syndrome, Sperm & testicular autoimmunity, Stiff person syndrome (SPS), Subacute bacterial endocarditis (SBE), Susac's syndrome, Sympathetic ophthalmia (SO), Takayasu's arteritis, Temporal arteritis/Giant cell arteritis, Thrombocytopenia purpura (TTP), Tolosa-Hunt syndrome (THS), Transverse myelitis, Type 1 diabetes, Ulcerative colitis (UC), Undifferentiated connective tissue disease (UCTD), Uveitis, Vasculitis, Vitiligo, Vogt-Koyanagi-Harada Disease, and Wegener's granulomatosis (or Granulomatosis with Polyangiitis (GPA)).

The invention includes compositions and methods for treating cancer. Types of cancer that can be treated include, but are not limited to, Acute Lymphoblastic Leukemia (ALL), Acute Myeloid Leukemia (AML), Adrenocortical Carcinoma, AIDS-Related Cancers, Kaposi Sarcoma, AIDS-Related Lymphoma, Primary CNS Lymphoma, Anal Cancer, Appendix Cancer (Gastrointestinal Carcinoid Tumors), Astrocytomas, Atypical Teratoid/Rhabdoid Tumor, Brain Cancer, Basal Cell Carcinoma of the Skin, Bile Duct Cancer, Bladder Cancer, Bone Cancer (includes Ewing Sarcoma and Osteosarcoma and Malignant Fibrous Histiocytoma), Brain Tumors, Breast Cancer, Bronchial Tumors, Burkitt Lymphoma, Non-Hodgkin Lymphoma, Carcinoid Tumors, Carcinoma of Unknown Primary, Cardiac (Heart) Tumors, Embryonal Tumors, Germ Cell Tumor, Primary CNS Lymphoma, Cervical Cancer, Cholangiocarcinoma, Chordoma, Chronic Lymphocytic Leukemia (CLL), Chronic Myelogenous Leukemia (CML), Chronic Myeloproliferative Neoplasms, Colorectal Cancer, Craniopharyngioma, Cutaneous T-Cell Lymphoma (Mycosis Fungoides and Sézary Syndrome), Ductal Carcinoma In Situ (DCIS), Endometrial Cancer, Ependymoma, Esophageal Cancer, Esthesioneuroblastoma, Ewing Sarcoma, Extracranial Germ Cell Tumor, Eye Cancer, Intraocular Melanoma, Fallopian Tube Cancer, Fibrous Histiocytoma of Bone, Osteosarcoma, Gallbladder Cancer, Gastric Cancer, Stomach Cancer, Gastrointestinal Carcinoid Tumor, Gastrointestinal Stromal Tumors (GIST), Central Nervous System Germ Cell Tumors, Extracranial Germ Cell Tumors, Extragonadal Germ Cell Tumors, Ovarian Germ Cell Tumors, Testicular Cancer, Gestational Trophoblastic Disease, Hairy Cell Leukemia, Head and Neck Cancer, Heart Tumors, Hepatocellular (Liver) Cancer, Histiocytosis (Langerhans Cell), Hodgkin Lymphoma, Hypopharyngeal Cancer, Intraocular Melanoma, Islet Cell Tumors, Pancreatic Neuroendocrine Tumors, Kidney Cancer, Renal Cell Cancer, Langerhans Cell Histiocytosis, Laryngeal Cancer, Leukemia, Lip and Oral Cavity Cancer, Liver Cancer, Lung Cancer (Non-Small Cell and Small Cell), Lymphoma, Male Breast Cancer, Malignant Fibrous Histiocytoma of Bone and Osteosarcoma, Melanoma, Intraocular (Eye) Melanoma, Merkel Cell Carcinoma (Skin Cancer), Malignant Mesothelioma, Metastatic Cancer, Metastatic Squamous Neck Cancer with Occult Primary, Midline Tract Carcinoma With NUT Gene Changes, Mouth Cancer, Multiple Endocrine Neoplasia Syndromes, Multiple Myeloma/Plasma Cell Neoplasms, Mycosis Fungoides (Lymphoma), Myelodysplastic Syndromes, Myelodysplastic/Myeloproliferative Neoplasms, Nasal Cavity and Paranasal Sinus Cancer, Nasopharyngeal Cancer, Neuroblastoma, Non-Small Cell Lung Cancer, Oral Cancer, and Oropharyngeal Cancer, Ovarian Cancer, Pancreatic Cancer, Papillomatosis, Paraganglioma, Paranasal Sinus and Nasal Cavity Cancer, Parathyroid Cancer, Penile Cancer, Pharyngeal Cancer, Pheochromocytoma, Pituitary Tumor, Plasma Cell Neoplasm/Multiple Myeloma, Pleuropulmonary Blastoma, Primary Central Nervous System (CNS) Lymphoma, Primary Peritoneal Cancer, Prostate Cancer, Rectal Cancer Recurrent Cancer, Retinoblastoma, Rhabdomyosarcoma, Salivary Gland Cancer, Sarcoma, Vascular Tumors, Uterine Sarcoma, Sézary Syndrome (Lymphoma), Small Cell Lung Cancer, Small Intestine Cancer, Soft Tissue Sarcoma, Squamous Cell Carcinoma, Stomach (Gastric) Cancer, Throat Cancer, Thymoma, Thymic Carcinoma, Thyroid Cancer, Transitional Cell Cancer of the Renal Pelvis and Ureter, Carcinoma of Unknown Primary, Ureter and Renal Pelvis, Transitional Cell Cancer, Urethral Cancer, Uterine Cancer, Vaginal Cancer, Vulvar Cancer, Wilms Tumor, and combinations thereof.

In certain embodiments, the subject can be administered an additional treatment. For example, the subject can be administered a combination of a composition of the present invention and an additional treatment. Examples of additional treatments include but are not limited to, chemotherapy, radiation, surgery, medication, immune checkpoint inhibitors, immune checkpoint blockade (ICB) antibodies, immune checkpoint inhibitors that block CTLA-4 or PD1, anti-CTLA4 monoclonal antibody, anti-PD1 monoclonal antibody, anti-PD-L1 monoclonal antibody, adoptive cell transfer, human recombinant cytokines, cancer vaccines, immunotherapy, targeted therapy, hormone therapy, stem cell transplant, precision medicine, non-specific immunotherapy (e.g. cytokines and chemokines, such as IL-2, IFNa, IFNb, IFNg), oncolytic virus therapy, T-cell therapy (e.g. adoptive transfer of TILs, CAR-T therapy), cancer vaccines (e.g. conventional DC vaccine), Ipilimumab (Yervoy), Nivolumab (Opdivo), Pembrolizumab (Keytruda), Atezolizumab (Tecentriq), Avelumab (Bavencio), Durvalumab (Imfinzi), Anti-LAG-3, anti-TIM1, Anti-TIM3, Anti-CSF-R, IDO inhibitor, OX-40 agonist, GITR agonist, CD80 agonist, CD86 agonist, ICOS agonist, ICOSLG agonist, CD276 agonist, VTCN1 agonist, TNFSF14 agonist, TNFSF9 agonist, TNFSF4 agonist, CD70 agonist, CD40 agonist, LGALS9 agonist, CD80 inhibitor, CD86 inhibitor, ICOS inhibitor, ICOSLG inhibitor, CD276 inhibitor, VTCN1 inhibitor, TNFSF14 inhibitor, TNFSF9 inhibitor, TNFSF4 inhibitor, CD70 inhibitor, CD40 inhibitor, LGALS9 inhibitor, TLR9 agonist, CD20 antibody, CD80 antibody, TIGIT antibody, B7-H1 antibody, B7-H2 antibody, B7-H3 antibody, B7-H4 antibody, CD28 antibody, CD47 antibody, anti-BTLA, anti-Galetin9, anti-IL15R, anti-GD2. In some embodiments the monoclonal antibody is fully human, humanized or chimeric.

CRISPR/Cas9

The CRISPR/Cas9 system is a facile and efficient system for inducing targeted genetic alterations. Target recognition by the Cas9 protein requires a 'seed' sequence within the guide RNA (gRNA) and a conserved dinucleotide containing protospacer adjacent motif (PAM) sequence upstream of the gRNA-binding region. The CRISPR/Cas9 system can thereby be engineered to cleave virtually any DNA sequence by redesigning the gRNA in cell lines (such as 293T cells), primary cells, and CAR T cells. The CRISPR/Cas9 system can simultaneously target multiple genomic loci by co-expressing a single Cas9 protein with two or more gRNAs, making this system uniquely suited for multiple gene editing or synergistic activation of target genes.

The Cas9 protein and guide RNA form a complex that identifies and cleaves target sequences. Cas9 is comprised of six domains: REC I, REC II, Bridge Helix, PAM interacting, HNH, and RuvC. The RecI domain binds the guide RNA, while the Bridge helix binds to target DNA. The HNH and RuvC domains are nuclease domains. Guide RNA is engineered to have a 5' end that is complementary to the target DNA sequence. Upon binding of the guide RNA to the Cas9 protein, a conformational change occurs activating the protein. Once activated, Cas9 searches for target DNA by binding to sequences that match its protospacer adjacent motif (PAM) sequence. A PAM is a two or three nucleotide base sequence within one nucleotide downstream of the region complementary to the guide RNA. In one non-limiting example, the PAM sequence is 5'-NGG-3'. When the Cas9 protein finds its target sequence with the appropriate PAM, it melts the bases upstream of the PAM and pairs them with the complementary region on the guide RNA. Then the RuvC and HNH nuclease domains cut the target DNA after the third nucleotide base upstream of the PAM.

One non-limiting example of a CRISPR/Cas system used to inhibit gene expression, CRISPRi, is described in U.S. Patent Appl. Publ. No. US20140068797. CRISPRi induces permanent gene disruption that utilizes the RNA-guided Cas9 endonuclease to introduce DNA double stranded breaks, which trigger error-prone repair pathways to result in frame shift mutations. A catalytically dead Cas9 lacks endonuclease activity. When coexpressed with a guide RNA, a DNA recognition complex is generated that specifically interferes with transcriptional elongation, RNA polymerase binding, or transcription factor binding. This CRISPRi system efficiently represses expression of targeted genes.

CRISPR/Cas gene disruption occurs when a guide nucleotide sequence specific for a target gene and a Cas endonuclease are introduced into a cell and form a complex that enables the Cas endonuclease to introduce a double strand break at the target gene. In certain embodiments, the CRISPR/Cas system comprises an expression vector, such as, but not limited to, an pAd5F35-CRISPR vector. In other embodiments, the Cas expression vector induces expression of Cas9 endonuclease. Other endonucleases may also be used, including but not limited to, T7, Cas3, Cas8a, Cas8b, Cas10d, Cse1, Csy1, Csn2, Cas4, Cas10, Csm2, Cmr5, Fok1, other nucleases known in the art, and any combinations thereof.

In certain embodiments, inducing the Cas9 expression vector comprises exposing the cell to an agent that activates an inducible promoter in the Cas9 expression vector. In such embodiments, the Cas9 expression vector includes an inducible promoter, such as one that is inducible by exposure to an antibiotic (e.g., by tetracycline or a derivative of tetracycline, for example doxycycline). However, it should be appreciated that other inducible promoters can be used. The inducing agent can be a selective condition (e.g., exposure to an agent, for example an antibiotic) that results in induction of the inducible promoter. This results in expression of the Cas expression vector.

In certain embodiments, guide RNA(s) and Cas9 can be delivered to a cell as a ribonucleoprotein (RNP) complex. RNPs are comprised of purified Cas9 protein complexed with gRNA and are well known in the art to be efficiently delivered to multiple types of cells, including but not limited to stem cells and immune cells (Addgene, Cambridge, MA, Mirus Bio LLC, Madison, WI).

The guide RNA is specific for a genomic region of interest and targets that region for Cas endonuclease-induced double strand breaks. The target sequence of the guide RNA sequence may be within a loci of a gene or within a non-coding region of the genome. In certain embodiments, the guide nucleotide sequence is at least 10, 11, 12, 13, 14, 15, 16, 17, 18, 19, 20, 21, 22, 23, 24, 25, 26, 27, 30, 31, 32, 33, 34, 35, 36, 37, 38, 39, 40 or more nucleotides in length.

Guide RNA (gRNA), also referred to as "short guide RNA" or "sgRNA", provides both targeting specificity and scaffolding/binding ability for the Cas9 nuclease. The gRNA can be a synthetic RNA composed of a targeting sequence and scaffold sequence derived from endogenous bacterial crRNA and tracrRNA. gRNA is used to target Cas9 to a specific genomic locus in genome engineering experiments. Guide RNAs can be designed using standard tools well known in the art.

In the context of formation of a CRISPR complex, "target sequence" refers to a sequence to which a guide sequence is designed to have some complementarity, where hybridization between a target sequence and a guide sequence promotes the formation of a CRISPR complex. Full complementarity is not necessarily required, provided there is sufficient complementarity to cause hybridization and promote formation of a CRISPR complex. A target sequence may comprise any polynucleotide, such as a DNA or a RNA polynucleotide. In certain embodiments, a target sequence is located in the nucleus or cytoplasm of a cell. In other embodiments, the target sequence may be within an organelle of a eukaryotic cell, for example, mitochondrion or nucleus. Typically, in the context of an endogenous CRISPR system, formation of a CRISPR complex (comprising a guide sequence hybridized to a target sequence and complexed with one or more Cas proteins) results in cleavage of one or both strands in or near (e.g., within about 1, 2, 3, 4, 5, 6, 7, 8, 9, 10, 20, 50 or more base pairs) the target sequence. As with the target sequence, it is believed that complete complementarity is not needed, provided this is sufficient to be functional.

In certain embodiments, one or more vectors driving expression of one or more elements of a CRISPR system are introduced into a host cell, such that expression of the elements of the CRISPR system direct formation of a CRISPR complex at one or more target sites. For example, a Cas enzyme, a guide sequence linked to a tracr-mate sequence, and a tracr sequence could each be operably linked to separate regulatory elements on separate vectors. Alternatively, two or more of the elements expressed from the same or different regulatory elements may be combined in a single vector, with one or more additional vectors providing any components of the CRISPR system not included in the first vector. CRISPR system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In certain embodiments, a single promoter drives expression of a transcript encoding a CRISPR enzyme and one or more of the guide sequence, tracr mate sequence (optionally operably linked to the guide sequence), and a tracr sequence embedded within one or more intron sequences (e.g., each in a different intron, two or more in at least one intron, or all in a single intron).

In certain embodiments, the CRISPR enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR enzyme fusion protein may comprise any additional protein sequence, and optionally a linker sequence between any two domains. Examples of protein domains that may be fused to a CRISPR enzyme include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Additional domains that may form part of a fusion protein comprising a CRISPR enzyme are described in U.S. Patent Appl. Publ. No. US20110059502, which is incorporated herein by reference. In certain embodiments, a tagged CRISPR enzyme is used to identify the location of a target sequence.

Conventional viral and non-viral based gene transfer methods can be used to introduce nucleic acids in mammalian and non-mammalian cells or target tissues. Such methods can be used to administer nucleic acids encoding components of a CRISPR system to cells in culture, or in a host organism. Non-viral vector delivery systems include DNA plasmids, RNA (e.g., a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell (Anderson, 1992, Science 256:808-813; and Yu, et al., 1994, Gene Therapy 1:13-26).

In certain embodiments, the CRISPR/Cas is derived from a type II CRISPR/Cas system. In some embodiments, the CRISPR/Cas system is derived from a Cas9 protein. The Cas9 protein can be from *Streptococcus pyogenes, Streptococcus thermophilus*, or other species.

In general, Cas proteins comprise at least one RNA recognition and/or RNA binding domain. RNA recognition and/or RNA binding domains interact with the guiding RNA. Cas proteins can also comprise nuclease domains (i.e., DNase or RNase domains), DNA binding domains, helicase domains, RNAse domains, protein-protein interaction domains, dimerization domains, as well as other domains. The Cas proteins can be modified to increase nucleic acid binding affinity and/or specificity, alter an enzymatic activity, and/or change another property of the protein. In certain embodiments, the Cas-like protein of the fusion protein can be derived from a wild type Cas9 protein or fragment thereof. In other embodiments, the Cas can be derived from modified Cas9 protein. For example, the amino acid sequence of the Cas9 protein can be modified to alter one or more properties (e.g., nuclease activity, affinity, stability, and so forth) of the protein. Alternatively, domains of the Cas9 protein not involved in RNA-guided cleavage can be eliminated from the protein such that the modified Cas9 protein is smaller than the wild type Cas9 protein. In general, a Cas9 protein comprises at least two nuclease (i.e., DNase) domains. For example, a Cas9 protein can comprise a RuvC-like nuclease domain and a HNH-like nuclease domain. The RuvC and HNH domains work together to cut single strands to make a double-stranded break in DNA. (Jinek, et al., 2012, Science, 337:816-821). In certain embodiments, the Cas9-derived protein can be modified to contain only one functional nuclease domain (either a RuvC-like or a HNH-like nuclease domain). For example, the Cas9-derived protein can be modified such that one of the nuclease domains is deleted or mutated such that it is no longer functional (i.e., the nuclease activity is absent). In some embodiments in which one of the nuclease domains is inactive, the Cas9-derived protein is able to introduce a nick into a double-stranded nucleic acid (such protein is termed a "nickase"), but not cleave the double-stranded DNA. In any of the above-described embodiments, any or all of the nuclease domains can be inactivated by one or more deletion mutations, insertion mutations, and/or substitution mutations using well-known methods, such as site-directed mutagenesis, PCR-mediated mutagenesis, and total gene synthesis, as well as other methods known in the art.

In one non-limiting embodiment, a vector drives the expression of the CRISPR system. The art is replete with suitable vectors that are useful in the present invention. The vectors to be used are suitable for replication and, optionally, integration in eukaryotic cells. Typical vectors contain transcription and translation terminators, initiation sequences, and promoters useful for regulation of the expression of the desired nucleic acid sequence. The vectors of the present invention may also be used for nucleic acid standard gene delivery protocols. Methods for gene delivery are known in the art (U.S. Pat. Nos. 5,399,346, 5,580,859 & 5,589,466, incorporated by reference herein in their entireties).

Further, the vector may be provided to a cell in the form of a viral vector. Viral vector technology is well known in the art and is described, for example, in Sambrook et al. (4th Edition, Molecular Cloning: A Laboratory Manual, Cold Spring Harbor Laboratory, New York, 2012), and in other virology and molecular biology manuals. Viruses, which are useful as vectors include, but are not limited to, retroviruses, adenoviruses, adeno-associated viruses, herpes viruses, Sindbis virus, gammaretrovirus and lentiviruses. In general, a suitable vector contains an origin of replication functional in at least one organism, a promoter sequence, convenient restriction endonuclease sites, and one or more selectable markers (e.g., WO 01/96584; WO 01/29058; and U.S. Pat. No. 6,326,193).

Introduction of Nucleic Acids

In certain embodiments an expression system is used for the introduction of dgRNAs and Cas9 proteins into the cells of interest. Typically employed options include but are not limited to plasmids and viral vectors such as adeno-associated virus (AAV) vector or lentivirus vector.

Methods of introducing nucleic acids into a cell include physical, biological and chemical methods. Physical methods for introducing a polynucleotide, such as RNA, into a host cell include calcium phosphate precipitation, lipofection, particle bombardment, microinjection, electroporation, and the like. RNA can be introduced into target cells using commercially available methods which include electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany). RNA can also be introduced into cells using cationic liposome mediated transfection using lipofection, using polymer encapsulation, using peptide mediated transfection, or using biolistic particle delivery systems such as "gene guns" (see, for example, Nishikawa, et al. Hum Gene Ther., 12(8): 861-70 (2001).

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

Lipids suitable for use can be obtained from commercial sources. For example, dimyristyl phosphatidylcholine ("DMPC") can be obtained from Sigma, St. Louis, MO; dicetyl phosphate ("DCP") can be obtained from K & K Laboratories (Plainview, NY); cholesterol ("Choi") can be obtained from Calbiochem-Behring; dimyristyl phosphatidylglycerol ("DMPG") and other lipids may be obtained from Avanti Polar Lipids, Inc. (Birmingham, AL). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5:505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the nucleic acids in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

Moreover, the nucleic acids may be introduced by any means, such as transducing the cells, transfecting the cells, and electroporating the cells. One nucleic acid may be introduced by one method and another nucleic acid may be introduced into the cell by a different method.

RNA

In one embodiment, the nucleic acids introduced into the cell are RNA. In another embodiment, the RNA is mRNA that comprises in vitro transcribed RNA or synthetic RNA. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA.

PCR can be used to generate a template for in vitro transcription of mRNA which is then introduced into cells. Methods for performing PCR are well known in the art. Primers for use in PCR are designed to have regions that are substantially complementary to regions of the DNA to be used as a template for the PCR. "Substantially complementary", as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a gene that is normally transcribed in cells (the open reading frame), including 5' and 3' UTRs. The primers can also be designed to amplify a portion of a gene that encodes a particular domain of interest. In one embodiment, the primers are designed to amplify the coding region of a human cDNA, including all or portions of the 5' and 3' UTRs. Primers useful for PCR are generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Chemical structures that have the ability to promote stability and/or translation efficiency of the RNA may also be used. The RNA preferably has 5' and 3' UTRs. In one embodiment, the 5' UTR is between zero and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the gene of interest. Alternatively, UTR sequences that are not endogenous to the gene of interest can be added by incorporating the UTR sequences into the forward and reverse primers or by any other modifications of the template. The use of UTR sequences that are not endogenous to the gene of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous gene. Alternatively, when a 5' UTR that is not endogenous to the gene of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be derived from an RNA virus whose RNA genome is stable in cells. In other embodiments various nucleotide analogues can be used in the 3' or 5' UTR to impede exonuclease degradation of the mRNA.

To enable synthesis of RNA from a DNA template, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In one embodiment, the mRNA has a cap on the 5' end and a 3' poly(A) tail which determine ribosome binding, initiation of translation and stability mRNA in the cell. On a circular DNA template, for instance, plasmid DNA, RNA polymerase produces a long concatameric product which may not be suitable for expression in eukaryotic cells. The transcription of plasmid DNA linearized at the end of the 3' UTR results in normal sized mRNA which may not be effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003)).

The conventional method of integration of polyA/T stretches into a DNA template is by molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100 T tail (size can be 50-5000 T), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines.

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

In some embodiments, the RNA is electroporated into the cells, such as in vitro transcribed RNA.

The methods also provide the ability to control the level of expression over a wide range by changing, for example, the promoter or the amount of input RNA, making it possible to individually regulate the expression level. Furthermore, the PCR-based technique of mRNA production greatly facilitates the design of the mRNAs with different structures and combination of their domains.

One advantage of RNA transfection methods of the invention is that RNA transfection is essentially transient and vector-free. A RNA transgene can be delivered to a lymphocyte and expressed therein following a brief in vitro cell activation, as a minimal expressing cassette without the need for any additional viral sequences. Under these conditions, integration of the transgene into the host cell genome is unlikely. Cloning of cells is not necessary because of the efficiency of transfection of the RNA and its ability to uniformly modify the entire lymphocyte population.

Genetic modification of cells with in vitro-transcribed RNA (IVT-RNA) makes use of two different strategies both of which have been successively tested in various animal models. Cells are transfected with in vitro-transcribed RNA by means of lipofection or electroporation. It is desirable to stabilize IVT-RNA using various modifications in order to achieve prolonged expression of transferred IVT-RNA.

Some IVT vectors are known in the literature which are utilized in a standardized manner as template for in vitro transcription and which have been genetically modified in such a way that stabilized RNA transcripts are produced. Currently protocols used in the art are based on a plasmid vector with the following structure: a 5' RNA polymerase promoter enabling RNA transcription, followed by a gene of interest which is flanked either 3' and/or 5' by untranslated regions (UTR), and a 3' polyadenyl cassette containing 50-70 A nucleotides. Prior to in vitro transcription, the circular plasmid is linearized downstream of the polyadenyl cassette by type II restriction enzymes (recognition sequence corresponds to cleavage site). The polyadenyl cassette thus corresponds to the later poly(A) sequence in the transcript. As a result of this procedure, some nucleotides remain as part of the enzyme cleavage site after linearization and extend or mask the poly(A) sequence at the 3' end. It is not clear, whether this nonphysiological overhang affects the amount of protein produced intracellularly from such a construct.

RNA has several advantages over more traditional plasmid or viral approaches. Gene expression from an RNA source does not require transcription and the protein product is produced rapidly after the transfection. Further, since the RNA has to only gain access to the cytoplasm, rather than the nucleus, and therefore typical transfection methods result in an extremely high rate of transfection. In addition, plasmid based approaches require that the promoter driving the expression of the gene of interest be active in the cells under study.

In another aspect, the RNA construct is delivered into the cells by electroporation. See, e.g., the formulations and methodology of electroporation of nucleic acid constructs into mammalian cells as taught in US 2004/0014645, US 2005/0052630A1, US 2005/0070841A1, US 2004/0059285A1, US 2004/0092907A1. The various parameters including electric field strength required for electroporation of any known cell type are generally known in the relevant research literature as well as numerous patents and applications in the field. See e.g., U.S. Pat. Nos. 6,678,556, 7,171,264, and 7,173,116. Apparatus for therapeutic application of electroporation are available commercially, e.g., the MedPulser™ DNA Electroporation Therapy System (Inovio/Genetronics, San Diego, Calif.), and are described in patents such as U.S. Pat. Nos. 6,567,694; 6,516,223, 5,993,434, 6,181,964, 6,241,701, and 6,233,482; electroporation may also be used for transfection of cells in vitro as described e.g. in US20070128708A1. Electroporation may also be utilized to deliver nucleic acids into cells in vitro. Accordingly, electroporation-mediated administration into cells of nucleic acids including expression constructs utilizing any of the many available devices and electroporation systems known to those of skill in the art presents an exciting new means for delivering an RNA of interest to a target cell.

Sources of Cells

In one embodiment, cells are obtained from a subject. Non-limiting examples of subjects include humans, dogs, cats, mice, rats, pigs and transgenic species thereof. Preferably, the subject is a human. Cells can be obtained from a number of sources, including peripheral blood mononuclear cells, bone marrow, lymph node tissue, spleen tissue, umbilical cord, cancer cells and tumors. In certain embodiments, any number of cell lines available in the art, may be used. In certain embodiments, cells can be obtained from a unit of blood collected from a subject using any number of techniques known to the skilled artisan, such as Ficoll separation. In one embodiment, cells from the circulating blood of an individual are obtained by apheresis or leukapheresis. The apheresis product typically contains lymphocytes, including T cells, monocytes, granulocytes, B cells, other nucleated white blood cells, red blood cells, and platelets. The cells collected by apheresis may be washed to remove the plasma fraction and to place the cells in an appropriate buffer or media, such as phosphate buffered saline (PBS) or wash solution lacks calcium and may lack magnesium or may lack many if not all divalent cations, for subsequent processing steps. After washing, the cells may be resuspended in a variety of biocompatible buffers, such as, for example, Ca-free, Mg-free PBS. Alternatively, the undesirable components of the apheresis sample may be removed and the cells directly resuspended in culture media.

In another embodiment, cells are isolated from peripheral blood. Alternatively, cells can be isolated from umbilical cord. In any event, a specific subpopulation of cells can be further isolated by positive or negative selection techniques.

Cells can also be frozen. While many freezing solutions and parameters are known in the art and will be useful in this context, in a non-limiting example, one method involves using PBS containing 20% DMSO and 8% human serum albumin, or other suitable cell freezing media. The cells are then frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

Pharmaceutical Compositions

Pharmaceutical compositions of the present invention may comprise an agonist of a gene (e.g. Prodh2, Ccnblip1, Sreklip1, or Wdr37), as described herein, in combination with one or more pharmaceutically or physiologically acceptable carriers, diluents or excipients. Also provided are pharmaceutical compositions comprising an engineered immune cell of the invention. Further provided are pharmaceutical compositions comprising a Prodh2 peptide or a fragment thereof.

Compositions of the present invention may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

Pharmaceutical compositions of the present invention may be administered in a manner appropriate to the disease to be treated (or prevented). The quantity and frequency of administration will be determined by such factors as the condition of the patient, and the type and severity of the patient's disease, although appropriate dosages may be determined by clinical trials.

The administration of the composition of the invention may be carried out in any convenient manner known to those of skill in the art. The composition of the present invention may be administered to a subject by aerosol inhalation, injection, ingestion, transfusion, implantation or transplantation. The compositions described herein may be administered to a patient transarterially, subcutaneously, intradermally, intratumorally, intranodally, intramedullarly, intracystically intramuscularly, by intravenous (i.v.) injection, parenterally or intraperitoneally. In other instances, the composition of the invention are injected directly into a site of inflammation in the subject, a local disease site in the subject, a lymph node, an organ, a tumor, and the like.

It should be understood that the methods and compositions that would be useful in the present invention are not limited to the particular formulations set forth in the examples. The following examples are put forth so as to provide those of ordinary skill in the art with a complete disclosure and description of how to make and use the cells, expansion and culture methods, and therapeutic methods of the invention, and are not intended to limit the scope of what the inventors regard as their invention.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", fourth edition (Sambrook, 2012); "Oligonucleotide Synthesis" (Gait, 1984); "Culture of Animal Cells" (Freshney, 2010); "Methods in Enzymology" "Handbook of Experimental Immunology" (Weir, 1997); "Gene Transfer Vectors for Mammalian Cells" (Miller and Calos, 1987); "Short Protocols in Molecular Biology" (Ausubel, 2002); "Polymerase Chain Reaction: Principles, Applications and Troubleshooting", (Babar, 2011); "Current Protocols in Immunology" (Coligan, 2002). These techniques are applicable to the production of the polynucleotides and polypeptides of the invention, and, as such, may be considered in making and practicing the invention. Particularly useful techniques for particular embodiments will be discussed in the sections that follow.

Experimental Examples

The invention is now described with reference to the following Examples. These Examples are provided for the purpose of illustration only, and the invention is not limited to these Examples, but rather encompasses all variations that are evident as a result of the teachings provided herein.

The materials and methods employed in these experiments are now described.

Mice (Examples 1-10): Rosa26-Cas9-2A-EGFP constitutive expressed mice (Cas9-mice); OT-I TCR transgenic mice were used in this study. OT-I;Cas9 mice were generated by breeding OT-I and Cas9 mice. Mice, both female and male, aged 8-12 weeks were used for naïve $CD8^+$ T cell isolation.

Cell culture (Examples 1-10): HEK293FT, B16F10, and E0771 cell lines were obtained from the American Type Culture Collection (Manassas, VA) and cultured in DMEM (Gibco) medium supplemented with 10% FBS (Sigma) and 200 U/mL penicillin-streptomycin (Gibco), named D10 medium. Naïve $CD8^+$ T cells were cultured in RPMI-1640 (Gibco) medium supplemented with 10% FBS, 2 mM L-Glutamine, 200 U/mL penicillin-streptomycin (Gibco), and 49 µM β-mercaptoethanol (Sigma). For T cell in vitro experiments, complete RPMI-1640 medium was supplemented with 2 ng/mL IL-2, 1 µg/mL anti-CD28, and 12 ng/ml Il-12p70 cytokines or antibody. All cytokines and antibodies were purchased from BioLegend.

mm10dgLib design (Examples 1-4): The 250 bp sequences upstream of all mouse protein-coding genes were extracted by Ensembl Biomart. All possible dgRNA spacers (15mer-NGG) were identified, both on the sense and antisense strands. 18mers were then mapped to the mm 10 genome by Bowtie with settings bowtie-n 2-e 120--best. After discarding any alignments with mismatches in the 17th or 18th position ("GG" in NGG PAM), the number of alignments was tabulated for each spacer. Each alignment was then scored based on the number of mismatches, disregarding any mismatches in the 16th position (the "N" in NGG), using the following formula: (#of 0 mismatch alignments*1000)+(#of 1 mismatch alignments*50)+(#of 2 mismatch alignments*1). Larger mismatch scores indicate decreased genome-wide mapping specificity. Subsequently, all non-uniquely mapping spacers, as well as spacers with mismatch score>=2000, were discarded. The top 4 dgRNA spacers were then chosen based on the shortest distance to the −200 position from the TSS, since transcription factors generally bind to promoters at around this distance. In total, 83,601 dgRNAs targeting coding transcripts and 1,000 non-targeting controls (NTCs) were designed.

mm10dgLib design (Examples 5-10): The The 250 bp sequences upstream of all mouse protein-coding genes were extracted by Ensembl Biomart. All possible dgRNA spacers (15mer-NGG) were identified, both on the sense and antisense strands. 18mers were then mapped to the mm10 genome by Bowtie with settings bowtie-n 2-e 120--best. After discarding any alignments with mismatches in the 17th or 18th position ("GG" in NGG PAM), the number of alignments was tabulated for each spacer. Each alignment was then scored based on the number of mismatches, disregarding any mismatches in the 16th position (the "N" in NGG), using the following formula: (#of 0 mismatch alignments*1000)+(#of 1 mismatch alignments*50)+(#of 2 mismatch alignments*1). Larger mismatch scores indicate decreased genome-wide mapping specificity. Subsequently, all non-uniquely mapping spacers, as well as spacers with mismatch score>=2000, were discarded. The top 4 dgRNA spacers were then chosen based on shortest distance to the −200 position from the TSS, since transcription factors generally to bind to promoters at around this distance. In total, 83,601 dgRNAs targeting 22,391 coding transcripts and 1,000 non-targeting controls (NTCs) were designed.

Construction of T cell dgRNA activation (TdgA) vector (Examples 1-10): The gBlocks of U6-dgRNA-MS2 and EFS-Thy1.1-MS2-p65-HSF1 gene fragments were synthesized from Integrated DNA Technologies (IDT), then these cassettes were subcloned into a lentiviral vector via Gibson Assembly (NEB). The resulting activation vector, *lenti*-U6-dgRNA(BsmbI)-MS2-EFS-Thy1.1-MPH, was named TdgA vector

```
TdgA vector:
                                      (SEQ ID NO: 84,602)
TTAATGTAGTCTTATGCAATACTCTTGTAGTCTTGCAACATGGTAACGATGAG

TTAGCAACATGCCTTACAAGGAGAGAAAAAGCACCGTGCATGCCGATTGGTG

GAAGTAAGGTGGTACGATCGTGCCTTATTAGGAAGGCAACAGACGGGTCTGA

CATGGATTGGACGAACCACTGAATTGCCGCATTGCAGAGATATTGTATTTAAG

TGCCTAGCTCGATACATAAACGGGTCTCTCTGGTTAGACCAGATCTGAGCCTG

GGAGCTCTCTGGCTAACTAGGGAACCCACTGCTTAAGCCTCAATAAAGCTTGC

CTTGAGTGCTTCAAGTAGTGTGTGCCCGTCTGTTGTGTGACTCTGGTAACTAG

AGATCCCTCAGACCCTTTTAGTCAGTGTGGAAAATCTCTAGCAGTGGCGCCCG

AACAGGGACTTGAAAGCGAAAGGGAAACCAGAGGAGCTCTCTCGACGCAGG

ACTCGGCTTGCTGAAGCGCGCACGGCAAGAGGCGAGGGGCGGCGACTGGTG

AGTACGCCAAAAATTTTGACTAGCGGAGGCTAGAAGGAGAGAGATGGGTGC

GAGAGCGTCAGTATTAAGCGGGGGAGAATTAGATCGCGATGGGAAAAAATTC

GGTTAAGGCCAGGGGAAAGAAAAAATATAAATTAAAACATATAGTATGGG

CAAGCAGGGAGCTAGAACGATTCGCAGTTAATCCTGGCCTGTTAGAAACATC

AGAAGGCTGTAGACAAATACTGGGACAGCTACAACCATCCCTTCAGACAGGA

TCAGAAGAACTTAGATCATTATATAATACAGTAGCAACCCTCTATTGTGTGCA

TCAAAGGATAGAGATAAAAGACACCAAGGAAGCTTTAGACAAGATAGAGGA

AGAGCAAAACAAAAGTAAGACCACCGCACAGCAAGCGGCCGCTGATCTTCA

GACCTGGAGGAGGAGATATGAGGGACAATTGGAGAAGTGAATTATATAAAT

ATAAAGTAGTAAAAATTGAACCATTAGGAGTAGCACCCACCAAGGCAAAGA

GAAGAGTGGTGCAGAGAGAAAAAAGAGCAGTGGGAATAGGAGCTTTGTTCC

TTGGGTTCTTGGGAGCAGCAGGAAGCACTATGGGCGCAGCGTCAATGACGCT

GACGGTACAGGCCAGACAATTATTGTCTGGTATAGTGCAGCAGCAGAACAAT

TTGCTGAGGGCTATTGAGGCGCAACAGCATCTGTTGCAACTCACAGTCTGGG

GCATCAAGCAGCTCCAGGCAAGAATCCTGGCTGTGGAAAGATACCTAAAGGA

TCAACAGCTCCTGGGGATTTGGGGTTGCTCTGGAAAACTCATTTGCACCACTG

CTGTGCCTTGGAATGCTAGTTGGAGTAATAAATCTCTGGAACAGATTTGGAAT

CACACGACCTGGATGGAGTGGGACAGAGAAATTAACAATTACACAAGCTTAA

TACACTCCTTAATTGAAGAATCGCAAAACCAGCAAGAAAAGAATGAACAAGA

ATTATTGGAATTAGATAAATGGGCAAGTTTGTGGAATTGGTTTAACATAACAA

ATTGGCTGTGGTATATAAAATTATTCATAATGATAGTAGGAGGCTTGGTAGGT

TTAAGAATAGTTTTTGCTGTACTTTCTATAGTGAATAGAGTTAGGCAGGGATA

TTCACCATTATCGTTTCAGACCCACCTCCCAACCCCGAGGGGACCCAGAGAG

GGCCTATTTCCCATGATTCCTTCATATTTGCATATACGATACAAGGCTGTTAG

AGAGATAATTAGAATTAATTTGACTGTAAACACAAAGATATTAGTACAAAAT

ACGTGACGTAGAAAGTAATAATTTCTTGGGTAGTTTGCAGTTTTAAAATTATG

TTTTAAAATGGACTATCATATGCTTACCGTAACTTGAAAGTATTTCGATTTCTT
```

-continued

```
GGCTTTATATATCTTGTGGAAAGGACGAAACACCGGAGACGGGATACCGTCT

CTGTTTTAGAGCTAGGCCAACATGAGGATCACCCATGTCTGCAGGGCCTAGC

AAGTTAAAATAAGGCTAGTCCGTTATCAACTTGGCCAACATGAGGATCACCC

ATGTCTGCAGGGCCAAGTGGCACCGAGTCGGTGCTTTTTTTGGATCCAAGCTT

GGCGTAACTAGATCTTGAGACAAATGGCAGTATTCATCCACAATTTTAAAAG

AAAAGGGGGATTGGGGGGTACAGTGCAGGGGAAAGAATAGTAGACATAAT

AGCAACAGACATACAAACTAAAGAATTACAAAAACAAATTACAAAAATTCA

AAATTTTCGGGTTTATTACAGGGACAGCAGAGATCCACTTTGGCGCCGGCTCG

AGGGGGCCCGGGGAATTCGCTAGCTAGGTCTTGAAAGGAGTGGGAATTGGCT

CCGGTGCCCGTCAGTGGGCAGAGCGCACATCGCCCACAGTCCCCGAGAAGTT

GGGGGGAGGGGTCGGCAATTGATCCGGTGCCTAGAGAAGGTGGCGCGGGGT

AAACTGGGAAAGTGATGTCGTGTACTGGCTCCGCCTTTTTCCCGAGGGTGGGG

GAGAACCGTATATAAGTGCAGTAGTCGCCGTGAACGTTCTTTTTCGCAACGGG

TTTGCCGCCAGAACACAGGACCGGTTCTAGACGTACGGCCACCATGAACCCA

GCCATCAGCGTCGCTCTCCTGCTCTCAGTCTTGCAGGTGTCCCGAGGGCAGAA

GGTGACCAGCCTGACAGCCTGCCTGGTGAACCAAAACCTTCGCCTGGACTGC

CGCCATGAGAATAACACCAAGGATAACTCCATCCAGCATGAGTTCAGCCTGA

CCCGAGAGAAGAGGAAGCACGTGCTCTCAGGCACCCTTGGGATACCCGAGCA

CACGTACCGCTCCCGCGTCACCCTCTCCAACCAGCCCTATATCAAGGTCCTTA

CCCTAGCCAACTTCACCACCAAGGATGAGGGCGACTACTTTTGTGAGCTTCGC

GTGTCGGGCGCGAATCCCATGAGCTCCAATAAAAGTATCAGTGTGTATAGAG

ACAAGCTGGTCAAGTGTGGCGGCATAAGCCTGCTGGTTCAGAACACATCCTG

GATGCTGCTGCTGCTGCTTTCCCTCTCCCTCCTCCAAGCCCTGGACTTCATTTC

TCTGGGCAGTGGAGAGGGCAGAGGAAGTCTGCTAACATGCGGTGACGTCGAG

GAGAATCCTGGCCCAATGGCTTCAAACTTTACTCAGTTCGTGCTCGTGGACAA

TGGTGGGACAGGGGATGTGACAGTGGCTCCTTCTAATTTCGCTAATGGGGTG

GCAGAGTGGATCAGCTCCAACTCACGGAGCCAGGCCTACAAGGTGACATGCA

GCGTCAGGCAGTCTAGTGCCCAGAAGAGAAAGTATACCATCAAGGTGGAGGT

CCCCAAAGTGGCTACCCAGACAGTGGGCGGAGTCGAACTGCCTGTCGCCGCT

TGGAGGTCCTACCTGAACATGGAGCTCACTATCCCAATTTTCGCTACCAATTC

TGACTGTGAACTCATCGTGAAGGCAATGCAGGGGCTCCTCAAAGACGGTAAT

CCTATCCCTTCCGCCATCGCCGCTAACTCAGGTATCTACAGCGCTGGAGGAGG

TGGAAGCGGAGGAGGAGGAAGCGGAGGAGGAGGTAGCGGACCTAAGAAAA

AGAGGAAGGTGGCGGCCGCTGGATCCCCTTCAGGGCAGATCAGCAACCAGGC

CCTGGCTCTGGCCCCTAGCTCCGCTCCAGTGCTGGCCCAGACTATGGTGCCCT

CTAGTGCTATGGTGCCTCTGGCCCAGCCACCTGCTCCAGCCCCTGTGCTGACC

CCAGGACCACCCCAGTCACTGAGCGCTCCAGTGCCCAAGTCTACACAGGCCG

GCGAGGGGACTCTGAGTGAAGCTCTGCTGCACCTGCAGTTCGACGCTGATGA

GGACCTGGGAGCTCTGCTGGGGAACAGCACCGATCCCGGAGTGTTCACAGAT

CTGGCCTCCGTGGACAACTCTGAGTTTCAGCAGCTGCTGAATCAGGGCGTGTC
```

-continued

```
CATGTCTCATAGTACAGCCGAACCAATGCTGATGGAGTACCCCGAAGCCATT

ACCCGGCTGGTGACCGGCAGCCAGCGGCCCCCCGACCCCGCTCCAACTCCCC

TGGGAACCAGCGGCCTGCCTAATGGGCTGTCCGGAGATGAAGACTTCTCAAG

CATCGCTGATATGGACTTTAGTGCCCTGCTGTCACAGATTTCCTCTAGTGGGC

AGGGAGGAGGTGGAAGCGGCTTCAGCGTGGACACCAGTGCCCTGCTGGACCT

GTTCAGCCCCTCGGTGACCGTGCCCGACATGAGCCTGCCTGACCTTGACAGCA

GCCTGGCCAGTATCCAAGAGCTCCTGTCTCCCAGGAGCCCCCCAGGCCTCCC

GAGGCAGAGAACAGCAGCCCGGATTCAGGGAAGCAGCTGGTGCACTACACA

GCGCAGCCGCTGTTCCTGCTGGACCCCGGCTCCGTGGACACCGGGAGCAACG

ACCTGCCGGTGCTGTTTGAGCTGGGAGAGGGCTCCTACTTCTCCGAAGGGGA

CGGCTTCGCCGAGGACCCCACCATCTCCCTGCTGACAGGCTCGGAGCCTCCCA

AAGCCAAGGACCCCACTGTCTCCTAATGTACAAGCGCTAATAAAAGATCTTT

ATTTTCATTAGATCTGTGTGTTGGTTTTTTGTGTGGTAACTCTAGACGTGCGGT

CGACTTTAAGACCAATGACTTACAAGGCAGCTGTAGATCTTAGCCACTTTTTA

AAAGAAAAGGGGGGACTGGAAGGGCTAATTCACTCCCAACGAAGACAAGAT

CTGCTTTTTGCTTGTACTGGGTCTCTCTGGTTAGACCAGATCTGAGCCTGGGA

GCTCTCTGGCTAACTAGGGAACCCACTGCTTAAGCCTCAATAAAGCTTGCCTT

GAGTGCTTCAAGTAGTGTGTGCCCGTCTGTTGTGTGACTCTGGTAACTAGAGA

TCCCTCAGACCCTTTTAGTCAGTGTGGAAAATCTCTAGCAGTACGTATAGTAG

TTCATGTCATCTTATTATTCAGTATTTATAACTTGCAAAGAAATGAATATCAG

AGAGTGAGAGGAACTTGTTTATTGCAGCTTATAATGGTTACAAATAAAGCAA

TAGCATCACAAATTTCACAAATAAAGCATTTTTTCACTGCATTCTAGTTGTG

GTTTGTCCAAACTCATCAATGTATCTTATCATGTCTGGCTCTAGCTATCCCGCC

CCTAACTCCGCCCATCCCGCCCCTAACTCCGCCCAGTTCCGCCCATTCTCCGC

CCCATGGCTGACTAATTTTTTTTATTTATGCAGAGGCCGAGGCCGCCTCGGCC

TCTGAGCTATTCCAGAAGTAGTGAGGAGGCTTTTTTGGAGGCCTAGGGACGT

ACCCAATTCGCCCTATAGTGAGTCGTATTACGCGCGCTCACTGGCCGTCGTTT

TACAACGTCGTGACTGGGAAAACCCTGGCGTTACCCAACTTAATCGCCTTGCA

GCACATCCCCCTTTCGCCAGCTGGCGTAATAGCGAAGAGGCCCGCACCGATC

GCCCTTCCCAACAGTTGCGCAGCCTGAATGGCGAATGGGACGCGCCCTGTAG

CGGCGCATTAAGCGCGGCGGGTGTGGTGGTTACGCGCAGCGTGACCGCTACA

CTTGCCAGCGCCCTAGCGCCCGCTCCTTTCGCTTTCTTCCCTTCCTTTCTCGCC

ACGTTCGCCGGCTTTCCCCGTCAAGCTCTAAATCGGGGGCTCCCTTTAGGGTT

CCGATTTAGTGCTTTACGGCACCTCGACCCCAAAAAACTTGATTAGGGTGATG

GTTCACGTAGTGGGCCATCGCCCTGATAGACGGTTTTTCGCCCTTTGACGTTG

GAGTCCACGTTCTTTAATAGTGGACTCTTGTTCCAAACTGGAACAACACTCAA

CCCTATCTCGGTCTATTCTTTTGATTTATAAGGGATTTTGCCGATTTCGGCCTA

TTGGTTAAAAAATGAGCTGATTTAACAAAAATTTAACGCGAATTTTAACAAA

ATATTAACGCTTACAATTTAGGTGGCACTTTTCGGGGAAATGTGCGCGGAACC

CCTATTTGTTTATTTTTCTAAATACATTCAAATATGTATCCGCTCATGAGACAA

TAACCCTGATAAATGCTTCAATAATATTGAAAAAGGAAGAGTATGAGTATTC
```

```
AACATTTCCGTGTCGCCCTTATTCCCTTTTTTGCGGCATTTTGCCTTCCTGTTTT

TGCTCACCCAGAAACGCTGGTGAAAGTAAAAGATGCTGAAGATCAGTTGGGT

GCACGAGTGGGTTACATCGAACTGGATCTCAACAGCGGTAAGATCCTTGAGA

GTTTTCGCCCCGAAGAACGTTTTCCAATGATGAGCACTTTTAAAGTTCTGCTA

TGTGGCGCGGTATTATCCCGTATTGACGCCGGGCAAGAGCAACTCGGTCGCC

GCATACACTATTCTCAGAATGACTTGGTTGAGTACTCACCAGTCACAGAAAA

GCATCTTACGGATGGCATGACAGTAAGAGAATTATGCAGTGCTGCCATAACC

ATGAGTGATAACACTGCGGCCAACTTACTTCTGACAACGATCGGAGGACCGA

AGGAGCTAACCGCTTTTTTGCACAACATGGGGGATCATGTAACTCGCCTTGAT

CGTTGGGAACCGGAGCTGAATGAAGCCATACCAAACGACGAGCGTGACACCA

CGATGCCTGTAGCAATGGCAACAACGTTGCGCAAACTATTAACTGGCGAACT

ACTTACTCTAGCTTCCCGGCAACAATTAATAGACTGGATGGAGGCGGATAAA

GTTGCAGGACCACTTCTGCGCTCGGCCCTTCCGGCTGGCTGGTTTATTGCTGA

TAAATCTGGAGCCGGTGAGCGTGGGTCTCGCGGTATCATTGCAGCACTGGGG

CCAGATGGTAAGCCCTCCCGTATCGTAGTTATCTACACGACGGGGAGTCAGG

CAACTATGGATGAACGAAATAGACAGATCGCTGAGATAGGTGCCTCACTGAT

TAAGCATTGGTAACTGTCAGACCAAGTTTACTCATATATACTTTAGATTGATT

TAAAACTTCATTTTTAATTTAAAAGGATCTAGGTGAAGATCCTTTTTGATAAT

CTCATGACCAAAATCCCTTAACGTGAGTTTTCGTTCCACTGAGCGTCAGACCC

CGTAGAAAAGATCAAAGGATCTTCTTGAGATCCTTTTTTTCTGCGCGTAATCT

GCTGCTTGCAAACAAAAAAACCACCGCTACCAGCGGTGGTTTGTTTGCCGGA

TCAAGAGCTACCAACTCTTTTTCCGAAGGTAACTGGCTTCAGCAGAGCGCAG

ATACCAAATACTGTTCTTCTAGTGTAGCCGTAGTTAGGCCACCACTTCAAGAA

CTCTGTAGCACCGCCTACATACCTCGCTCTGCTAATCCTGTTACCAGTGGCTG

CTGCCAGTGGCGATAAGTCGTGTCTTACCGGGTTGGACTCAAGACGATAGTTA

CCGGATAAGGCGCAGCGGTCGGGCTGAACGGGGGGTTCGTGCACACAGCCCA

GCTTGGAGCGAACGACCTACACCGAACTGAGATACCTACAGCGTGAGCTATG

AGAAAGCGCCACGCTTCCCGAAGGGAGAAAGGCGGACAGGTATCCGGTAAG

CGGCAGGGTCGGAACAGGAGAGCGCACGAGGGAGCTTCCAGGGGAAACGC

CTGGTATCTTTATAGTCCTGTCGGGTTTCGCCACCTCTGACTTGAGCGTCGATT

TTTGTGATGCTCGTCAGGGGGCGGAGCCTATGGAAAAACGCCAGCAACGCG

GCCTTTTTACGGTTCCTGGCCTTTTGCTGGCCTTTTGCTCACATGTTCTTTCCTG

CGTTATCCCCTGATTCTGTGGATAACCGTATTACCGCCTTTGAGTGAGCTGAT

ACCGCTCGCCGCAGCCGAACGACCGAGCGCAGCGAGTCAGTGAGCGAGGAA

GCGGAAGAGCGCCCAATACGCAAACCGCCTCTCCCCGCGCGTTGGCCGATTC

ATTAATGCAGCTGGCACGACAGGTTTCCCGACTGGAAAGCGGGCAGTGAGCG

CAACGCAATTAATGTGAGTTAGCTCACTCATTAGGCACCCCAGGCTTTACACT

TTATGCTTCCGGCTCGTATGTTGTGTGGAATTGTGAGCGGATAACAATTTCAC

ACAGGAAACAGCTATGACCATGATTACGCCAAGCGCGCAATTAACCCTCACT

AAAGGGAACAAAAGCTGGAGCTGCAAGC
``` mm10dgLib cloning (Examples 1-10): Designed mm10dgLib was synthesized from IDT followed by subcloning into TdgA vector via Gibson assembly and electroporation. Approximately >230×coverage (~$2\times10^7$ clones were obtained) was achieved after electroporation. The mm 10dgLib plasmids were extracted via maxi plasmid preparation (Qiagen), followed by Illumina sequencing to confirm library representation. A total of 82,197/83,601 of GTS and 988/1,000 of NTC were cloned.

Lentivirus production (Examples 1-10): Lentivirus was produced using low-passage HEK239FT cells. One day before transfection, HEK293FT cells were seeded in 15 cm-dish at 50-60% confluency. Two hours before transfection, D10 media was replaced with 13 mL pre-warmed Opti-MEM medium (Invitrogen). For each plate, 450 µL of Opti-MEM was mixed with 20 µg 10dgLib plasmid or vector control plasmid, 15 µg psPAX2 (Addgene), 10 µg pMD2.G (Addgene) and 130 µl polyethylenimine (PEI). After brief vortex, the mixture was incubated for 15 min at room temperature and then dropwise added to cells. After 6 h of transfection, Opti-MEM media was replaced with 20 mL pre-warmed D10 medium. Viral supernatant was collected at 48 h and 72 h post-transfection, then filtered using 0.45 µm filters (Fisher/VWR) to remove cell debris, finally concentrated virus using AmiconUltra 100 kD ultracentrifugation units (Millipore), all virus was aliquoted and stored in −80° C.

Naïve $CD8^+$ T cell isolation and culture (Examples 1-4): Spleens and mesenteric lymph nodes (mLNs) were dissected from OT-I;Cas9β mice, then placed into ice-cold PBS supplemented with 2% FBS. Organs were mashed through a 100 µm filter and lymphocytes were re-suspended with 2% FBS. Red blood cells (RBCs) were lysed with 1 mL ACK lysis buffer (Lonza) per 3 spleens for 1-2 min at room temperature, then lysis was stopped by adding 50 mL 2% FBS PBS. RBC lysed lymphocytes were filtered with 40 µm filters to remove cell debris. Naïve $CD8a^+$ T cell purification was performed using Naïve $CD8a^+$ T cell Isolation Kits according to the Miltenyi Biotec's standard procedures. Naïve $CD8a^+$ T cells were cultured at 1-2×$10^6$ cells/mL density in anti-CD3, and cRPMI medium was supplemented with 2 ng/mL IL-2, 1 µg/mL anti-CD28, and 12 ng/ml IL-12p70. All cytokines and antibodies were purchased from the BioLegend.

Naïve $CD8^+$ T cell isolation and culture (Examples 5-10): Mesenteric lymph nodes (mLNs) and spleens were dissected from OT-I;Cas9β mice, then placed into ice-cold PBS supplemented with 2% FBS. Lymphocytes were released by grinding organs through a 100 µm filter, then re-suspended with 2% FBS. Red blood cells (RBCs) were lysed with 1 mL ACK lysis buffer (Lonza) for 2 spleens at 1-2 min at room temperature, then neutralized with 2% FBS PBS at 20 volumes per volume of lysis buffer. RBC-lysed lymphocyte solution was filtered through 40 µm filters to remove cell debris. Naïve $CD8a^+$ T cell purification was performed using Naïve $CD8a^+$ T cell Isolation Kits (Miltenyi Biotec) according to the manufacturer's protocols. Naïve $CD8a^+$ T cells were cultured at 1×$10^6$ cells/mL density in 2 µg/mL anti-CD3ε (BioLegend) treated plates or dishes.

Lentivirus titration (Examples 1-10): Naïve $CD8a^+$ T cells were infected with lentivirus in different volume ratios between cRPMI and lentivirus after isolation. At day 3 after T cell isolation, T cells were collected and stained with anti-CD8α-APC and anti-Thy 1.1-PE. The Thy 1.1-positive cells were successfully infected with lentivirus, as well as expressed after lentivirus infection. The ratio of $CD8^+$ and $Thy1.1^+$ cells were determined by flow cytometry. Viral titer was calculated by FACS of the mm10dgLib infected cells using Thy 1.1 marker. Each group had 3 independent biological replicates.

mm10dgLib lentivirus transduction (Examples 1-4): With the titration information of lentivirus, for each replicate, 1.5×$10^7$ OT-1;Cas9 naïve $CD8^+$ T cells were cultured in a 10-cm plate and transduced with 400 µL mm 10dgLib or empty vector lentivirus at a volume ratio 1:25 (media: virus).

mm10dgLib lentivirus transduction (Examples 5-10): Given the lentiviral titer information, for each replicate, 1.5×$10^7$ OT-I;Cas9β naïve $CD8^+$ T cells were cultured in a 10-cm plate and transduced with 400 µL mm10dgLib or empty vector lentivirus at a volume ratio of 1:25 (virus: media), which can successfully infect around 75% T cells (FIG. 12).

Kill assay and CRISPR screen: mm10dgLib lentivirus infected OT-I; Cas9i $CD8^+$ T cells were cultured 10-cm dishes pretreated with anti-CD3 treated dishes using cRPMI-1640 supplemented with 2 ng/ml IL-2,1 µg/mL anti-CD28, and 2 ng/ml IL-12p70 for 4 days. The medium was changed with fresh media every day. About 12 hours before kill assay, infected OT-I;Cas9e $CD8^+$ T cells were reseeded on new dishes which were untreated with anti-CD3ε and cRPMI-1640 only supplemented with 2 ng/ml IL-2 and 2 ng/ml IL-12p70 to rest cells. At the same time, 2×$10^6$ E0771 cells were seeded in 6-well plates in D10 medium. On day 5, E0771 cells were incubated with 1 ng/ml SIINFEKL (SEQ ID NO. 84,614) peptide for 4 hours. Before start kill assay, $CD8^+$ T cells were suspended with fresh cRPMI-1640 with 2 nM monensin and anti-CD107a-PE antibody (BioLegend) (1:400 dilution). The final cell concentration was 2× $10^6$ cells/mL. After SIINFEKL (SEQ ID NO. 84,614) peptide incubation, 3×$10^6$ $CD8^+$ T cells per replicate (E0771: T cell≈1:1) were added to E0771 cells and co-incubated for 2 h in the incubator. At the end of co-incubation, T cells were gently washed down with PBS and stained with anti-CD8α-APC, anti-CD38-PE/Cy7 for 30 min on the ice. Cells were analyzed and sorted using BD FACSAria. High killing population, i.e CD107a high-expressed cells, were sorted for library readout. For high killing gating, the top 5% of $CD8^+$ and $CD107a^+$ cell population of mm 10dgLib groups without SIINFEKL (SEQ ID NO. 84,614) peptide was set as the lowest limit for sorting.

Flow cytometry (Examples 1-10): T cells were collected and washed one time using MACS buffer (0.2% BSA and 5 mM EDTA in PBS) before staining. T cells were stained on ice for 30 min after adding antibodies (1:200 dilution). Samples were run on a BD FACSAria cytometer, and analysis was performed using FlowJo software 9.9.4 (Threestar, Ashland, OR).

Kill assay screen readout and deep sequencing (Examples 1-10): The sorted cells and cell pellets (2×$10^6$ cells/replicate, collected before kill assay) were lysed using QuickExtract solution (Epicentre) at 65° C. for 30 min. dgRNA readout was performed using two-step PCR amplification. PCR was performed using Phusion Flash High Fidelity Master Mix (Thermo Fisher). The first PCR (PCR #1) step used primers Forward: 5'-aatggactatcatatgcttaccgtaacttgaaagtatttcg-3' (SEQ ID NO: 84,603) and Reverse: 5'-ctttagtttgtatgtctgttgc-tattatgtctactattctttccc-3' (SEQ ID NO: 84,604) to amplify dgRNA cassette. The second PCR (PCR #2) amplification used uniquely barcoded primers, SF1 to SF12 and SNR1 to SNR12, to allow multiplexing of samples in a single Hiseq run. For PCR #1, each sample was performed using 5 reactions in a 50 µL volume. The cycle conditions were: 98° C. for 1 min, 25 cycles of (98° C. for 1s, 62° C. for 5 s, 72° C. for 15 s), and 72° C. for 2 min. PCR products of each sample were pooled together for barcoding PCR. For PCR #2, 2 μl of pooled PCR #1 products were used as template in a 50 μL reaction. The PCR cycle condition was: 98° C. for 1 min, 30 cycles of (98° C. for 1s, 62° C. for 5 s, 72° C. for 15 s), and 72° C. for 2 min. All PCR products were quantified with a gel-based method using the Low-Range Quantitative Ladder (Life Technologies), then gel purified using the QIAQuick gel extraction kit (Qiagen). Purified PCR products were equally pooled in one tube for deep sequencing. Diluted libraries with 5-20% PhiX were sequenced with HiSeq 2500 or HiSeq 4000 systems (Illumina).

dgRNA screen data analysis (Examples 1-10): Raw single-end fastq read files were filtered and demultiplexed using Cutadapt (Martin, M. (2011) EMBnet.journal 17, 10-12). To remove extra sequences downstream (i.e. 3' end) of the sgRNA spacer sequences, the following command was used: cutadapt-a GTTTTAGAGCTAGGC-e 0.2--discard-untrimmed (SEQ ID NO. 84,631). As the forward PCR primers used to readout sgRNA representation were designed to have a variety of barcodes to facilitate multiplexed sequencing, demultiplexing these filtered reads was performed with the following settings: cutadapt-g file: fbc.fasta--no-trim, where fbc.fasta contained the 12 possible barcode sequences within the forward primers (Table 1). Finally, to remove extra sequences upstream (i.e. 5' end) of the sgRNA spacers, the following command was used: cutadapt-g AAAGGACGAAACACCG-e 0.2-m 14-M 18 (SEQ ID NO. 84,632). Minimum/maximum read lengths were set at 14/18 bp respectively to exclude non-specific reads and enriched for the 15 bp dgRNA spacer sequences. The 15 bp dgRNA spacer sequences from each demulitplexed sample were then mapped to the designed dgRNA spacers in the mm10dgLib. A bowtie index of the dgRNA library was generated using the bowtie-build command in Bowtie 1.1.2 (Langmead, B., et al. (2009) *Genome Biol* 10, R25, doi: 10.1186/gb-2009-10-3-r25). The filtered fastq read files were mapped to the index using the following settings: bowtie-v 1-m 1 mm10dgLib-q<fastq_file>. Using the resultant mapping output, the number of reads that had mapped to each sgRNA within the library was quantified.

Enrichment analysis of dgRNAs (Examples 1-10): Enrichment analysis was performed using custom R scripts. The library representation of each sample was quantified by the number of read counts. Raw counts were normalized and log-transformed. Mean values were averaged from biological replicates of the same group (plasmid, unsorted cell or high-kill). FDR values were calculated from the null distribution of the 1,000 NTCs in each variable. Linear regression for the 1,000 NTCs between samples was performed using the 1 m ( ) function.

RT-qPCR (Examples 1-10): For single gene CRISPR/dgRNA activation, 3-5 days after lentivirus transduction, cells were lysed and total RNA was extracted from IM.Cas9 (immortalized hepatocyte as a Cas9-expressing control cell line) and Cas9β CD8+ T cells. For cDNA overexpression, 48 h and 72 h after lentivirus transduction, OT-I CD8+ T cells were collected for RNA preparation. All RNA preparations were performed using RNasy Plus Mini Kit (Qiagen). Gene expression was quantified using Taqman Fast Universal PCR Master Mix (Thermo Fisher) and Taqman probes (Invitrogen). RNA expression was normalized to Gapdh and compared to wells transduced with vector lentivirus. Relative mRNA expression was determined via the $\Delta\Delta\ C_t$ method.

Top candidate validation (Examples 1-4): Candidate hits Prodh2, Ccnblip1, Sreklip1, and Wdr37 were selected for further validation. All cDNAs were purchased from the Dharmacon, followed by cloning into a lentiviral overexpression vector (*lenti*-EF1a-Flag-WPRE vector). Before overexpression lentivirus transduction, OT-I CD8+ T cells were isolated and activated by 2 tion, OT-I CD88 coated plates for 3 days, then T cells were transduced with concentrated lentivirus. At day 6, infected OT-I; Cas9t CD8+ T cells were reseeded on new 6-well plates which were untreated with anti-CD38 and cRPMI-1640 only supplemented with 2 ng/ml IL-2 and 2 ng/mL IL-12p70 to rest cells. At the same time, $5\times10^5$/well of E0771 cells were seeded in 24-well plates for kill assay. The next day, E0771 cells were incubated with 1 ng/mL or 10 ng/mL SIINFEKL (SEQ ID NO. 84,614) peptide for 4 hours. The validation kill assay was performed as previously described. At the end of co-incubation, T cells were gently washed down with PBS and stained with anti-CD8α-APC for 30 min on ice, cells were analyzed using BD FACSAria.

Standard statistical analysis (Examples 1-4): Data between two groups were analyzed using a two-tailed paired t-test. Multiple t-test using the Holm-Sidak method was used for multiple group comparison. A p value less or equal to 0.05 was considered statistically significant. Prism (GraphPad Software Inc.) and RStudio were used for these analyses.

AAV-based HDR donor template construction (Examples 5-10): TRAC homologous recombination arms (HA) were cloned from the both sides of crRNA binding site located in the first exon of TRAC locus. A CD22-CAR sequence, containing a CD22 m971 scFv, 4-1BB intracellular domains, and CD3ζ intracellular domain, was synthesized as a gBlock from IDT. PRODH2 cDNA was purchased from GenScript, then subcloned into a AAV vector. The final vector was named as pLY57_TRAC-LHA-pAAV-EFS-CD22BBz-PRODH2-TRAC-RHA(3166mut). See FIG. 9A. pLY57 TRAC-LHA-pAAV-EFS-CD22BBZ-PRODH2-TRAC-RHA (3166mut) (SEQ ID NO: 84,605)

```
CCTGCAGGCAGCTGCGCGCTCGCTCGCTCACTGAGGCCGCCCGGGCAAAGCC

CGGGCGTCGGGCGACCTTTGGTCGCCCGGCCTCAGTGAGCGAGCGAGCGCGC

AGAGAGGGAGTGGCCAACTCCATCACTAGGGGTTCCTGCGGCCGCACGCGTT

GTCCTAGGTCTTGAAAGGAGTGGGAATTGGCTCCGGTGCCCGTCAGTGGGCA

GAGCGCACATCGCCCACAGTCCCCGAGAAGTTGGGGGGAGGGGTCGGCAATT

GATCCGGTGCCTAGAGAAGGTGGCGCGGGGTAAACTGGGAAAGTGATGTCGT

GTACTGGCTCCGCCTTTTTCCCGAGGGTGGGGGAGAACCGTATATAAGTGCA

GTAGTCGCCGTGAACGTTCTTTTTCGCAACGGGTTTGCCGCCAGAACACAGGA
```

-continued

```
CCGGTTCTAGACGTACGGCCACCTGCTTCTGCTCGTGACAAGCCTGCTGCTGT
GCGAGCTGCCCCACCCTGCCTTTCTGCTGTCCCTCAGGTGCAGCTGCAGCAGT
CTGGCCCTGGCCTCGTGAAGCCTAGCCAGACCCTGGCCTGACCTGTGCCATCA
GCGGCGATAGCGTGTCCAGCAATAGCGCCGCCTGGAACTGGTCAGACAGAGC
CCTAGCAGAGGCCTGGAATGGCTGGGCCGGACCTACTACCGGTCCAAGGGTA
CAACGACTACGCCGTGTCCGTGAAGTCCCGGATCACCATCAACCCCGACACC
AGCAGAACCAGTTCTCCCTGCAGCTGAACAGCGTGACCCCCGAGGATACCGC
CGTGTACTACGCGCCAGAGAAGTGACCGGCGACCTGGAAGATGCCTTCGACA
TCTGGGCCAGGGCACATGGTCACCGTGTCTAGCGGAGGCGGCGGAAGCGAC
ATCCAGATGACACAGAGCCCCAGCCCCTGAGCGCCAGCGTGGGAGACAGAGT
GACCATCACCTGTCGGGCCAGCCAGACCATCGGTCCTACCTGAACTGGTATC
AGCAGCGGCCTGGCAAGGCCCCCAACCTGCTGATCTATCCGCCAGCTCACTG
CAGAGCGGCGTGCCCAGCAGATTTTCCGGCAGAGGCAGCGGCACCACTTCAC
CCTGACAATCAGTTCCCTGCAGGCCGAGGACTTCGCCACCTACTACTGCCAGC
AGAGCTACAGCATCCCCCAGACCTTCGGCCAGGGGACCAAGCTGGAAATCAA
AGCGGCCGCAGGTACCCCACGACGCCAGCGCCGCGACCACCAACACCGGCGC
CCACCATCGCGTCGCAGCCCCTGCCCTGCGCCCAGAGGCATGCCGGCCAGCA
GCAGGGGCGCAGTGCACACGAGGGGCTGACTTCGCCTGTGATATCTACAT
CTGGGCGCCCTTGGCCGGGACTTGTGGGGTCCTTCTCTGTCACTGGTTATCAC
CCTTTACTGCAAACGGGGCAGAAAGAAACTCCTGTATATATTCAACAACCATT
TATGAGACCAGTACAAACTACTCAAGAGGAAGATGGCTGTAGCTGCCGATTC
CAGAAGAAGAAGAAGGAGGATGTGAACTGAGAGTGAAGTTCAGCAGGAGCG
CAGACCCCCCGCGTACCAGCAGGGCCAGAACCAGCTCTATAACGAGCTCAAT
CTAGGACGAAGAAGGAGTACGATGTTTTGGACAAGAGACGTGGCCGGGACCC
TGAGATGGGGGGAAAGCCGGAAGGAAGAACCCTCAGGAAGGCCTGTACAAT
GAACTGCAGAAAGATAAGATGGCGGAGCCTACAGTGAGATTGGGATGAAAG
GCGAGCGCCGGAGGGGCAAGGGGCACGATGGCCTTACCAGGGTCTCAGTACA
GCCACCAAGGACACCTACGACGCCCTTCACATGCAGGCCCTGCCCCTCGCGG
CAGTGGAGAGGGCAGAGGAAGTCTGCTAACATGCGGTGACGTCGAGGAGAA
TCCTGGCCCAGGTACCACGGACCGAGCGGCCGCAGGAACCCCTAGTGATGGA
GTTGGCCACTCCCTCTCTGCGCGCTCGCTCGCTCACTGAGGCCGGGCGACCAA
AGGTCGCCCGACGCCCGGGCTTTGCCCGGGCGGCCTCAGTGAGCGAGCGAGC
GCGCAGCTGCCTGCAGGGGCGCCTGATGCGGTATTTTCTCCTTACGCATCTGT
GCGGTATTTCACACCGCATACGTCAAAGCAACCATAGTACGCGCCCTGTAGC
GGCGCATTAAGCGCGGCGGGTGTGGTGGTTACGCGCAGCGTGACCGCTACAC
TTGCCAGCGCCCTAGCGCCCGCTCCTTTCGCTTTCTTCCCTTCCTTTCTCGCCA
CGTTCGCCGGCTTTCCCCGTCAAGCTCTAAATCGGGGGCTCCCTTTAGGGTTC
CGATTTAGTGCTTTACGGCACCTCGACCCCAAAAAACTTGATTTGGGTGATGG
TTCACGTAGTGGGCCATCGCCCTGATAGACGGTTTTTCGCCCTTTGACGTTGG
AGTCCACGTTCTTTAATAGTGGACTCTTGTTCCAAACTGGAACAACACTCAAC
```

-continued
```
CCTATCTCGGGCTATTCTTTTGATTTATAAGGGATTTTGCCGATTTCGGCCTAT

TGGTTAAAAAATGAGCTGATTTAACAAAAATTTAACGCGAATTTTAACAAAA

TATTAACGTTTACAATTTTATGGTGCACTCTCAGTACAATCTGCTCTGATGCCG

CATAGTTAAGCCAGCCCCGACACCCGCCAACACCCGCTGACGCGCCCTGACG

GGCTTGTCTGCTCCCGGCATCCGCTTACAGACAAGCTGTGACCGTCTCCGGGA

GCTGCATGTGTCAGAGGTTTTCACCGTCATCACCGAAACGCGCGAGACGAAA

GGGCCTCGTGATACGCCTATTTTTATAGGTTAATGTCATGATAATAATGGTTT

CTTAGACGTCAGGTGGCACTTTTCGGGGAAATGTGCGCGGAACCCCTATTTGT

TTATTTTTCTAAATACATTCAAATATGTATCCGCTCATGAGACAATAACCCTG

ATAAATGCTTCAATAATATTGAAAAAGGAAGAGTATGAGTATTCAACATTTC

CGTGTCGCCCTTATTCCCTTTTTGCGGCATTTTGCCTTCCTGTTTTTGCTCACC

CAGAAACGCTGGTGAAAGTAAAAGATGCTGAAGATCAGTTGGGTGCACGAGT

GGGTTACATCGAACTGGATCTCAACAGCGGTAAGATCCTTGAGAGTTTTCGCC

CCGAAGAACGTTTTCCAATGATGAGCACTTTTAAAGTTCTGCTATGTGGCGCG

GTATTATCCCGTATTGACGCCGGGCAAGAGCAACTCGGTCGCCGCATACACT

ATTCTCAGAATGACTTGGTTGAGTACTCACCAGTCACAGAAAAGCATCTTACG

GATGGCATGACAGTAAGAGAATTATGCAGTGCTGCCATAACCATGAGTGATA

ACACTGCGGCCAACTTACTTCTGACAACGATCGGAGGACCGAAGGAGCTAAC

CGCTTTTTTGCACAACATGGGGGATCATGTAACTCGCCTTGATCGTTGGGAAC

CGGAGCTGAATGAAGCCATACCAAACGACGAGCGTGACACCACGATGCCTGT

AGCAATGGCAACAACGTTGCGCAAACTATTAACTGGCGAACTACTTACTCTA

GCTTCCCGGCAACAATTAATAGACTGGATGGAGGCGGATAAAGTTGCAGGAC

CACTTCTGCGCTCGGCCCTTCCGGCTGGCTGGTTTATTGCTGATAAATCTGGA

GCCGGTGAGCGTGGGTCTCGCGGTATCATTGCAGCACTGGGGCCAGATGGTA

AGCCCTCCCGTATCGTAGTTATCTACACGACGGGGAGTCAGGCAACTATGGA

TGAACGAAATAGACAGATCGCTGAGATAGGTGCCTCACTGATTAAGCATTGG

TAACTGTCAGACCAAGTTTACTCATATATACTTTAGATTGATTTAAAACTTCA

TTTTTAATTTAAAAGGATCTAGGTGAAGATCCTTTTTGATAATCTCATGACCA

AAATCCCTTAACGTGAGTTTTCGTTCCACTGAGCGTCAGACCCCGTAGAAAAG

ATCAAAGGATCTTCTTGAGATCCTTTTTTTCTGCGCGTAATCTGCTGCTTGCAA

ACAAAAAAACCACCGCTACCAGCGGTGGTTTGTTTGCCGGATCAAGAGCTAC

CAACTCTTTTTCCGAAGGTAACTGGCTTCAGCAGAGCGCAGATACCAAATACT

GTCCTTCTAGTGTAGCCGTAGTTAGGCCACCACTTCAAGAACTCTGTAGCACC

GCCTACATACCTCGCTCTGCTAATCCTGTTACCAGTGGCTGCTGCCAGTGGCG

ATAAGTCGTGTCTTACCGGGTTGGACTCAAGACGATAGTTACCGGATAAGGC

GCAGCGGTCGGGCTGAACGGGGGGTTCGTGCACACAGCCCAGCTTGGAGCGA

ACGACCTACACCGAACTGAGATACCTACAGCGTGAGCTATGAGAAAGCGCCA

CGCTTCCCGAAGGGAGAAAGGCGGACAGGTATCCGGTAAGCGGCAGGGTCG

GAACAGGAGAGCGCACGAGGGAGCTTCCAGGGGGAAACGCCTGGTATCTTTA
```

-continued

```
TAGTCCTGTCGGGTTTCGCCACCTCTGACTTGAGCGTCGATTTTTGTGATGCTC

GTCAGGGGGCGGAGCCTATGGAAAAACGCCAGCAACGCGGCCTTTTTACGG

TTCCTGGCCTTTTGCTGGCCTTTTGCTCACATGT
```

Control vectors were also generated with a stop codon in PRODH2 (See FIGS. 9A-9D) and with a mutation in PRODH2 (catalytic domain mutant of PRODH2 CAR construct with specific amino acid substitutions to kill the catalytic activity). pLY59 TRAC-LHA-pAAV-EFS-CD22BBz-PRODH2 (STOP)-TRAC-RHA (3166mut) (SEQ ID NO: 84,606):

```
plY59_TRAC-LHA-pAAV-EFS-CD22BBz-PRODH2(STOP)-TRAC-RHA(3166mut)
(SEQ ID NO: 84,606):
CCTGCAGGCAGCTGCGCGCTCGCTCGCTCACTGAGGCCGCCCGGGCAAAGCC

CGGGCGTCGGGCGACCTTTGGTCGCCCGGCCTCAGTGAGCGAGCGAGCGCGC

AGAGAGGGAGTGGCCAACTCCATCACTAGGGGTTCCTGCGGCCGCACGCGTT

GTCCTAGGTCTTGAAAGGAGTGGGAATTGGCTCCGGTGCCCGTCAGTGGGCA

GAGCGCACATCGCCCACAGTCCCCGAGAAGTTGGGGGGAGGGGTCGGCAATT

GATCCGGTGCCTAGAGAAGGTGGCGCGGGGTAAACTGGGAAAGTGATGTCGT

GTACTGGCTCCGCCTTTTTCCCGAGGGTGGGGGAGAACCGTATATAAGTGCA

GTAGTCGCCGTGAACGTTCTTTTTCGCAACGGGTTTGCCGCCAGAACACAGGA

CCGGTTCTAGACGTACGGCCACCTGCTTCTGCTCGTGACAAGCCTGCTGCTGT

GCGAGCTGCCCCACCCTGCCTTTCTGCTGTCCCTCAGGTGCAGCTGCAGCAGT

CTGGCCCTGGCCTCGTGAAGCCTAGCCAGACCCTGGCCTGACCTGTGCCATCA

GCGGCGATAGCGTGTCCAGCAATAGCGCCGCCTGGAACTGGTCAGACAGAGC

CCTAGCAGAGGCCTGGAATGGCTGGGCCGGACCTACTACCGGTCCAAGGGTA

CAACGACTACGCCGTGTCCGTGAAGTCCCGGATCACCATCAACCCCGACACC

AGCAGAACCAGTTCTCCCTGCAGCTGAACAGCGTGACCCCCGAGGATACCGC

CGTGTACTACGCGCCAGAGAAGTGACCGGCGACCTGGAAGATGCCTTCGACA

TCTGGGGCCAGGGCACATGGTCACCGTGTCTAGCGGAGGCGGCGGAAGCGAC

ATCCAGATGACACAGAGCCCCAGCCCCTGAGCGCCAGCGTGGGAGACAGAGT

GACCATCACCTGTCGGGCCAGCCAGACCATCGGTCCTACCTGAACTGGTATC

AGCAGCGGCCTGGCAAGGCCCCCAACCTGCTGATCTATCCGCCAGCTCACTG

CAGAGCGGCGTGCCCAGCAGATTTTCCGGCAGAGGCAGCGGCACCACTTCAC

CCTGACAATCAGTTCCCTGCAGGCCGAGGACTTCGCCACCTACTACTGCCAGC

AGAGCTACAGCATCCCCCAGACCTTCGGCCAGGGGACCAAGCTGGAAATCAA

AGCGGCCGCAGGTACCCCACGACGCCAGCGCCGCGACCACCAACACCGGCGC

CCACCATCGCGTCGCAGCCCCTGCCCTGCGCCCAGAGGCATGCCGGCCAGCA

GCAGGGGCGCAGTGCACACGAGGGGGCTGACTTCGCCTGTGATATCTACAT

CTGGGCGCCCTTGGCCGGGACTTGTGGGGTCCTTCTCTGTCACTGGTTATCAC

CCTTTACTGCAAACGGGGCAGAAAGAAACTCCTGTATATATTCAACAACCATT

TATGAGACCAGTACAAACTACTCAAGAGGAAGATGGCTGTAGCTGCCGATTC

CAGAAGAAGAAGAAGGAGGATGTGAACTGAGAGTGAAGTTCAGCAGGAGCG

CAGACCCCCCGCGTACCAGCAGGGCCAGAACCAGCTCTATAACGAGCTCAAT
```

-continued

```
CTAGGACGAAGAAGGAGTACGATGTTTTGGACAAGAGACGTGGCCGGGACCC

TGAGATGGGGGAAAGCCGGAAGGAAGAACCCTCAGGAAGGCCTGTACAAT

GAACTGCAGAAAGATAAGATGGCGGAGCCTACAGTGAGATTGGGATGAAAG

GCGAGCGCCGGAGGGGCAAGGGGCACGATGGCCTTACCAGGGTCTCAGTACA

GCCACCAAGGACACCTACGACGCCCTTCACATGCAGGCCCTGCCCCTCGCGG

CAGTGGAGAGGGCAGAGGAAGTCTGCTAACATGCGGTGACGTCGAGGAGAA

TCCTGGCCCATAATAGTGAGGTACCACGGACCGAGCGGCCGCAGGAACCCCT

AGTGATGGAGTTGGCCACTCCCTCTCTGCGCGCTCGCTCGCTCACTGAGGCCG

GGCGACCAAAGGTCGCCCGACGCCCGGGCTTTGCCCGGGCGGCCTCAGTGAG

CGAGCGAGCGCGCAGCTGCCTGCAGGGGCGCCTGATGCGGTATTTTCTCCTTA

CGCATCTGTGCGGTATTTCACACCGCATACGTCAAAGCAACCATAGTACGCGC

CCTGTAGCGGCGCATTAAGCGCGGCGGGTGTGGTGGTTACGCGCAGCGTGAC

CGCTACACTTGCCAGCGCCCTAGCGCCCGCTCCTTTCGCTTTCTTCCCTTCCTT

TCTCGCCACGTTCGCCGGCTTTCCCCGTCAAGCTCTAAATCGGGGGCTCCCTT

TAGGGTTCCGATTTAGTGCTTTACGGCACCTCGACCCCAAAAAACTTGATTTG

GGTGATGGTTCACGTAGTGGGCCATCGCCCTGATAGACGGTTTTTCGCCCTTT

GACGTTGGAGTCCACGTTCTTTAATAGTGGACTCTTGTTCCAAACTGGAACAA

CACTCAACCCTATCTCGGGCTATTCTTTTGATTTATAAGGGATTTTGCCGATTT

CGGCCTATTGGTTAAAAAATGAGCTGATTTAACAAAAATTTAACGCGAATTTT

AACAAAATATTAACGTTTACAATTTTATGGTGCACTCTCAGTACAATCTGCTC

TGATGCCGCATAGTTAAGCCAGCCCCGACACCCGCCAACACCCGCTGACGCG

CCCTGACGGGCTTGTCTGCTCCCGGCATCCGCTTACAGACAAGCTGTGACCGT

CTCCGGGAGCTGCATGTGTCAGAGGTTTTCACCGTCATCACCGAAACGCGCG

AGACGAAAGGGCCTCGTGATACGCCTATTTTTATAGGTTAATGTCATGATAAT

AATGGTTTCTTAGACGTCAGGTGGCACTTTTCGGGGAAATGTGCGCGGAACCC

CTATTTGTTTATTTTTCTAAATACATTCAAATATGTATCCGCTCATGAGACAAT

AACCCTGATAAATGCTTCAATAATATTGAAAAAGGAAGAGTATGAGTATTCA

ACATTTCCGTGTCGCCCTTATTCCCTTTTTTGCGGCATTTTGCCTTCCTGTTTTT

GCTCACCCAGAAACGCTGGTGAAAGTAAAAGATGCTGAAGATCAGTTGGGTG

CACGAGTGGGTTACATCGAACTGGATCTCAACAGCGGTAAGATCCTTGAGAG

TTTTCGCCCCGAAGAACGTTTTCCAATGATGAGCACTTTTAAAGTTCTGCTAT

GTGGCGCGGTATTATCCCGTATTGACGCCGGGCAAGAGCAACTCGGTCGCCG

CATACACTATTCTCAGAATGACTTGGTTGAGTACTCACCAGTCACAGAAAAGC

ATCTTACGGATGGCATGACAGTAAGAGAATTATGCAGTGCTGCCATAACCAT

GAGTGATAACACTGCGGCCAACTTACTTCTGACAACGATCGGAGGACCGAAG

GAGCTAACCGCTTTTTTGCACAACATGGGGGATCATGTAACTCGCCTTGATCG

TTGGGAACCGGAGCTGAATGAAGCCATACCAAACGACGAGCGTGACACCACG

ATGCCTGTAGCAATGGCAACAACGTTGCGCAAACTATTAACTGGCGAACTAC

TTACTCTAGCTTCCCGGCAACAATTAATAGACTGGATGGAGGCGGATAAAGT

TGCAGGACCACTTCTGCGCTCGGCCCTTCCGGCTGGCTGGTTTATTGCTGATA
```

```
AATCTGGAGCCGGTGAGCGTGGGTCTCGCGGTATCATTGCAGCACTGGGGCC

AGATGGTAAGCCCTCCCGTATCGTAGTTATCTACACGACGGGGAGTCAGGCA

ACTATGGATGAACGAAATAGACAGATCGCTGAGATAGGTGCCTCACTGATTA

AGCATTGGTAACTGTCAGACCAAGTTTACTCATATATACTTTAGATTGATTTA

AAACTTCATTTTTAATTTAAAAGGATCTAGGTGAAGATCCTTTTTGATAATCT

CATGACCAAAATCCCTTAACGTGAGTTTTCGTTCCACTGAGCGTCAGACCCCG

TAGAAAAGATCAAAGGATCTTCTTGAGATCCTTTTTTTCTGCGCGTAATCTGC

TGCTTGCAAACAAAAAAACCACCGCTACCAGCGGTGGTTTGTTTGCCGGATC

AAGAGCTACCAACTCTTTTTCCGAAGGTAACTGGCTTCAGCAGAGCGCAGAT

ACCAAATACTGTCCTTCTAGTGTAGCCGTAGTTAGGCCACCACTTCAAGAACT

CTGTAGCACCGCCTACATACCTCGCTCTGCTAATCCTGTTACCAGTGGCTGCT

GCCAGTGGCGATAAGTCGTGTCTTACCGGGTTGGACTCAAGACGATAGTTAC

CGGATAAGGCGCAGCGGTCGGGCTGAACGGGGGGTTCGTGCACACAGCCCAG

CTTGGAGCGAACGACCTACACCGAACTGAGATACCTACAGCGTGAGCTATGA

GAAAGCGCCACGCTTCCCGAAGGGAGAAAGGCGGACAGGTATCCGGTAAGC

GGCAGGGTCGGAACAGGAGAGCGCACGAGGGAGCTTCCAGGGGGAAACGCC

TGGTATCTTTATAGTCCTGTCGGGTTTCGCCACCTCTGACTTGAGCGTCGATTT

TTGTGATGCTCGTCAGGGGGCGGAGCCTATGGAAAAACGCCAGCAACGCGG

CCTTTTTACGGTTCCTGGCCTTTTGCTGGCCTTTTGCTCACATGT pLY58_TRAC-LHA-pAAV-EFS-CD22BBz-PRODH2(Mut)-TRAC-RHA(3166mut)
(SEQ ID NO: 84,607);
CCTGCAGGCAGCTGCGCGCTCGCTCGCTCACTGAGGCCGCCCGGGCAAAGCC

CGGGCGTCGGGCGACCTTTGGTCGCCCGGCCTCAGTGAGCGAGCGAGCGCGC

AGAGAGGGAGTGGCCAACTCCATCACTAGGGGTTCCTGCGGCCGCACGCGTT

GTCCTAGGTCTTGAAAGGAGTGGGAATTGGCTCCGGTGCCCGTCAGTGGGCA

GAGCGCACATCGCCCACAGTCCCCGAGAAGTTGGGGGGAGGGGTCGGCAATT

GATCCGGTGCCTAGAGAAGGTGGCGCGGGGTAAACTGGGAAAGTGATGTCGT

GTACTGGCTCCGCCTTTTTCCCGAGGGTGGGGGAGAACCGTATATAAGTGCA

GTAGTCGCCGTGAACGTTCTTTTTCGCAACGGGTTTGCCGCCAGAACACAGGA

CCGGTTCTAGACGTACGGCCACCTGCTTCTGCTCGTGACAAGCCTGCTGCTGT

GCGAGCTGCCCCACCCTGCCTTTCTGCTGTCCCTCAGGTGCAGCTGCAGCAGT

CTGGCCCTGGCCTCGTGAAGCCTAGCCAGACCCTGGCCTGACCTGTGCCATCA

GCGGCGATAGCGTGTCCAGCAATAGCGCCGCCTGGAACTGGTCAGACAGAGC

CCTAGCAGAGGCCTGGAATGGCTGGGCCGGACCTACTACCGGTCCAAGGGTA

CAACGACTACGCCGTGTCCGTGAAGTCCCGGATCACCATCAACCCCGACACC

AGCAGAACCAGTTCTCCCTGCAGCTGAACAGCGTGACCCCCGAGGATACCGC

CGTGTACTACGCGCCAGAGAAGTGACCGGCGACCTGGAAGATGCCTTCGACA

TCTGGGGCCAGGGCACATGGTCACCGTGTCTAGCGGAGGCGGCGGAAGCGAC

ATCCAGATGACACAGAGCCCCAGCCCCTGAGCGCCAGCGTGGGAGACAGAGT

GACCATCACCTGTCGGGCCAGCCAGACCATCGGTCCTACCTGAACTGGTATC

AGCAGCGGCCTGGCAAGGCCCCCAACCTGCTGATCTATCCGCCAGCTCACTG

CAGAGCGGCGTGCCCAGCAGATTTTCCGGCAGAGGCAGCGGCACCACTTCAC
```

-continued

```
CCTGACAATCAGTTCCCTGCAGGCCGAGGACTTCGCCACCTACTACTGCCAGC

AGAGCTACAGCATCCCCCAGACCTTCGGCCAGGGGACCAAGCTGGAAATCAA

AGCGGCCGCAGGTACCCCACGACGCCAGCGCCGCGACCACCAACACCGGCGC

CCACCATCGCGTCGCAGCCCCTGCCCTGCGCCCAGAGGCATGCCGGCCAGCA

GCAGGGGGCGCAGTGCACACGAGGGGGCTGACTTCGCCTGTGATATCTACAT

CTGGGCGCCCTTGGCCGGGACTTGTGGGGTCCTTCTCTGTCACTGGTTATCAC

CCTTTACTGCAAACGGGGCAGAAAGAAACTCCTGTATATATTCAACAACCATT

TATGAGACCAGTACAAACTACTCAAGAGGAAGATGGCTGTAGCTGCCGATTC

CAGAAGAAGAAGAAGGAGGATGTGAACTGAGAGTGAAGTTCAGCAGGAGCG

CAGACCCCCGCGTACCAGCAGGGCCAGAACCAGCTCTATAACGAGCTCAAT

CTAGGACGAAGAAGGAGTACGATGTTTTGGACAAGAGACGTGGCCGGGACCC

TGAGATGGGGGAAAGCCGGAAGGAAGAACCCTCAGGAAGGCCTGTACAAT

GAACTGCAGAAAGATAAGATGGCGGAGCCTACAGTGAGATTGGGATGAAAG

GCGAGCGCCGGAGGGGCAAGGGGCACGATGGCCTTACCAGGGTCTCAGTACA

GCCACCAAGGACACCTACGACGCCCTTCACATGCAGGCCCTGCCCCTCGCGG

CAGTGGAGAGGGCAGAGGAAGTCTGCTAACATGCGGTGACGTCGAGGAGAA

TCCTGGCCCAGCTGCTGCCGCTGCCGGTACCACGGACCGAGCGGCCGCAGGA

ACCCCTAGTGATGGAGTTGGCCACTCCCTCTCTGCGCGCTCGCTCGCTCACTG

AGGCCGGGCGACCAAAGGTCGCCCGACGCCCGGGCTTTGCCCGGGCGGCCTC

AGTGAGCGAGCGAGCGCGCAGCTGCCTGCAGGGGCGCCTGATGCGGTATTTT

CTCCTTACGCATCTGTGCGGTATTTCACACCGCATACGTCAAAGCAACCATAG

TACGCGCCCTGTAGCGGCGCATTAAGCGCGGCGGGTGTGGTGGTTACGCGCA

GCGTGACCGCTACACTTGCCAGCGCCCTAGCGCCCGCTCCTTTCGCTTTCTTC

CCTTCCTTTCTCGCCACGTTCGCCGGCTTTCCCCGTCAAGCTCTAAATCGGGG

GCTCCCTTTAGGGTTCCGATTTAGTGCTTTACGGCACCTCGACCCCAAAAAAC

TTGATTTGGGTGATGGTTCACGTAGTGGGCCATCGCCCTGATAGACGGTTTTT

CGCCCTTTGACGTTGGAGTCCACGTTCTTTAATAGTGGACTCTTGTTCCAAACT

GGAACAACACTCAACCCTATCTCGGGCTATTCTTTTGATTTATAAGGGATTTT

GCCGATTTCGGCCTATTGGTTAAAAAATGAGCTGATTTAACAAAAATTTAACG

CGAATTTTAACAAAATATTAACGTTTACAATTTTATGGTGCACTCTCAGTACA

ATCTGCTCTGATGCCGCATAGTTAAGCCAGCCCCGACACCCGCCAACACCCG

CTGACGCGCCCTGACGGGCTTGTCTGCTCCCGGCATCCGCTTACAGACAAGCT

GTGACCGTCTCCGGGAGCTGCATGTGTCAGAGGTTTTCACCGTCATCACCGAA

ACGCGCGAGACGAAAGGGCCTCGTGATACGCCTATTTTTATAGGTTAATGTCA

TGATAATAATGGTTTCTTAGACGTCAGGTGGCACTTTTCGGGGAAATGTGCGC

GGAACCCCTATTTGTTTATTTTTCTAAATACATTCAAATATGTATCCGCTCATG

AGACAATAACCCTGATAAATGCTTCAATAATATTGAAAAAGGAAGAGTATGA

GTATTCAACATTTCCGTGTCGCCCTTATTCCCTTTTTTGCGGCATTTTGCCTTCC

TGTTTTTGCTCACCCAGAAACGCTGGTGAAAGTAAAAGATGCTGAAGATCAG

TTGGGTGCACGAGTGGGTTACATCGAACTGGATCTCAACAGCGGTAAGATCC
```

-continued

TTGAGAGTTTTCGCCCCGAAGAACGTTTTCCAATGATGAGCACTTTTAAAGTT

CTGCTATGTGGCGCGGTATTATCCCGTATTGACGCCGGGCAAGAGCAACTCG

GTCGCCGCATACACTATTCTCAGAATGACTTGGTTGAGTACTCACCAGTCACA

GAAAAGCATCTTACGGATGGCATGACAGTAAGAGAATTATGCAGTGCTGCCA

TAACCATGAGTGATAACACTGCGGCCAACTTACTTCTGACAACGATCGGAGG

ACCGAAGGAGCTAACCGCTTTTTTGCACAACATGGGGGATCATGTAACTCGC

CTTGATCGTTGGGAACCGGAGCTGAATGAAGCCATACCAAACGACGAGCGTG

ACACCACGATGCCTGTAGCAATGGCAACAACGTTGCGCAAACTATTAACTGG

CGAACTACTTACTCTAGCTTCCCGGCAACAATTAATAGACTGGATGGAGGCG

GATAAAGTTGCAGGACCACTTCTGCGCTCGGCCCTTCCGGCTGGCTGGTTTAT

TGCTGATAAATCTGGAGCCGGTGAGCGTGGGTCTCGCGGTATCATTGCAGCA

CTGGGGCCAGATGGTAAGCCCTCCCGTATCGTAGTTATCTACACGACGGGGA

GTCAGGCAACTATGGATGAACGAAATAGACAGATCGCTGAGATAGGTGCCTC

ACTGATTAAGCATTGGTAACTGTCAGACCAAGTTTACTCATATATACTTTAGA

TTGATTTAAAACTTCATTTTTAATTTAAAAGGATCTAGGTGAAGATCCTTTTTG

ATAATCTCATGACCAAAATCCCTTAACGTGAGTTTTCGTTCCACTGAGCGTCA

GACCCCGTAGAAAAGATCAAAGGATCTTCTTGAGATCCTTTTTTTCTGCGCGT

AATCTGCTGCTTGCAAACAAAAAAACCACCGCTACCAGCGGTGGTTTGTTTGC

CGGATCAAGAGCTACCAACTCTTTTTCCGAAGGTAACTGGCTTCAGCAGAGC

GCAGATACCAAATACTGTCCTTCTAGTGTAGCCGTAGTTAGGCCACCACTTCA

AGAACTCTGTAGCACCGCCTACATACCTCGCTCTGCTAATCCTGTTACCAGTG

GCTGCTGCCAGTGGCGATAAGTCGTGTCTTACCGGGTTGGACTCAAGACGAT

AGTTACCGGATAAGGCGCAGCGGTCGGGCTGAACGGGGGGTTCGTGCACACA

GCCCAGCTTGGAGCGAACGACCTACACCGAACTGAGATACCTACAGCGTGAG

CTATGAGAAAGCGCCACGCTTCCCGAAGGGAGAAAGGCGGACAGGTATCCG

GTAAGCGGCAGGGTCGGAACAGGAGAGCGCACGAGGGAGCTTCCAGGGGGA

AACGCCTGGTATCTTTATAGTCCTGTCGGGTTTCGCCACCTCTGACTTGAGCG

TCGATTTTTGTGATGCTCGTCAGGGGGCGGAGCCTATGGAAAAACGCCAGC

AACGCGGCCTTTTTACGGTTCCTGGCCTTTTGCTGGCCTTTTGCTCACATGT pLY55_TRAC-LHA-pAAV-U6LbcrTRAC-EFS-CD22BBz-PRODH2-TRAC-
RHA(3166mut) (SEQ ID NO: 84,608):
CCTGCAGGCAGCTGCGCGCTCGCTCGCTCACTGAGGCCGCCCGGGCAAAGCC

CGGGCGTCGGGCGACCTTTGGTCGCCCGGCCTCAGTGAGCGAGCGAGCGCGC

AGAGAGGGAGTGGCCAACTCCATCACTAGGGGTTCCTGCGGCCGCACGCGTG

TCGCGTTCTAGAAGAGGGCCTATTTCCCATGATTCCTTCATATTTGCATATAC

GATACAAGGCTGTTAGAGAGATAATTGGAATTAATTTGACTGTAAACACAAA

GATATTAGTACAAAATACGTGACGTAGAAAGTAATAATTTCTTGGGTAGTTTG

CAGTTTTAAAATTATGTTTTAAAATGGACTATCATATGCTTACCGTAACTTGA

AAGTATTTCGATTTCTTGGCTTTATATATCTTGAAGCTTGGCGTAACTAGATCT

TGAGACAAGGTACCTAGGTCTTGAAAGGAGTGGGAATTGGCTCCGGTGCCCG

TCAGTGGGCAGAGCGCACATCGCCCACAGTCCCCGAGAAGTTGGGGGGAGGG

GTCGGCAATTGATCCGGTGCCTAGAGAAGGTGGCGCGGGGTAAACTGGGAAA

-continued

```
GTGATGTCGTGTACTGGCTCCGCCTTTTTCCCGAGGGTGGGGGAGAACCGTAT

ATAAGTGCAGTAGTCGCCGTGAACGTTCTTTTTCGCAACGGGTTTGCCGCCAG

AACACAGGACCGGTTCTAGACGTACGGCCACCTGCTTCTGCTCGTGACAAGC

CTGCTGCTGTGCGAGCTGCCCCACCCTGCCTTTCTGCTGTCCCTCAGGTGCAG

CTGCAGCAGTCTGGCCCTGGCCTCGTGAAGCCTAGCCAGACCCTGGCCTGAC

CTGTGCCATCAGCGGCGATAGCGTGTCCAGCAATAGCGCCGCCTGGAACTGG

TCAGACAGAGCCCTAGCAGAGGCCTGGAATGGCTGGGCCGGACCTACTACCG

GTCCAAGGGTACAACGACTACGCCGTGTCCGTGAAGTCCCGGATCACCATCA

ACCCCGACACCAGCAGAACCAGTTCTCCCTGCAGCTGAACAGCGTGACCCCC

GAGGATACCGCCGTGTACTACGCGCCAGAGAAGTGACCGGCGACCTGGAAGA

TGCCTTCGACATCTGGGGCCAGGGCACATGGTCACCGTGTCTAGCGGAGGCG

GCGGAAGCGACATCCAGATGACACAGAGCCCCAGCCCCTGAGCGCCAGCGTG

GGAGACAGAGTGACCATCACCTGTCGGGCCAGCCAGACCATCGGTCCTACCT

GAACTGGTATCAGCAGCGGCCTGGCAAGGCCCCCAACCTGCTGATCTATCCG

CCAGCTCACTGCAGAGCGGCGTGCCCAGCAGATTTTCCGGCAGAGGCAGCGG

CACCACTTCACCCTGACAATCAGTTCCCTGCAGGCCGAGGACTTCGCCACCTA

CTACTGCCAGCAGAGCTACAGCATCCCCCAGACCTTCGGCCAGGGGACCAAG

CTGGAAATCAAAGCGGCCGCAGGTACCCCACGACGCCAGCGCCGCGACCACC

AACACCGGCGCCCACCATCGCGTCGCAGCCCCTGCCCTGCGCCCAGAGGCAT

GCCGGCCAGCAGCAGGGGCGCAGTGCACACGAGGGGGCTGACTTCGCCTGT

GATATCTACATCTGGGCGCCCTTGGCCGGGACTTGTGGGGTCCTTCTCTGTCA

CTGGTTATCACCCTTTACTGCAAACGGGGCAGAAAGAAACTCCTGTATATATT

CAACAACCATTTATGAGACCAGTACAAACTACTCAAGAGGAAGATGGCTGTA

GCTGCCGATTCCAGAAGAAGAAGAAGGAGGATGTGAACTGAGAGTGAAGTT

CAGCAGGAGCGCAGACCCCCCGCGTACCAGCAGGGCCAGAACCAGCTCTATA

ACGAGCTCAATCTAGGACGAAGAAGGAGTACGATGTTTTGGACAAGAGACGT

GGCCGGGACCCTGAGATGGGGGGAAAGCCGGAAGGAAGAACCCTCAGGAAG

GCCTGTACAATGAACTGCAGAAAGATAAGATGGCGGAGCCTACAGTGAGATT

GGGATGAAAGGCGAGCGCCGGAGGGGCAAGGGGCACGATGGCCTTACCAGG

GTCTCAGTACAGCCACCAAGGACACCTACGACGCCCTTCACATGCAGGCCCT

GCCCCTCGCGGCAGTGGAGAGGGCAGAGGAAGTCTGCTAACATGCGGTGACG

TCGAGGAGAATCCTGGCCCAGACTACAAAGACCATGACGGTGATTATAAAGA

TCATGACATCGGTACCACGGACCGAGCGGCCGCAGGAACCCCTAGTGATGGA

GTTGGCCACTCCCTCTCTGCGCGCTCGCTCGCTCACTGAGGCCGGGCGACCAA

AGGTCGCCCGACGCCCGGGCTTTGCCCGGGCGGCCTCAGTGAGCGAGCGAGC

GCGCAGCTGCCTGCAGGGGCGCCTGATGCGGTATTTTCTCCTTACGCATCTGT

GCGGTATTTCACACCGCATACGTCAAAGCAACCATAGTACGCGCCCTGTAGC

GGCGCATTAAGCGCGGCGGGTGTGGTGGTTACGCGCAGCGTGACCGCTACAC

TTGCCAGCGCCCTAGCGCCCGCTCCTTTCGCTTTCTTCCCTTCCTTTCTCGCCA

CGTTCGCCGGCTTTCCCCGTCAAGCTCTAAATCGGGGGCTCCCTTTAGGGTTC
```

-continued

```
CGATTTAGTGCTTTACGGCACCTCGACCCCAAAAAACTTGATTTGGGTGATGG
TTCACGTAGTGGGCCATCGCCCTGATAGACGGTTTTTCGCCCTTTGACGTTGG
AGTCCACGTTCTTTAATAGTGGACTCTTGTTCCAAACTGGAACAACACTCAAC
CCTATCTCGGGCTATTCTTTTGATTTATAAGGGATTTTGCCGATTTCGGCCTAT
TGGTTAAAAAATGAGCTGATTTAACAAAAATTTAACGCGAATTTTAACAAAA
TATTAACGTTTACAATTTTATGGTGCACTCTCAGTACAATCTGCTCTGATGCCG
CATAGTTAAGCCAGCCCCGACACCCGCCAACACCCGCTGACGCGCCCTGACG
GGCTTGTCTGCTCCCGGCATCCGCTTACAGACAAGCTGTGACCGTCTCCGGGA
GCTGCATGTGTCAGAGGTTTTCACCGTCATCACCGAAACGCGCGAGACGAAA
GGGCCTCGTGATACGCCTATTTTTATAGGTTAATGTCATGATAATAATGGTTT
CTTAGACGTCAGGTGGCACTTTTCGGGGAAATGTGCGCGGAACCCCTATTTGT
TTATTTTTCTAAATACATTCAAATATGTATCCGCTCATGAGACAATAACCCTG
ATAAATGCTTCAATAATATTGAAAAAGGAAGAGTATGAGTATTCAACATTTC
CGTGTCGCCCTTATTCCCTTTTTGCGGCATTTTGCCTTCCTGTTTTTGCTCACC
CAGAAACGCTGGTGAAAGTAAAAGATGCTGAAGATCAGTTGGGTGCACGAGT
GGGTTACATCGAACTGGATCTCAACAGCGGTAAGATCCTTGAGAGTTTTCGCC
CCGAAGAACGTTTTCCAATGATGAGCACTTTTAAAGTTCTGCTATGTGGCGCG
GTATTATCCCGTATTGACGCCGGGCAAGAGCAACTCGGTCGCCGCATACACT
ATTCTCAGAATGACTTGGTTGAGTACTCACCAGTCACAGAAAAGCATCTTACG
GATGGCATGACAGTAAGAGAATTATGCAGTGCTGCCATAACCATGAGTGATA
ACACTGCGGCCAACTTACTTCTGACAACGATCGGAGGACCGAAGGAGCTAAC
CGCTTTTTTGCACAACATGGGGGATCATGTAACTCGCCTTGATCGTTGGGAAC
CGGAGCTGAATGAAGCCATACCAAACGACGAGCGTGACACCACGATGCCTGT
AGCAATGGCAACAACGTTGCGCAAACTATTAACTGGCGAACTACTTACTCTA
GCTTCCCGGCAACAATTAATAGACTGGATGGAGGCGGATAAAGTTGCAGGAC
CACTTCTGCGCTCGGCCCTTCCGGCTGGCTGGTTTATTGCTGATAAATCTGGA
GCCGGTGAGCGTGGGTCTCGCGGTATCATTGCAGCACTGGGGCCAGATGGTA
AGCCCTCCCGTATCGTAGTTATCTACACGACGGGGAGTCAGGCAACTATGGA
TGAACGAAATAGACAGATCGCTGAGATAGGTGCCTCACTGATTAAGCATTGG
TAACTGTCAGACCAAGTTTACTCATATATACTTTAGATTGATTTAAAACTTCA
TTTTTAATTTAAAAGGATCTAGGTGAAGATCCTTTTTGATAATCTCATGACCA
AAATCCCTTAACGTGAGTTTTCGTTCCACTGAGCGTCAGACCCCGTAGAAAAG
ATCAAAGGATCTTCTTGAGATCCTTTTTTTCTGCGCGTAATCTGCTGCTTGCAA
ACAAAAAAACCACCGCTACCAGCGGTGGTTTGTTTGCCGGATCAAGAGCTAC
CAACTCTTTTTCCGAAGGTAACTGGCTTCAGCAGAGCGCAGATACCAAATACT
GTCCTTCTAGTGTAGCCGTAGTTAGGCCACCACTTCAAGAACTCTGTAGCACC
GCCTACATACCTCGCTCTGCTAATCCTGTTACCAGTGGCTGCTGCCAGTGGCG
ATAAGTCGTGTCTTACCGGGTTGGACTCAAGACGATAGTTACCGGATAAGGC
GCAGCGGTCGGGCTGAACGGGGGGTTCGTGCACACAGCCCAGCTTGGAGCGA
ACGACCTACACCGAACTGAGATACCTACAGCGTGAGCTATGAGAAAGCGCCA
CGCTTCCCGAAGGGAGAAAGGCGGACAGGTATCCGGTAAGCGGCAGGGTCG
```

-continued

GAACAGGAGAGCGCACGAGGGAGCTTCCAGGGGGAAACGCCTGGTATCTTTA

TAGTCCTGTCGGGTTTCGCCACCTCTGACTTGAGCGTCGATTTTTGTGATGCTC

GTCAGGGGGCGGAGCCTATGGAAAAACGCCAGCAACGCGGCCTTTTTACGG

TTCCTGGCCTTTTGCTGGCCTTTTGCTCACATGT pLY56_TRAC-LHA-pAAV-U6LbcrTRAC-EFS-CD22BBz-GFP-TRAC-RHA(3166mut)
(SEQ ID NO: 84,609):
CCTGCAGGCAGCTGCGCGCTCGCTCGCTCACTGAGGCCGCCCGGGCAA

AGCCCGGGCGTCGGGCGACCTTTGGTCGCCCGGCCTCAGTGAGCGAGCGAGC

GCGCAGAGAGGGAGTGGCCAACTCCATCACTAGGGGTTCCTGCGGCCGCACG

CGTGTCGCGTTCTAGAAGAGGGCCTATTTCCCATGATTCCTTCATATTTGCAT

ATACGATACAAGGCTGTTAGAGAGATAATTGGAATTAATTTGACTGTAAACA

CAAAGATATTAGTACAAAATACGTGACGTAGAAAGTAATAATTTCTTGGGTA

GTTTGCAGTTTTAAAATTATGTTTTAAAATGGACTATCATATGCTTACCGTAA

CTTGAAAGTATTTCGATTTCTTGGCTTTATATATCTTGAAGCTTGGCGTAACTA

GATCTTGAGACAAGGTACCTAGGTCTTGAAAGGAGTGGGAATTGGCTCCGGT

GCCCGTCAGTGGGCAGAGCGCACATCGCCCACAGTCCCCGAGAAGTTGGGGG

GAGGGGTCGGCAATTGATCCGGTGCCTAGAGAAGGTGGCGCGGGGTAAACTG

GGAAAGTGATGTCGTGTACTGGCTCCGCCTTTTTCCCGAGGGTGGGGAGAA

CCGTATATAAGTGCAGTAGTCGCCGTGAACGTTCTTTTTCGCAACGGGTTTGC

CGCCAGAACACAGGACCGGTTCTAGACGTACGGCCACCTGCTTCTGCTCGTG

ACAAGCCTGCTGCTGTGCGAGCTGCCCCACCCTGCCTTTCTGCTGTCCCTCAG

GTGCAGCTGCAGCAGTCTGGCCCTGGCCTCGTGAAGCCTAGCCAGACCCTGG

CCTGACCTGTGCCATCAGCGGCGATAGCGTGTCCAGCAATAGCGCCGCCTGG

AACTGGTCAGACAGAGCCCTAGCAGAGGCCTGGAATGGCTGGGCCGGACCTA

CTACCGGTCCAAGGGTACAACGACTACGCCGTGTCCGTGAAGTCCCGGATCA

CCATCAACCCCGACACCAGCAGAACCAGTTCTCCCTGCAGCTGAACAGCGTG

ACCCCCGAGGATACCGCCGTGTACTACGCGCCAGAGAAGTGACCGGCGACCT

GGAAGATGCCTTCGACATCTGGGGCCAGGGCACATGGTCACCGTGTCTAGCG

GAGGCGGCGGAAGCGACATCCAGATGACACAGAGCCCCAGCCCCTGAGCGC

CAGCGTGGGAGACAGAGTGACCATCACCTGTCGGGCCAGCCAGACCATCGGT

CCTACCTGAACTGGTATCAGCAGCGGCCTGGCAAGGCCCCCAACCTGCTGAT

CTATCCGCCAGCTCACTGCAGAGCGGCGTGCCCAGCAGATTTTCCGGCAGAG

GCAGCGGCACCACTTCACCCTGACAATCAGTTCCCTGCAGGCCGAGGACTTC

GCCACCTACTACTGCCAGCAGAGCTACAGCATCCCCCAGACCTTCGGCCAGG

GGACCAAGCTGGAAATCAAAGCGGCCGCAGGTACCCCACGACGCCAGCGCC

GCGACCACCAACACCGGCGCCCACCATCGCGTCGCAGCCCCTGCCCTGCGCC

CAGAGGCATGCCGGCCAGCAGCAGGGGCGCAGTGCACACGAGGGGCTGA

CTTCGCCTGTGATATCTACATCTGGGCGCCCTTGGCCGGGACTTGTGGGGTCC

TTCTCTGTCACTGGTTATCACCCTTTACTGCAAACGGGGCAGAAAGAAACTCC

TGTATATATTCAACAACCATTTATGAGACCAGTACAAACTACTCAAGAGGAA

GATGGCTGTAGCTGCCGATTCCAGAAGAAGAAGAAGGAGGATGTGAACTGA

-continued

```
GAGTGAAGTTCAGCAGGAGCGCAGACCCCCGCGTACCAGCAGGGCCAGAA

CCAGCTCTATAACGAGCTCAATCTAGGACGAAGAAGGAGTACGATGTTTTGG

ACAAGAGACGTGGCCGGGACCCTGAGATGGGGGGAAAGCCGGAAGGAAGAA

CCCTCAGGAAGGCCTGTACAATGAACTGCAGAAAGATAAGATGGCGGAGCCT

ACAGTGAGATTGGGATGAAAGGCGAGCGCCGGAGGGGCAAGGGGCACGATG

GCCTTACCAGGGTCTCAGTACAGCCACCAAGGACACCTACGACGCCCTTCAC

ATGCAGGCCCTGCCCCTCGCGGCAGTGGAGAGGGCAGAGGAAGTCTGCTAAC

ATGCGGTGACGTCGAGGAGAATCCTGGCCCAGGTACCACGGACCGAGCGGCC

GCAGGAACCCCTAGTGATGGAGTTGGCCACTCCCTCTCTGCGCGCTCGCTCGC

TCACTGAGGCCGGGCGACCAAAGGTCGCCCGACGCCCGGGCTTTGCCCGGGC

GGCCTCAGTGAGCGAGCGAGCGCGCAGCTGCCTGCAGGGGCGCCTGATGCGG

TATTTTCTCCTTACGCATCTGTGCGGTATTTCACACCGCATACGTCAAAGCAA

CCATAGTACGCGCCCTGTAGCGGCGCATTAAGCGCGGCGGGTGTGGTGGTTA

CGCGCAGCGTGACCGCTACACTTGCCAGCGCCCTAGCGCCCGCTCCTTTCGCT

TTCTTCCCTTCCTTTCTCGCCACGTTCGCCGGCTTTCCCCGTCAAGCTCTAAAT

CGGGGGCTCCCTTTAGGGTTCCGATTTAGTGCTTTACGGCACCTCGACCCCAA

AAAACTTGATTTGGGTGATGGTTCACGTAGTGGGCCATCGCCCTGATAGACG

GTTTTTCGCCCTTTGACGTTGGAGTCCACGTTCTTTAATAGTGGACTCTTGTTC

CAAACTGGAACAACACTCAACCCTATCTCGGGCTATTCTTTTGATTTATAAGG

GATTTTGCCGATTTCGGCCTATTGGTTAAAAAATGAGCTGATTTAACAAAAAT

TTAACGCGAATTTTAACAAAATATTAACGTTTACAATTTTATGGTGCACTCTC

AGTACAATCTGCTCTGATGCCGCATAGTTAAGCCAGCCCCGACACCCGCCAA

CACCCGCTGACGCGCCCTGACGGGCTTGTCTGCTCCCGGCATCCGCTTACAGA

CAAGCTGTGACCGTCTCCGGGAGCTGCATGTGTCAGAGGTTTTCACCGTCATC

ACCGAAACGCGCGAGACGAAAGGGCCTCGTGATACGCCTATTTTTATAGGTT

AATGTCATGATAATAATGGTTTCTTAGACGTCAGGTGGCACTTTTCGGGGAAA

TGTGCGCGGAACCCCTATTTGTTTATTTTTCTAAATACATTCAAATATGTATCC

GCTCATGAGACAATAACCCTGATAAATGCTTCAATAATATTGAAAAAGGAAG

AGTATGAGTATTCAACATTTCCGTGTCGCCCTTATTCCCTTTTTTGCGGCATTT

TGCCTTCCTGTTTTTGCTCACCCAGAAACGCTGGTGAAAGTAAAAGATGCTGA

AGATCAGTTGGGTGCACGAGTGGGTTACATCGAACTGGATCTCAACAGCGGT

AAGATCCTTGAGAGTTTTCGCCCCGAAGAACGTTTTCCAATGATGAGCACTTT

TAAAGTTCTGCTATGTGGCGCGGTATTATCCCGTATTGACGCCGGGCAAGAGC

AACTCGGTCGCCGCATACACTATTCTCAGAATGACTTGGTTGAGTACTCACCA

GTCACAGAAAAGCATCTTACGGATGGCATGACAGTAAGAGAATTATGCAGTG

CTGCCATAACCATGAGTGATAACACTGCGGCCAACTTACTTCTGACAACGATC

GGAGGACCGAAGGAGCTAACCGCTTTTTTGCACAACATGGGGGATCATGTAA

CTCGCCTTGATCGTTGGGAACCGGAGCTGAATGAAGCCATACCAAACGACGA

GCGTGACACCACGATGCCTGTAGCAATGGCAACAACGTTGCGCAAACTATTA

ACTGGCGAACTACTTACTCTAGCTTCCCGGCAACAATTAATAGACTGGATGGA

GGCGGATAAAGTTGCAGGACCACTTCTGCGCTCGGCCCTTCCGGCTGGCTGGT
```

-continued

```
TTATTGCTGATAAATCTGGAGCCGGTGAGCGTGGGTCTCGCGGTATCATTGCA

GCACTGGGGCCAGATGGTAAGCCCTCCCGTATCGTAGTTATCTACACGACGG

GGAGTCAGGCAACTATGGATGAACGAAATAGACAGATCGCTGAGATAGGTGC

CTCACTGATTAAGCATTGGTAACTGTCAGACCAAGTTTACTCATATATACTTT

AGATTGATTTAAAACTTCATTTTTAATTTAAAAGGATCTAGGTGAAGATCCTT

TTTGATAATCTCATGACCAAAATCCCTTAACGTGAGTTTTCGTTCCACTGAGC

GTCAGACCCCGTAGAAAAGATCAAAGGATCTTCTTGAGATCCTTTTTTTCTGC

GCGTAATCTGCTGCTTGCAAACAAAAAAACCACCGCTACCAGCGGTGGTTTG

TTTGCCGGATCAAGAGCTACCAACTCTTTTTCCGAAGGTAACTGGCTTCAGCA

GAGCGCAGATACCAAATACTGTCCTTCTAGTGTAGCCGTAGTTAGGCCACCAC

TTCAAGAACTCTGTAGCACCGCCTACATACCTCGCTCTGCTAATCCTGTTACC

AGTGGCTGCTGCCAGTGGCGATAAGTCGTGTCTTACCGGGTTGGACTCAAGA

CGATAGTTACCGGATAAGGCGCAGCGGTCGGGCTGAACGGGGGTTCGTGCA

CACAGCCCAGCTTGGAGCGAACGACCTACACCGAACTGAGATACCTACAGCG

TGAGCTATGAGAAAGCGCCACGCTTCCCGAAGGGAGAAAGGCGGACAGGTA

TCCGGTAAGCGGCAGGGTCGGAACAGGAGAGCGCACGAGGGAGCTTCCAGG

GGGAAACGCCTGGTATCTTTATAGTCCTGTCGGGTTTCGCCACCTCTGACTTG

AGCGTCGATTTTTGTGATGCTCGTCAGGGGGGCGGAGCCTATGGAAAAACGC

CAGCAACGCGGCCTTTTTACGGTTCCTGGCCTTTTGCTGGCCTTTTGCTCACAT

GT
```

AAV production (Examples 5-10): Low-passage HEK293FT cells were used for AAV production. Briefly, 2 h before transfection, D10 media was replaced by pre-warmed DMEM (FBS-free). For each 15 cm-dish, HEK293FT cells were transiently transfected with 5.2 µg transfer, 8.9 µg AAV6 serotype and 10.4 µg pDF6 plasmids using 130 µL PEI. After 6-12 h of transfection, DMEM was replaced with 20 mL pre-warmed D10 media. Cells were dislodged and transferred to 50 mL Falcon tubes after 48-72 h post-transfection. For AAV purification, 1/10 volume of pure chloroform was added and the solution was incubated at 37° C. in the shaker with speed of 200 rpm for 1 h. NaCl was added to a final concentration of 1 M, then pelleted at 20,000×g at 4° C. for 15 min. The aqueous layer was gently transferred to another clean tube and the chloroform layer was discarded. 10% (w/v) of PEG8000 (Promega) was added and shaken within the tubes until dissolved. The mixture was incubated on the ice for 1 h followed by centrifuge at 20,000×g at 4° C. for 15 min. The pellet was resuspended with 5-15 mL PBS including $MgCl_2$ and benzonase (Sigma). After 30-60 min digestion, one volume of chloroform was added, shaken vigorously and spun down at 15,000×g at 4° C. for 10 min. The aqueous layer was collected carefully and AAV was concentrated using AmiconUltra 100 kD ultracentrifugation units (Millipore). Virus was aliquoted and stored in −80° C. To measure virus titer, RT-qPCR was performed using Taqman assays (ThermoFisher) targeted to EFS promoter engineered in the AAV vector.

Human primary $CD8^+$ T cell electroporation and CD22-CAR-PRODH2 knock-in: Human primary $CD8^+$ T cells were isolated from PBMCs obtained from health donors. $CD8^+$ T cells were cultured in X-VIVO™ 15 media (Lonza) supplied with 5% human serum and IL-2. Before electroporation, TRAC crRNA and tracrRNA were mixed in 1:1 ratio (final concentration 50 µM), heated at 95° C. for 5 min in the thermal cycler, then cooled to room temperature. 0.3 µL Cas9 protein (61 µM) was mixed with 0.2 µL Buffer R for each reaction (Neon Transfection System Kit, Thermo Fisher), then mixed with 0.5 µL annealed crRNA: tracrRNA duplex, incubated the mixture at room temperature for 10-20 min. Human $CD8^+$ T cells were collected and washed with PBS to completely remove the media. $5\times10^5$ of T cells per reaction were resuspended in 10 µL Buffer R which included 1 µL RNP complex. 10 µL of cell: RNP mixture was loaded into the Neon Pipette without any bubbles. The electroporation parameter was set at 1600 V, 10 ms for 3 pluses. Cells were immediately transferred to a 48-well plate with pre-warmed media after electroporation. A total of ~$1.5\times10^9$ viral genome copy of AAV6 HDR donor was added into each electroporated T cell reaction within 1 h after electroporation.

Immunoblots (Examples 5-10): Human $CD8^+$ T cells with CD22-CAR-PRODH2 or CD22-CAR-PRODH2 (Stop) KI were collected and washed with PBS to remove media. Cells were lysed with RIPA lysis buffer supplied with protease and phosphatase inhibitor cocktail (Thermo Fisher) and incubated on ice for 30 min, followed by centrifugation at ≥15,000×g for 15 min at 4° C. The supernatant was collected for protein quantification. The total protein concentration was quantified by performing a Bradford protein assay (Bio-Rad), a total of 10 µg protein per sample was loaded into SDS-PAGE gel (Bio-Rad), proteins in the gel were transferred into Amersham Protran 0.45 µm NC Nitrocellulose Blotting membrane (GE Healthcare) after electrophoresis. Membranes were blocked with 2% BSA in TBST buffer for 1 h at room temperature, followed by the primary antibody incubation at 4° C. overnight. Anti-PRODH2 antibody was purchased from Atlas Antibodies (HPA051287) and anti-Vinculin was purchased from Abcam (ab129002) which was used as internal control. Antibody binding was detected using horseradish peroxidase-conjugated secondary antibody and ECL substrate (Bio-Rad).

Top candidate validation in kill assay (Examples 5-10): Candidate hits mouse Prodh2, Ccnblip1, Sreklip1, and Wdr37 were selected for further validation. All cDNAs were purchased from the Dharmacon, then cloned into a lentiviral overexpression vector (*lenti*-EF1a-Flag-WPRE vector).

```
pLY040_FLAG_rat Ccnblip1 (SEQ ID NO: 84,610):
GTCGACGGATCGGGAGATCTCCCGATCCCCTATGGTGCACTCTCAGTACAATC

TGCTCTGATGCCGCATAGTTAAGCCAGTATCTGCTCCCTGCTTGTGTGTTGGA

GGTCGCTGAGTAGTGCGCGAGCAAAATTTAAGCTACAACAAGGCAAGGCTTG

ACCGACAATTGCATGAAGAATCTGCTTAGGGTTAGGCGTTTTGCGCTGCTTCG

CGATGTACGGGCCAGATATACGCGTTGACATTGATTATTGACTAGTTATTAAT

AGTAATCAATTACGGGGTCATTAGTTCATAGCCCATATATGGAGTTCCGCGTT

ACATAACTTACGGTAAATGGCCCGCCTGGCTGACCGCCCAACGACCCCCGCC

CATTGACGTCAATAATGACGTATGTTCCCATAGTAACGCCAATAGGGACTTTC

CATTGACGTCAATGGGTGGAGTATTTACGGTAAACTGCCCACTTGGCAGTACA

TCAAGTGTATCATATGCCAAGTACGCCCCCTATTGACGTCAATGACGGTAAAT

GGCCCGCCTGGCATTATGCCCAGTACATGACCTTATGGGACTTTCCTACTTGG

CAGTACATCTACGTATTAGTCATCGCTATTACCATGGTGATGCGGTTTTGGCA

GTACATCAATGGGCGTGGATAGCGGTTTGACTCACGGGGATTTCCAAGTCTCC

ACCCCATTGACGTCAATGGGAGTTTGTTTTGGCACCAAAATCAACGGGACTTT

CCAAAATGTCGTAACAACTCCGCCCCATTGACGCAAATGGGCGGTAGGCGTG

TACGGTGGGAGGTCTATATAAGCAGCGCGTTTTGCCTGTACTGGGTCTCTCTG

GTTAGACCAGATCTGAGCCTGGGAGCTCTCTGGCTAACTAGGGAACCCACTG

CTTAAGCCTCAATAAAGCTTGCCTTGAGTGCTTCAAGTAGTGTGTGCCCGTCT

GTTGTGTGACTCTGGTAACTAGAGATCCCTCAGACCCTTTTAGTCAGTGTGGA

AAATCTCTAGCAGTGGCGCCCGAACAGGGACTTGAAAGCGAAAGGGAAACC

AGAGGAGCTCTCTCGACGCAGGACTCGGCTTGCTGAAGCGCGCACGGCAAGA

GGCGAGGGGCGGCGACTGGTGAGTACGCCAAAAATTTTGACTAGCGGAGGCT

AGAAGGAGAGAGATGGGTGCGAGAGCGTCAGTATTAAGCGGGGAGAATTA

GATCGCGATGGGAAAAAATTCGGTTAAGGCCAGGGGGAAAGAAAAAATATA

AATTAAAACATATAGTATGGGCAAGCAGGGAGCTAGAACGATTCGCAGTTAA

TCCTGGCCTGTTAGAAACATCAGAAGGCTGTAGACAAATACTGGGACAGCTA

CAACCATCCCTTCAGACAGGATCAGAAGAACTTAGATCATTATATAATACAG

TAGCAACCCTCTATTGTGTGCATCAAAGGATAGAGATAAAAGACACCAAGGA

AGCTTTAGACAAGATAGAGGAAGAGCAAAACAAAAGTAAGACCACCGCACA

GCAAGCGGCCGCTGATCTTCAGACCTGGAGGAGGAGATATGAGGGACAATTG

GAGAAGTGAATTATATAAATATAAAGTAGTAAAAATTGAACCATTAGGAGTA

GCACCCACCAAGGCAAAGAGAAGAGTGGTGCAGAGAGAAAAAAGAGCAGTG

GGAATAGGAGCTTTGTTCCTTGGGTTCTTGGGAGCAGCAGGAAGCACTATGG

GCGCAGCGTCAATGACGCTGACGGTACAGGCCAGACAATTATTGTCTGGTAT

AGTGCAGCAGCAGAACAATTTGCTGAGGGCTATTGAGGCGCAACAGCATCTG
```

-continued

```
TTGCAACTCACAGTCTGGGGCATCAAGCAGCTCCAGGCAAGAATCCTGGCTG
TGGAAAGATACCTAAAGGATCAACAGCTCCTGGGGATTTGGGGTTGCTCTGG
AAAACTCATTTGCACCACTGCTGTGCCTTGGAATGCTAGTTGGAGTAATAAAT
CTCTGGAACAGATTTGGAATCACACGACCTGGATGGAGTGGGACAGAGAAAT
TAACAATTACACAAGCTTAATACACTCCTTAATTGAAGAATCGCAAACCAG
CAAGAAAAGAATGAACAAGAATTATTGGAATTAGATAAATGGGCAAGTTTGT
GGAATTGGTTTAACATAACAAATTGGCTGTGGTATATAAAATTATTCATAATG
ATAGTAGGAGGCTTGGTAGGTTTAAGAATAGTTTTTGCTGTACTTTCTATAGT
GAATAGAGTTAGGCAGGGATATTCACCATTATCGTTTCAGACCCACCTCCCAA
CCCCGAGGGGACCCGACAGGCCCGAAGGAATAGAAGAAGAAGGTGGAGAGA
GAGACAGAGACAGATCCATTCGATTAGTGAACGGATCGGCACTGCGTGCGCC
AATTCTGCAGACAAATGGCAGTATTCATCCACAATTTTAAAAGAAAAGGGGG
GATTGGGGGGTACAGTGCAGGGGAAAGAATAGTAGACATAATAGCAACAGA
CATACAAACTAAAGAATTACAAAAACAAATTACAAAAATTCAAAATTTTCGG
GTTTATTACAGGGACAGCAGAGATCCAGTTTGGTTAATTAGCTAGCTGCAAA
GATGGATAAAGTTTTAAACAGAGAGGAATCTTTGCAGCTAATGGACCTTCTA
GGTCTTGAAAGGAGTGGGAATTGGCTCCGGTGCCCGTCAGTGGGCAGAGCGC
ACATCGCCCACAGTCCCCGAGAAGTTGGGGGGAGGGGTCGGCAATTGAACCG
GTGCCTAGAGAAGGTGGCGCGGGGTAAACTGGGAAAGTGATGTCGTGTACTG
GCTCCGCCTTTTTCCCGAGGGTGGGGGAGAACCGTATATAAGTGCAGTAGTC
GCCGTGAACGTTCTTTTTCGCAACGGGTTTGCCGCCAGAACACAGGTAAGTGC
CGTGTGTGGTTCCCGCGGGCCTGGCCTCTTTACGGGTTATGGCCCTTGCGTGC
CTTGAATTACTTCCACCTGGCTGCAGTACGTGATTCTTGATCCCGAGCTTCGG
GTTGGAAGTGGGTGGGAGAGTTCGAGGCCTTGCGCTTAAGGAGCCCCTTCGC
CTCGTGCTTGAGTTGAGGCCTGGCCTGGGCGCTGGGGCCGCCGCGTGCGAAT
CTGGTGGCACCTTCGCGCCTGTCTCGCTGCTTTCGATAAGTCTCTAGCCATTTA
AAATTTTTGATGACCTGCTGCGACGCTTTTTTTCTGGCAAGATAGTCTTGTAA
ATGCGGGCCAAGATCTGCACACTGGTATTTCGGTTTTTGGGGCCGCGGGCGGC
GACGGGGCCCGTGCGTCCCAGCGCACATGTTCGGCGAGGCGGGGCCTGCGAG
CGCGGCCACCGAGAATCGGACGGGGGTAGTCTCAAGCTGGCCGGCCTGCTCT
GGTGCCTGGCCTCGCGCCGCCGTGTATCGCCCCGCCCTGGGCGGCAAGGCTG
GCCCGGTCGGCACCAGTTGCGTGAGCGGAAAGATGGCCGCTTCCCGGCCCTG
CTGCAGGGAGCTCAAAATGGAGGACGCGGCGCTCGGGAGAGCGGGCGGGTG
AGTCACCCACACAAAGGAAAAGGGCCTTTCCGTCCTCAGCCGTCGCTTCATGT
GACTCCACGGAGTACCGGGCGCCGTCCAGGCACCTCGATTAGTTCTCGAGCTT
TTGGAGTACGTCGTCTTTAGGTTGGGGGGAGGGGTTTTATGCGATGGAGTTTC
CCCACACTGAGTGGGTGGAGACTGAAGTTAGGCCAGCTTGGCACTTGATGTA
ATTCTCCTTGGAATTTGCCCTTTTTGAGTTTGGATCTTGGTTCATTCTCAAGCC
TCAGACAGTGGTTCAAAGTTTTTTTCTTCCATTTCAGGTGTCGTGACGTACGG
CCACCATGGATTACAAAGACGATGACGATAAGATGTCTTTGTGTGAAGACAT
GTTGCTGTGCAATTATCGGAAGTGTCGTATCAAGCTCTCTGGCTATGCTTGGG
```

-continued

```
TCACGGCCTGCTCTCACATCTTCTGTGATCAGCATGGCAGTGGTGAGTTCAGT

CATTCACCAGCAATCTGCCCTGCTTGCAACAGCACCCTTTCTGGAAAGCTAGA

CATTGTCCGGACAGAGCTCAGTCCGTCAGAGGAGTACAAAGCTATGGTATTG

GCAGGGCTTCGACCCGAGGTTGTTTTGGACATTAGCTCCCGAGCATTGGCCTT

CTGGACGTACCAGGTGCACCAGGAACGTCTCTATCAAGAATACAATTTCAGC

AAGGCTGAGAACCACTTAAAACAGATGGAGAAGATATACACGCAGCAAATA

CAGAGCAAGGACGTAGAATTGACCTCTATGAAAGGGGAGGTTACCTCCATGA

AGAAAGTTCTGGAGGAATACAAGAAGAAGTTTAGTGATATCTCTGAGAAACT

GATGGAGCGCAACCGCCAATACCAAAAGCTCCAAGGCCTTTATGATAGCCTC

AGGCTAAGGAATATCACTATCGCTAGCCAGGAGGGCTCCCTGGAACCAGCTA

TGATCCCACAGTCTGGAGTCTTTGGCTTCCCATCAGGGAATAGCTCAAAGTTT

TCTTTGGACCATACACCAGCTGGAAATCAAGGTGGTGGAGATGAAGATGTTC

AGTTCAGACCATTTTTTGTGTGTTCTCCCACAGCACCTGAACCTGTTAACAAC

TTCTTTAGTTTTGCGTCTCAAAGCCATGAAGCAGAGCAGCAAGTCTGCAGCAG

GGCCTTTAAAGCAAAAAGAATTTAGGAATTCGATATCAAGCTTATCGATAAT

CAACCTCTGGATTACAAAATTTGTGAAAGATTGACTGGTATTCTTAACTATGT

TGCTCCTTTTACGCTATGTGGATACGCTGCTTTAATGCCTTTGTATCATGCTAT

TGCTTCCCGTATGGCTTTCATTTTCTCCTCCTTGTATAAATCCTGGTTGCTGTCT

CTTTATGAGGAGTTGTGGCCCGTTGTCAGGCAACGTGGCGTGGTGTGCACTGT

GTTTGCTGACGCAACCCCCACTGGTTGGGGCATTGCCACCACCTGTCAGCTCC

TTTCCGGGACTTTCGCTTTCCCCCTCCCTATTGCCACGGCGGAACTCATCGCC

GCCTGCCTTGCCCGCTGCTGGACAGGGGCTCGGCTGTTGGGCACTGACAATTC

CGTGGTGTTGTCGGGGAAATCATCGTCCTTTCCTTGGCTGCTCGCCTGTGTTGC

CACCTGGATTCTGCGCGGGACGTCCTTCTGCTACGTCCCTTCGGCCCTCAATC

CAGCGGACCTTCCTTCCCGCGGCCTGCTGCCGGCTCTGCGGCCTCTTCCGCGT

CTTCGCCTTCGCCCTCAGACGAGTCGGATCTCCCTTTGGGCCGCCTCCCCGCA

TCGATACCGTCGACCTCGAGACCTAGAAAAACATGGAGCAATCACAAGTAGC

AATACAGCAGCTACCAATGCTGATTGTGCCTGGCTAGAAGCACAAGAGGAGG

AGGAGGTGGGTTTTCCAGTCACACCTCAGGTACCTTTAAGACCAATGACTTAC

AAGGCAGCTGTAGATCTTAGCCACTTTTTAAAAGAAAAGGGGGGACTGGAAG

GGCTAATTCACTCCCAACGAAGACAAGATATCCTTGATCTGTGGATCTACCAC

ACACAAGGCTACTTCCCTGATTGGCAGAACTACACACCAGGGCCAGGGATCA

GATATCCACTGACCTTTGGATGGTGCTACAAGCTAGTACCAGTTGAGCAAGA

GAAGGTAGAAGAAGCCAATGAAGGAGAGAACACCCGCTTGTTACACCCTGTG

AGCCTGCATGGGATGGATGACCCGGAGAGAGAAGTATTAGAGTGGAGGTTTG

ACAGCCGCCTAGCATTTCATCACATGGCCCGAGAGCTGCATCCGGACTGTACT

GGGTCTCTCTGGTTAGACCAGATCTGAGCCTGGGAGCTCTCTGGCTAACTAGG

GAACCCACTGCTTAAGCCTCAATAAAGCTTGCCTTGAGTGCTTCAAGTAGTGT

GTGCCCGTCTGTTGTGTGACTCTGGTAACTAGAGATCCCTCAGACCCTTTTAG

TCAGTGTGGAAAATCTCTAGCAGGGCCCGTTTAAACCCGCTGATCAGCCTCGA
```

```
CTGTGCCTTCTAGTTGCCAGCCATCTGTTGTTTGCCCCTCCCCCGTGCCTTCCT

TGACCCTGGAAGGTGCCACTCCCACTGTCCTTTCCTAATAAAATGAGGAAATT

GCATCGCATTGTCTGAGTAGGTGTCATTCTATTCTGGGGGGTGGGGTGGGGCA

GGACAGCAAGGGGGAGGATTGGGAAGACAATAGCAGGCATGCTGGGGATGC

GGTGGGCTCTATGGCTTCTGAGGCGGAAAGAACCAGCTGGGGCTCTAGGGGG

TATCCCCACGCGCCCTGTAGCGGCGCATTAAGCGCGGCGGGTGTGGTGGTTA

CGCGCAGCGTGACCGCTACACTTGCCAGCGCCCTAGCGCCCGCTCCTTTCGCT

TTCTTCCCTTCCTTTCTCGCCACGTTCGCCGGCTTTCCCCGTCAAGCTCTAAAT

CGGGGGCTCCCTTTAGGGTTCCGATTTAGTGCTTTACGGCACCTCGACCCCAA

AAAACTTGATTAGGGTGATGGTTCACGTAGTGGGCCATCGCCCTGATAGACG

GTTTTTCGCCCTTTGACGTTGGAGTCCACGTTCTTTAATAGTGGACTCTTGTTC

CAAACTGGAACAACACTCAACCCTATCTCGGTCTATTCTTTTGATTTATAAGG

GATTTTGCCGATTTCGGCCTATTGGTTAAAAAATGAGCTGATTTAACAAAAAT

TTAACGCGAATTAATTCTGTGGAATGTGTGTCAGTTAGGGTGTGGAAAGTCCC

CAGGCTCCCCAGCAGGCAGAAGTATGCAAAGCATGCATCTCAATTAGTCAGC

AACCAGGTGTGGAAAGTCCCCAGGCTCCCCAGCAGGCAGAAGTATGCAAAGC

ATGCATCTCAATTAGTCAGCAACCATAGTCCCGCCCCTAACTCCGCCCATCCC

GCCCCTAACTCCGCCCAGTTCCGCCCATTCTCCGCCCCATGGCTGACTAATTT

TTTTTATTTATGCAGAGGCCGAGGCCGCCTCTGCCTCTGAGCTATTCCAGAAG

TAGTGAGGAGGCTTTTTTGGAGGCCTAGGCTTTTGCAAAAAGCTCCCGGGAG

CTTGTATATCCATTTTCGGATCTGATCAGCACGTGTTGACAATTAATCATCGG

CATAGTATATCGGCATAGTATAATACGACAAGGTGAGGAACTAAACCATGGC

CAAGTTGACCAGTGCCGTTCCGGTGCTCACCGCGCGCGACGTCGCCGGAGCG

GTCGAGTTCTGGACCGACCGGCTCGGGTTCTCCCGGGACTTCGTGGAGGACG

ACTTCGCCGGTGTGGTCCGGGACGACGTGACCCTGTTCATCAGCGCGGTCCAG

GACCAGGTGGTGCCGGACAACACCCTGGCCTGGGTGTGGGTGCGCGGCCTGG

ACGAGCTGTACGCCGAGTGGTCGGAGGTCGTGTCCACGAACTTCCGGGACGC

CTCCGGGCCGGCCATGACCGAGATCGGCGAGCAGCCGTGGGGGGGGAGTTC

GCCCTGCGCGACCCGGCCGGCAACTGCGTGCACTTCGTGGCCGAGGAGCAGG

ACTGACACGTGCTACGAGATTTCGATTCCACCGCCGCCTTCTATGAAAGGTTG

GGCTTCGGAATCGTTTTCCGGGACGCCGGCTGGATGATCCTCCAGCGCGGGG

ATCTCATGCTGGAGTTCTTCGCCCACCCCAACTTGTTTATTGCAGCTTATAATG

GTTACAAATAAAGCAATAGCATCACAAATTTCACAAATAAAGCATTTTTTCA

CTGCATTCTAGTTGTGGTTTGTCCAAACTCATCAATGTATCTTATCATGTCTGT

ATACCGTCGACCTCTAGCTAGAGCTTGGCGTAATCATGGTCATAGCTGTTTCC

TGTGTGAAATTGTTATCCGCTCACAATTCCACACAACATACGAGCCGGAAGC

ATAAAGTGTAAAGCCTGGGGTGCCTAATGAGTGAGCTAACTCACATTAATTG

CGTTGCGCTCACTGCCCGCTTTCCAGTCGGGAAACCTGTCGTGCCAGCTGCAT

TAATGAATCGGCCAACGCGCGGGGAGAGGCGGTTTGCGTATTGGGCGCTCTT

CCGCTTCCTCGCTCACTGACTCGCTGCGCTCGGTCGTTCGGCTGCGGCGAGCG

GTATCAGCTCACTCAAAGGCGGTAATACGGTTATCCACAGAATCAGGGGATA
```

-continued

```
ACGCAGGAAAGAACATGTGAGCAAAAGGCCAGCAAAAGGCCAGGAACCGTA

AAAAGGCCGCGTTGCTGGCGTTTTTCCATAGGCTCCGCCCCCCTGACGAGCAT

CACAAAAATCGACGCTCAAGTCAGAGGTGGCGAAACCCGACAGGACTATAA

AGATACCAGGCGTTTCCCCCTGGAAGCTCCCTCGTGCGCTCTCCTGTTCCGAC

CCTGCCGCTTACCGGATACCTGTCCGCCTTTCTCCCTTCGGGAAGCGTGGCGC

TTTCTCATAGCTCACGCTGTAGGTATCTCAGTTCGGTGTAGGTCGTTCGCTCCA

AGCTGGGCTGTGTGCACGAACCCCCCGTTCAGCCCGACCGCTGCGCCTTATCC

GGTAACTATCGTCTTGAGTCCAACCCGGTAAGACACGACTTATCGCCACTGGC

AGCAGCCACTGGTAACAGGATTAGCAGAGCGAGGTATGTAGGCGGTGCTACA

GAGTTCTTGAAGTGGTGGCCTAACTACGGCTACACTAGAAGAACAGTATTTG

GTATCTGCGCTCTGCTGAAGCCAGTTACCTTCGGAAAAAGAGTTGGTAGCTCT

TGATCCGGCAAACAAACCACCGCTGGTAGCGGTGGTTTTTTTGTTTGCAAGCA

GCAGATTACGCGCAGAAAAAAAGGATCTCAAGAAGATCCTTTGATCTTTTCT

ACGGGGTCTGACGCTCAGTGGAACGAAAACTCACGTTAAGGGATTTTGGTCA

TGAGATTATCAAAAAGGATCTTCACCTAGATCCTTTTAAATTAAAAATGAAGT

TTTAAATCAATCTAAAGTATATATGAGTAAACTTGGTCTGACAGTTACCAATG

CTTAATCAGTGAGGCACCTATCTCAGCGATCTGTCTATTTCGTTCATCCATAGT

TGCCTGACTCCCCGTCGTGTAGATAACTACGATACGGGAGGGCTTACCATCTG

GCCCCAGTGCTGCAATGATACCGCGAGACCCACGCTCACCGGCTCCAGATTT

ATCAGCAATAAACCAGCCAGCCGGAAGGGCCGAGCGCAGAAGTGGTCCTGC

AACTTTATCCGCCTCCATCCAGTCTATTAATTGTTGCCGGGAAGCTAGAGTAA

GTAGTTCGCCAGTTAATAGTTTGCGCAACGTTGTTGCCATTGCTACAGGCATC

GTGGTGTCACGCTCGTCGTTTGGTATGGCTTCATTCAGCTCCGGTTCCCAACG

ATCAAGGCGAGTTACATGATCCCCCATGTTGTGCAAAAAAGCGGTTAGCTCCT

TCGGTCCTCCGATCGTTGTCAGAAGTAAGTTGGCCGCAGTGTTATCACTCATG

GTTATGGCAGCACTGCATAATTCTCTTACTGTCATGCCATCCGTAAGATGCTT

TTCTGTGACTGGTGAGTACTCAACCAAGTCATTCTGAGAATAGTGTATGCGGC

GACCGAGTTGCTCTTGCCCGGCGTCAATACGGGATAATACCGCGCCACATAG

CAGAACTTTAAAAGTGCTCATCATTGGAAAACGTTCTTCGGGGCGAAAACTCT

CAAGGATCTTACCGCTGTTGAGATCCAGTTCGATGTAACCCACTCGTGCACCC

AACTGATCTTCAGCATCTTTTACTTTCACCAGCGTTTCTGGGTGAGCAAAAAC

AGGAAGGCAAAATGCCGCAAAAAAGGGAATAAGGGCGACACGGAAATGTTG

AATACTCATACTCTTCCTTTTTCAATATTATTGAAGCATTTATCAGGGTTATTG

TCTCATGAGCGGATACATATTTGAATGTATTTAGAAAAATAAACAAATAGGG

GTTCCGCGCACATTTCCCCGAAAAGTGCCACCTGAC pLY040_FLAG_mWdr37 (SEQ ID NO: 84,611):
GTCGACGGATCGGGAGATCTCCCGATCCCCTATGGTGCACTCTCAGTACAATC

TGCTCTGATGCCGCATAGTTAAGCCAGTATCTGCTCCCTGCTTGTGTGTTGGA

GGTCGCTGAGTAGTGCGCGAGCAAAATTTAAGCTACAACAAGGCAAGGCTTG

ACCGACAATTGCATGAAGAATCTGCTTAGGGTTAGGCGTTTTGCGCTGCTTCG

CGATGTACGGGCCAGATATACGCGTTGACATTGATTATTGACTAGTTATTAAT
```

```
AGTAATCAATTACGGGGTCATTAGTTCATAGCCCATATATGGAGTTCCGCGTT
ACATAACTTACGGTAAATGGCCCGCCTGGCTGACCGCCCAACGACCCCCGCC
CATTGACGTCAATAATGACGTATGTTCCCATAGTAACGCCAATAGGGACTTTC
CATTGACGTCAATGGGTGGAGTATTTACGGTAAACTGCCCACTTGGCAGTACA
TCAAGTGTATCATATGCCAAGTACGCCCCCTATTGACGTCAATGACGGTAAAT
GGCCCGCCTGGCATTATGCCCAGTACATGACCTTATGGGACTTTCCTACTTGG
CAGTACATCTACGTATTAGTCATCGCTATTACCATGGTGATGCGGTTTTGGCA
GTACATCAATGGGCGTGGATAGCGGTTTGACTCACGGGGATTTCCAAGTCTCC
ACCCCATTGACGTCAATGGGAGTTTGTTTTGGCACCAAAATCAACGGGACTTT
CCAAAATGTCGTAACAACTCCGCCCCATTGACGCAAATGGGCGGTAGGCGTG
TACGGTGGGAGGTCTATATAAGCAGCGCGTTTTGCCTGTACTGGGTCTCTCTG
GTTAGACCAGATCTGAGCCTGGGAGCTCTCTGGCTAACTAGGGAACCCACTG
CTTAAGCCTCAATAAAGCTTGCCTTGAGTGCTTCAAGTAGTGTGTGCCCGTCT
GTTGTGTGACTCTGGTAACTAGAGATCCCTCAGACCCTTTTAGTCAGTGTGGA
AAATCTCTAGCAGTGGCGCCCGAACAGGGACTTGAAAGCGAAAGGGAAACC
AGAGGAGCTCTCTCGACGCAGGACTCGGCTTGCTGAAGCGCGCACGGCAAGA
GGCGAGGGGCGGCGACTGGTGAGTACGCCAAAAATTTTGACTAGCGGAGGCT
AGAAGGAGAGAGATGGGTGCGAGAGCGTCAGTATTAAGCGGGGGAGAATTA
GATCGCGATGGGAAAAAATTCGGTTAAGGCCAGGGGGAAAGAAAAAATATA
AATTAAAACATATAGTATGGGCAAGCAGGGAGCTAGAACGATTCGCAGTTAA
TCCTGGCCTGTTAGAAACATCAGAAGGCTGTAGACAAATACTGGGACAGCTA
CAACCATCCCTTCAGACAGGATCAGAAGAACTTAGATCATTATATAATACAG
TAGCAACCCTCTATTGTGTGCATCAAAGGATAGAGATAAAAGACACCAAGGA
AGCTTTAGACAAGATAGAGGAAGAGCAAAACAAAAGTAAGACCACCGCACA
GCAAGCGGCCGCTGATCTTCAGACCTGGAGGAGGAGATATGAGGGACAATTG
GAGAAGTGAATTATATAAATATAAAGTAGTAAAAATTGAACCATTAGGAGTA
GCACCCACCAAGGCAAAGAAGAAGAGTGGTGCAGAGAGAAAAAAGAGCAGTG
GGAATAGGAGCTTTGTTCCTTGGGTTCTTGGGAGCAGCAGGAAGCACTATGG
GCGCAGCGTCAATGACGCTGACGGTACAGGCCAGACAATTATTGTCTGGTAT
AGTGCAGCAGCAGAACAATTTGCTGAGGGCTATTGAGGCGCAACAGCATCTG
TTGCAACTCACAGTCTGGGGCATCAAGCAGCTCCAGGCAAGAATCCTGGCTG
TGGAAAGATACCTAAAGGATCAACAGCTCCTGGGGATTTGGGGTTGCTCTGG
AAAACTCATTTGCACCACTGCTGTGCCTTGGAATGCTAGTTGGAGTAATAAAT
CTCTGGAACAGATTTGGAATCACACGACCTGGATGGAGTGGGACAGAGAAAT
TAACAATTACACAAGCTTAATACACTCCTTAATTGAAGAATCGCAAAACCAG
CAAGAAAAGAATGAACAAGAATTATTGGAATTAGATAAATGGGCAAGTTTGT
GGAATTGGTTTAACATAACAAATTGGCTGTGGTATATAAAATTATTCATAATG
ATAGTAGGAGGCTTGGTAGGTTTAAGAATAGTTTTTGCTGTACTTTCTATAGT
GAATAGAGTTAGGCAGGGATATTCACCATTATCGTTTCAGACCCACCTCCCAA
CCCCGAGGGGACCCGACAGGCCCGAAGGAATAGAAGAAGAAGGTGGAGAGA
```

-continued
```
GAGACAGAGACAGATCCATTCGATTAGTGAACGGATCGGCACTGCGTGCGCC
AATTCTGCAGACAAATGGCAGTATTCATCCACAATTTTAAAAGAAAAGGGGG
GATTGGGGGGTACAGTGCAGGGGAAAGAATAGTAGACATAATAGCAACAGA
CATACAAACTAAAGAATTACAAAAACAAATTACAAAAATTCAAAATTTTCGG
GTTTATTACAGGGACAGCAGAGATCCAGTTTGGTTAATTAGCTAGCTGCAAA
GATGGATAAAGTTTTAAACAGAGAGGAATCTTTGCAGCTAATGGACCTTCTA
GGTCTTGAAAGGAGTGGGAATTGGCTCCGGTGCCCGTCAGTGGGCAGAGCGC
ACATCGCCCACAGTCCCCGAGAAGTTGGGGGGAGGGGTCGGCAATTGAACCG
GTGCCTAGAGAAGGTGGCGCGGGGTAAACTGGGAAAGTGATGTCGTGTACTG
GCTCCGCCTTTTTCCCGAGGGTGGGGGAGAACCGTATATAAGTGCAGTAGTC
GCCGTGAACGTTCTTTTTCGCAACGGGTTTGCCGCCAGAACACAGGTAAGTGC
CGTGTGTGGTTCCCGCGGGCCTGGCCTCTTTACGGGTTATGGCCCTTGCGTGC
CTTGAATTACTTCCACCTGGCTGCAGTACGTGATTCTTGATCCCGAGCTTCGG
GTTGGAAGTGGGTGGGAGAGTTCGAGGCCTTGCGCTTAAGGAGCCCCTTCGC
CTCGTGCTTGAGTTGAGGCCTGGCCTGGGCGCTGGGGCCGCCGCGTGCGAAT
CTGGTGGCACCTTCGCGCCTGTCTCGCTGCTTTCGATAAGTCTCTAGCCATTTA
AAATTTTTGATGACCTGCTGCGACGCTTTTTTTCTGGCAAGATAGTCTTGTAA
ATGCGGGCCAAGATCTGCACACTGGTATTTCGGTTTTTGGGGCCGCGGGCGGC
GACGGGCCCGTGCGTCCCAGCGCACATGTTCGGCGAGGCGGGGCCTGCGAG
CGCGGCCACCGAGAATCGGACGGGGGTAGTCTCAAGCTGGCCGGCCTGCTCT
GGTGCCTGGCCTCGCGCCGCCGTGTATCGCCCCGCCCTGGGCGGCAAGGCTG
GCCCGGTCGGCACCAGTTGCGTGAGCGGAAAGATGGCCGCTTCCCGGCCCTG
CTGCAGGGAGCTCAAAATGGAGGACGCGGCGCTCGGGAGAGCGGGCGGGTG
AGTCACCCACACAAAGGAAAAGGGCCTTTCCGTCCTCAGCCGTCGCTTCATGT
GACTCCACGGAGTACCGGGCGCCGTCCAGGCACCTCGATTAGTTCTCGAGCTT
TTGGAGTACGTCGTCTTTAGGTTGGGGGGAGGGGTTTTATGCGATGGAGTTTC
CCCACACTGAGTGGGTGGAGACTGAAGTTAGGCCAGCTTGGCACTTGATGTA
ATTCTCCTTGGAATTTGCCCTTTTTGAGTTTGGATCTTGGTTCATTCTCAAGCC
TCAGACAGTGGTTCAAAGTTTTTTTCTTCCATTTCAGGTGTCGTGACGTACGG
CCACCATGGATTACAAAGACGATGACGATAAGATGCCCACAGAAAGCGGAA
GTTGTTCAACTGCTCGCCAAGCAAAACAAAAGCGCAAGTCTCATAGCCTTTCT
ATACGAAGAACTAACAGCTCAGAACAAGAGAGGACTGGACTGCCAAGAGAA
ATGTTAGAAGGACAAGATTCTAAACTGCCGTCCTCAGTTCGCAGTACACTGCT
GGAATTGTTTGGCCAGATAGAAAGAGAATTTGAAAATCTTTACATCGAAAAC
TTAGAATTGCGCAGAGAAATTGATACTCTTAATGAACGTTTAGCTGGTGAAG
GACAAGCGATCGATGGGGCAGAATTGAGTAAGGGCCAACTCAAAACAAAAG
CCAGTCACAGTACCAGTCAGCTTTCTCAGAAGCTTAAGACCACCTACAAGGCT
TCCACCAGCAAGATTGTTTCCAGCTTTAAGATTACCACATCCAGGGCCATCTG
TCAGCTTGTGAAGGAGTATATTGGCCACAGGGATGGCATCTGGGATGTCAGT
GTTACAAGGACACAGCCTATTGTTCTTGGGACAGCATCTGCTGATCACACGGC
TTTGTTGTGGAGCATAGAGACTGGCAAATGTCTTGTCAAGTACGCTGGCCATG
```

-continued

```
TGGGCTCAGTAAATTCTATAAAATTCCATCCCTCAGAGCAGTTGGCTCTTACT
GCTTCTGGAGATCAGACTGCTCATATCTGGAGATACGTGGTACAGCTTCCAAC
ACCTCAGCCTGTTGCCGACACTAGTCAACAAATTTCTGGTGAAGATGAAATA
GAATGCTCTGATAAAGATGAGCCTGACATTGATGGAGACGTGTCCAGTGACT
GTCCTACTGTCCGAGTCCCACTGACATCTCTCAAAAGCCACCAGGGTGTGGTT
ATTGCTGCTGACTGGCTGGTTGGTGGGAAACAAGTGGTGACAGCCTCATGGG
ACAGAACTGCCAACCTGTATGATGTGGAGACATCTGAACTCGTTCATTCCCTG
ACAGGGCATGACCAGGAGTTAACACATTGTTGCACTCACCCCACCCAGCGGC
TCGTGGTGACCTCCTCCCGTGACACAACTTTCCGTCTCTGGGATTTCAGGGAC
CCTTCCATCCACTCCGTGAATGTTTTCCAAGGACACACGGACACTGTGACCTC
TGCTGTGTTCACTGTGGGAGACAACGTCGTTTCAGGCAGTGATGACCGCACA
GTAAAAGTCTGGGATTTAAAAAATATGAGATCTCCAATTGCGACAATTCGTA
CAGACTCTGCCATTAATAGGATCAATGTGTGTGTTGGCCAAAAAATCATAGCC
CTCCCCCATGACAACCGGCAAGTGCGATTGTTTGATATGTCGGGAGTGAGGCT
AGCACGGCTTCCCCGGAGCAGCCGACAGGGTCACAGACGAATGGTGTGCTGC
TCAGCGTGGAGTGAAGACCACCCCATATGCAATCTATTTACCTGTGGGTTCGA
TAGGCAAGCTATTGGGTGGAACATCAATATTCCTGCACTGTTACAAGAAAAA
TAAGAATTCGATATCAAGCTTATCGATAATCAACCTCTGGATTACAAAATTTG
TGAAAGATTGACTGGTATTCTTAACTATGTTGCTCCTTTTACGCTATGTGGATA
CGCTGCTTTAATGCCTTTGTATCATGCTATTGCTTCCCGTATGGCTTTCATTTT
CTCCTCCTTGTATAAATCCTGGTTGCTGTCTCTTTATGAGGAGTTGTGGCCCGT
TGTCAGGCAACGTGGCGTGGTGTGCACTGTGTTTGCTGACGCAACCCCCACTG
GTTGGGGCATTGCCACCACCTGTCAGCTCCTTTCCGGGACTTTCGCTTTCCCC
TCCCTATTGCCACGGCGGAACTCATCGCCGCCTGCCTTGCCCGCTGCTGGACA
GGGGCTCGGCTGTTGGGCACTGACAATTCCGTGGTGTTGTCGGGGAAATCATC
GTCCTTTCCTTGGCTGCTCGCCTGTGTTGCCACCTGGATTCTGCGCGGGACGTC
CTTCTGCTACGTCCCTTCGGCCCTCAATCCAGCGGACCTTCCTTCCCGCGGCCT
GCTGCCGGCTCTGCGGCCTCTTCCGCGTCTTCGCCTTCGCCCTCAGACGAGTC
GGATCTCCCTTTGGGCCGCCTCCCCGCATCGATACCGTCGACCTCGAGACCTA
GAAAAACATGGAGCAATCACAAGTAGCAATACAGCAGCTACCAATGCTGATT
GTGCCTGGCTAGAAGCACAAGAGGAGGAGGAGGTGGGTTTTCCAGTCACACC
TCAGGTACCTTTAAGACCAATGACTTACAAGGCAGCTGTAGATCTTAGCCACT
TTTTAAAAGAAAAGGGGGGACTGGAAGGGCTAATTCACTCCCAACGAAGACA
AGATATCCTTGATCTGTGGATCTACCACACACAAGGCTACTTCCCTGATTGGC
AGAACTACACACCAGGGCCAGGGATCAGATATCCACTGACCTTTGGATGGTG
CTACAAGCTAGTACCAGTTGAGCAAGAGAAGGTAGAAGAAGCCAATGAAGG
AGAGAACACCCGCTTGTTACACCCTGTGAGCCTGCATGGGATGGATGACCCG
GAGAGAGAAGTATTAGAGTGGAGGTTTGACAGCCGCCTAGCATTTCATCACA
TGGCCCGAGAGCTGCATCCGGACTGTACTGGGTCTCTCTGGTTAGACCAGATC
TGAGCCTGGGAGCTCTCTGGCTAACTAGGGAACCCACTGCTTAAGCCTCAATA
```

```
-continued
AAGCTTGCCTTGAGTGCTTCAAGTAGTGTGTGCCCGTCTGTTGTGTGACTCTG

GTAACTAGAGATCCCTCAGACCCTTTTAGTCAGTGTGGAAAATCTCTAGCAGG

GCCCGTTTAAACCCGCTGATCAGCCTCGACTGTGCCTTCTAGTTGCCAGCCAT

CTGTTGTTTGCCCCTCCCCCGTGCCTTCCTTGACCCTGGAAGGTGCCACTCCCA

CTGTCCTTTCCTAATAAAATGAGGAAATTGCATCGCATTGTCTGAGTAGGTGT

CATTCTATTCTGGGGGGTGGGGTGGGGCAGGACAGCAAGGGGGAGGATTGGG

AAGACAATAGCAGGCATGCTGGGGATGCGGTGGGCTCTATGGCTTCTGAGGC

GGAAAGAACCAGCTGGGGCTCTAGGGGGTATCCCCACGCGCCCTGTAGCGGC

GCATTAAGCGCGGCGGGTGTGGTGGTTACGCGCAGCGTGACCGCTACACTTG

CCAGCGCCCTAGCGCCCGCTCCTTTCGCTTTCTTCCCTTCCTTTCTCGCCACGT

TCGCCGGCTTTCCCCGTCAAGCTCTAAATCGGGGGCTCCCTTTAGGGTTCCGA

TTTAGTGCTTTACGGCACCTCGACCCCAAAAAACTTGATTAGGGTGATGGTTC

ACGTAGTGGGCCATCGCCCTGATAGACGGTTTTTCGCCCTTTGACGTTGGAGT

CCACGTTCTTTAATAGTGGACTCTTGTTCCAAACTGGAACAACACTCAACCCT

ATCTCGGTCTATTCTTTTGATTTATAAGGGATTTTGCCGATTTCGGCCTATTGG

TTAAAAAATGAGCTGATTTAACAAAAATTTAACGCGAATTAATTCTGTGGAAT

GTGTGTCAGTTAGGGTGTGGAAAGTCCCCAGGCTCCCCAGCAGGCAGAAGTA

TGCAAAGCATGCATCTCAATTAGTCAGCAACCAGGTGTGGAAAGTCCCCAGG

CTCCCCAGCAGGCAGAAGTATGCAAAGCATGCATCTCAATTAGTCAGCAACC

ATAGTCCCGCCCCTAACTCCGCCCATCCCGCCCCTAACTCCGCCCAGTTCCGC

CCATTCTCCGCCCCATGGCTGACTAATTTTTTTTATTTATGCAGAGGCCGAGG

CCGCCTCTGCCTCTGAGCTATTCCAGAAGTAGTGAGGAGGCTTTTTTGGAGGC

CTAGGCTTTTGCAAAAAGCTCCCGGGAGCTTGTATATCCATTTTCGGATCTGA

TCAGCACGTGTTGACAATTAATCATCGGCATAGTATATCGGCATAGTATAATA

CGACAAGGTGAGGAACTAAACCATGGCCAAGTTGACCAGTGCCGTTCCGGTG

CTCACCGCGCGCGACGTCGCCGGAGCGGTCGAGTTCTGGACCGACCGGCTCG

GGTTCTCCCGGGACTTCGTGGAGGACGACTTCGCCGGTGTGGTCCGGGACGA

CGTGACCCTGTTCATCAGCGCGGTCCAGGACCAGGTGGTGCCGGACAACACC

CTGGCCTGGGTGTGGGTGCGCGGCCTGGACGAGCTGTACGCCGAGTGGTCGG

AGGTCGTGTCCACGAACTTCCGGGACGCCTCCGGGCCGGCCATGACCGAGAT

CGGCGAGCAGCCGTGGGGCGGGAGTTCGCCCTGCGCGACCCGGCCGGCAAC

TGCGTGCACTTCGTGGCCGAGGAGCAGGACTGACACGTGCTACGAGATTTCG

ATTCCACCGCCGCCTTCTATGAAAGGTTGGGCTTCGGAATCGTTTTCCGGGAC

GCCGGCTGGATGATCCTCCAGCGCGGGGATCTCATGCTGGAGTTCTTCGCCCA

CCCCAACTTGTTTATTGCAGCTTATAATGGTTACAAATAAAGCAATAGCATCA

CAAATTTCACAAATAAAGCATTTTTTTCACTGCATTCTAGTTGTGGTTTGTCCA

AACTCATCAATGTATCTTATCATGTCTGTATACCGTCGACCTCTAGCTAGAGC

TTGGCGTAATCATGGTCATAGCTGTTTCCTGTGTGAAATTGTTATCCGCTCAC

AATTCCACACAACATACGAGCCGGAAGCATAAAGTGTAAAGCCTGGGGTGCC

TAATGAGTGAGCTAACTCACATTAATTGCGTTGCGCTCACTGCCCGCTTTCCA

GTCGGGAAACCTGTCGTGCCAGCTGCATTAATGAATCGGCCAACGCGCGGGG
```

```
AGAGGCGGTTTGCGTATTGGGCGCTCTTCCGCTTCCTCGCTCACTGACTCGCT

GCGCTCGGTCGTTCGGCTGCGGCGAGCGGTATCAGCTCACTCAAAGGCGGTA

ATACGGTTATCCACAGAATCAGGGGATAACGCAGGAAAGAACATGTGAGCA

AAAGGCCAGCAAAAGGCCAGGAACCGTAAAAAGGCCGCGTTGCTGGCGTTTT

TCCATAGGCTCCGCCCCCTGACGAGCATCACAAAAATCGACGCTCAAGTCA

GAGGTGGCGAAACCCGACAGGACTATAAAGATACCAGGCGTTTCCCCCTGGA

AGCTCCCTCGTGCGCTCTCCTGTTCCGACCCTGCCGCTTACCGGATACCTGTC

CGCCTTTCTCCCTTCGGGAAGCGTGGCGCTTTCTCATAGCTCACGCTGTAGGT

ATCTCAGTTCGGTGTAGGTCGTTCGCTCCAAGCTGGGCTGTGTGCACGAACCC

CCCGTTCAGCCCGACCGCTGCGCCTTATCCGGTAACTATCGTCTTGAGTCCAA

CCCGGTAAGACACGACTTATCGCCACTGGCAGCAGCCACTGGTAACAGGATT

AGCAGAGCGAGGTATGTAGGCGGTGCTACAGAGTTCTTGAAGTGGTGGCCTA

ACTACGGCTACACTAGAAGAACAGTATTTGGTATCTGCGCTCTGCTGAAGCCA

GTTACCTTCGGAAAAAGAGTTGGTAGCTCTTGATCCGGCAAACAAACCACCG

CTGGTAGCGGTGGTTTTTTTGTTTGCAAGCAGCAGATTACGCGCAGAAAAAA

AGGATCTCAAGAAGATCCTTTGATCTTTTCTACGGGGTCTGACGCTCAGTGGA

ACGAAAACTCACGTTAAGGGATTTTGGTCATGAGATTATCAAAAAGGATCTT

CACCTAGATCCTTTTAAATTAAAAATGAAGTTTTAAATCAATCTAAAGTATAT

ATGAGTAAACTTGGTCTGACAGTTACCAATGCTTAATCAGTGAGGCACCTATC

TCAGCGATCTGTCTATTTCGTTCATCCATAGTTGCCTGACTCCCCGTCGTGTAG

ATAACTACGATACGGGAGGGCTTACCATCTGGCCCCAGTGCTGCAATGATAC

CGCGAGACCCACGCTCACCGGCTCCAGATTTATCAGCAATAAACCAGCCAGC

CGGAAGGGCCGAGCGCAGAAGTGGTCCTGCAACTTTATCCGCCTCCATCCAG

TCTATTAATTGTTGCCGGGAAGCTAGAGTAAGTAGTTCGCCAGTTAATAGTTT

GCGCAACGTTGTTGCCATTGCTACAGGCATCGTGGTGTCACGCTCGTCGTTTG

GTATGGCTTCATTCAGCTCCGGTTCCCAACGATCAAGGCGAGTTACATGATCC

CCCATGTTGTGCAAAAAAGCGGTTAGCTCCTTCGGTCCTCCGATCGTTGTCAG

AAGTAAGTTGGCCGCAGTGTTATCACTCATGGTTATGGCAGCACTGCATAATT

CTCTTACTGTCATGCCATCCGTAAGATGCTTTTCTGTGACTGGTGAGTACTCA

ACCAAGTCATTCTGAGAATAGTGTATGCGGCGACCGAGTTGCTCTTGCCCGGC

GTCAATACGGGATAATACCGCGCCACATAGCAGAACTTTAAAAGTGCTCATC

ATTGGAAAACGTTCTTCGGGGCGAAAACTCTCAAGGATCTTACCGCTGTTGAG

ATCCAGTTCGATGTAACCCACTCGTGCACCCAACTGATCTTCAGCATCTTTTA

CTTTCACCAGCGTTTCTGGGTGAGCAAAAACAGGAAGGCAAAATGCCGCAAA

AAAGGGAATAAGGGCGACACGGAAATGTTGAATACTCATACTCTTCCTTTTTC

AATATTATTGAAGCATTTATCAGGGTTATTGTCTCATGAGCGGATACATATTT

GAATGTATTTAGAAAAATAAACAAATAGGGGTTCCGCGCACATTTCCCCGAA

AAGTGCCACCTGAC
``` pLY040_FLAG_mSreklip1 (SEQ ID NO: 84,612):
```
GTCGACGGATCGGGAGATCTCCCGATCCCCTATGGTGCACTCTCAGTACAATC

TGCTCTGATGCCGCATAGTTAAGCCAGTATCTGCTCCCTGCTTGTGTGTTGGA
```

```
GGTCGCTGAGTAGTGCGCGAGCAAAATTTAAGCTACAACAAGGCAAGGCTTG

ACCGACAATTGCATGAAGAATCTGCTTAGGGTTAGGCGTTTTGCGCTGCTTCG

CGATGTACGGGCCAGATATACGCGTTGACATTGATTATTGACTAGTTATTAAT

AGTAATCAATTACGGGGTCATTAGTTCATAGCCCATATATGGAGTTCCGCGTT

ACATAACTTACGGTAAATGGCCCGCCTGGCTGACCGCCCAACGACCCCCGCC

CATTGACGTCAATAATGACGTATGTTCCCATAGTAACGCCAATAGGGACTTTC

CATTGACGTCAATGGGTGGAGTATTTACGGTAAACTGCCCACTTGGCAGTACA

TCAAGTGTATCATATGCCAAGTACGCCCCCTATTGACGTCAATGACGGTAAAT

GGCCCGCCTGGCATTATGCCCAGTACATGACCTTATGGGACTTTCCTACTTGG

CAGTACATCTACGTATTAGTCATCGCTATTACCATGGTGATGCGGTTTTGGCA

GTACATCAATGGGCGTGGATAGCGGTTTGACTCACGGGGATTTCCAAGTCTCC

ACCCCATTGACGTCAATGGGAGTTTGTTTTGGCACCAAAATCAACGGGACTTT

CCAAAATGTCGTAACAACTCCGCCCCATTGACGCAAATGGGCGGTAGGCGTG

TACGGTGGGAGGTCTATATAAGCAGCGCGTTTTGCCTGTACTGGGTCTCTCTG

GTTAGACCAGATCTGAGCCTGGGAGCTCTCTGGCTAACTAGGGAACCCACTG

CTTAAGCCTCAATAAAGCTTGCCTTGAGTGCTTCAAGTAGTGTGTGCCCGTCT

GTTGTGTGACTCTGGTAACTAGAGATCCCTCAGACCCTTTTAGTCAGTGTGGA

AAATCTCTAGCAGTGGCGCCCGAACAGGGACTTGAAAGCGAAAGGGAAACC

AGAGGAGCTCTCTCGACGCAGGACTCGGCTTGCTGAAGCGCGCACGGCAAGA

GGCGAGGGGCGGCGACTGGTGAGTACGCCAAAAATTTTGACTAGCGGAGGCT

AGAAGGAGAGAGATGGGTGCGAGAGCGTCAGTATTAAGCGGGGAGAATTA

GATCGCGATGGGAAAAAATTCGGTTAAGGCCAGGGGGAAAGAAAAAATATA

AATTAAAACATATAGTATGGGCAAGCAGGGAGCTAGAACGATTCGCAGTTAA

TCCTGGCCTGTTAGAAACATCAGAAGGCTGTAGACAAATACTGGGACAGCTA

CAACCATCCCTTCAGACAGGATCAGAAGAACTTAGATCATTATATAATACAG

TAGCAACCCTCTATTGTGTGCATCAAAGGATAGAGATAAAAGACACCAAGGA

AGCTTTAGACAAGATAGAGGAAGAGCAAAACAAAAGTAAGACCACCGCACA

GCAAGCGGCCGCTGATCTTCAGACCTGGAGGAGGAGATATGAGGGACAATTG

GAGAAGTGAATTATATAAATATAAAGTAGTAAAAATTGAACCATTAGGAGTA

GCACCCACCAAGGCAAAGAGAAGAGTGGTGCAGAGAGAAAAAAGAGCAGTG

GGAATAGGAGCTTTGTTCCTTGGGTTCTTGGGAGCAGCAGGAAGCACTATGG

GCGCAGCGTCAATGACGCTGACGGTACAGGCCAGACAATTATTGTCTGGTAT

AGTGCAGCAGCAGAACAATTTGCTGAGGGCTATTGAGGCGCAACAGCATCTG

TTGCAACTCACAGTCTGGGGCATCAAGCAGCTCCAGGCAAGAATCCTGGCTG

TGGAAAGATACCTAAAGGATCAACAGCTCCTGGGGATTTGGGGTTGCTCTGG

AAAACTCATTTGCACCACTGCTGTGCCTTGGAATGCTAGTTGGAGTAATAAAT

CTCTGGAACAGATTTGGAATCACACGACCTGGATGGAGTGGGACAGAGAAAT

TAACAATTACACAAGCTTAATACACTCCTTAATTGAAGAATCGCAAAACCAG

CAAGAAAAGAATGAACAAGAATTATTGGAATTAGATAAATGGGCAAGTTTGT

GGAATTGGTTTAACATAACAAATTGGCTGTGGTATATAAAATTATTCATAATG
```

-continued
```
ATAGTAGGAGGCTTGGTAGGTTTAAGAATAGTTTTTGCTGTACTTTCTATAGT

GAATAGAGTTAGGCAGGGATATTCACCATTATCGTTTCAGACCCACCTCCCAA

CCCCGAGGGGACCCGACAGGCCCGAAGGAATAGAAGAAGAAGGTGGAGAGA

GAGACAGAGACAGATCCATTCGATTAGTGAACGGATCGGCACTGCGTGCGCC

AATTCTGCAGACAAATGGCAGTATTCATCCACAATTTTAAAAGAAAAGGGGG

GATTGGGGGTACAGTGCAGGGGAAAGAATAGTAGACATAATAGCAACAGA

CATACAAACTAAAGAATTACAAAAACAAATTACAAAAATTCAAAATTTTCGG

GTTTATTACAGGGACAGCAGAGATCCAGTTTGGTTAATTAGCTAGCTGCAAA

GATGGATAAAGTTTTAAACAGAGAGGAATCTTTGCAGCTAATGGACCTTCTA

GGTCTTGAAAGGAGTGGGAATTGGCTCCGGTGCCCGTCAGTGGGCAGAGCGC

ACATCGCCCACAGTCCCCGAGAAGTTGGGGGGAGGGGTCGGCAATTGAACCG

GTGCCTAGAGAAGGTGGCGCGGGGTAAACTGGGAAAGTGATGTCGTGTACTG

GCTCCGCCTTTTTCCCGAGGGTGGGGGAGAACCGTATATAAGTGCAGTAGTC

GCCGTGAACGTTCTTTTTCGCAACGGGTTTGCCGCCAGAACACAGGTAAGTGC

CGTGTGTGGTTCCCGCGGGCCTGGCCTCTTTACGGGTTATGGCCCTTGCGTGC

CTTGAATTACTTCCACCTGGCTGCAGTACGTGATTCTTGATCCCGAGCTTCGG

GTTGGAAGTGGGTGGGAGAGTTCGAGGCCTTGCGCTTAAGGAGCCCCTTCGC

CTCGTGCTTGAGTTGAGGCCTGGCCTGGGCGCTGGGGCCGCCGCGTGCGAAT

CTGGTGGCACCTTCGCGCCTGTCTCGCTGCTTTCGATAAGTCTCTAGCCATTTA

AAATTTTTGATGACCTGCTGCGACGCTTTTTTTCTGGCAAGATAGTCTTGTAA

ATGCGGGCCAAGATCTGCACACTGGTATTTCGGTTTTTGGGGCCGCGGGCGGC

GACGGGCCCGTGCGTCCCAGCGCACATGTTCGGCGAGGCGGGGCCTGCGAG

CGCGGCCACCGAGAATCGGACGGGGGTAGTCTCAAGCTGGCCGGCCTGCTCT

GGTGCCTGGCCTCGCGCCGCCGTGTATCGCCCCGCCCTGGGCGGCAAGGCTG

GCCCGGTCGGCACCAGTTGCGTGAGCGGAAAGATGGCCGCTTCCCGGCCCTG

CTGCAGGGAGCTCAAAATGGAGGACGCGGCGCTCGGGAGAGCGGGCGGGTG

AGTCACCCACACAAAGGAAAAGGGCCTTTCCGTCCTCAGCCGTCGCTTCATGT

GACTCCACGGAGTACCGGGCGCCGTCCAGGCACCTCGATTAGTTCTCGAGCTT

TTGGAGTACGTCGTCTTTAGGTTGGGGGGAGGGGTTTTATGCGATGGAGTTTC

CCCACACTGAGTGGGTGGAGACTGAAGTTAGGCCAGCTTGGCACTTGATGTA

ATTCTCCTTGGAATTTGCCCTTTTTGAGTTTGGATCTTGGTTCATTCTCAAGCC

TCAGACAGTGGTTCAAAGTTTTTTTCTTCCATTTCAGGTGTCGTGACGTACGG

CCACCATGGATTACAAAGACGATGACGATAAGATGGCAGTCCCAGGTTGCAA

CAAGGACAATGTCAGAGCAGGCTGCAGAAAATGTGGCTACCCTGGTCATCTG

ACTTTCGAGTGCCGCAATTTTCTCCGGGTAGATCCCAAAAGGGACATTGTGTT

GGACGTCAGCAGCACCAGTAGTGAGGACAGTGATGAAGAAAATGAGGAGCT

GAACAAGCTGCAGGCTCTGCAGGAGAAAAGAATAAATGAAGAAGAGGAAAA

GAAAAAGGAAAAGAGCAGGGAGAAAATTAAATTGAAGAAAAGGAGGAAAA

GGTCTTACTCCAGTGCCACTGAAGAGGACTCCGCAAAACAAAAGAAACAGAA

GTATCAGAAAAAGAAAAGAAAAAGGAAAAAAAGAACAAGTCAAAGAAAG

GAAAGCATCACAAAAAGGAAAAAAAGAAGAGAAAAAAGGAAAAGCGTTCTT
```

-continued

```
CCCCTTACCATTCTGAACTCACCAAAAAGTAAGAATTCGATATCAAGCTTATC

GATAATCAACCTCTGGATTACAAAATTTGTGAAAGATTGACTGGTATTCTTAA

CTATGTTGCTCCTTTTACGCTATGTGGATACGCTGCTTTAATGCCTTTGTATCA

TGCTATTGCTTCCCGTATGGCTTTCATTTTCTCCTCCTTGTATAAATCCTGGTT

GCTGTCTCTTTATGAGGAGTTGTGGCCCGTTGTCAGGCAACGTGGCGTGGTGT

GCACTGTGTTTGCTGACGCAACCCCCACTGGTTGGGGCATTGCCACCACCTGT

CAGCTCCTTTCCGGGACTTTCGCTTTCCCCCTCCCTATTGCCACGGCGGAACTC

ATCGCCGCCTGCCTTGCCCGCTGCTGGACAGGGGCTCGGCTGTTGGGCACTGA

CAATTCCGTGGTGTTGTCGGGGAAATCATCGTCCTTTCCTTGGCTGCTCGCCT

GTGTTGCCACCTGGATTCTGCGCGGGACGTCCTTCTGCTACGTCCCTTCGGCC

CTCAATCCAGCGGACCTTCCTTCCCGCGGCCTGCTGCCGGCTCTGCGGCCTCT

TCCGCGTCTTCGCCTTCGCCCTCAGACGAGTCGGATCTCCCTTTGGGCCGCCT

CCCCGCATCGATACCGTCGACCTCGAGACCTAGAAAAACATGGAGCAATCAC

AAGTAGCAATACAGCAGCTACCAATGCTGATTGTGCCTGGCTAGAAGCACAA

GAGGAGGAGGAGGTGGGTTTTCCAGTCACACCTCAGGTACCTTTAAGACCAA

TGACTTACAAGGCAGCTGTAGATCTTAGCCACTTTTTAAAAGAAAAGGGGGG

ACTGGAAGGGCTAATTCACTCCCAACGAAGACAAGATATCCTTGATCTGTGG

ATCTACCACACACAAGGCTACTTCCCTGATTGGCAGAACTACACACCAGGGC

CAGGGATCAGATATCCACTGACCTTTGGATGGTGCTACAAGCTAGTACCAGTT

GAGCAAGAGAAGGTAGAAGAAGCCAATGAAGGAGAGAACACCCGCTTGTTA

CACCCTGTGAGCCTGCATGGGATGGATGACCCGGAGAGAGAAGTATTAGAGT

GGAGGTTTGACAGCCGCCTAGCATTTCATCACATGGCCCGAGAGCTGCATCC

GGACTGTACTGGGTCTCTCTGGTTAGACCAGATCTGAGCCTGGGAGCTCTCTG

GCTAACTAGGGAACCCACTGCTTAAGCCTCAATAAAGCTTGCCTTGAGTGCTT

CAAGTAGTGTGTGCCCGTCTGTTGTGTGACTCTGGTAACTAGAGATCCCTCAG

ACCCTTTTAGTCAGTGTGGAAAATCTCTAGCAGGGCCCGTTTAAACCCGCTGA

TCAGCCTCGACTGTGCCTTCTAGTTGCCAGCCATCTGTTGTTTGCCCCTCCCCC

GTGCCTTCCTTGACCCTGGAAGGTGCCACTCCCACTGTCCTTTCCTAATAAAA

TGAGGAAATTGCATCGCATTGTCTGAGTAGGTGTCATTCTATTCTGGGGGGTG

GGGTGGGGCAGGACAGCAAGGGGGAGGATTGGGAAGACAATAGCAGGCATG

CTGGGGATGCGGTGGGCTCTATGGCTTCTGAGGCGGAAAGAACCAGCTGGGG

CTCTAGGGGGTATCCCCACGCGCCCTGTAGCGGCGCATTAAGCGCGGCGGGT

GTGGTGGTTACGCGCAGCGTGACCGCTACACTTGCCAGCGCCCTAGCGCCCG

CTCCTTTCGCTTTCTTCCCTTCCTTTCTCGCCACGTTCGCCGGCTTTCCCCGTCA

AGCTCTAAATCGGGGGCTCCCTTTAGGGTTCCGATTTAGTGCTTTACGGCACC

TCGACCCCAAAAAACTTGATTAGGGTGATGGTTCACGTAGTGGGCCATCGCC

CTGATAGACGGTTTTTCGCCCTTTGACGTTGGAGTCCACGTTCTTTAATAGTG

GACTCTTGTTCCAAACTGGAACAACACTCAACCCTATCTCGGTCTATTCTTTTG

ATTTATAAGGGATTTTGCCGATTTCGGCCTATTGGTTAAAAAATGAGCTGATT

TAACAAAAATTTAACGCGAATTAATTCTGTGGAATGTGTGTCAGTTAGGGTGT
```

-continued

```
GGAAAGTCCCCAGGCTCCCCAGCAGGCAGAAGTATGCAAAGCATGCATCTCA

ATTAGTCAGCAACCAGGTGTGGAAAGTCCCCAGGCTCCCCAGCAGGCAGAAG

TATGCAAAGCATGCATCTCAATTAGTCAGCAACCATAGTCCCGCCCCTAACTC

CGCCCATCCCGCCCCTAACTCCGCCCAGTTCCGCCCATTCTCCGCCCCATGGC

TGACTAATTTTTTTATTTATGCAGAGGCCGAGGCCGCCTCTGCCTCTGAGCT

ATTCCAGAAGTAGTGAGGAGGCTTTTTTGGAGGCCTAGGCTTTTGCAAAAAG

CTCCCGGGAGCTTGTATATCCATTTTCGGATCTGATCAGCACGTGTTGACAAT

TAATCATCGGCATAGTATATCGGCATAGTATAATACGACAAGGTGAGGAACT

AAACCATGGCCAAGTTGACCAGTGCCGTTCCGGTGCTCACCGCGCGCGACGT

CGCCGGAGCGGTCGAGTTCTGGACCGACCGGCTCGGGTTCTCCCGGGACTTC

GTGGAGGACGACTTCGCCGGTGTGGTCCGGGACGACGTGACCCTGTTCATCA

GCGCGGTCCAGGACCAGGTGGTGCCGGACAACACCCTGGCCTGGGTGTGGGT

GCGCGGCCTGGACGAGCTGTACGCCGAGTGGTCGGAGGTCGTGTCCACGAAC

TTCCGGGACGCCTCCGGGCCGGCCATGACCGAGATCGGCGAGCAGCCGTGGG

GGCGGGAGTTCGCCCTGCGCGACCCGGCCGGCAACTGCGTGCACTTCGTGGC

CGAGGAGCAGGACTGACACGTGCTACGAGATTTCGATTCCACCGCCGCCTTCT

ATGAAAGGTTGGGCTTCGGAATCGTTTTCCGGGACGCCGGCTGGATGATCCTC

CAGCGCGGGGATCTCATGCTGGAGTTCTTCGCCCACCCCAACTTGTTTATTGC

AGCTTATAATGGTTACAAATAAAGCAATAGCATCACAAATTTCACAAATAAA

GCATTTTTTTCACTGCATTCTAGTTGTGGTTTGTCCAAACTCATCAATGTATCT

TATCATGTCTGTATACCGTCGACCTCTAGCTAGAGCTTGGCGTAATCATGGTC

ATAGCTGTTTCCTGTGTGAAATTGTTATCCGCTCACAATTCCACACAACATAC

GAGCCGGAAGCATAAAGTGTAAAGCCTGGGGTGCCTAATGAGTGAGCTAACT

CACATTAATTGCGTTGCGCTCACTGCCCGCTTTCCAGTCGGGAAACCTGTCGT

GCCAGCTGCATTAATGAATCGGCCAACGCGCGGGGAGAGGCGGTTTGCGTAT

TGGGCGCTCTTCCGCTTCCTCGCTCACTGACTCGCTGCGCTCGGTCGTTCGGCT

GCGGCGAGCGGTATCAGCTCACTCAAAGGCGGTAATACGGTTATCCACAGAA

TCAGGGGATAACGCAGGAAAGAACATGTGAGCAAAAGGCCAGCAAAAGGCC

AGGAACCGTAAAAAGGCCGCGTTGCTGGCGTTTTTCCATAGGCTCCGCCCCCC

TGACGAGCATCACAAAAATCGACGCTCAAGTCAGAGGTGGCGAAACCCGACA

GGACTATAAAGATACCAGGCGTTTCCCCCTGGAAGCTCCCTCGTGCGCTCTCC

TGTTCCGACCCTGCCGCTTACCGGATACCTGTCCGCCTTTCTCCCTTCGGGAA

GCGTGGCGCTTTCTCATAGCTCACGCTGTAGGTATCTCAGTTCGGTGTAGGTC

GTTCGCTCCAAGCTGGGCTGTGTGCACGAACCCCCCGTTCAGCCCGACCGCTG

CGCCTTATCCGGTAACTATCGTCTTGAGTCCAACCCGGTAAGACACGACTTAT

CGCCACTGGCAGCAGCCACTGGTAACAGGATTAGCAGAGCGAGGTATGTAGG

CGGTGCTACAGAGTTCTTGAAGTGGTGGCCTAACTACGGCTACACTAGAAGA

ACAGTATTTGGTATCTGCGCTCTGCTGAAGCCAGTTACCTTCGGAAAAAGAGT

TGGTAGCTCTTGATCCGGCAAACAAACCACCGCTGGTAGCGGTGGTTTTTTTG

TTTGCAAGCAGCAGATTACGCGCAGAAAAAAAGGATCTCAAGAAGATCCTTT

GATCTTTTCTACGGGGTCTGACGCTCAGTGGAACGAAAACTCACGTTAAGGG
```

-continued

```
ATTTTGGTCATGAGATTATCAAAAAGGATCTTCACCTAGATCCTTTTAAATTA
AAAATGAAGTTTTAAATCAATCTAAAGTATATATGAGTAAACTTGGTCTGACA
GTTACCAATGCTTAATCAGTGAGGCACCTATCTCAGCGATCTGTCTATTTCGT
TCATCCATAGTTGCCTGACTCCCCGTCGTGTAGATAACTACGATACGGGAGGG
CTTACCATCTGGCCCCAGTGCTGCAATGATACCGCGAGACCCACGCTCACCG
GCTCCAGATTTATCAGCAATAAACCAGCCAGCCGGAAGGGCCGAGCGCAGAA
GTGGTCCTGCAACTTTATCCGCCTCCATCCAGTCTATTAATTGTTGCCGGGAA
GCTAGAGTAAGTAGTTCGCCAGTTAATAGTTTGCGCAACGTTGTTGCCATTGC
TACAGGCATCGTGGTGTCACGCTCGTCGTTTGGTATGGCTTCATTCAGCTCCG
GTTCCCAACGATCAAGGCGAGTTACATGATCCCCCATGTTGTGCAAAAAAGC
GGTTAGCTCCTTCGGTCCTCCGATCGTTGTCAGAAGTAAGTTGGCCGCAGTGT
TATCACTCATGGTTATGGCAGCACTGCATAATTCTCTTACTGTCATGCCATCC
GTAAGATGCTTTTCTGTGACTGGTGAGTACTCAACCAAGTCATTCTGAGAATA
GTGTATGCGGCGACCGAGTTGCTCTTGCCCGGCGTCAATACGGGATAATACC
GCGCCACATAGCAGAACTTTAAAAGTGCTCATCATTGGAAAACGTTCTTCGG
GGCGAAAACTCTCAAGGATCTTACCGCTGTTGAGATCCAGTTCGATGTAACCC
ACTCGTGCACCCAACTGATCTTCAGCATCTTTTACTTTCACCAGCGTTTCTGGG
TGAGCAAAAACAGGAAGGCAAAATGCCGCAAAAAAGGGAATAAGGGCGACA
CGGAAATGTTGAATACTCATACTCTTCCTTTTTCAATATTATTGAAGCATTTAT
CAGGGTTATTGTCTCATGAGCGGATACATATTTGAATGTATTTAGAAAAATAA
ACAAATAGGGGTTCCGCGCACATTTCCCCGAAAAGTGCCACCTGAC
pLY040_FLAG_mProhd2 (SEQ ID NO: 84,613):
GTCGACGGATCGGGAGATCTCCCGATCCCCTATGGTGCACTCTCAGTACAATC
TGCTCTGATGCCGCATAGTTAAGCCAGTATCTGCTCCCTGCTTGTGTGTTGGA
GGTCGCTGAGTAGTGCGCGAGCAAAATTTAAGCTACAACAAGGCAAGGCTTG
ACCGACAATTGCATGAAGAATCTGCTTAGGGTTAGGCGTTTTGCGCTGCTTCG
CGATGTACGGGCCAGATATACGCGTTGACATTGATTATTGACTAGTTATTAAT
AGTAATCAATTACGGGGTCATTAGTTCATAGCCCATATATGGAGTTCCGCGTT
ACATAACTTACGGTAAATGGCCCGCCTGGCTGACCGCCCAACGACCCCCGCC
CATTGACGTCAATAATGACGTATGTTCCCATAGTAACGCCAATAGGGACTTTC
CATTGACGTCAATGGGTGGAGTATTTACGGTAAACTGCCCACTTGGCAGTACA
TCAAGTGTATCATATGCCAAGTACGCCCCCTATTGACGTCAATGACGGTAAAT
GGCCCGCCTGGCATTATGCCCAGTACATGACCTTATGGGACTTTCCTACTTGG
CAGTACATCTACGTATTAGTCATCGCTATTACCATGGTGATGCGGTTTTGGCA
GTACATCAATGGGCGTGGATAGCGGTTTGACTCACGGGGATTTCCAAGTCTCC
ACCCCATTGACGTCAATGGGAGTTTGTTTTGGCACCAAAATCAACGGGACTTT
CCAAAATGTCGTAACAACTCCGCCCCATTGACGCAAATGGGCGGTAGGCGTG
TACGGTGGGAGGTCTATATAAGCAGCGCGTTTTGCCTGTACTGGGTCTCTCTG
GTTAGACCAGATCTGAGCCTGGGAGCTCTCTGGCTAACTAGGGAACCCACTG
CTTAAGCCTCAATAAAGCTTGCCTTGAGTGCTTCAAGTAGTGTGTGCCCGTCT
GTTGTGTGACTCTGGTAACTAGAGATCCCTCAGACCCTTTTAGTCAGTGTGGA
```

-continued

```
AAATCTCTAGCAGTGGCGCCCGAACAGGGACTTGAAAGCGAAAGGGAAACC

AGAGGAGCTCTCTCGACGCAGGACTCGGCTTGCTGAAGCGCGCACGGCAAGA

GGCGAGGGGCGGCGACTGGTGAGTACGCCAAAAATTTTGACTAGCGGAGGCT

AGAAGGAGAGAGATGGGTGCGAGAGCGTCAGTATTAAGCGGGGGAGAATTA

GATCGCGATGGGAAAAAATTCGGTTAAGGCCAGGGGGAAAGAAAAAATATA

AATTAAAACATATAGTATGGGCAAGCAGGGAGCTAGAACGATTCGCAGTTAA

TCCTGGCCTGTTAGAAACATCAGAAGGCTGTAGACAAATACTGGGACAGCTA

CAACCATCCCTTCAGACAGGATCAGAAGAACTTAGATCATTATATAATACAG

TAGCAACCCTCTATTGTGTGCATCAAAGGATAGAGATAAAAGACACCAAGGA

AGCTTTAGACAAGATAGAGGAAGAGCAAAACAAAAGTAAGACCACCGCACA

GCAAGCGGCCGCTGATCTTCAGACCTGGAGGAGGAGATATGAGGGACAATTG

GAGAAGTGAATTATATAAATATAAAGTAGTAAAAATTGAACCATTAGGAGTA

GCACCCACCAAGGCAAAGAGAAGAGTGGTGCAGAGAGAAAAAAGAGCAGTG

GGAATAGGAGCTTTGTTCCTTGGGTTCTTGGGAGCAGCAGGAAGCACTATGG

GCGCAGCGTCAATGACGCTGACGGTACAGGCCAGACAATTATTGTCTGGTAT

AGTGCAGCAGCAGAACAATTTGCTGAGGGCTATTGAGGCGCAACAGCATCTG

TTGCAACTCACAGTCTGGGGCATCAAGCAGCTCCAGGCAAGAATCCTGGCTG

TGGAAAGATACCTAAAGGATCAACAGCTCCTGGGGATTTGGGGTTGCTCTGG

AAAACTCATTTGCACCACTGCTGTGCCTTGGAATGCTAGTTGGAGTAATAAAT

CTCTGGAACAGATTTGGAATCACACGACCTGGATGGAGTGGGACAGAGAAAT

TAACAATTACACAAGCTTAATACACTCCTTAATTGAAGAATCGCAAAACCAG

CAAGAAAAGAATGAACAAGAATTATTGGAATTAGATAAATGGGCAAGTTTGT

GGAATTGGTTTAACATAACAAATTGGCTGTGGTATATAAAATTATTCATAATG

ATAGTAGGAGGCTTGGTAGGTTTAAGAATAGTTTTTGCTGTACTTTCTATAGT

GAATAGAGTTAGGCAGGGATATTCACCATTATCGTTTCAGACCCACCTCCCAA

CCCCGAGGGGACCCGACAGGCCCGAAGGAATAGAAGAAGAAGGTGGAGAGA

GAGACAGAGACAGATCCATTCGATTAGTGAACGGATCGGCACTGCGTGCGCC

AATTCTGCAGACAAATGGCAGTATTCATCCACAATTTTAAAAGAAAAGGGGG

GATTGGGGGGTACAGTGCAGGGGAAAGAATAGTAGACATAATAGCAACAGA

CATACAAACTAAAGAATTACAAAAACAAATTACAAAAATTCAAAATTTTCGG

GTTTATTACAGGGACAGCAGAGATCCAGTTTGGTTAATTAGCTAGCTGCAAA

GATGGATAAAGTTTTAAACAGAGAGGAATCTTTGCAGCTAATGGACCTTCTA

GGTCTTGAAAGGAGTGGGAATTGGCTCCGGTGCCCGTCAGTGGGCAGAGCGC

ACATCGCCCACAGTCCCCGAGAAGTTGGGGGGAGGGGTCGGCAATTGAACCG

GTGCCTAGAGAAGGTGGCGCGGGGTAAACTGGGAAAGTGATGTCGTGTACTG

GCTCCGCCTTTTTCCCGAGGGTGGGGGAGAACCGTATATAAGTGCAGTAGTC

GCCGTGAACGTTCTTTTTCGCAACGGGTTTGCCGCCAGAACACAGGTAAGTGC

CGTGTGTGGTTCCCGCGGGCCTGGCCTCTTTACGGGTTATGGCCCTTGCGTGC

CTTGAATTACTTCCACCTGGCTGCAGTACGTGATTCTTGATCCCGAGCTTCGG

GTTGGAAGTGGGTGGGAGAGTTCGAGGCCTTGCGCTTAAGGAGCCCCTTCGC
```

```
-continued
CTCGTGCTTGAGTTGAGGCCTGGCCTGGGCGCTGGGGCCGCCGCGTGCGAAT

CTGGTGGCACCTTCGCGCCTGTCTCGCTGCTTTCGATAAGTCTCTAGCCATTTA

AAATTTTTGATGACCTGCTGCGACGCTTTTTTTCTGGCAAGATAGTCTTGTAA

ATGCGGGCCAAGATCTGCACACTGGTATTTCGGTTTTTGGGGCCGCGGGCGGC

GACGGGGCCCGTGCGTCCCAGCGCACATGTTCGGCGAGGCGGGGCCTGCGAG

CGCGGCCACCGAGAATCGGACGGGGGTAGTCTCAAGCTGGCCGGCCTGCTCT

GGTGCCTGGCCTCGCGCCGCCGTGTATCGCCCCGCCCTGGGCGGCAAGGCTG

GCCCGGTCGGCACCAGTTGCGTGAGCGGAAAGATGGCCGCTTCCCGGCCCTG

CTGCAGGGAGCTCAAAATGGAGGACGCGGCGCTCGGGAGAGCGGGCGGGTG

AGTCACCCACACAAAGGAAAAGGGCCTTTCCGTCCTCAGCCGTCGCTTCATGT

GACTCCACGGAGTACCGGGCGCCGTCCAGGCACCTCGATTAGTTCTCGAGCTT

TTGGAGTACGTCGTCTTTAGGTTGGGGGGAGGGGTTTTATGCGATGGAGTTTC

CCCACACTGAGTGGGTGGAGACTGAAGTTAGGCCAGCTTGGCACTTGATGTA

ATTCTCCTTGGAATTTGCCCTTTTTGAGTTTGGATCTTGGTTCATTCTCAAGCC

TCAGACAGTGGTTCAAAGTTTTTTTCTTCCATTTCAGGTGTCGTGACGTACGG

CCACCATGGATTACAAAGACGATGACGATAAGATGATCTGGACGCGTCTGCC

GCTGTATGGCCCCTCCAAGCCCTCTACAGGTGGCTGGCAGCCCTGCGCTTTG

ATGGTGGGCCTTCCATGTCAAGGGAACCGCAGAACTGGCACGGGCTTTGCT

AGTGCTTCGCCTATGCGCCTGGCCCCCTTTGGTCACTCATGGACTAGCGTTTC

AGGCCTGGTCTCAGCGACTCCTGGGATCCCGGCTCTCAGGCGCACTTCTTCGA

GCATCCATCTACGGGCAGTTTGTGGCCGGGGAGACAGCAGAGGAAGTGAGGA

ACTGTGTCGGGCAGCTGCAGGCCCTGGGACTCCAGCCCCTGTTGGCAGTACC

CACCGAGGAGGAACCAGACTCCACTGCCAAGACCAGTGAGGTCTGGTATGAG

GAGAACCTTAGCGCCATGCTGCGCTGTGTGGACTTATCCCGAGCCCTCGTGGA

CGCCCACGGCCCAGCCAGGAACAGCCTCATGCAGCTGAAGGTGACCGCGCTA

GCCAGCACTCGGCTTTGTAAAGAGCTGTCGGCTTGGATCCAAAGACCCAGAG

GCTCCTCGGAGCTGAGCCCTGAGAGGCTGGCAGAAGCCATGGACTCGGGTCG

GAACCTCCAGCTCTCCTGCCTCAGCACAGAACAGAATCAGCACCTGCAGGCC

TCCCTCAGCCGCTTGCACCGAGTGGCACAGCACGCCCGGGCGAAGTGTGTGC

GGCTGCTGGTAGATGCTGAATATACTTTCATTAACCCTGCACTGTCCCTGCTG

GTGGCTGCCCTGGCTGTGCGCTGGAACAGCCCTGAGGAAGGTGGTCCGTGGG

TGTGGAACACTTACCAGGCCTATCTAAAGGACACTCACCAACGGCTGGAGCA

GGACGCCGAGGCAGCACACAAGGCTGGCCTGGCATTTGGGGTGAAGTTGGTG

CGAGGTGCCTATCTGGACAAGGAGAGATCCATGACACAGCTCCAAGGGAAGG

AAGACTGTACCCAGCCTGACTATGAGGCCACTAGTCGGAGTTACAGCCGCTG

TCTAGAGCTGATGCTGCGCTGCGTGTCGAACCACGGTCCCCCGTGTCACCTCA

TGGTGGCTTCCCACAATGAAGAATCCGTTCGCCAGGCAACTAAGCGCATGTG

GGAGCTGGGCATTCCTCTGGATGGGCCTGTCTGTTTTGGACAACTTCTGGGCA

TGTGTGACCATGTCTCCCTGGCATTAGGGCAGGCTGGATATATGGTGTACAAG

TCTATTCCCTATGGCTGCCTGGAGGAGGTGATTCCCTACCTGATCCGAAGAGC

CCAGGAGAACAGGAGTGTGCTGCAGGGTGCCCGCAGGGAGCAGGCACTACTC
```

-continued

```
AGCCAGGAACTGTGGCGGAGACTGCTGGGAAGGACGGCCTAAGAATTCGATA
TCAAGCTTATCGATAATCAACCTCTGGATTACAAAATTTGTGAAAGATTGACT
GGTATTCTTAACTATGTTGCTCCTTTTACGCTATGTGGATACGCTGCTTTAATG
CCTTTGTATCATGCTATTGCTTCCCGTATGGCTTTCATTTTCTCCTCCTTGTATA
AATCCTGGTTGCTGTCTCTTTATGAGGAGTTGTGGCCCGTTGTCAGGCAACGT
GGCGTGGTGTGCACTGTGTTTGCTGACGCAACCCCCACTGGTTGGGGCATTGC
CACCACCTGTCAGCTCCTTTCCGGGACTTTCGCTTTCCCCCTCCCTATTGCCAC
GGCGGAACTCATCGCCGCCTGCCTTGCCCGCTGCTGGACAGGGGCTCGGCTG
TTGGGCACTGACAATTCCGTGGTGTTGTCGGGGAAATCATCGTCCTTTCCTTG
GCTGCTCGCCTGTGTTGCCACCTGGATTCTGCGCGGGACGTCCTTCTGCTACG
TCCCTTCGGCCCTCAATCCAGCGGACCTTCCTTCCCGCGGCCTGCTGCCGGCT
CTGCGGCCTCTTCCGCGTCTTCGCCTTCGCCCTCAGACGAGTCGGATCTCCCTT
TGGGCCGCCTCCCCGCATCGATACCGTCGACCTCGAGACCTAGAAAAACATG
GAGCAATCACAAGTAGCAATACAGCAGCTACCAATGCTGATTGTGCCTGGCT
AGAAGCACAAGAGGAGGAGGAGGTGGGTTTTCCAGTCACACCTCAGGTACCT
TTAAGACCAATGACTTACAAGGCAGCTGTAGATCTTAGCCACTTTTTAAAAGA
AAAGGGGGACTGGAAGGGCTAATTCACTCCCAACGAAGACAAGATATCCTT
GATCTGTGGATCTACCACACACAAGGCTACTTCCCTGATTGGCAGAACTACAC
ACCAGGGCCAGGGATCAGATATCCACTGACCTTTGGATGGTGCTACAAGCTA
GTACCAGTTGAGCAAGAGAAGGTAGAAGAAGCCAATGAAGGAGAGAACACC
CGCTTGTTACACCCTGTGAGCCTGCATGGGATGGATGACCCGGAGAGAGAAG
TATTAGAGTGGAGGTTTGACAGCCGCCTAGCATTTCATCACATGGCCCGAGA
GCTGCATCCGGACTGTACTGGGTCTCTCTGGTTAGACCAGATCTGAGCCTGGG
AGCTCTCTGGCTAACTAGGGAACCCACTGCTTAAGCCTCAATAAAGCTTGCCT
TGAGTGCTTCAAGTAGTGTGTGCCCGTCTGTTGTGTGACTCTGGTAACTAGAG
ATCCCTCAGACCCTTTTAGTCAGTGTGGAAAATCTCTAGCAGGGCCCGTTTAA
ACCCGCTGATCAGCCTCGACTGTGCCTTCTAGTTGCCAGCCATCTGTTGTTTGC
CCCTCCCCCGTGCCTTCCTTGACCCTGGAAGGTGCCACTCCCACTGTCCTTTCC
TAATAAAATGAGGAAATTGCATCGCATTGTCTGAGTAGGTGTCATTCTATTCT
GGGGGGTGGGGTGGGGCAGGACAGCAAGGGGGAGGATTGGGAAGACAATAG
CAGGCATGCTGGGGATGCGGTGGGCTCTATGGCTTCTGAGGCGGAAAGAACC
AGCTGGGGCTCTAGGGGGTATCCCCACGCGCCCTGTAGCGGCGCATTAAGCG
CGGCGGGTGTGGTGGTTACGCGCAGCGTGACCGCTACACTTGCCAGCGCCCT
AGCGCCCGCTCCTTTCGCTTTCTTCCCTTCCTTTCTCGCCACGTTCGCCGGCTT
TCCCCGTCAAGCTCTAAATCGGGGGCTCCCTTTAGGGTTCCGATTTAGTGCTT
TACGGCACCTCGACCCCAAAAAACTTGATTAGGGTGATGGTTCACGTAGTGG
GCCATCGCCCTGATAGACGGTTTTTCGCCCTTTGACGTTGGAGTCCACGTTCTT
TAATAGTGGACTCTTGTTCCAAACTGGAACAACACTCAACCCTATCTCGGTCT
ATTCTTTTGATTTATAAGGGATTTTGCCGATTTCGGCCTATTGGTTAAAAAATG
AGCTGATTTAACAAAAATTTAACGCGAATTAATTCTGTGGAATGTGTGTCAGT
```

-continued
TAGGGTGTGGAAAGTCCCCAGGCTCCCCAGCAGGCAGAAGTATGCAAAGCAT

GCATCTCAATTAGTCAGCAACCAGGTGTGGAAAGTCCCCAGGCTCCCCAGCA

GGCAGAAGTATGCAAAGCATGCATCTCAATTAGTCAGCAACCATAGTCCCGC

CCCTAACTCCGCCCATCCCGCCCCTAACTCCGCCCAGTTCCGCCCATTCTCCG

CCCCATGGCTGACTAATTTTTTTATTTATGCAGAGGCCGAGGCCGCCTCTGC

CTCTGAGCTATTCCAGAAGTAGTGAGGAGGCTTTTTTGGAGGCCTAGGCTTTT

GCAAAAAGCTCCCGGGAGCTTGTATATCCATTTTCGGATCTGATCAGCACGTG

TTGACAATTAATCATCGGCATAGTATATCGGCATAGTATAATACGACAAGGT

GAGGAACTAAACCATGGCCAAGTTGACCAGTGCCGTTCCGGTGCTCACCGCG

CGCGACGTCGCCGGAGCGGTCGAGTTCTGGACCGACCGGCTCGGGTTCTCCC

GGGACTTCGTGGAGGACGACTTCGCCGGTGTGGTCCGGGACGACGTGACCCT

GTTCATCAGCGCGGTCCAGGACCAGGTGGTGCCGGACAACACCCTGGCCTGG

GTGTGGGTGCGCGGCCTGGACGAGCTGTACGCCGAGTGGTCGGAGGTCGTGT

CCACGAACTTCCGGGACGCCTCCGGGCCGGCCATGACCGAGATCGGCGAGCA

GCCGTGGGGCGGGAGTTCGCCCTGCGCGACCCGGCCGGCAACTGCGTGCAC

TTCGTGGCCGAGGAGCAGGACTGACACGTGCTACGAGATTTCGATTCCACCG

CCGCCTTCTATGAAAGGTTGGGCTTCGGAATCGTTTTCCGGGACGCCGGCTGG

ATGATCCTCCAGCGCGGGGATCTCATGCTGGAGTTCTTCGCCCACCCCAACTT

GTTTATTGCAGCTTATAATGGTTACAAATAAAGCAATAGCATCACAAATTTCA

CAAATAAAGCATTTTTTTCACTGCATTCTAGTTGTGGTTTGTCCAAACTCATCA

ATGTATCTTATCATGTCTGTATACCGTCGACCTCTAGCTAGAGCTTGGCGTAA

TCATGGTCATAGCTGTTTCCTGTGTGAAATTGTTATCCGCTCACAATTCCACAC

AACATACGAGCCGGAAGCATAAAGTGTAAAGCCTGGGGTGCCTAATGAGTGA

GCTAACTCACATTAATTGCGTTGCGCTCACTGCCCGCTTTCCAGTCGGGAAAC

CTGTCGTGCCAGCTGCATTAATGAATCGGCCAACGCGCGGGGAGAGGCGGTT

TGCGTATTGGGCGCTCTTCCGCTTCCTCGCTCACTGACTCGCTGCGCTCGGTCG

TTCGGCTGCGGCGAGCGGTATCAGCTCACTCAAAGGCGGTAATACGGTTATC

CACAGAATCAGGGGATAACGCAGGAAAGAACATGTGAGCAAAAGGCCAGCA

AAAGGCCAGGAACCGTAAAAAGGCCGCGTTGCTGGCGTTTTTCCATAGGCTC

CGCCCCCCTGACGAGCATCACAAAAATCGACGCTCAAGTCAGAGGTGGCGAA

ACCCGACAGGACTATAAAGATACCAGGCGTTTCCCCCTGGAAGCTCCCTCGT

GCGCTCTCCTGTTCCGACCCTGCCGCTTACCGGATACCTGTCCGCCTTTCTCCC

TTCGGGAAGCGTGGCGCTTTCTCATAGCTCACGCTGTAGGTATCTCAGTTCGG

TGTAGGTCGTTCGCTCCAAGCTGGGCTGTGTGCACGAACCCCCCGTTCAGCCC

GACCGCTGCGCCTTATCCGGTAACTATCGTCTTGAGTCCAACCCGGTAAGACA

CGACTTATCGCCACTGGCAGCAGCCACTGGTAACAGGATTAGCAGAGCGAGG

TATGTAGGCGGTGCTACAGAGTTCTTGAAGTGGTGGCCTAACTACGGCTACAC

TAGAAGAACAGTATTTGGTATCTGCGCTCTGCTGAAGCCAGTTACCTTCGGAA

AAAGAGTTGGTAGCTCTTGATCCGGCAAACAAACCACCGCTGGTAGCGGTGG

TTTTTTTGTTTGCAAGCAGCAGATTACGCGCAGAAAAAAAGGATCTCAAGAA

GATCCTTTGATCTTTTCTACGGGGTCTGACGCTCAGTGGAACGAAAACTCACG

-continued

```
TTAAGGGATTTTGGTCATGAGATTATCAAAAAGGATCTTCACCTAGATCCTTT

TAAATTAAAAATGAAGTTTTAAATCAATCTAAAGTATATATGAGTAAACTTGG

TCTGACAGTTACCAATGCTTAATCAGTGAGGCACCTATCTCAGCGATCTGTCT

ATTTCGTTCATCCATAGTTGCCTGACTCCCCGTCGTGTAGATAACTACGATAC

GGGAGGGCTTACCATCTGGCCCCAGTGCTGCAATGATACCGCGAGACCCACG

CTCACCGGCTCCAGATTTATCAGCAATAAACCAGCCAGCCGGAAGGGCCGAG

CGCAGAAGTGGTCCTGCAACTTTATCCGCCTCCATCCAGTCTATTAATTGTTG

CCGGGAAGCTAGAGTAAGTAGTTCGCCAGTTAATAGTTTGCGCAACGTTGTTG

CCATTGCTACAGGCATCGTGGTGTCACGCTCGTCGTTTGGTATGGCTTCATTC

AGCTCCGGTTCCCAACGATCAAGGCGAGTTACATGATCCCCCATGTTGTGCAA

AAAAGCGGTTAGCTCCTTCGGTCCTCCGATCGTTGTCAGAAGTAAGTTGGCCG

CAGTGTTATCACTCATGGTTATGGCAGCACTGCATAATTCTCTTACTGTCATG

CCATCCGTAAGATGCTTTTCTGTGACTGGTGAGTACTCAACCAAGTCATTCTG

AGAATAGTGTATGCGGCGACCGAGTTGCTCTTGCCCGGCGTCAATACGGGAT

AATACCGCGCCACATAGCAGAACTTTAAAAGTGCTCATCATTGGAAAACGTT

CTTCGGGGCGAAAACTCTCAAGGATCTTACCGCTGTTGAGATCCAGTTCGATG

TAACCCACTCGTGCACCCAACTGATCTTCAGCATCTTTTACTTTCACCAGCGTT

TCTGGGTGAGCAAAAACAGGAAGGCAAAATGCCGCAAAAAAGGGAATAAGG

GCGACACGGAAATGTTGAATACTCATACTCTTCCTTTTTCAATATTATTGAAG

CATTTATCAGGGTTATTGTCTCATGAGCGGATACATATTTGAATGTATTTAGA

AAAATAAACAAATAGGGGTTCCGCGCACATTTCCCCGAAAAGTGCCACCTGA

C
```

Before lentivirus transduction, OT-I CD8⁺ T cells were isolated and activated by anti-CD38 and anti-CD28 for 2-3 days, then T cells were transduced with concentrated lentivirus. At day 6, infected OT-I CD8⁺ T cells were reseeded onto new 6-well plates which were untreated with anti-CD38 and cRPMI only supplemented with 2 ng/ML IL-2 and 2 ng/ml IL-12p70 to rest cells. At the same time, 5e5/well of E0771 cells were seeded in 24-well plates for kill assay. The next day, E0771 cells were incubated with 1 ng/ml or 10 ng/mL SIINFEKL (SEQ ID NO: 84,614) peptide for 4 hours. The validation kill assay was performed in the same manner as the screen kill assay.

Testing T cells anti-tumor function with Prodh2 using mouse models (Examples 5-10): Naïve CD8⁺ T cells were isolated from OT-I;Cas9β mice, then activated with anti-CD3ε and anti-CD28, activated cells were transduced with lentivirus on day 3 after isolation. (1) For the melanoma model, 3×10⁶ B16F10-mCh-rOVA cells (OVA-low) were subcutaneously injected into recipient Rag1⁻/⁻ mice. Two doses, 3×10⁶ and 2×10⁶ T cells were intravenously injected on day 19 and day 30 after B16F10-mCh-rOVA transplantation, respectively. (2) For the triple-negative breast cancer (TNBC) models, first, 3×10⁶ E0771-mCh-rOVA cells (OVA-low) cells were injected into the mammary fat pad of recipient Rag1⁻/⁻ mice. Two doses, 3×10⁶ and 2×10⁶ T cells were intravenously injected on day 13 and day 24 post E0771-mCh-rOVA implantation, respectively. (3) For the TNBC models, secondly, 2×10⁶ E0771-mCh-rOVA cells (OVA-high) cells were injected into the mammary fat pad of recipient Rag1⁻/⁻ mice. A single dose of 5×10⁶ T cells were intravenously injected on day 11 post E0771-mCh-rOVA implantation, because the OVA-high cancer model has stronger killing so that one treatment is sufficient to induce tumor regression. Tumor sizes were measured every 2-3 days from adoptive transfer to the survival endpoint. Tumor volume was calculated as/6×(length×width×height) of the tumour. Comparison of tumor growth curves were performed by two-way ANOVA.

IL-2 withdrawal assay (Examples 5-10): Mouse OT-I; Cas9β CD8 T cells were activated with anti-CD3ε and anti-CD28, T cells were transduced with Prodh2-OE or Vector lentivirus after T cells were completely activated. At day 3 after lentivirus transduction, T cells were collected and washed with PBS, then equal cell numbers were plated in media without IL-2. Cells were stained with anti-caspase 3-PE (Cell signaling technology), CD3-FITC, and CD8-APC at day 1 and 4 after IL-2 withdrawal.

Human CD22-CAR-PRODH2 T cell kill assay (Examples 5-10): To sensitively detect CD22-CAR-PRODH2 T cell killing efficacy, NALM6 cells (purchased from ATCC) were transduced with lentivirus packaged with GFP-Luciferase (GL) reporter constructs. NALM6-GL positive cells were sorted using a BD FACSAria II machine. 2×10⁴ NALM6-GL cells were seeded in a 96-well plate, then different cancer: T cell ratio co-cultures were set up. NALM6-GL cell proliferation was measured after 24 and 48 h of co-culture by adding 150 µg/ml D-Luciferin (PerkinElmer) using a multi-channel pipette. Luciferase intensity was measured by a Plate Reader (PerkinElmer).

Large-scale patient Tumor Immune Dysfunction and Exclusion (TIDE) analysis (Examples 5-10): The gene signatures of T cell dysfunction and prediction of cancer immunotherapy response on cancer patient data was performed using the TIDE algorithm as previously described (P. Jiang et al., Signatures of T cell dysfunction and exclusion predict cancer immunotherapy response. *Nat Med* 24, 1550-1558 (2018)). Gene expression level of PRODH2 was associated to CTL-mediated patient survival with or without checkpoint blockade treatment.

Bulk mRNA sequencing (mRNA-seq, RNA-seq) library preparation (Examples 5-10): For the mouse CD8+ T cell mRNA-seq, activated OT-I;Cas9β CD8+ T cells were infected with Prodh2 overexpression or vector lentivirus. At day 3 after infection, T cells were collected for qPCR validation before doing the RNA-seq library preparations. mRNA library preparations were performed using a NEB-Next® Ultra™ RNA Library Prep Kit for Illumina and samples were multiplexed using barcoded primers provided by NEBNext® Multiplex Oligos for Illumina® (Index Primers Set 1). For the human CD8+ T cell RNA-seq, CD22-CAR-PRODH2 and CD22-CAR-PRODH2 (stop) cassettes were site-specifically KI into TRAC locus, the flow cytometry, qPCR, and western blot were performed to confirm that CD22-CAR-PRODH2 or CD22-CAR-PRODH2 (stop) were successfully KI and expressed before doing the mRNA-seq library preparations. Same RNA library preparation procedures as mouse were performed. Libraries were sequenced with HiSeq 4000 or Novaseq systems (Illumina).

Bulk mRNA-seq data processing (Examples 5-10): Raw FASTQ files from mRNA-seq were analyzed for transcript quantification using Kalliso quant algorithm (N. L. Bray, H. Pimentel, P. Melsted, L. Pachter, Near-optimal probabilistic RNA-seq quantification. *Nat Biotechnol* 34, 525-527 (2016)) with the setting-b 100. Transcriptome references were obtained from Ensembl. Differential gene expression analysis for the effect of PRODH2 overexpression or genomic knockin was then performed using Sleuth (H. Pimentel, N. L. Bray, S. Puente, P. Melsted, L. Pachter, Differential analysis of RNA-seq incorporating quantification uncertainty. *Nat Methods* 14, 687-690 (2017)) with gene-level aggregation. Visualization of differentially expressed (DE) genes including volcano plots, bar plots, and Venn diagrams were performed using standard R packages including ggplot2 and VennDiagram.

Gene set level pathway analysis of differentially expressed genes (Examples 5-10): Gene set enrichment analysis (GSEA) was performed using the Java application from the Broad Institute. The full gene set from the differential gene expression analysis was ranked by "beta" value and then used as an input for GSEA pre-ranked analysis with database reference C5 Gene Ontology-Biological Process (GO-BP). The Database for Annotation, Visualization and Integrated Discovery (DAVID) (D. W. Huang, B. T. Sherman, R. A. Lempicki, Systematic and integrative analysis of large gene lists using DAVID bioinformatics resources. *Nature Protocols* 4, 44-57 (2009)) was used for further annotation enrichment analysis. Upregulated and downregulated genes from the differential gene expression analysis were defined with adjusted p-value cutoff of 0.01 for human CAR-T experiments and 0.05 for mouse experiments. Pathway enrichments for GO-BP annotations were used for visualization.

Metabolite extraction and data collection (Examples 5-10): For extraction of intracellular metabolites, cell culture media was first aspirated, then harvested and washed twice with PBS. $2 \times 10^6$ alive cells for each sample were used for metabolite extraction. After normalizing cell counts, 800 µL of 80% (vol/vol) HPLC-grade methanol (Sigma) (precooled to −80° C. on dry ice) was added to fresh cells in a 1.5-mL microcentrifuge tube, then tubes were put on dry ice for 30 minutes. The tubes were then incubated on ice for 20 minutes and centrifuged at 15,000×g for 15 min at 4° C. to pellet the cell debris. The metabolite-containing supernatant was transferred to a new 1.5-mL microcentrifuge tube on dry ice. Metabolite extraction was repeated with 400 µL of 80% (vol/vol) HPLC-grade methanol. The cell lysate/methanol mixtures were dried by Speedvac at room temperature. The metabolites were dissolved again with 80% (vol/vol) methanol, then centrifuged at 18,000×g for 10 min to remove any particulates, and the metabolite mixtures were stored at −80° C. until LC-MS analysis. For the metabolite analysis, the untargeted metabolic profiling was firstly analyzed with an Agilent 6550 QTOF LC/MS System first, then targeted metabolites were analyzed with an Agilent 6490 Triple quadrupole (QQQ) LC/MS System. Multiple reaction monitoring (MRM) was employed for the quantitation of purified standard (Sigma). A HILIC liquid chromatograph were optimized with a bioZen™ 2.6 µm Glycan LC Column, 150×2.1 mm (Phenomenex) and a Glycan guard column, 4×2 mm (Phenomenex). The eluents included buffer A, 0.01% formic acid in HPLC-grade water, and buffer B, 0.01% formic acid in acetonitrile. The gradient was set as follows: 0-2 min 94% B, 2-8 min 94-90% B, 8-16 min 90-76% B, 16-36 min 76-50% B, 36-42 min hold at 50% B and then back to initial conditions for 2 min for column equilibration. The flow rate was set as 0.3 mL/min. Multiple reaction monitoring (MRM) was employed for the quantitation of purified standard (Sigma).

Metabolomics data processing (Examples 5-10): Two metabolomics strategies were adopted, i.e. untargeted metabolomics (aiming to unbiasedly detect all detectable metabolites) and targeted approaches (aiming to detect specifically defined metabolites, such as related metabolites in the proline metabolism and T cell metabolism). For untargeted metabolomics analysis, the optimized workflow consists of automated peak detection and integration, peak alignment, background noise subtraction, and multivariate data analysis. These steps were carried out for comprehensive metabolite phenotyping of the two groups using Agilent Mass Hunter Qualitative Analysis Software (Version B.07.0.0, build 7.0.7024.0) and Agilent Mass Profiler Professional (Version 14.5-Build 2772). The metabolites were first putatively identified based on accurate mass match (accurate mass±30 ppm error) and fragmentation pattern match. Putative structural annotation was carried out by searching the metabolite databases HMDB (www.hmdb.ca) and METLIN (metlin.scripps.edu) using the mass-to-charge ratio of the metabolic features.

For the targeted metabolomics, available metabolites from the significantly changed metabolites of untargeted metabolomics analysis, as well as related proline metabolism and immune system metabolism, were purchased from Sigma. Multiple reaction monitoring (MRM) was employed for the qualitative and quantitative analysis of purified standard (Sigma). The features of spectra were extracted using Agilent Mass Hunter Qualitative Analysis Software (Version B.07.0.0, build 7.0.7024.0). Each peak was manually checked and the abundances of all metabolites were exported. The retention time of the standards was cross-referenced with those detected in the untargeted method for consistency, which also confirmed the accuracy of the untargeted methods. The integration of untargeted and targeted metabolites includes the combination of non-overlapping metabolites and the selection of targeted metabolites of overlapping metabolites.

Multivariate data analyses were conducted using Statistical analysis module of MetaboAnalyst 4.0 (J. G. Xia, I. V. Sinelnikov, B. Han, D. S. Wishart, MetaboAnalyst 3.0-making metabolomics more meaningful. *Nucleic Acids Res* 43, W251-W257 (2015), J. Chong et al., MetaboAnalyst 4.0: towards more transparent and integrative metabolomics analysis. *Nucleic Acids Res* 46, W486-W494 (2018)). Briefly, Log transformation and auto scaling (mean-centered and divided by the standard deviation of each variable) were used for data processing. Heatmaps and volcano plots were generated plots with MetaboAnalyst 4.0. Distance Measure was set as Euclidean and the Clustering Algorithm was set as Ward. The functions of the metabolic flowchart were constructed with the software Pathvisio v3.3.0 based on the KEGG database (www.genome.jp/kegg). The integrated analysis of the changed metabolites and genes were done with Joint Pathway analysis module of MetaboAnalyst 4.0.

Intersection of mRNA-seq, metabolomics and KEGG pathways (Examples 5-10): Differential expressed genes from mRNA-seq analysis were cross-referenced with expected differential expressed genes from metabolomics analysis in order to obtain consensus upregulated and downregulated gene sets due to PRODH2 overexpression or genomic knockin. For a given metabolite, genes contributing to its production or consumption were defined using the KEGG (Kyoto Encyclopedia of Genes and Genomes) Pathway Database (M. Kanehisa, S. Goto, KEGG: kyoto encyclopedia of genes and genomes. *Nucleic Acids Res* 28, 27-30 (2000)). Genes could be both "producing" and "consuming" when involved in reversible reactions. Expected upregulated genes were defined as those producing metabolites with positive logFC or those consuming metabolites with negative logFC. Expected downregulated genes were defined as those producing metabolites with negative logFC or those consuming metabolites with positive logFC. For consensus "upregulated" genes, first the union of downregulated mRNA-seq genes from human donor 1 and donor 2 from the CAR-T experiments were removed from the union of upregulated mRNA-seq genes (setdiff). Then the resulting restricted gene set was intersected with expected upregulated metabolomics genes. For consensus "downregulated" genes, the union of upregulated mRNA-seq genes was removed from the downregulated mRNA-seq genes (setdiff). Then the resulting restricted gene set was intersected with expected downregulated metabolomics genes.

Multi-Omics analysis (Examples 5-10): Consensus differential expressed genes from intersection analysis and differentially represented metabolites with fold changes from metabolomics analysis were used as inputs for joint pathway analysis using the MetaboAnalyst Portal (J. Xia, N. Psychogios, N. Young, D. S. Wishart, MetaboAnalyst: a web server for metabolomic data analysis and interpretation. *Nucleic Acids Res* 37, W652-660 (2009)). Default parameters were used, with Hypergeometric Test for enrichment analysis, Degree Centrality for topology analysis, and Gene-metabolite pathways for pathway databases. Pathways were considered statistically significant if the p-values were less than 0.05. For visualization, upregulated gene set and downregulated gene set were separated, each compared against DR metabolites (both increased and decreased, as the gene activity can influence on either direction), using the MetaboAnalyst Portal.

In vivo efficacy testing: NALM6-GL cancer cells, as described, were injected by intravenous route at 0.5 million/mouse into NSG mice. Mice were imaged by IVIS and randomized into 3 groups. 10 days after cancer cell injection, each mouse was intravenously injected with PBS, CD22 CAR-T cells with PRODH2 (Stop) knockin, or CD22 CAR-T cells with PRODH2 knockin. Mice were imaged in subsequent time points indicated.

Standard statistical analysis (Examples 5-10): Data between two groups were analyzed using a two-tailed unpaired t-test. Multiple t-test using the Holm-Sidak method was used for multiple group comparison. Different levels of statistical significance were accessed based on specific p values and type I error cutoffs (0.05, 0.01, 0.001, 0.0001). GraphPad Prism Software and RStudio were used for these analyses.

The results of the experiments are now described.

Figure 4A:
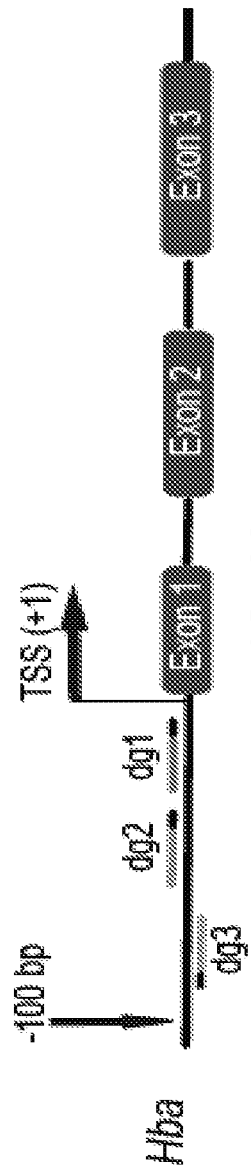
FIGS. 4A-4E illustrate results from testing the TdgA vector in immortalized cell lines and primary Cas9+ CD8+ T cells, and mm10dgLib lentivirus titration.
Figure 4C:
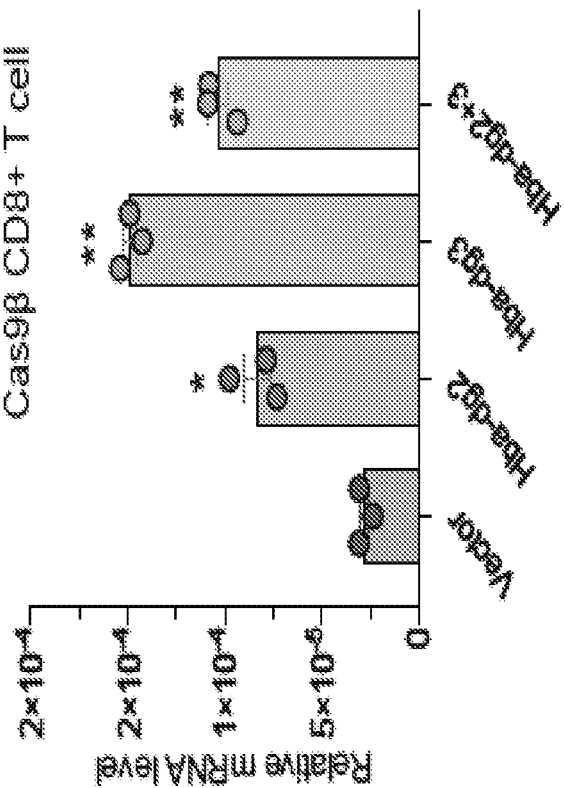
Figure 4B:
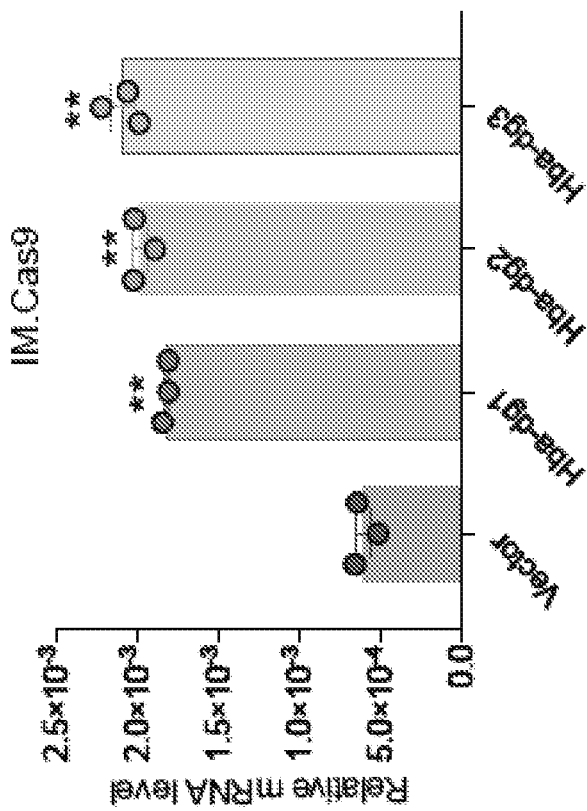

Example 1: Design and Generation of a Genome-Scale Dead-Guide RNA Activation Screen System for Primary T Cells To enable GOF screens, a lentiviral T cell dgRNA activation (TdgA) vector containing a dgRNA expression cassette driven by a U6 promoter with MS2-loop-containing chimeric backbone (U6-dgRNA-MS2), and a cassette expressing a fusion protein of Thy1.1 marker and transcription activators (EFS-Thy1.1-MPH) was designed and constructed (FIG. 1A). With 3 independent dgRNAs, the efficacy of the TdgA vector was verified by activating the mouse Hba gene in both immortalized cells (IM.Cas9, $p<0.01$ for all 3 dgRNAs) and Cas9-expressing primary murine $CD8^+$ T cells ($p<0.05$ for Hba-dg1, $p<0.01$ for Hba-dg2 and Hba-dg3) (FIG. 4A-4C).

Figure 1B:
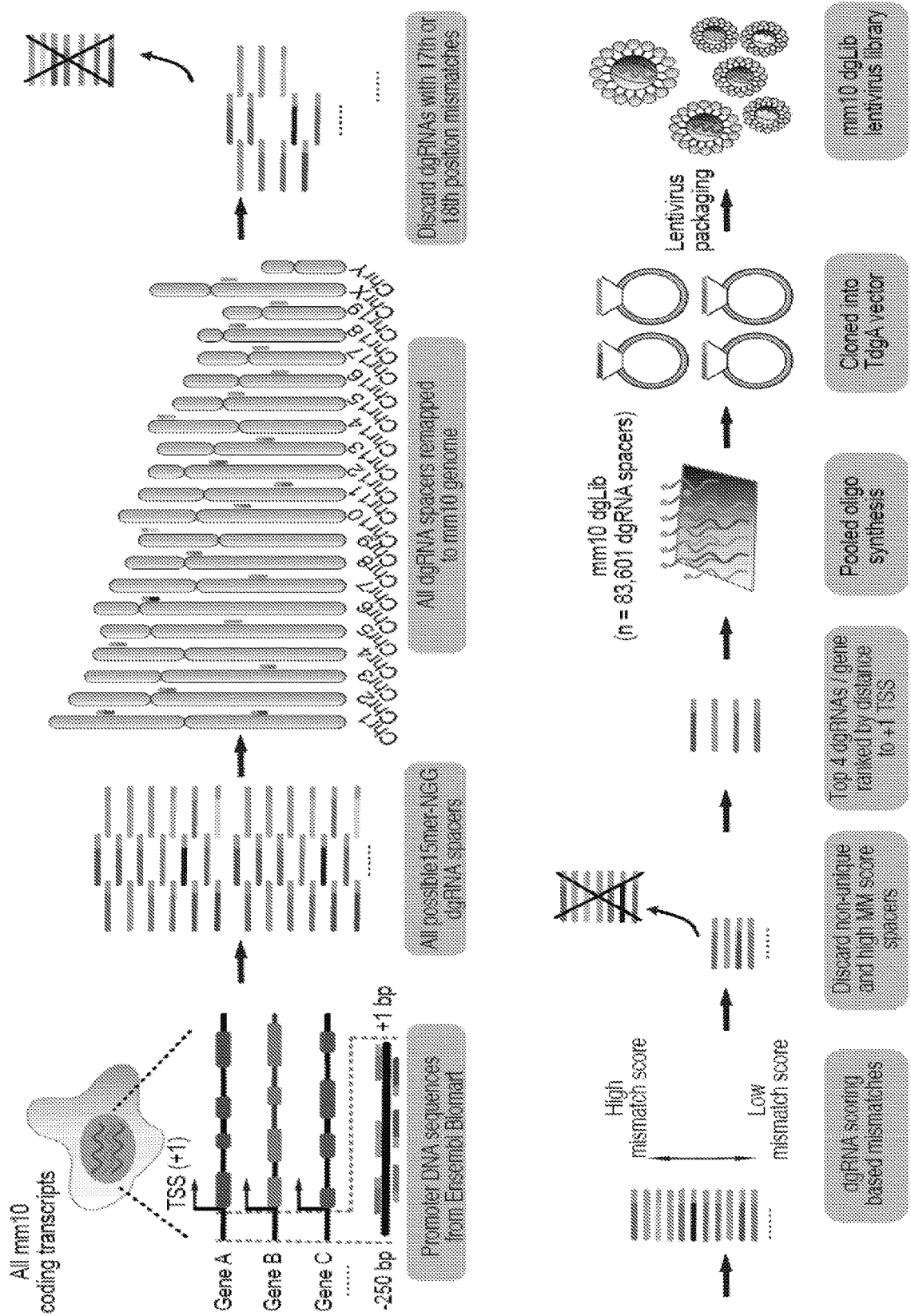
Figure 1D:
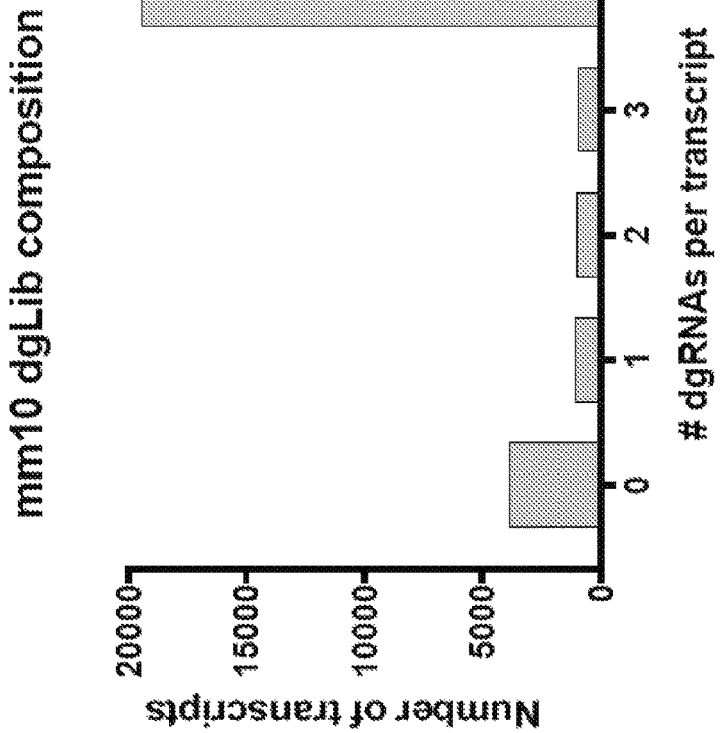
Figure 1C:
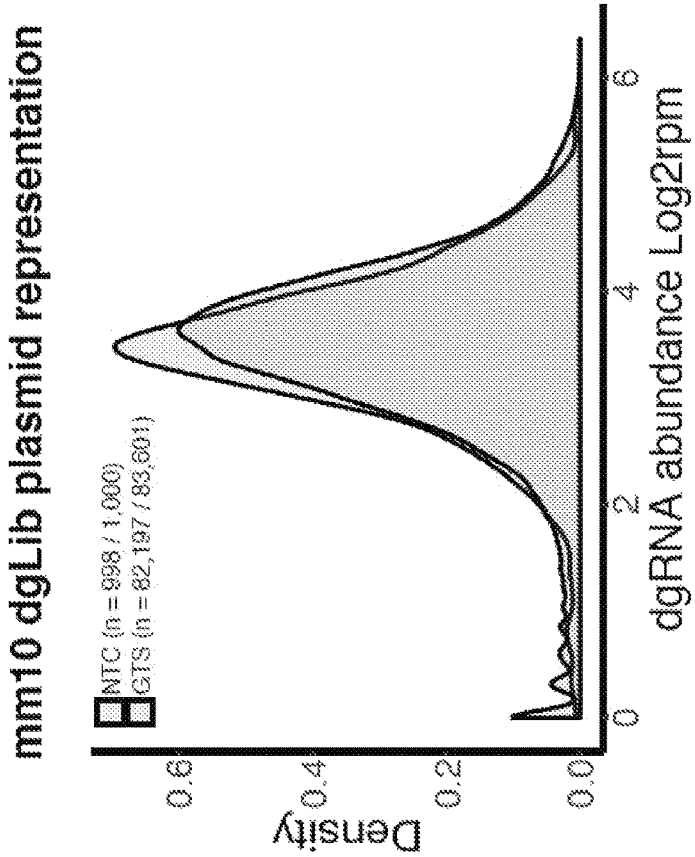
Figure 4D:
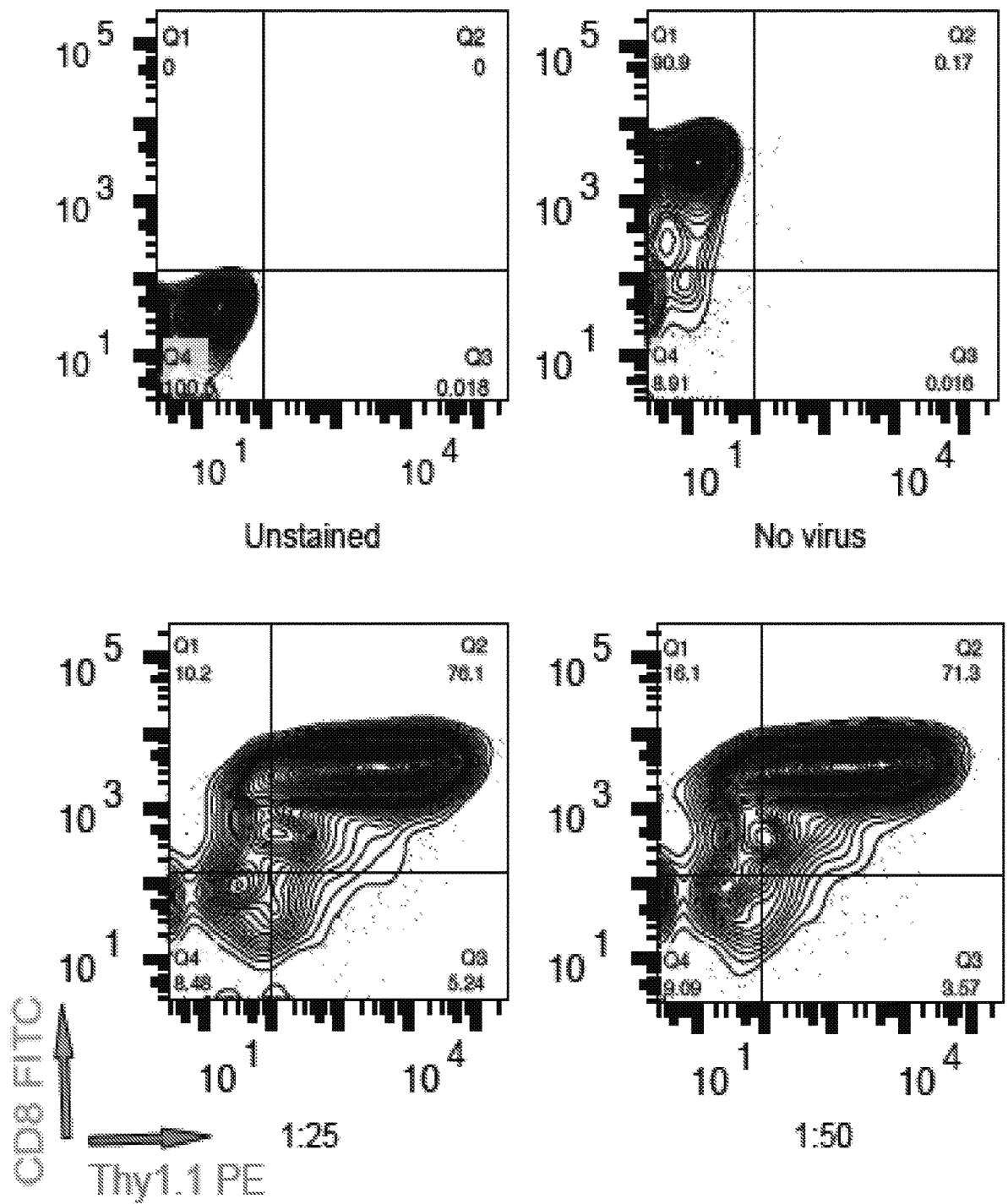
Figure 4E:
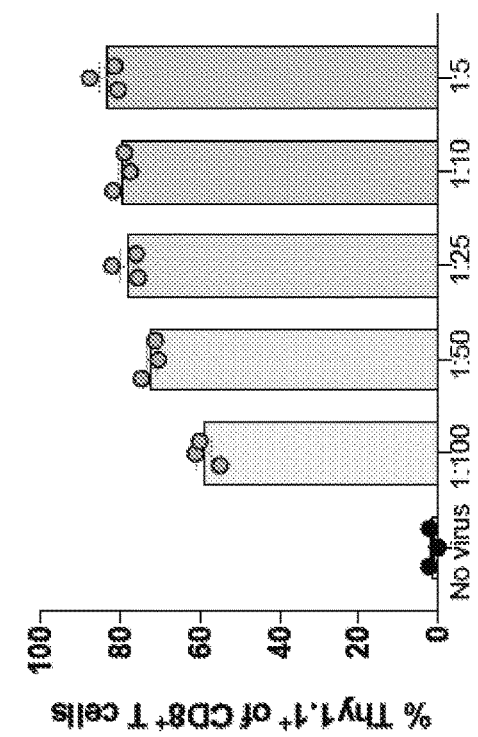

A mouse genome-scale dgRNA library (mm10dgLib) was designed using promoter sequences of all annotated protein-coding transcripts from the mm10 genome assembly (FIG. 1B). In this design, all possible 15-mer-NGG dgRNA spacer-PAM sequences within −250 bp of transcriptional start sites (TSSs) were identified. All spacer-PAM sequences were then re-mapped back to the mm10 mouse genome, dgRNAs with PAM mismatches were discarded, and ranked according to mismatch scores (MM scores). All dgRNA candidates with high MM scores were further filtered out and the top 4 dgRNAs per gene were chosen according to their distance to TSS (FIG. 1C). For genes with fewer than 4 dgRNAs passing all scoring criteria, all eligible dgRNAs were selected (FIG. 1C). Non-targeting control (NTC) sequences that did not map to the mouse genome were randomly generated, and the top 1,000 NTCs were chosen to spike into the library. As a result, the mm10dgLib consisted of 84,601 dgRNAs that target 83,601 coding transcripts (SEQ ID NOs. 1-83,601) and 1,000 NTCs (SEQ ID NOs. 83,602-84,601), which were synthesized as a pool and cloned into the TdgA vector (FIG. 1B). The mm10dgLib plasmid library representation was sequenced. 82,197/83,601 (98.3%) of gene-targeting spacers (GTSs) and 988/1,000 (98.8%) of NTCs were successfully cloned, and both GTSs and NTCs showed a log-normal distribution (FIG. 1D). The plasmid library was then packaged into lentivirus form with high titer (FIG. 4D-4E), enabling genome-scale activation screens for cells expressing catalytically active Cas9.

Figure 2A:
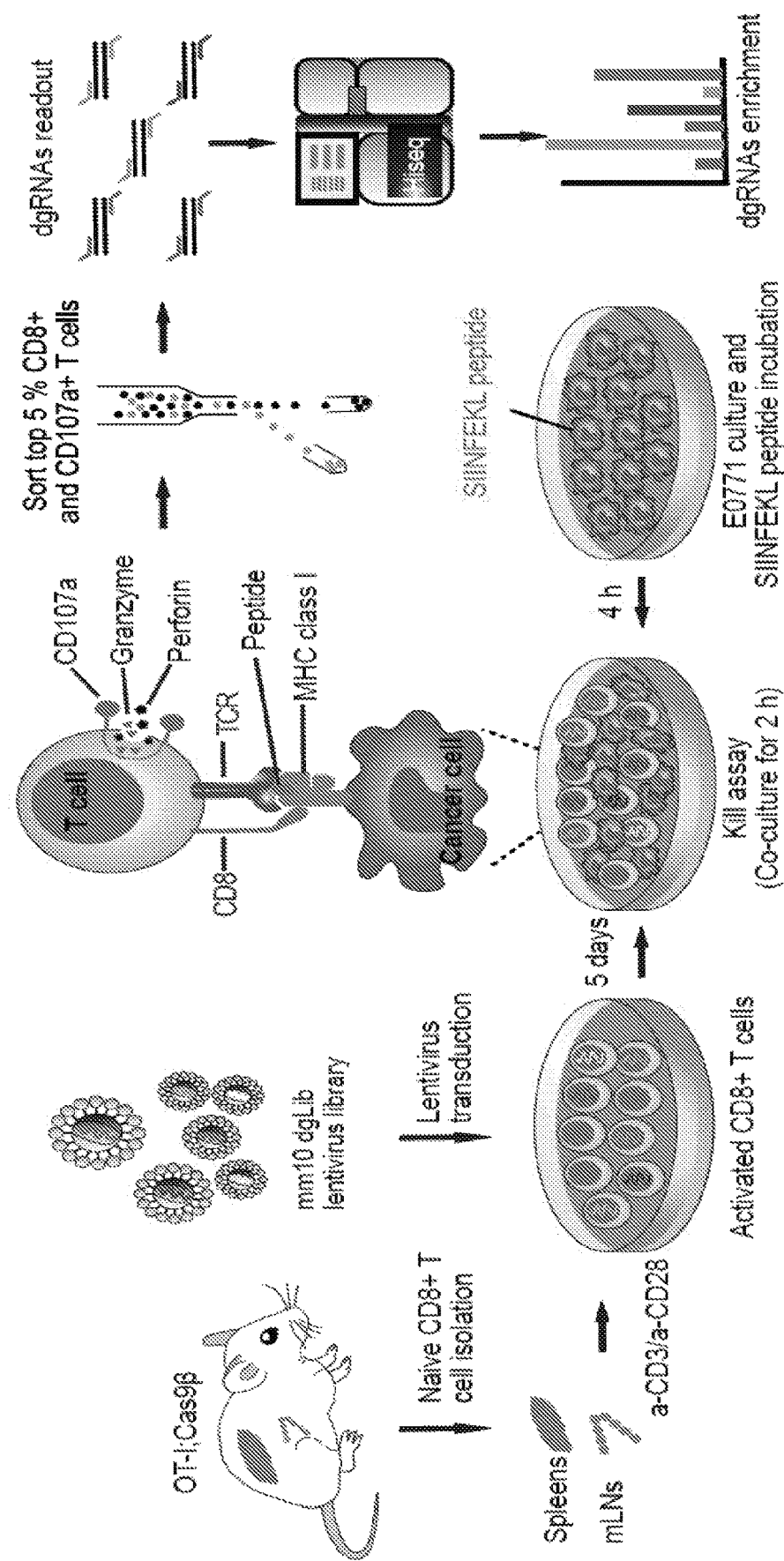
FIGS. 2A-2D illustrate genome-scale dgRNA activation screen identified genes that boost the effector function of CD8$^+$ T cells.
Figure 2B:
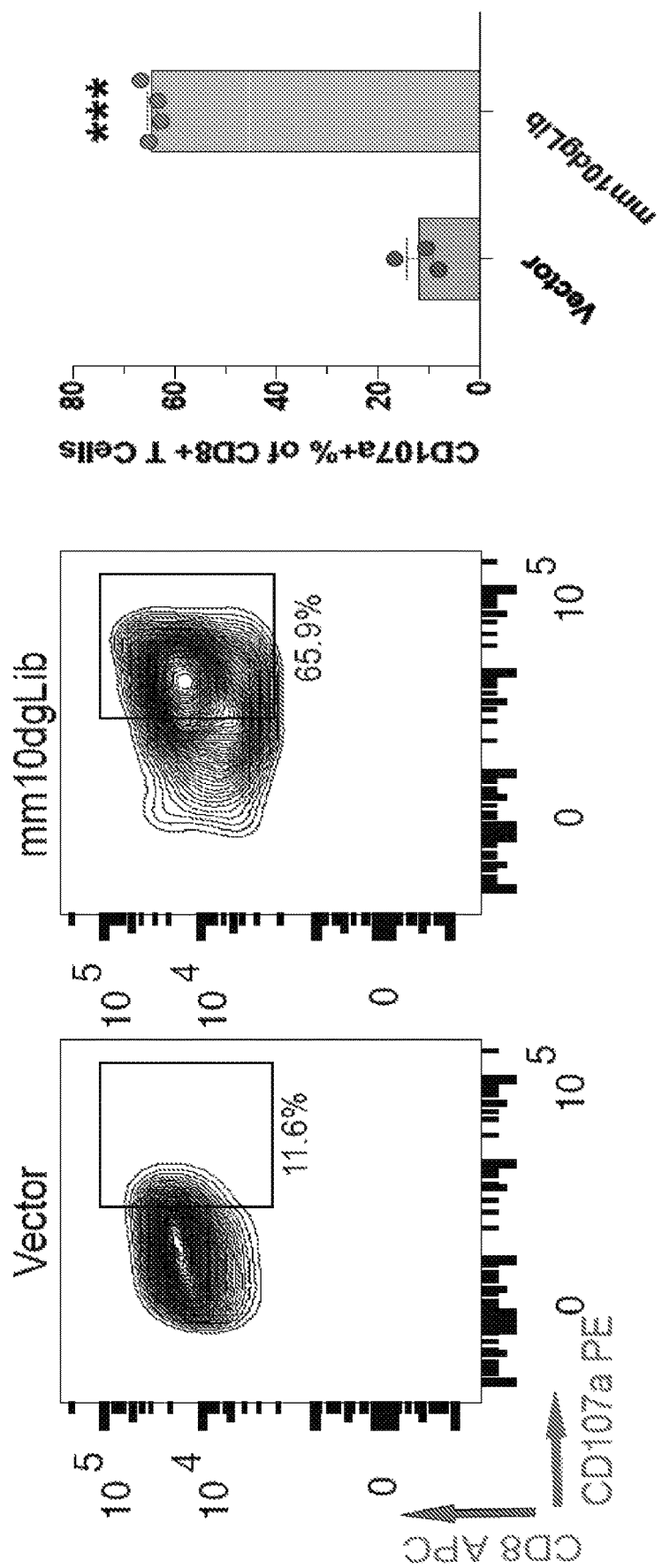

Example 2: Genome-Scale dgRNA Activation Screen Identified Genes that Boost the Effector Function of $CD8^+$ T Cells Degranulation is one of the major mechanisms through which cytotoxic CD8 T lymphocytes (CTL) mediate the killing of target cells. The granule-dependent (perforin and granzyme) pathway does not require de novo synthesis of proteins by effector CD8$^+$ T cells, but rather the release of pre-formed lytic granules within the cytoplasm. CD107a (LAMP-1) is a marker which can be presented on the cell surface after degranulation. To identify genes that when activated can enhance the degranulation ability of CD8$^+$ T cells after encountering their cognate antigen presented on the cell surface, a genome-scale dgRNA library based CD8$^+$ T cell kill assay activation screen (dgTKS) was devised (FIG. 2A). A co-culture system was developed in which OT-I;Cas9 CD8$^+$ T cells sensitively respond to E0771 breast cancer cells presenting SIINFEKL (SEQ ID NO. 84,614) peptide, the cognate antigen of the CD8$^+$ T cells from OT-I transgenic mice (FIG. 2A). Naïve CD8$^+$ T cells were isolated, transduced with the mm10dgLib or empty vector lentivirus, activated with anti-CD3 and anti-CD28, and cultured in cRPMI media with IL-2 and IL-12 for 4 days. The T cells were rested for 12 hours prior to the kill assay by exchanging fresh cRPMI media without anti-CD3 or anti-CD28. At day 5, E0771 cancer cells were pulsed with 1 ng/µL SIINFEKL (SEQ ID NO. 84,614) peptide for 4 hours, and the rested CD8$^+$ T cells were co-cultured with SIINFEKL (SEQ ID NO. 84,614)-incubated E0771 cancer cells at 1:1 ratio. The co-culture media also contained a specific anti-CD107a antibody that labeled the transiently presented surface CD107a. After 2 hours in co-culture, CD8$^+$ T cells were stained and flow cytometry analysis performed. The fraction of CD107a$^+$ cells was measured among the whole population of CD8$^+$ T cells co-cultured with E0771 cancer cells pulsed with SIINFEKL (SEQ ID NO. 84,614) peptide. mm 10dgLib lentivirus transduced CD8$^+$ T cells had a significantly higher CD107a$^+$ percentage compared to empty vector transduced cells (p<0.001) (FIG. 2B). Using fluorescence activated cell sorting (FACS), the mm10dgLib-transduced CD8$^+$ T cells expressing a high level (top 5%) of CD107a were sorted, in three independent biological replicates, for genomic DNA preparation and dgRNA library readout (FIG. 2A).

Figure 2C:
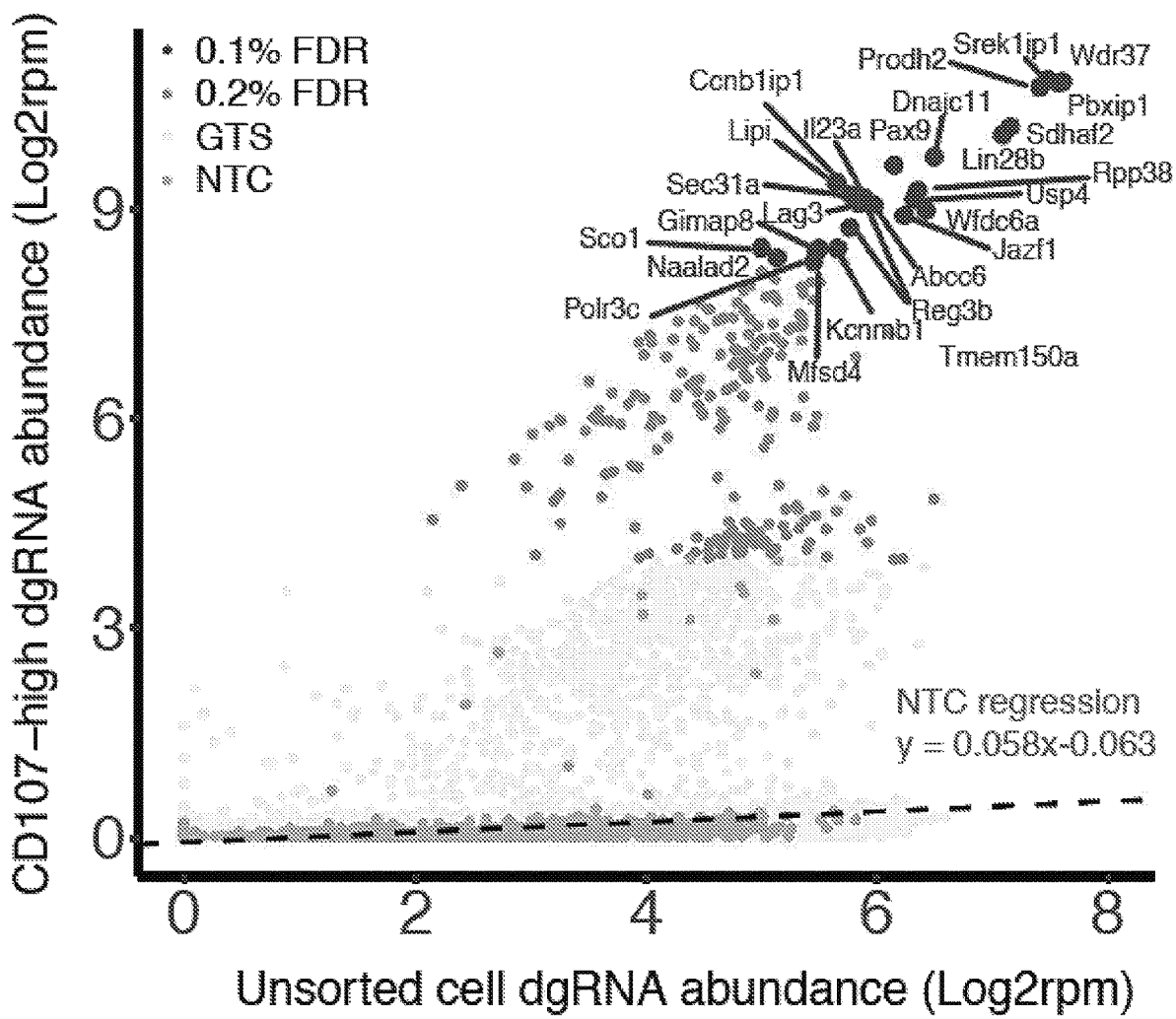
Figure 2D:
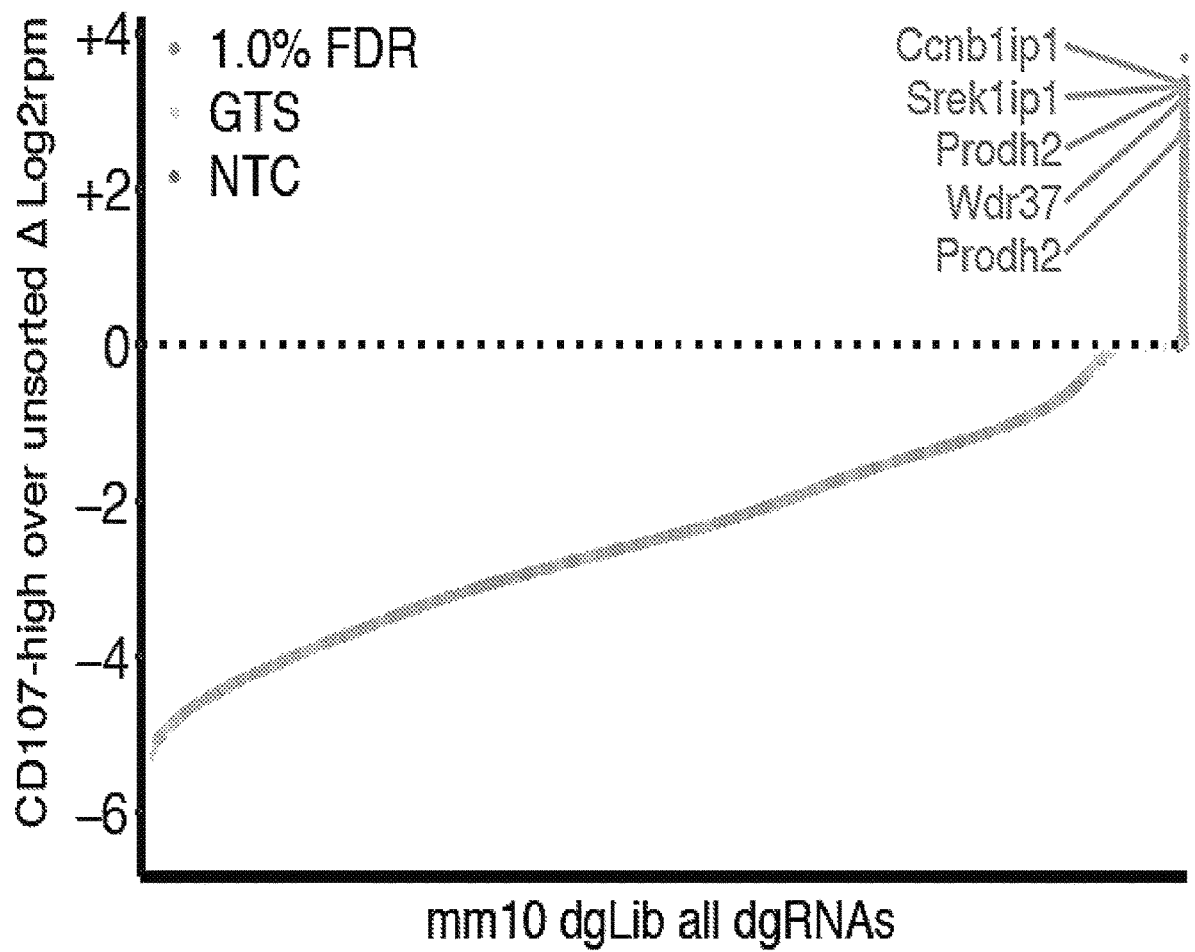

Illumina sequencing was used to read the dgRNA cassette of both CD107a$_+$-high sorted and unsorted CD8$^+$ T cells, and quantify the dgRNA abundance in the entire mm10dgLib. As a neutral baseline, the 1,000 NTCs were relatively evenly distributed in the unsorted cell population, but were rarely detected in the CD107a$^+$-high CD8$^+$ T cells (FIG. 2C). In contrast, there were two distinct populations of dgRNAs that deviated from the distribution and regression line of NTCs (FIG. 2C). With an FDR of 0.1%, significantly enriched dgRNAs were identified in sorted CD107a$^+$-high cells targeting 26 genes, such as Prodh2, Sreklip1, Wdr37, Ccnblip1, Pbxip1, and Sdhaf2 (FIG. 2C). Taking a differential dgRNA calculation by subtracting CD107a$^+$-high sorted from unsorted samples, similar hits were uncovered such as Prodh2, Ccnblip1, Sreklip1, and Wdr37 (FIG. 2D). Based on the results, it was hypothesized that overexpression of high-rank candidate genes from the dgTKS screen might enhance the degranulation ability of CD8$^+$ T effector cells.

Figure 3A:
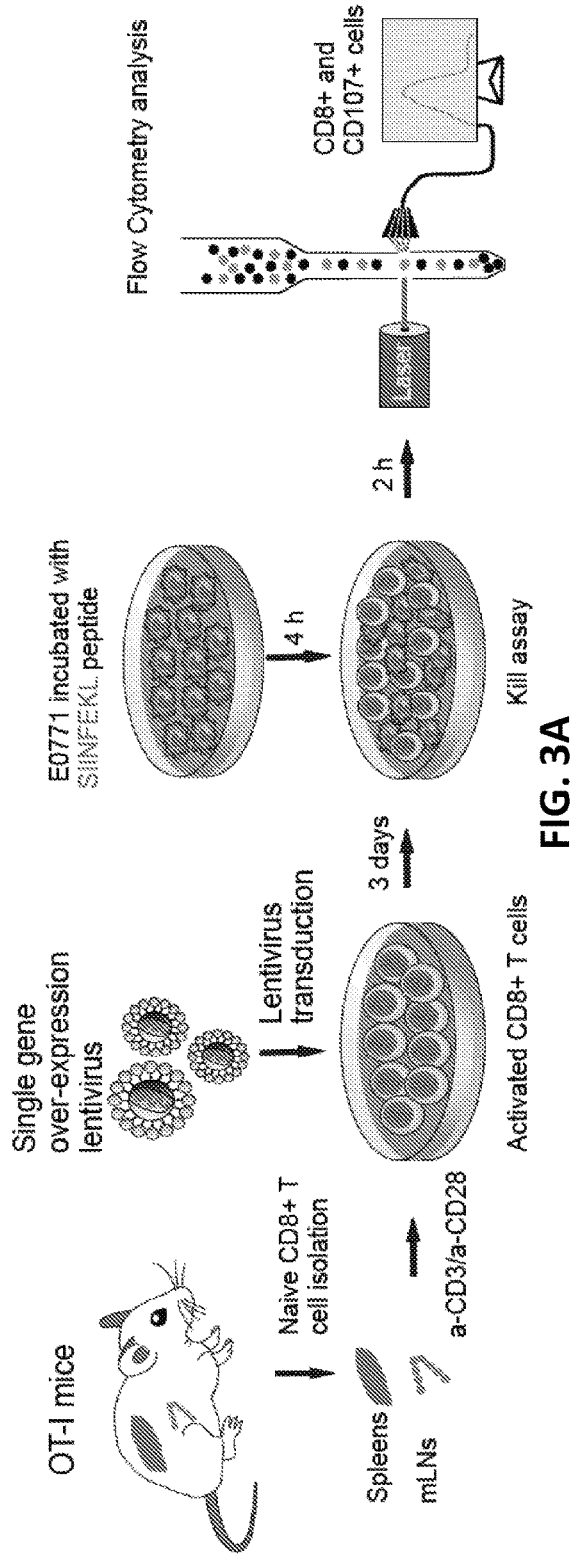
FIGS. 3A-3D illustrate testing gain-of-function of top candidates from dgTKS for enhancement of CD8+ T cell effector function.
Figure 3B:
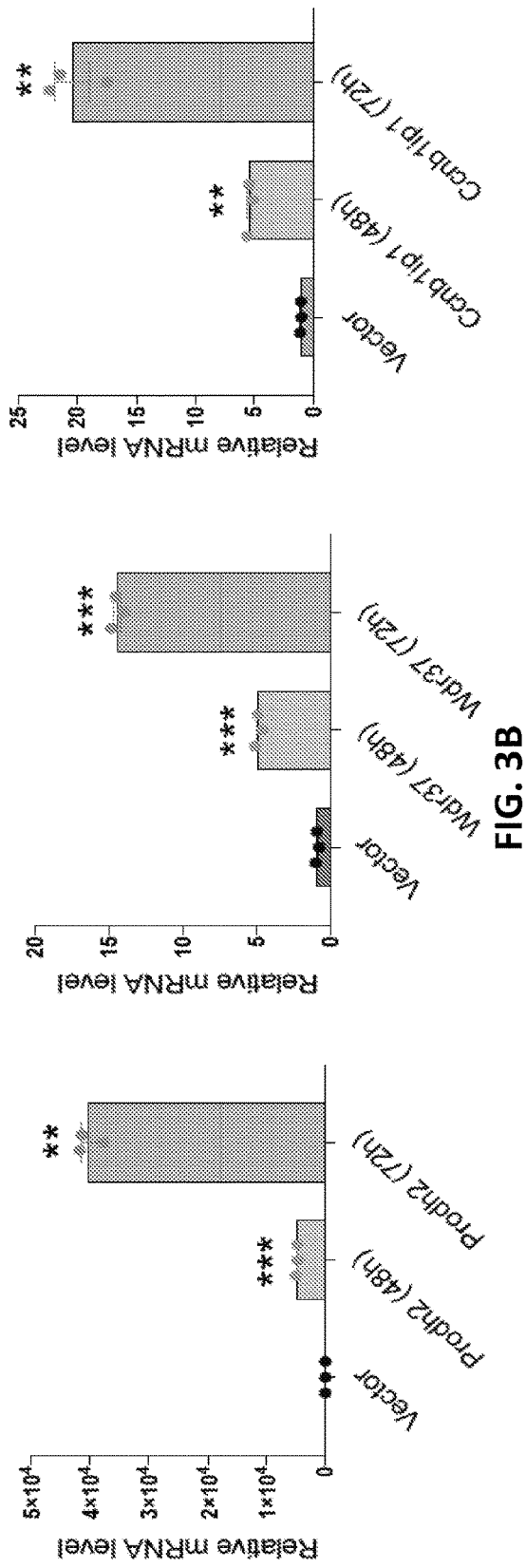
Figure 3C:
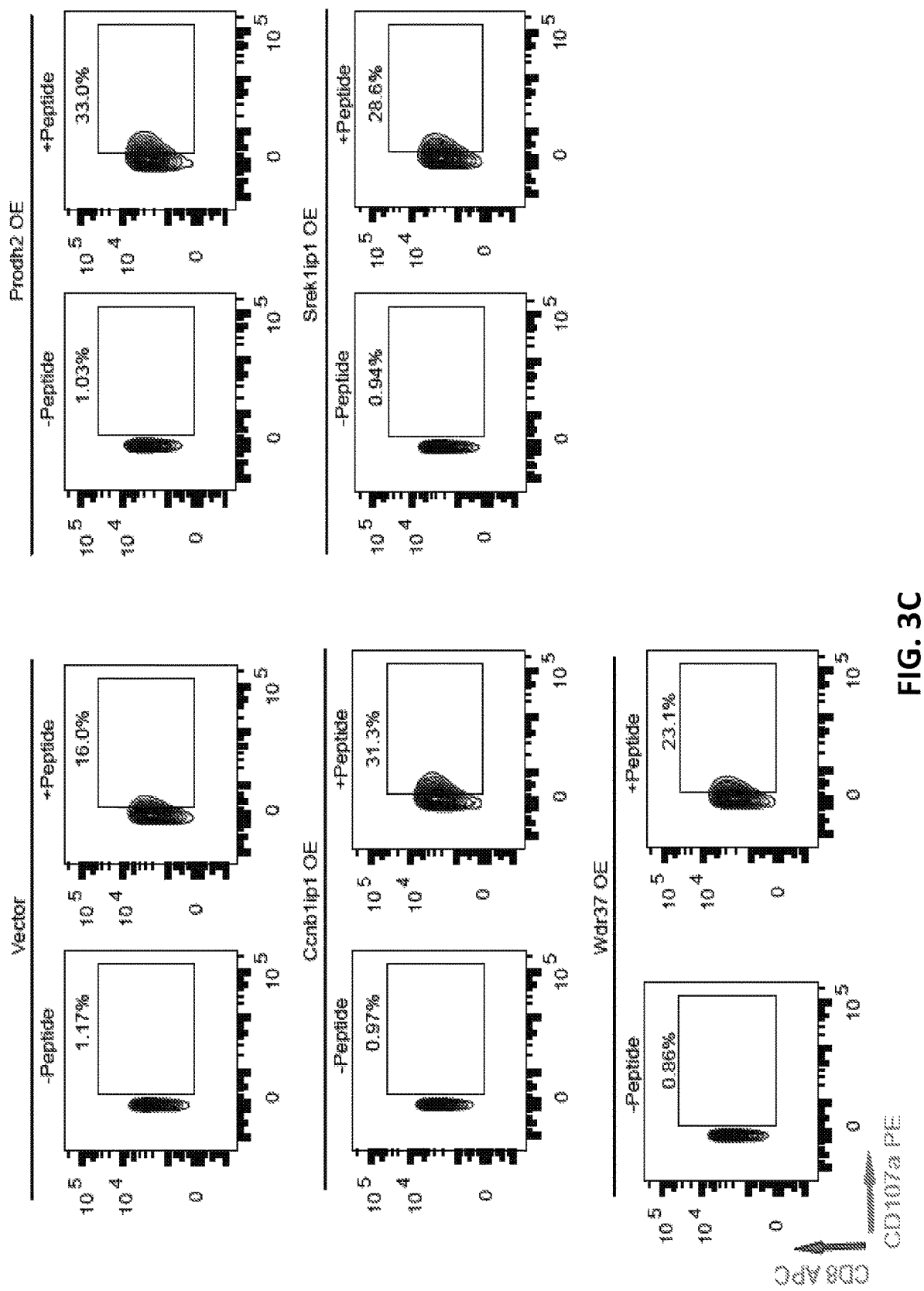
Figure 3D:
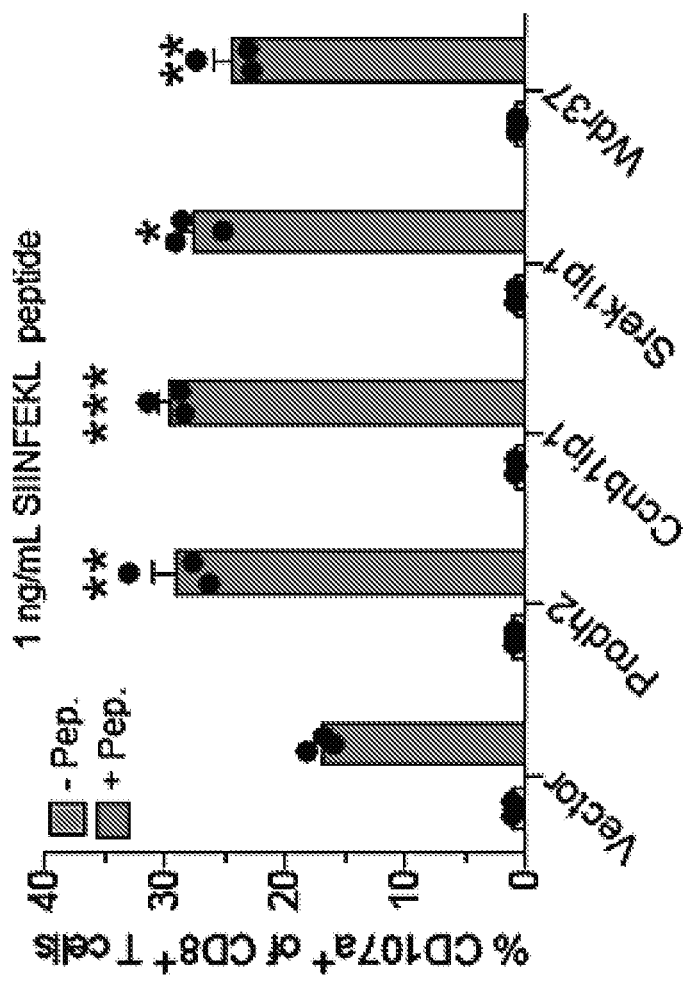
Figure 5A:
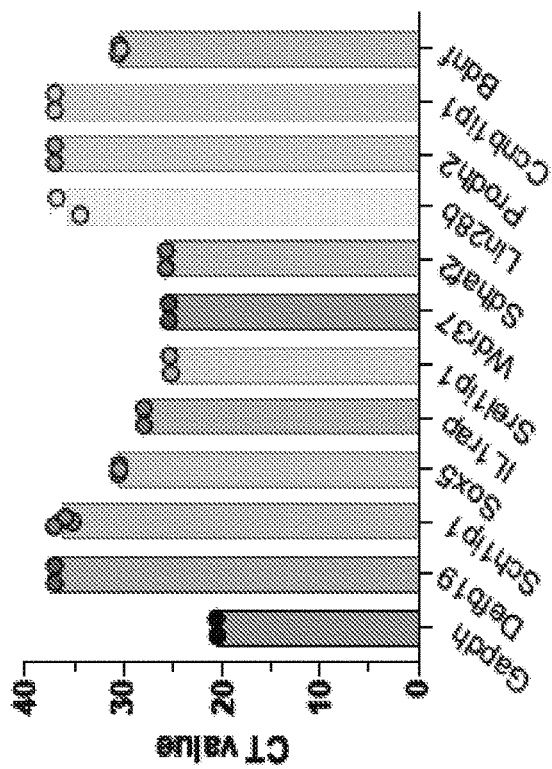
FIGS. 5A-5E illustrate CRISPR/dgRNA activation of representative candidates and kill assay validation.
Figure 5B:
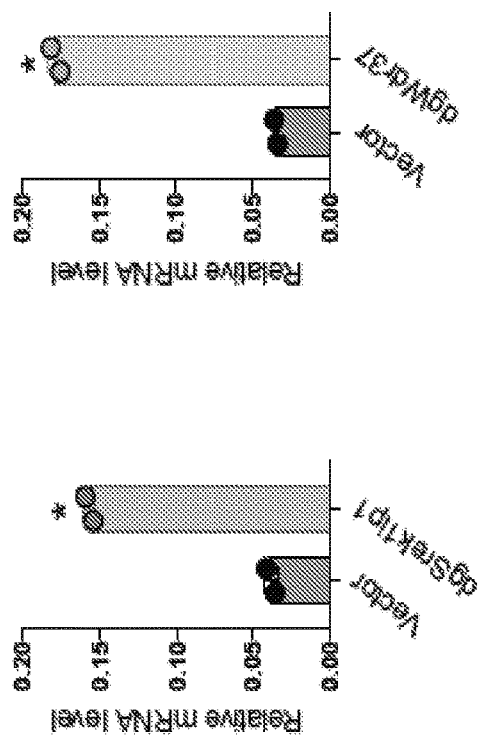
Figure 5C:
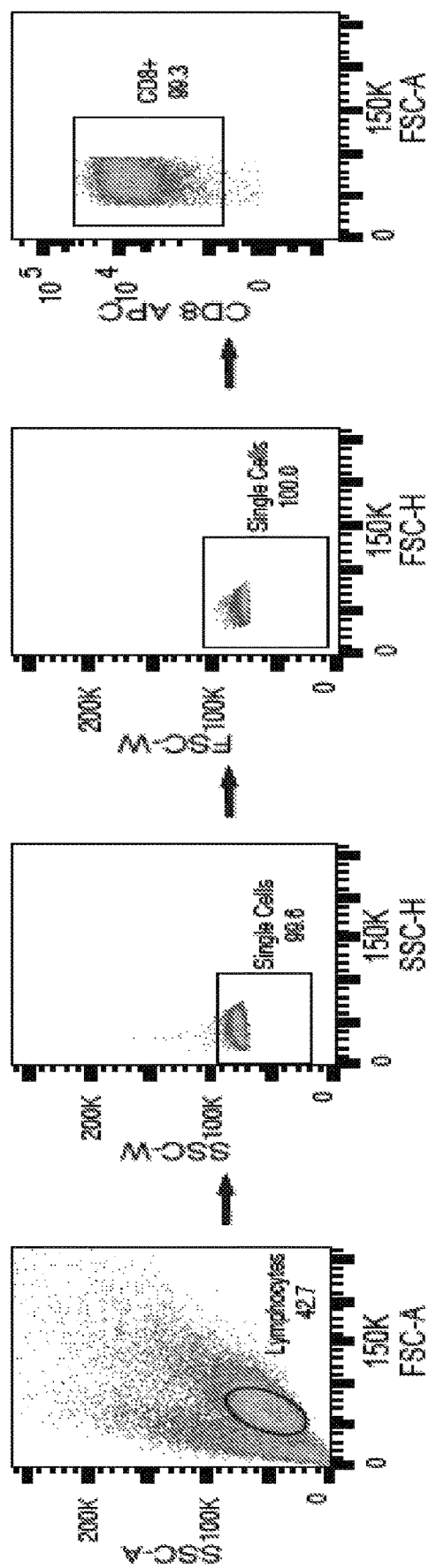
Figure 5D:
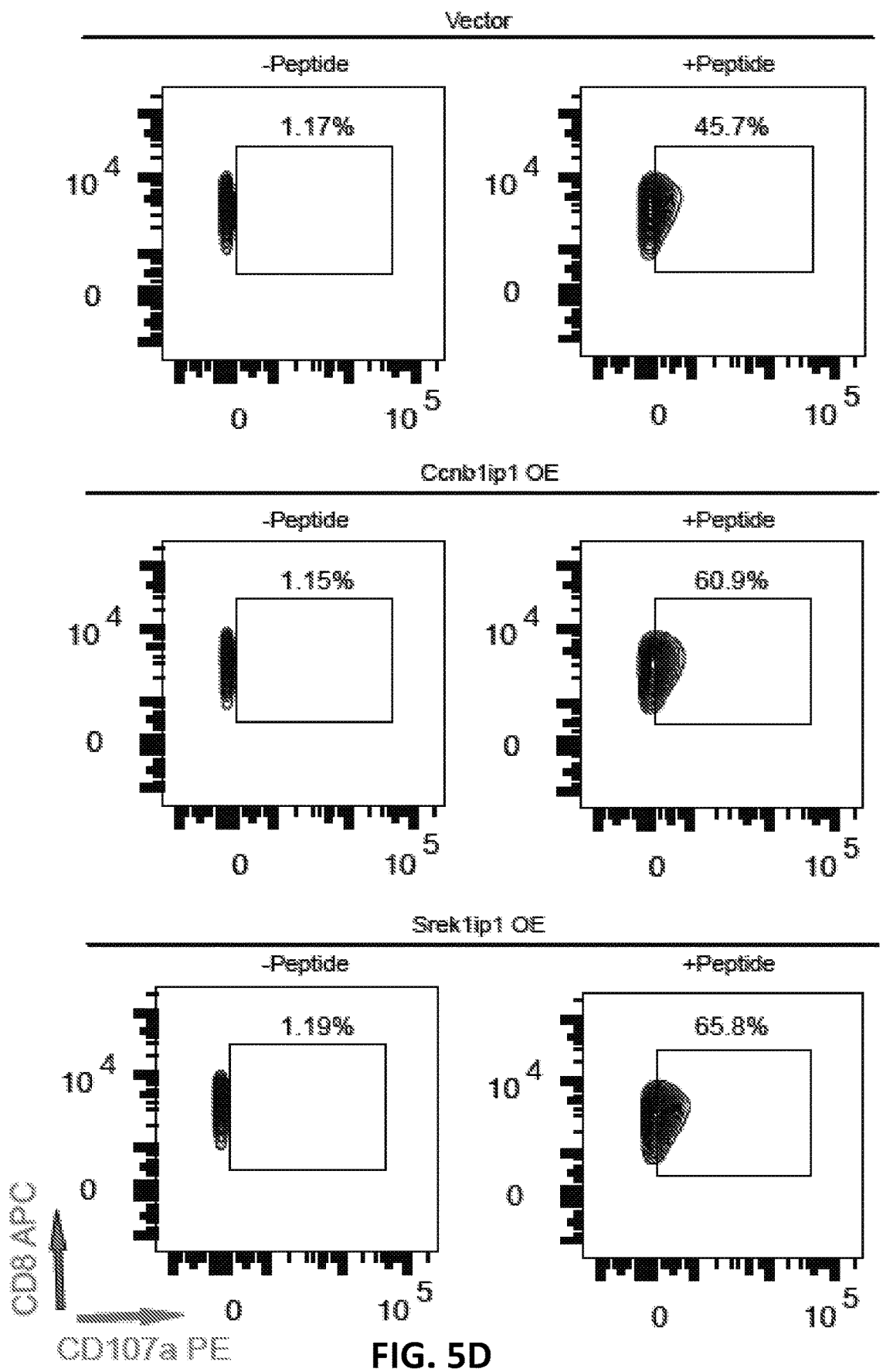
Figure 5E:
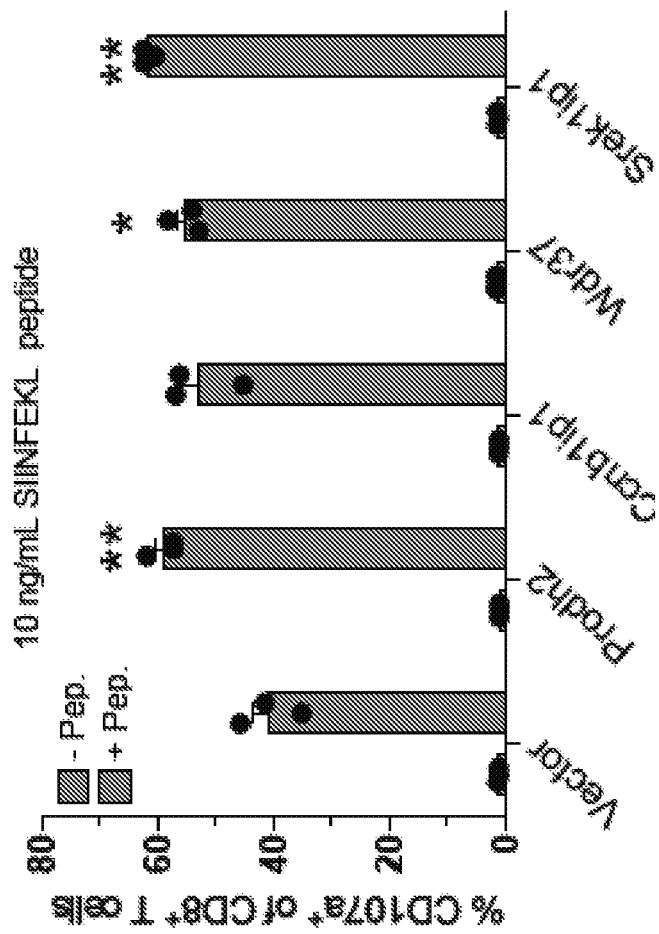

Example 3: Testing Activation of Top Candidates from dgTKS for Enhancement of CD8$^+$ T Cell Effector Function Using RT-qPCR, the natural level of expression for several high-rank candidate genes (including Defb19, Schlip1, Sox5, IL1rap, Srellip1, Wdr37, Sdhaf2, Lin28b, Prodh2, Ccnblip1 and Bdnf) were measured. Results showed that all of these genes had low levels of mRNA expression compared with a house-keeping gene Gapdh in primary CD8$^+$ T cells (FIG. 5A). Activation of Sreklip1, Wdr37 and Sdhaf2 was confirmed by a single dgRNA in CD8$^+$ T cells (FIG. 5B), yet the fold activation was modest (p<0.05 for vector vs. Sreklip1, Wdr37 or Sdhaf2). To better test these candidates' GOF phenotypes, cDNA overexpression of the entire coding region was directly leveraged. Full-length CDNAs for four top candidates, Prodh2, Ccnblip1, Sreklip1, or Wdr37, were cloned into a lentiviral overexpression vector and packaged into lentivirus (FIG. 3A). Transducing OT-I CD8$^+$ T cells with these lentiviral cDNAs led to robust and significant activation of targeted single candidate genes in 48 and 72 hours, as measured by RT-qPCR (p<0.01 for all vector vs. gene-specific cDNA comparisons) (FIG. 3B). Validation kill assays were performed 4 days after transduction. E0771 cancer cells were pulsed with 0 or 1 ng/µL SIINFEKL (SEQ ID NO. 84,614) peptide and co-cultured with single gene activated OT-I CD8$^+$ T cells, subsequently using flow cytometry to measure CD107a$^+$ (FIG. 5C). These data demonstrated that activation of Prodh2, Ccnblip1, Sreklip1, or Wdr37 significantly enhanced degranulation by CD8$^+$ T cells upon encountering SIINFEKL-pulsed cancer cells (compared to vector, p<0.01 for Prodh2, p<0.001 for Ccnblip1, p<0.05 for Sreklip1, and p<0.01 for Wdr37) (FIGS. 5C-5D). The experiment was repeated with E0771 cancer cells with 0 or 10 ng/µL SIINFEKL (SEQ ID NO. 84,614) peptide. Again, enhanced peptide-dependent degranulation was demonstrated (compared to vector, p<0.01 for Prodh2, p=0.06 for Ccnblip1 (marginal significant), p<0.05 for Sreklip1, and p<0.01 for Wdr37) (FIGS. 5D-5E). These data validated that augmented gene expression of Prodh2, Ccnblip1, Sreklip1, or Wdr37 can enhance CD8$^+$ T cell effector function, demonstrating the utility of the dgRNA-based genome-scale GOF screen for discovery of immune modulatory factors.

Example 4: Discussion

Advances in genome editing technologies have had a huge impact on basic sciences and translational medicine. CRISPR/Cas systems allow investigators to rapidly alter the genomes of virtually any eukaryotic species. In addition to enabling genomic engineering, Cas9 can be rendered catalytically inactive by mutating RuvC and HNH domains, thus repurposing Cas9 for genetic perturbation without introducing double stranded breaks (DSBs). Catalytically dead guide RNAs (dgRNAs), which are 14-nt or 15-nt in length, can be utilized to modulate gene expression without introducing DSBs at the target site. These innovations have expanded the potential applications of CRISPR technologies for genetic perturbations at the level of gene expression. High-throughput adaptations of these technologies can facilitate systematic interrogation of large numbers of genes or non-coding genetic elements for loss-of-function (LOF) and gain-of-function (GOF) screens.

GOF screens enable the identification of genes where ectopic activation produces a phenotype. By designing a catalytically dead guide RNA library, a high-throughput GOF screening using catalytically active Cas9 was enabled herein. This is particularly important because the existence of Cas9 transgenic mice means that Cas9$^+$ immune cells are readily available to be isolated and cultured at large scale. With the development of orthogonal screening technologies, the dgRNA library system may be used in conjunction with knockout systems to perform complex screens in individual Cas9+ cells.

Using a systems approach, a ranked list of GOF candidates enriched in T cells with superior effector function were unveiled. Four genes, Prodh2, Ccnblip1, Sreklip1, and Wdr37 were validated, where augmenting their expression consistently enhanced CD8$^+$ T cell degranulation. Prodh2 encodes an enzyme in proline metabolism by catalyzing the first step in the catabolism of trans-4-hydroxy-L-proline. L-arginine metabolism in T cells enhances anti-tumor activity and is linked to proline metabolism, although the latter is less well-characterized. Wdr37 encodes a member of the WD repeat proteins that are involved in a diverse set of cellular processes. Ccnblip1 encodes an E3 ubiquitin ligase that regulates the progression of the cell cycle. Sreklip1 encodes a protein that interacts with Srek1, a serine/arginine-rich (SR) splicing protein that interacts with other SR proteins to modulate splice site selection. These previously undocumented genes discovered through the dgRNA screening system herein provide a proof-of-principle for the discovery of new targets in primary T cells with relevance for cancer immunology.

Figure 6A:
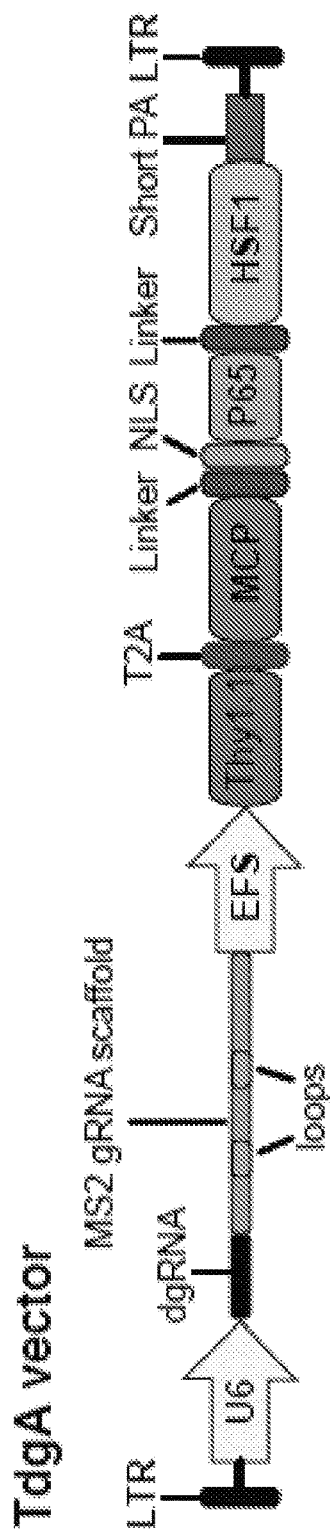
FIGS. 6A-6K illustrates genome-scale dgRNA activation screen design and identification of genes that boost the effector function of CD8+ T cells.
Figure 6B:
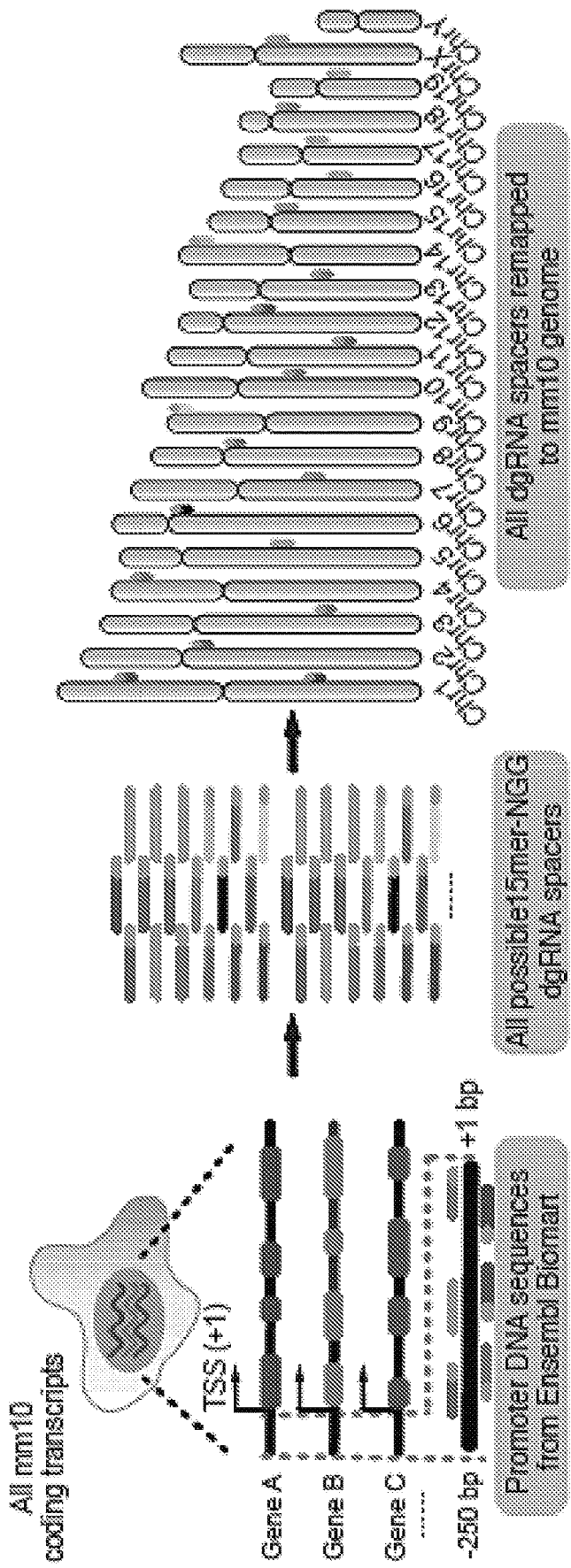
Figure 12D:
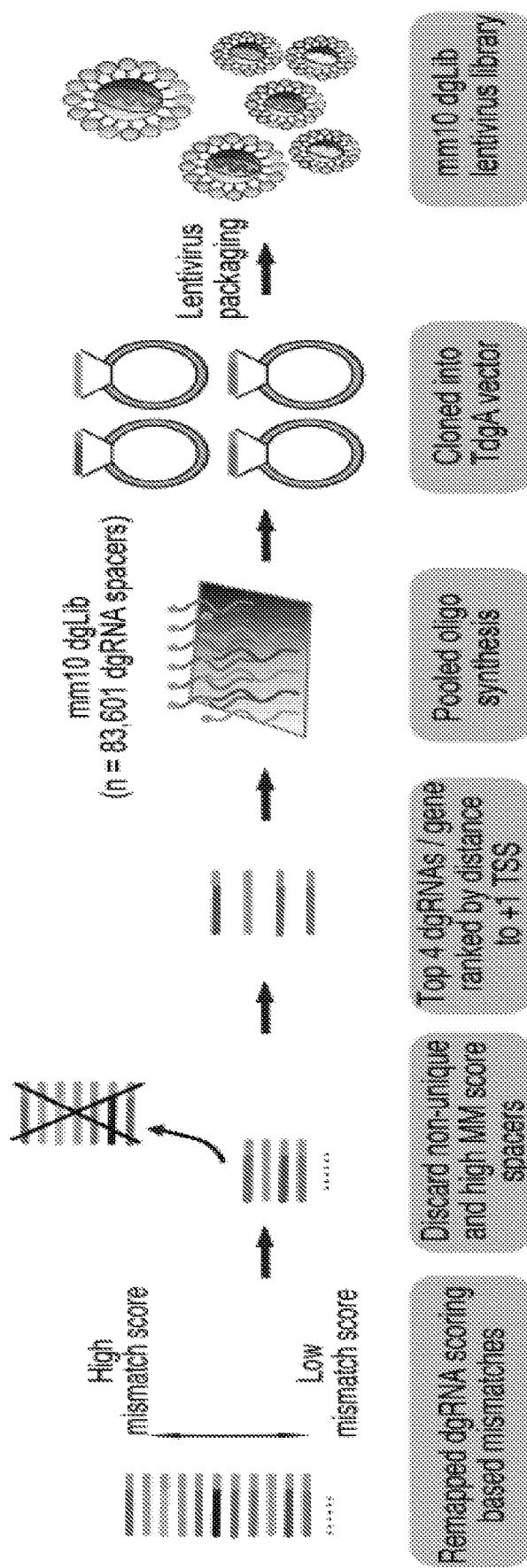
Figures 12E, 12F:
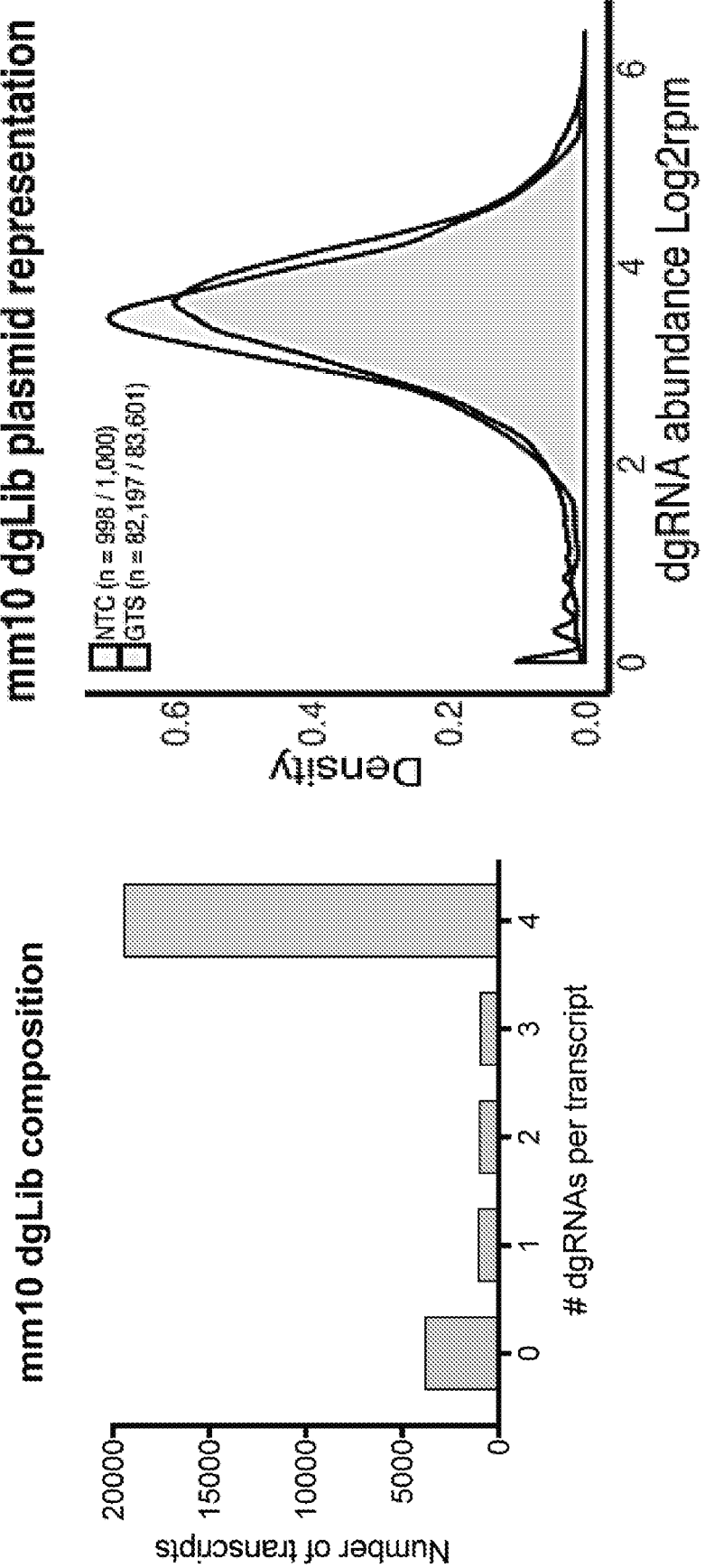
Figure 12G:
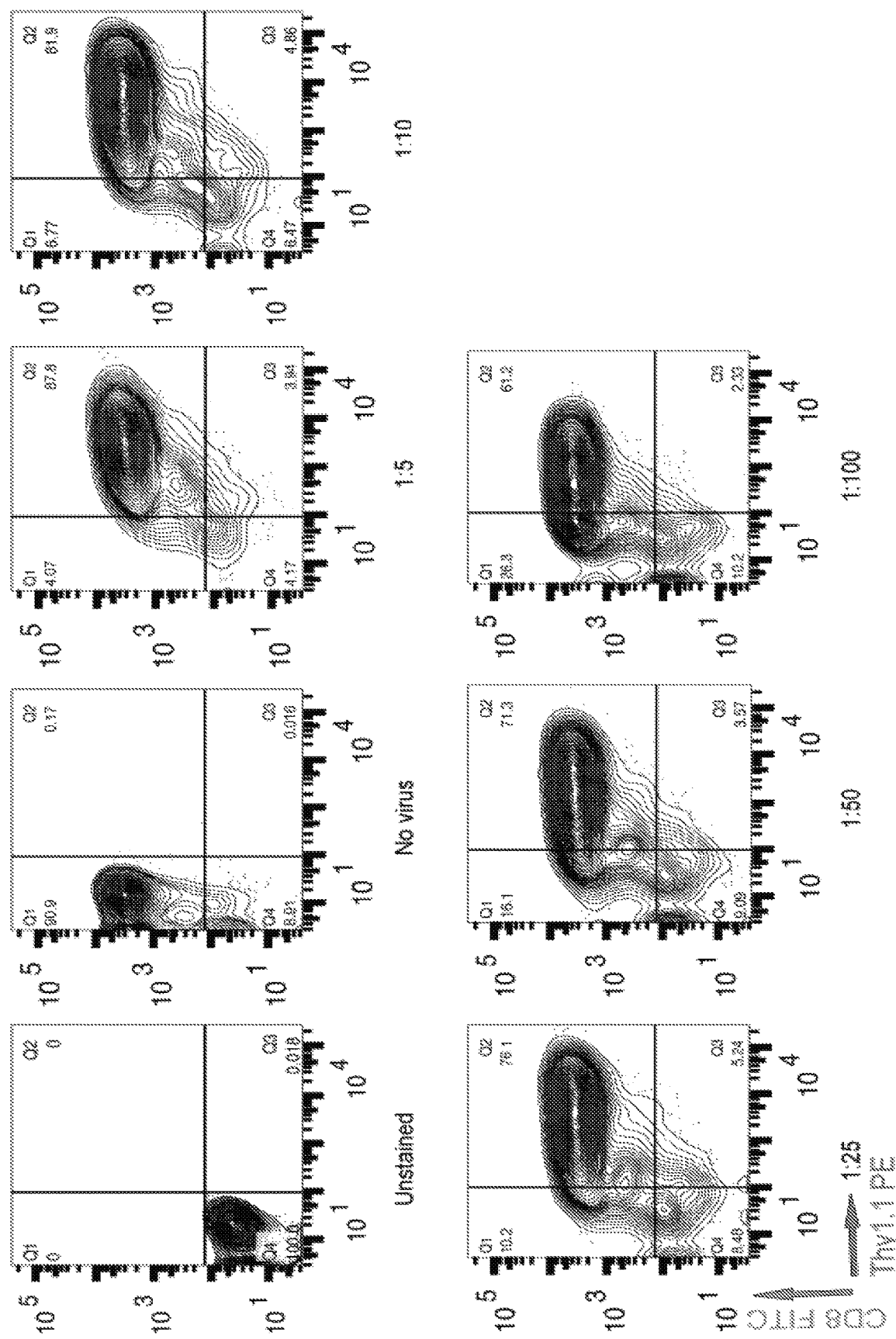
Figure 12H:
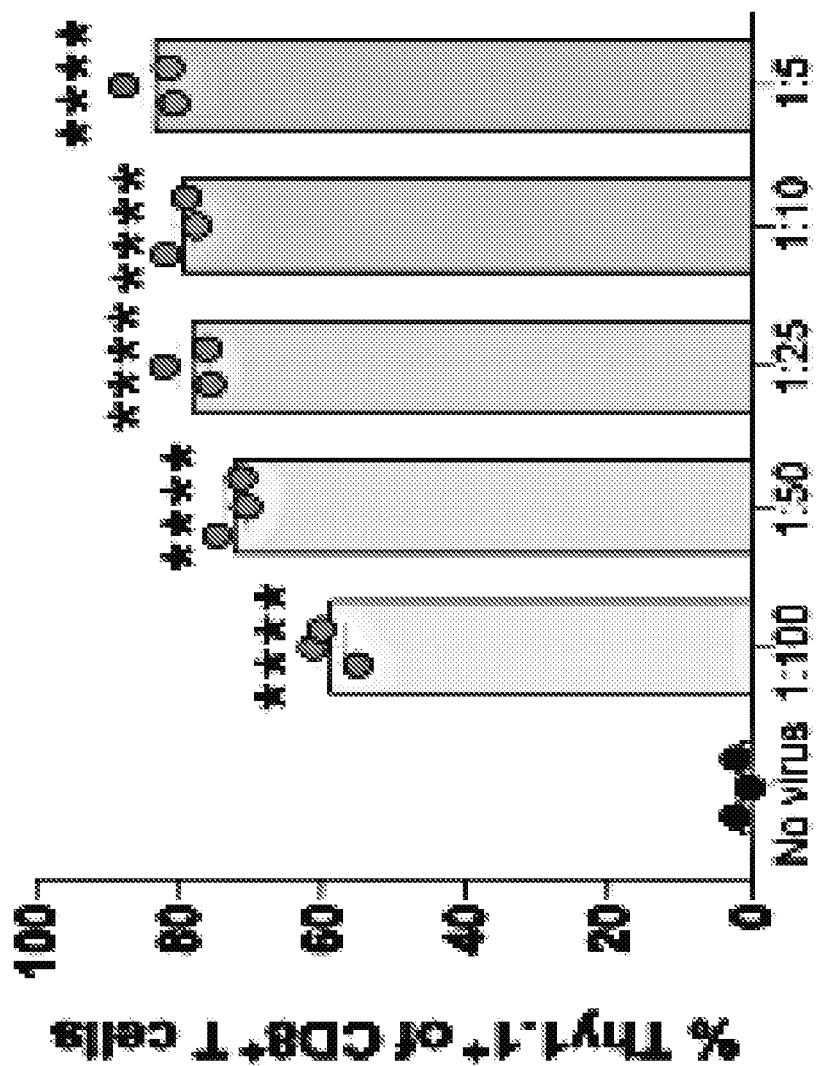

Example 5: Genome-Scale Identification of Effector Function Boosters for Primary CD8$^+$ T Cells A GOF screening approach for primary T cells was developed for unbiased identification of genes that enhance T cell effector function. Due to the challenges of introducing multiple components including Cas9, co-activators, and guide RNAs into primary T cells, the dgRNA system that with active Cas9 transgenic mice was utilized. First, a lentiviral T cell dgRNA activation (TdgA) vector (FIG. 6A) was designed and constructed. With 3 independent dgRNAs, the successful augmentation of gene expression of the mouse Hba gene in both immortalized cells and Cas9-expressing primary murine CD8$^+$ T cells was verified (FIGS. 12A-12C). A mouse genome-scale dgRNA library (mm 10dgLib) was then designed using promoter sequences of all annotated protein-coding transcripts from the mm10 genome assembly (Methods) (FIG. 6B, FIG. 12D). After spacer identification, on-target and off-target mapping and filtering, proximal score ranking, and spacer per gene choices for library balancing, the final mm10dgLib consists of 84,601 dgRNAs that target 22,391 coding transcripts and 1,000 non-targeting controls (NTCs) (Methods) (FIG. 6B, FIG. 12D), which was synthesized as a pool and cloned into the TdgA vector (FIG. 12D). The mm10dgLib plasmid library was sequenced and it was verified that 82, 197/83, 601 (98.3%) of gene-targeting spacers (GTSs) and 988/1, 000 (98.8%) of NTCs were successfully cloned, and that both GTSs and NTCs showed a log-normal distribution (FIGS. 12E-12F). The plasmid library was then packaged into lentivirus and functional titration was performed by flow cytometry to confirm adequate viral titer (FIGS. 12G-12H), enabling genome-scale activation screens for primary cells expressing catalytically active Cas9.

Figure 6C:
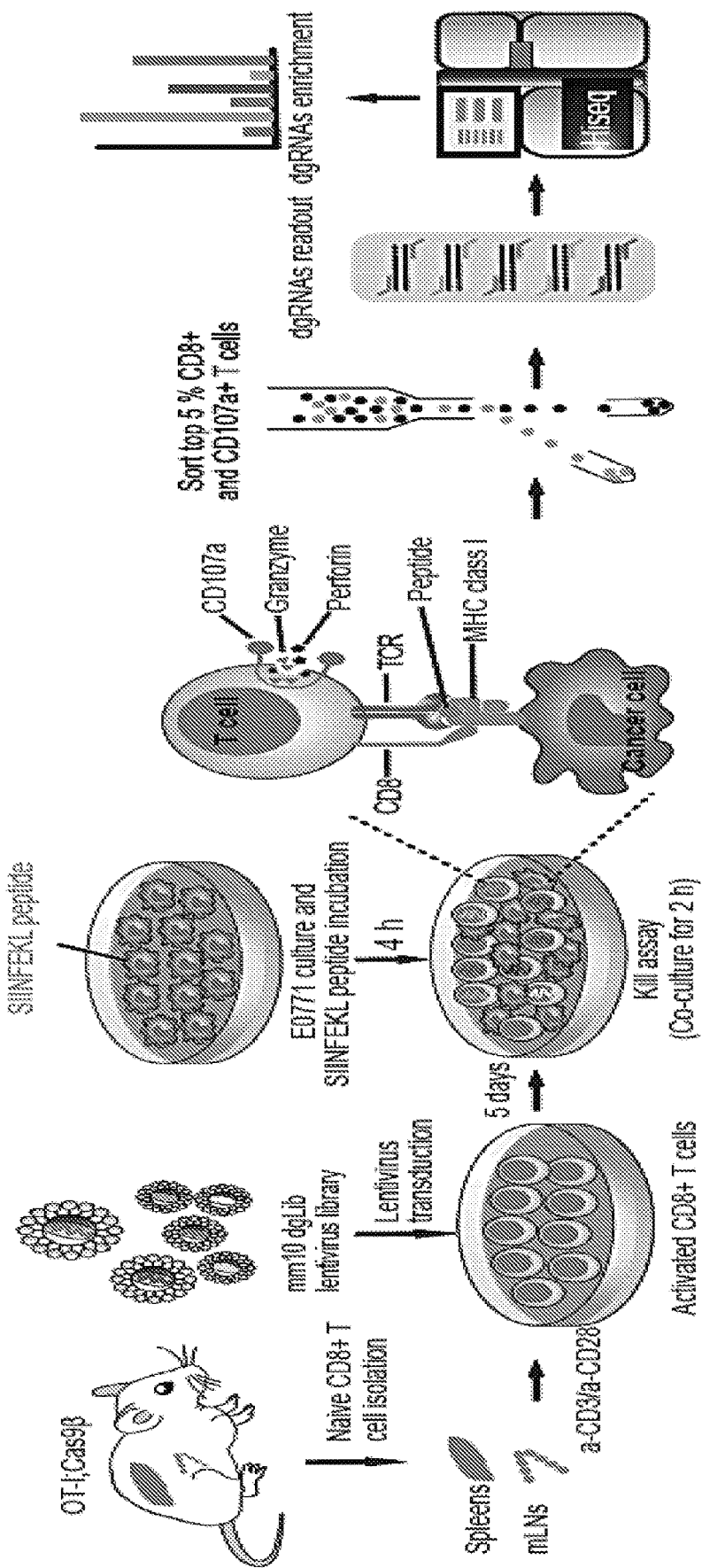
Figure 6D:
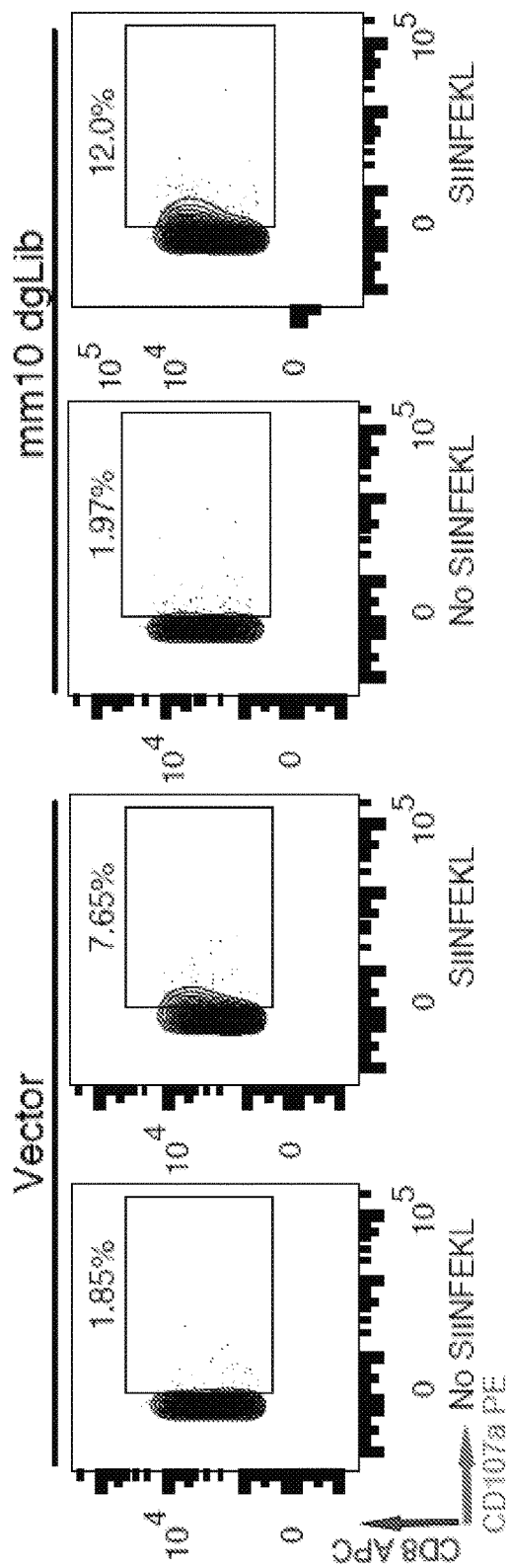
Figure 6E:
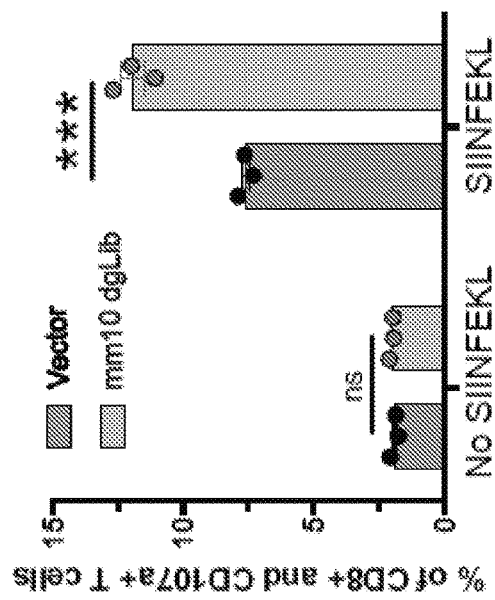
Figure 6F:
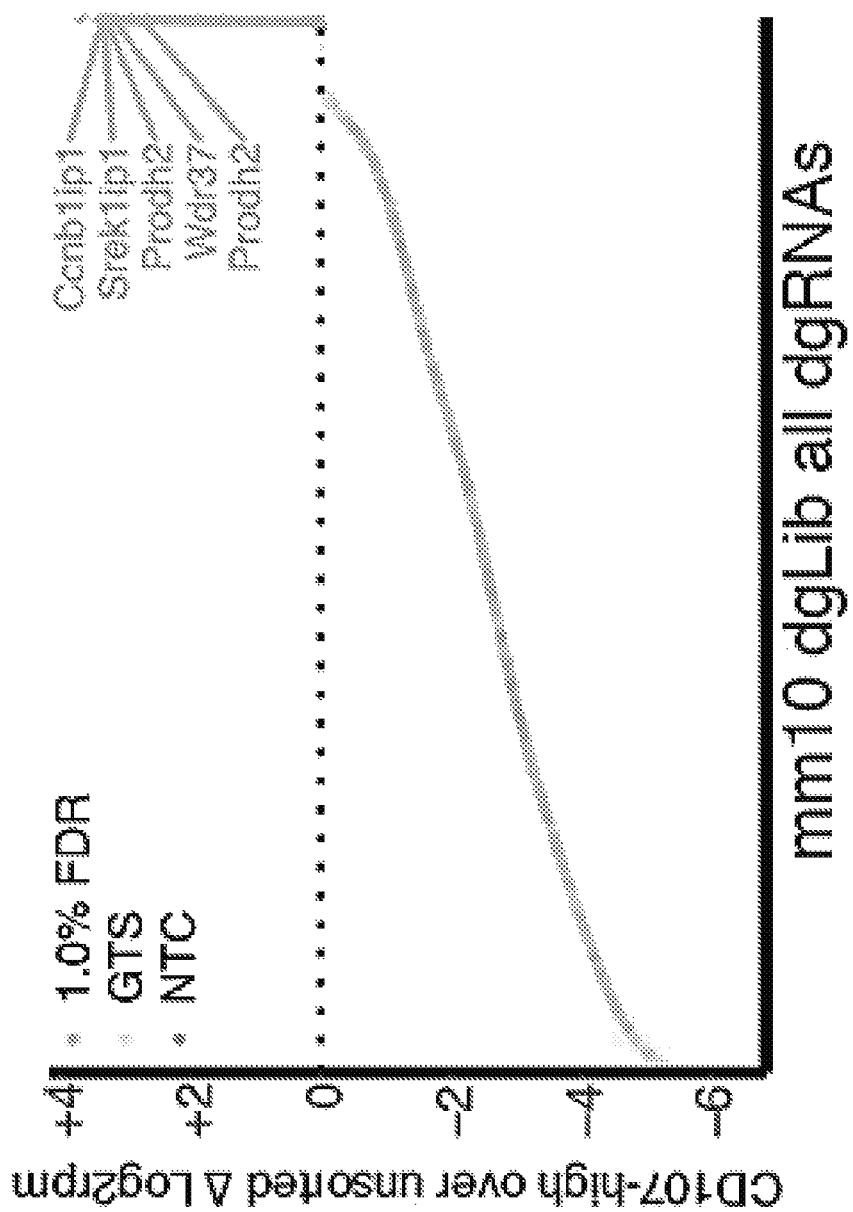
Figure 13:
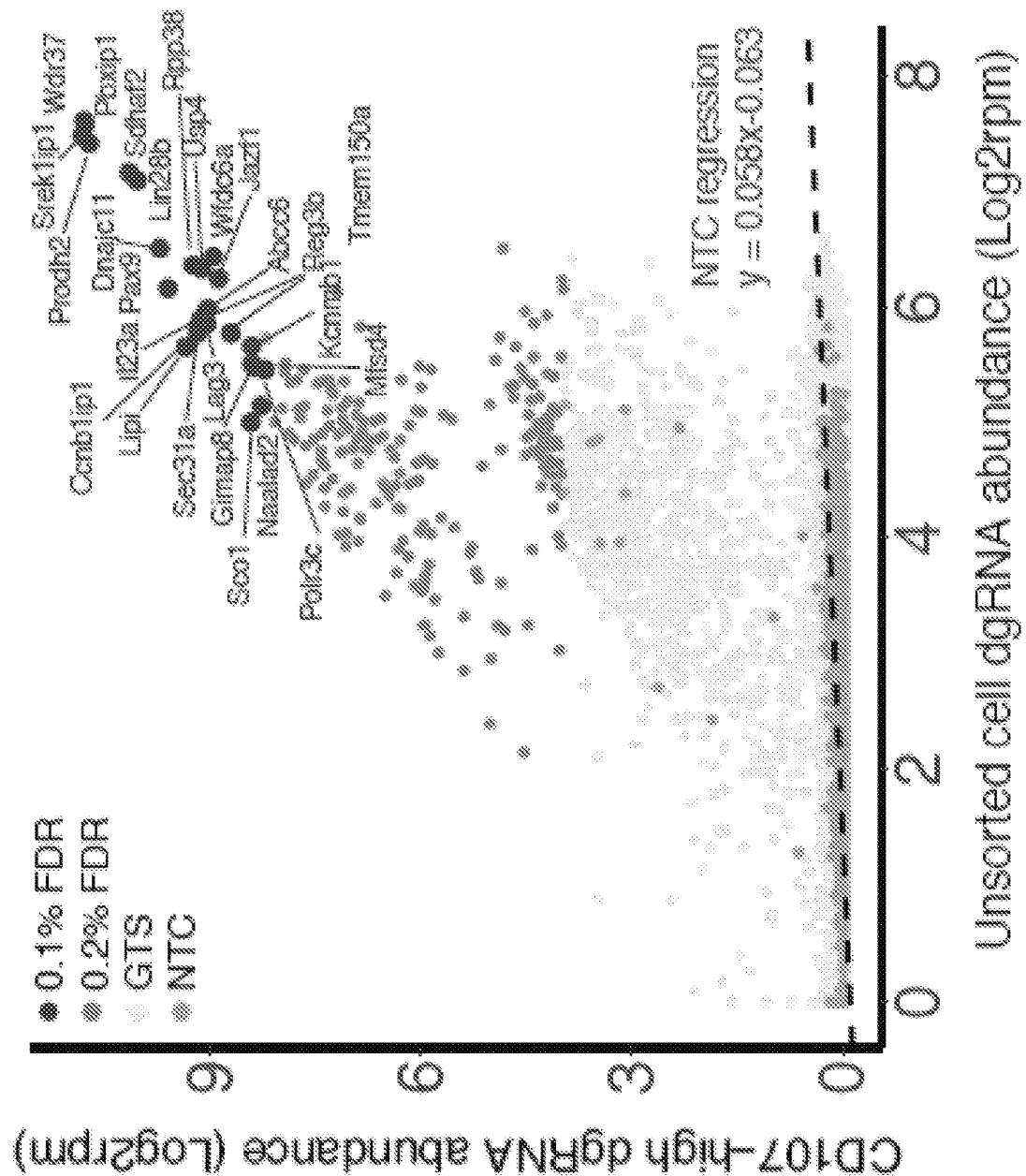
FIG. 13 illustrates bulk screen data analysis of dgTKS. The figure shows scatterplot of relative dgRNA abundances in the entire mm10dgLib library, with CD107a$^+$-high FACS sorted CD8$^+$ T cells, as compared to unsorted T cells. Blue dots are NTCs; brown dots are scoring GTSs that passed FDR 0.1% cutoff, with gene name labeled; orange dots are scoring GTSs that passed FDR 0.2% cutoff but did not pass FDR 0.1%; grey dots are remaining GTSs. Black dashed regression line of 1,000 NTCs represents a neutral baseline. GTSs deviating from the baseline showed enrichment in the CD107a"-high FACS as compared to the behavior of NTCs.

Degranulation is one of the major mechanisms through which cytotoxic CD8$^+$ T lymphocytes (CTL) mediate the killing of target cells. CD107a (LAMP-1) is a marker which can be presented on the cell surface after degranulation. To identify genes that when activated can enhance the degranulation ability of CD8$^+$ T cells after encountering their cognate antigen presented on the cell surface, a genome-scale dgRNA library-based CD8$^+$ T cell Kill assay activation Screen (dgTKS) was devised and performed (FIG. 6C). To do this, a co-culture system (kill assay) was developed in which OT-I;Cas9β CD8$^+$ T cells sensitively respond to E0771 breast cancer cells presenting SIINFEKL (SEQ ID NO. 84,614) peptide, the cognate antigen of the CD8$^+$ T cells from OT-I transgenic mice (FIG. 6C). In this system, CD107a$^+$ expression was measured among CD8$^+$ T cells co-cultured with E0771 cancer cells with or without SIIN-FEKL (SEQ ID NO. 84,614) peptide pulsing, and it was found that mm 10dgLib lentivirus transduced CD8$^+$ T cells had significantly higher CD107a$^+$ levels compared to empty vector transduced cells (p<0.001) (FIG. 6D-6E). Using fluorescence activated cell sorting (FACS), the mm 10dgLib-transduced CD8$^+$ T cells expressing a high level (top 5%) of CD107a were sorted, in three independent biological replicates, for genomic DNA preparation and dgRNA library readout (Methods; FIG. 6C). Illumina sequencing was used to read the dgRNA cassette of both CD107a$^+$-high sorted and unsorted CD8$^+$ T cells, and quantified the dgRNA abundance in the entire mm10dgLib. As a neutral baseline, it was found that the NTCs were relatively evenly distributed in the unsorted cell population, but were rarely detected in the CD107a$^+$-high CD8$^+$ T cells (FIG. 13). In contrast, there were two distinct populations of dgRNAs that deviated from the distribution and regression line of NTCs (FIG. 13). With an FDR of 0.1%, significantly enriched dgRNAs were identified in sorted CD107a$^+$-high cells targeting 26 genes, including Prodh2, Sreklip1, Wdr37, Ccnblip1, Pbxipl, and Sdhaf2 (FIG. 13). Taking a differential dgRNA calculation by subtracting CD107a$^+$-high sorted from unsorted samples, similar hits were uncovered, including Prodh2, Ccnblip1, Sreklip1, and Wdr37 (FIG. 6F). This screen revealed a global picture of GOF effects of endogenous genes on CD8$^+$ T cell degranulation and provided a ranked list of potential targets for T cell engineering.

Figure 6G:
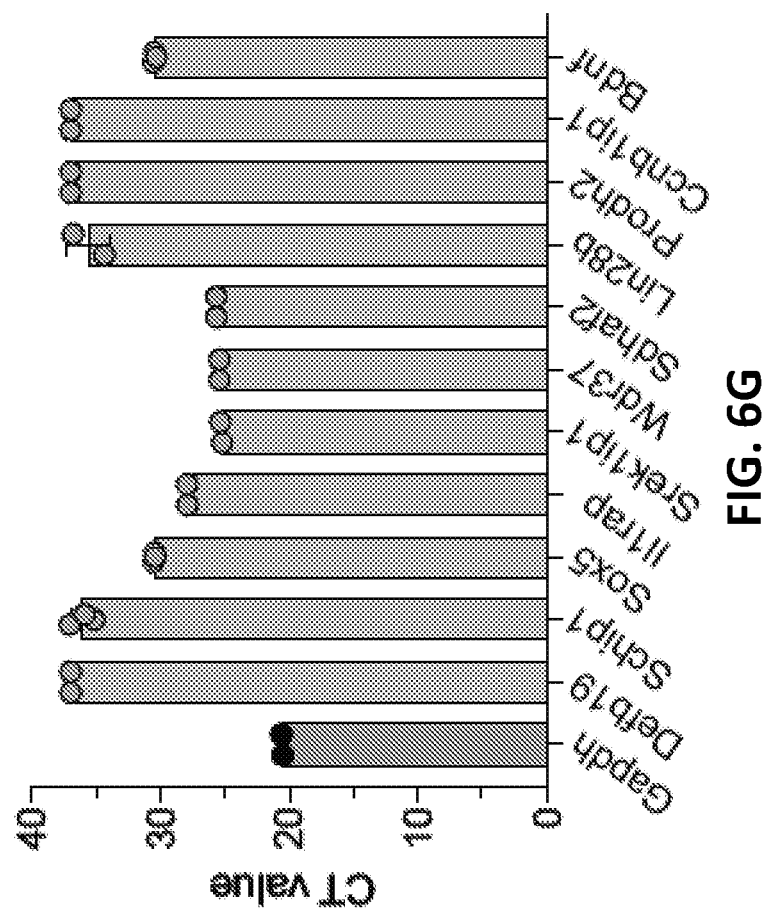
Figure 6H:
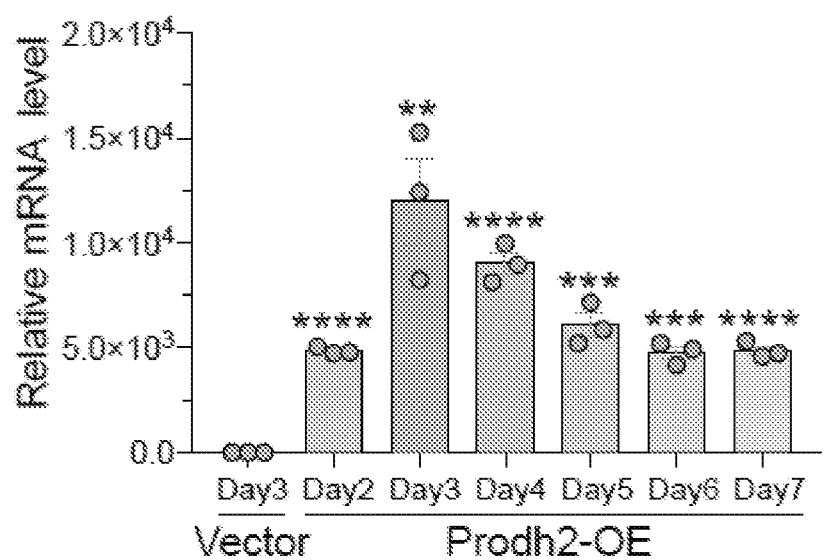
Figure 6I:
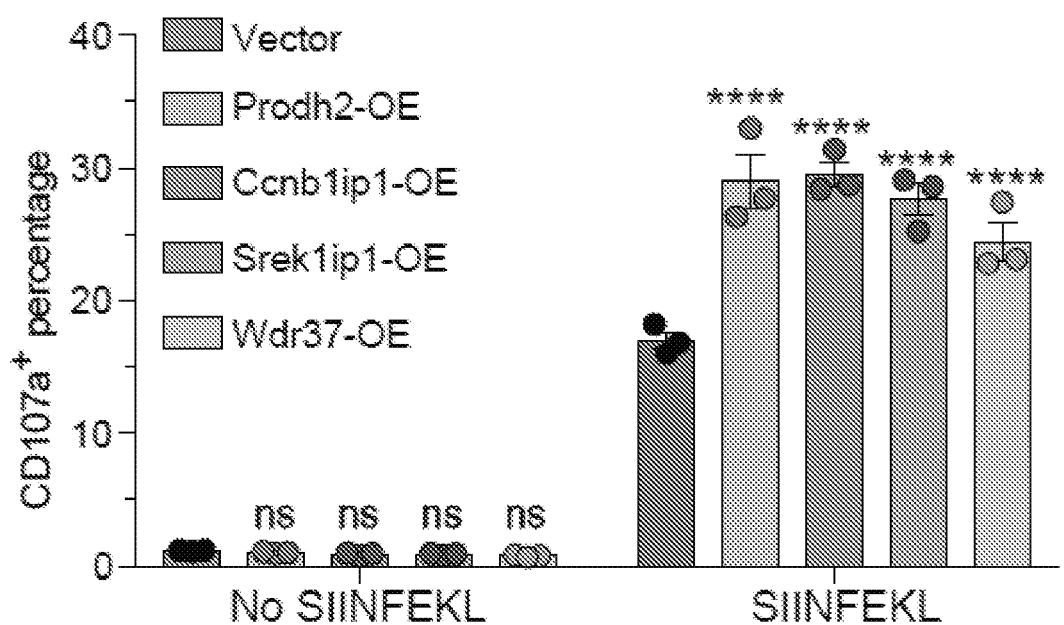
Figure 14A:
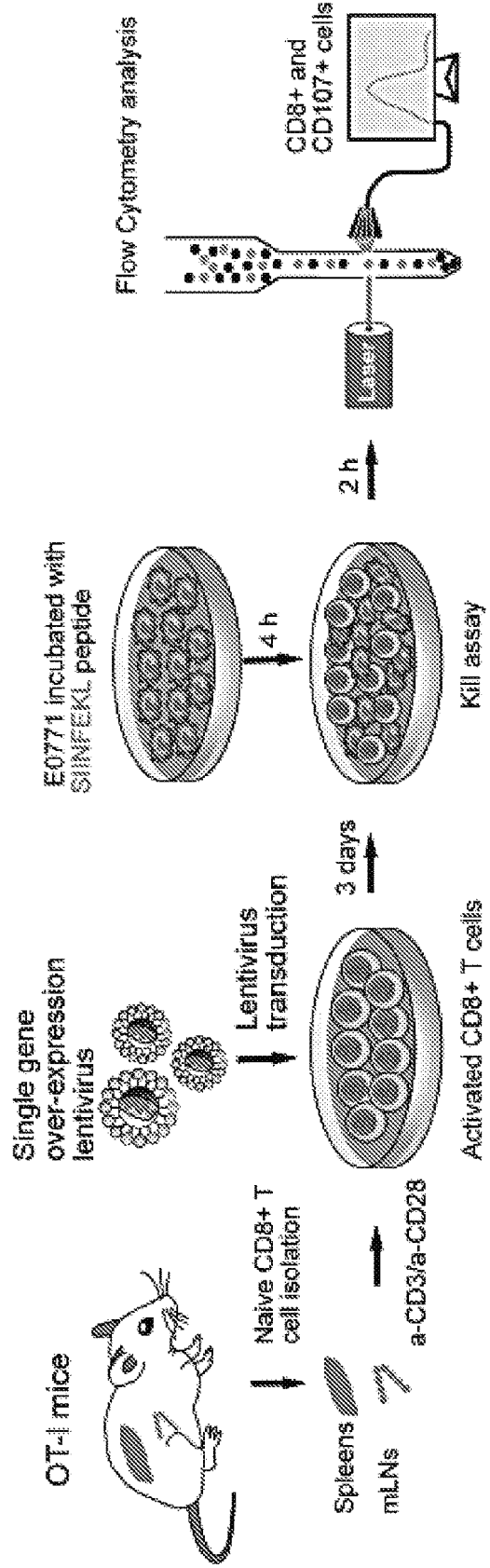
FIGS. 14A-14E illustrate testing gain-of-function of top candidates from dgTKS for enhancement of CD8$^+$ T cell effector function.
Figure 14B:
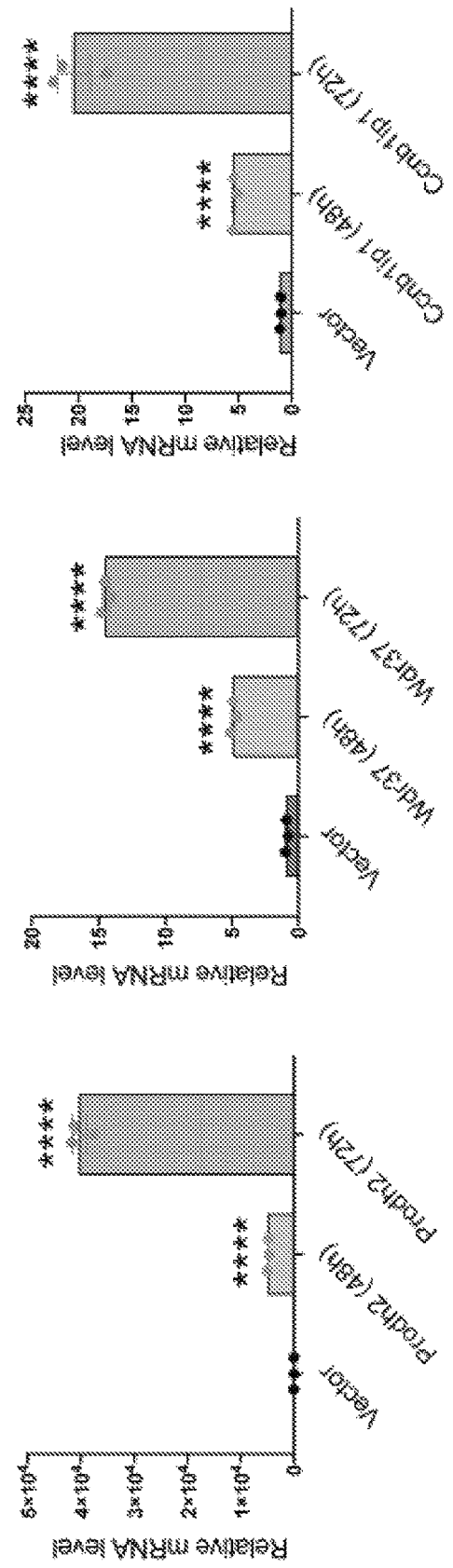
Figure 14C:
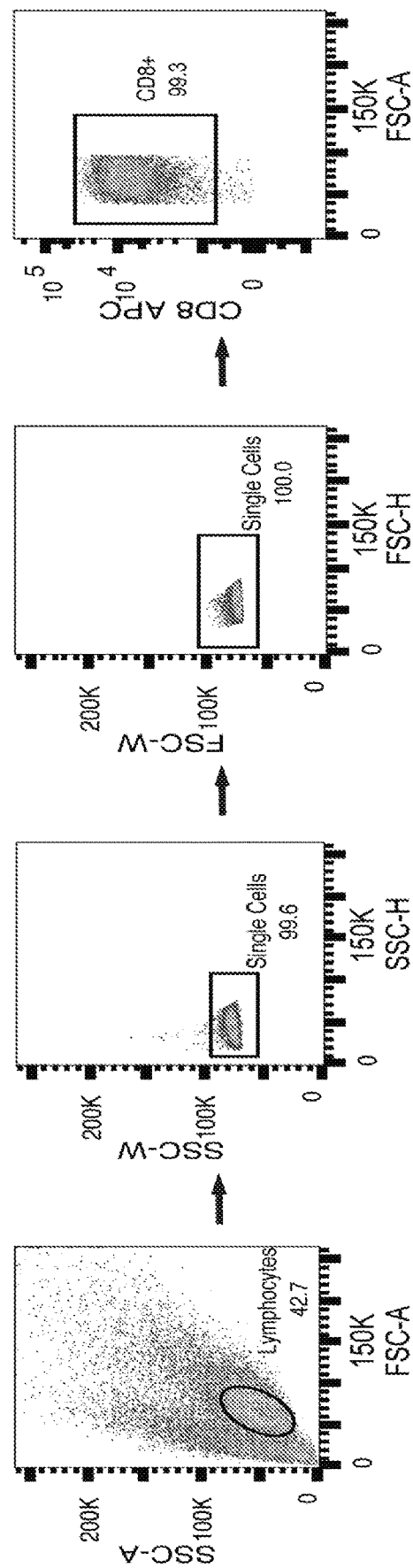
Figure 14D:
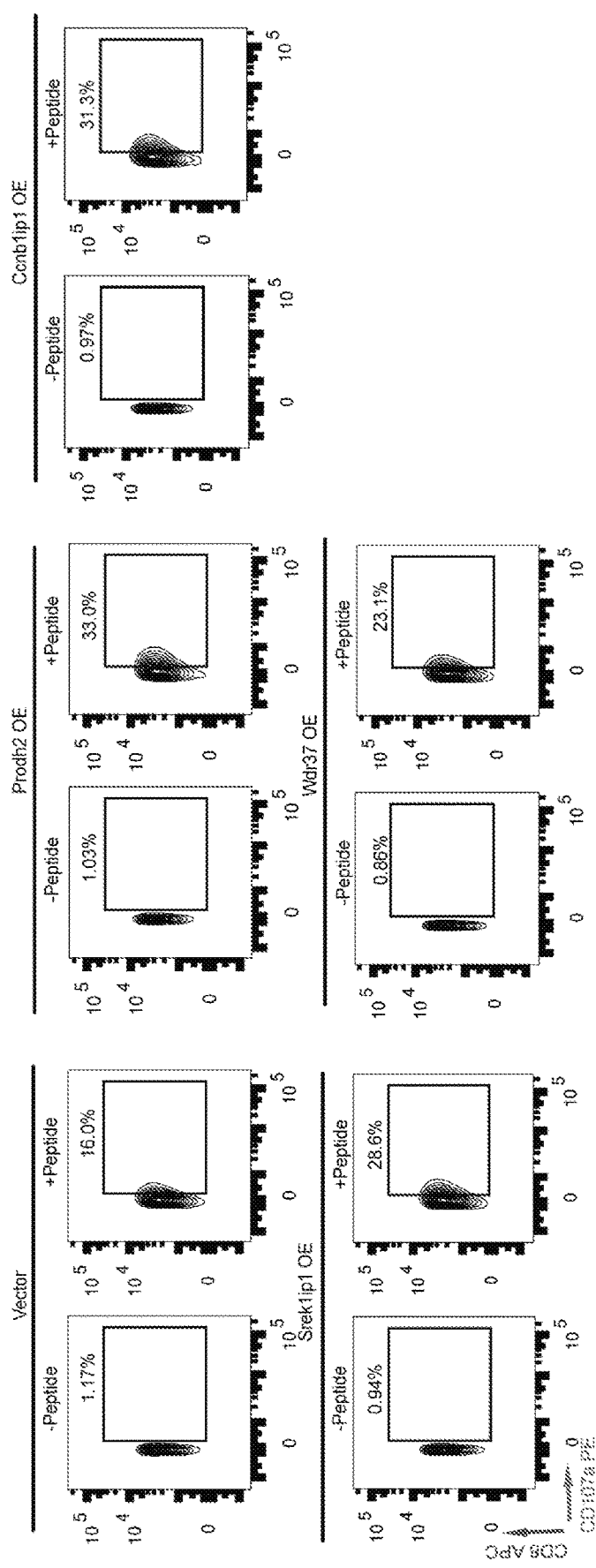

Example 6: Gain-of-Function Screen Hits from dgTKS Enhance CD8$^+$ T Cell Effector Function Without wishing to be bound by theory, based on the enrichment in the GOF screen, it was hypothesized that increased expression of high-rank candidate genes from the dgTKS screen might enhance the degranulation ability of CD8$^+$ T effector cells. Using RT-qPCR, the natural expression levels for several high-rank candidate genes, including Defb19, Schip1, Sox5, Ill1rap, Sreklip1, Wdr37, Sdhaf2, Lin28b, Prodh2, Ccnblip1 and Bdnf were measured. Results showed that all of these genes have low baseline levels of mRNA expression compared with a house-keeping gene Gapdh in primary CD8$^+$ T cells (FIG. 6G), leaving sufficient room for augmentation of gene expression for T cell engineering. After harnessing the dgRNA system's scalability for high-throughput screening, cDNA overexpression of the entire open reading frame (ORF) was directly leveraged for functional studies of individual target hits in order to (1) achieve consistently stronger fold augmentation, and (2) to enable "engineerability" in subsequent studies because knocking a short ORF into human T cells is practically simpler than the Cas9: Transactivator: sgRNA complex. Full-length cDNAs for four top candidates were cloned into a lentiviral overexpression vector and the lentivirus was packaged (Methods). It was found that transducing OT-I CD8$^+$ T cells with these lentiviral cDNAs led to robust and significant activation of targeted single candidate genes in 48 and 72 hours, as measured by RT-qPCR (FIG. 14A). A more refined time-course of gene expression on Prodh2 revealed that the transgene peaks on days 3-4 post-transduction with 8,000-12,000 fold of overexpression (FIG. 6H). Validation kill assays were performed 4 days after transduction for the four hits (Prodh2, Ccnblip1, Sreklip1, or Wdr37) and it was found that activation of each significantly enhanced degranulation by CD8+ T cells upon encountering SIINFEKL-pulsed cancer cells (FIG. 6I, FIG. 14B-14D). These data validated that augmented gene expression of Prodh2, Ccnblip1, Sreklip1, or Wdr37 can enhance CD8+ T cell effector function, providing GOF candidates for engineering improved T cell capabilities.

Figure 6K:
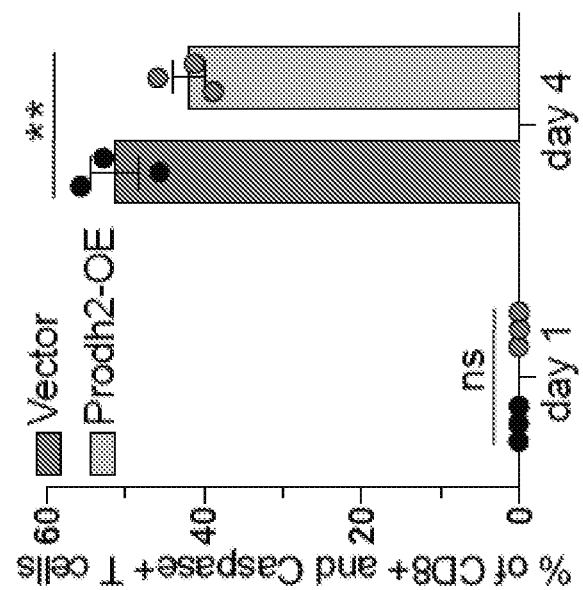
Figure 6J:
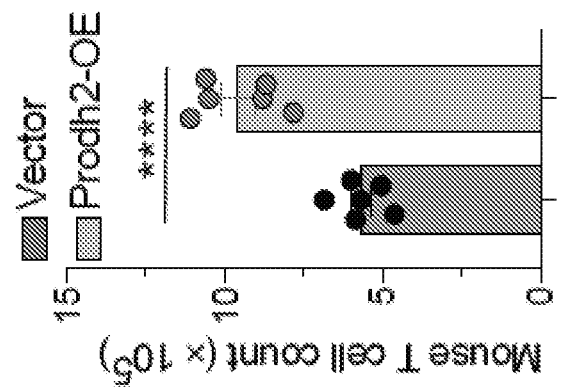
Figure 14E:

Example 7: Augmenting Prodh2 Expression Changes CD8+ T Cell Phenotypes, Enhances Anti-Tumor Activity and Dramatically Alters Transcriptional Programs Interestingly, among all targets, Prodh2-OE transduced T cells were found to proliferate rapidly in culture and it was noted that the T cell media turned yellow every day despite splitting, which was not observed in the culture of T cells that were untransduced or vector-transduced. Under the IL-2 withdrawal condition, quantification of cell numbers showed that the bulk Prodh2-OE CD8+ T cells proliferate 1.8 times faster than the vector-transduced counterparts (FIG. 6J). In addition, Prodh2-OE CD8+ T cells have lower levels of apoptosis (FIG. 6K, FIG. 14E). In vivo testing of the effect of Prodh2 overexpression on CD8 T cells' anti-tumor activity was performed using TCR-transgenic OT-I;Cas9β T cells that can recognize the cognate chicken ovalbumin (OVA) antigen (FIG. 15A). In both a subcutaneous melanoma model and an orthotopic triple-negative breast cancer (TNBC) model with clonal cell lines expressing low levels of OVA antigen, it was observed that Prodh2 overexpression significantly enhanced CD8+ T cells' anti-tumor activity in vivo (FIG. 15B-15C). This effect is consistent when using a TNBC model with cancer cells expressing high levels of OVA antigen (FIG. 15D).

Figures 7A, 7B:
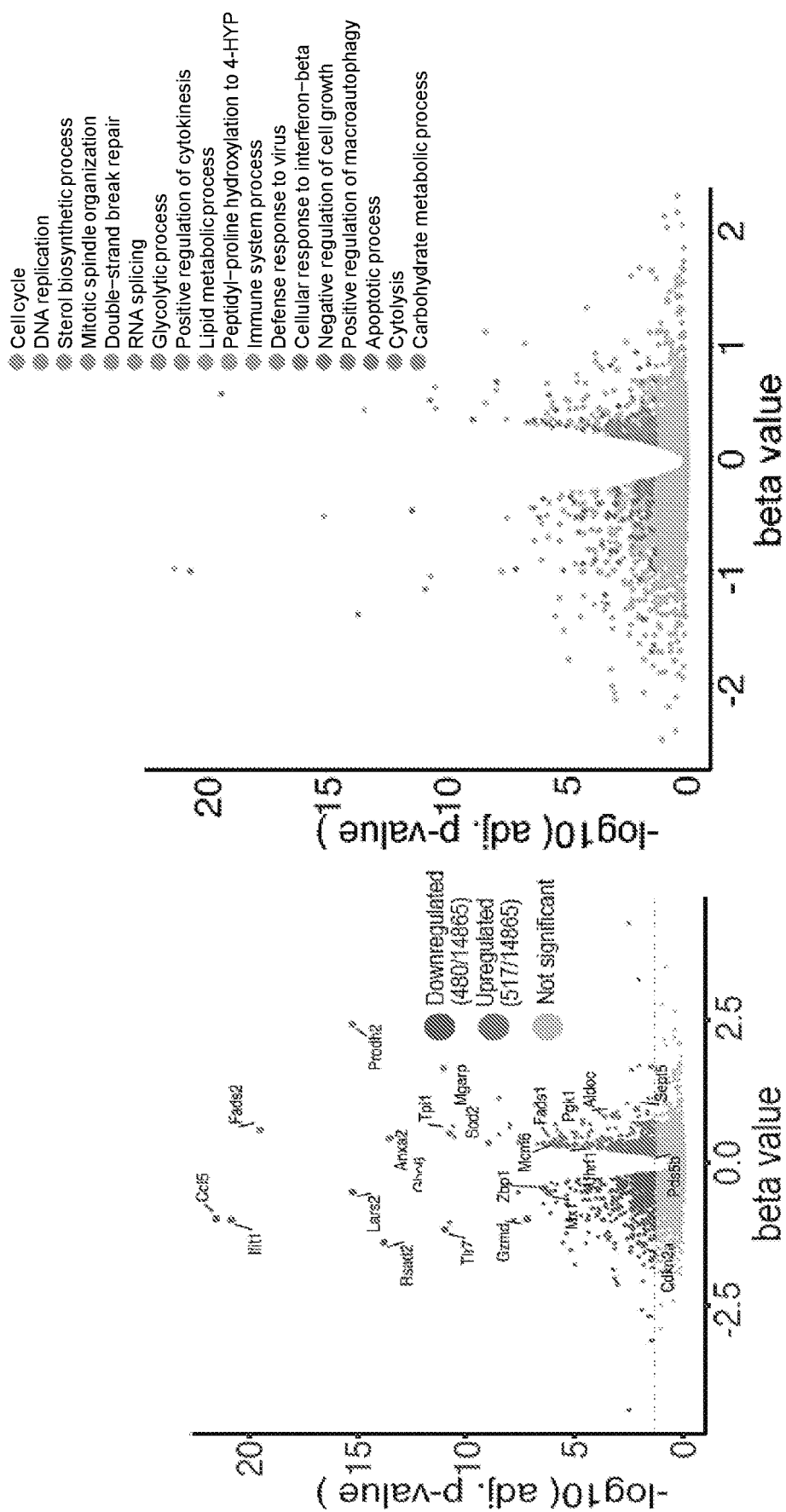
FIGS. 7A-7F illustrate that whole transcriptome profiling identified transcriptomic programs driven by Prodh2-OE in mouse primary CD8 T cells.
Figure 7C:
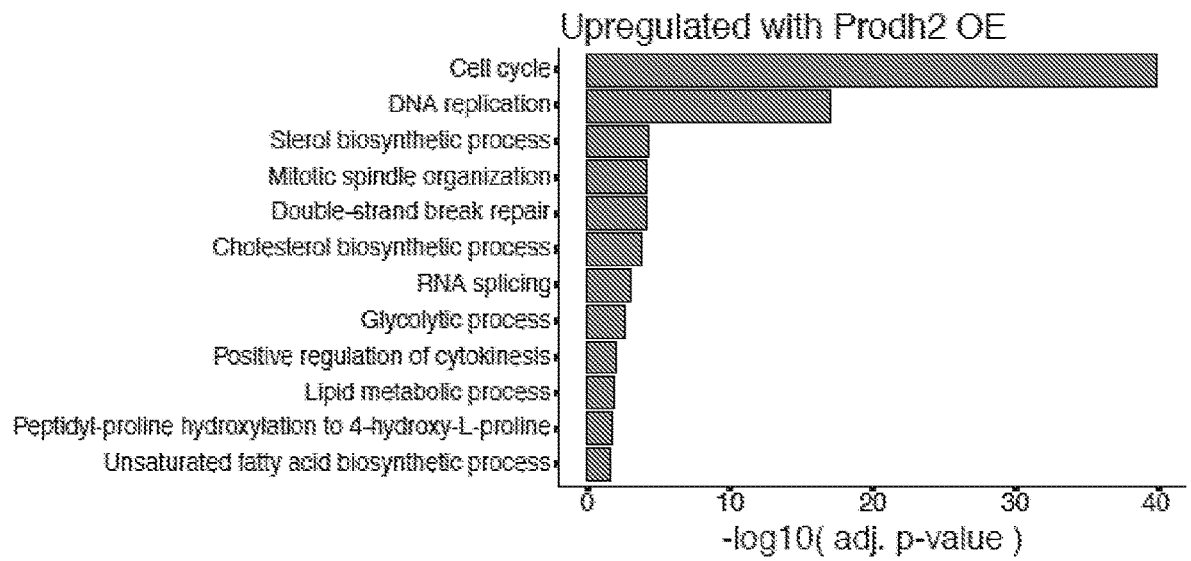
Figure 7D:
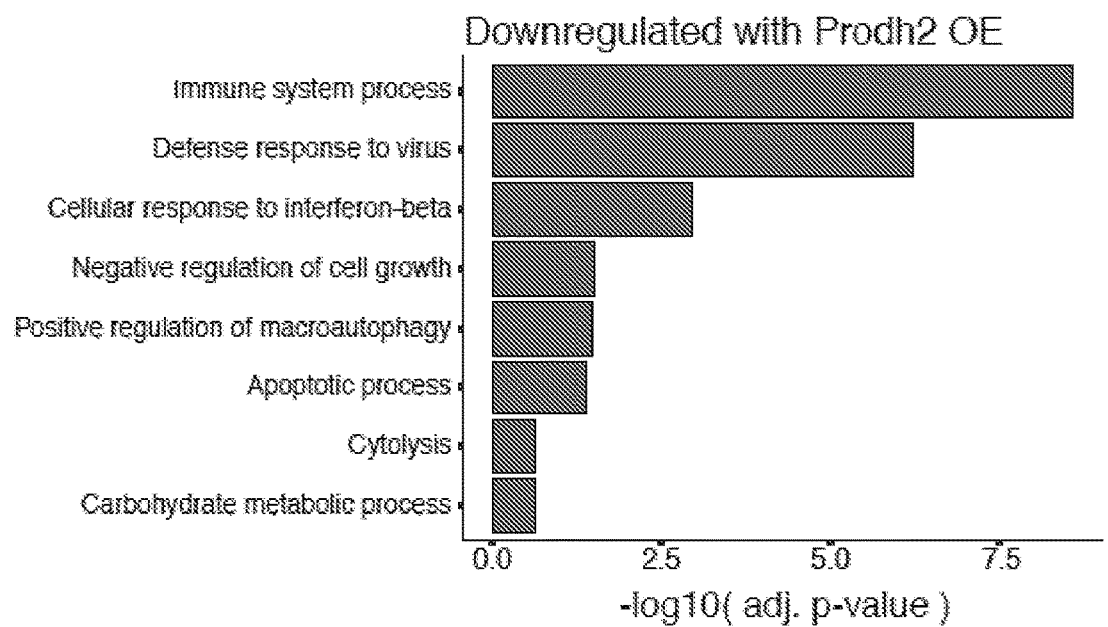
Figure 7E:
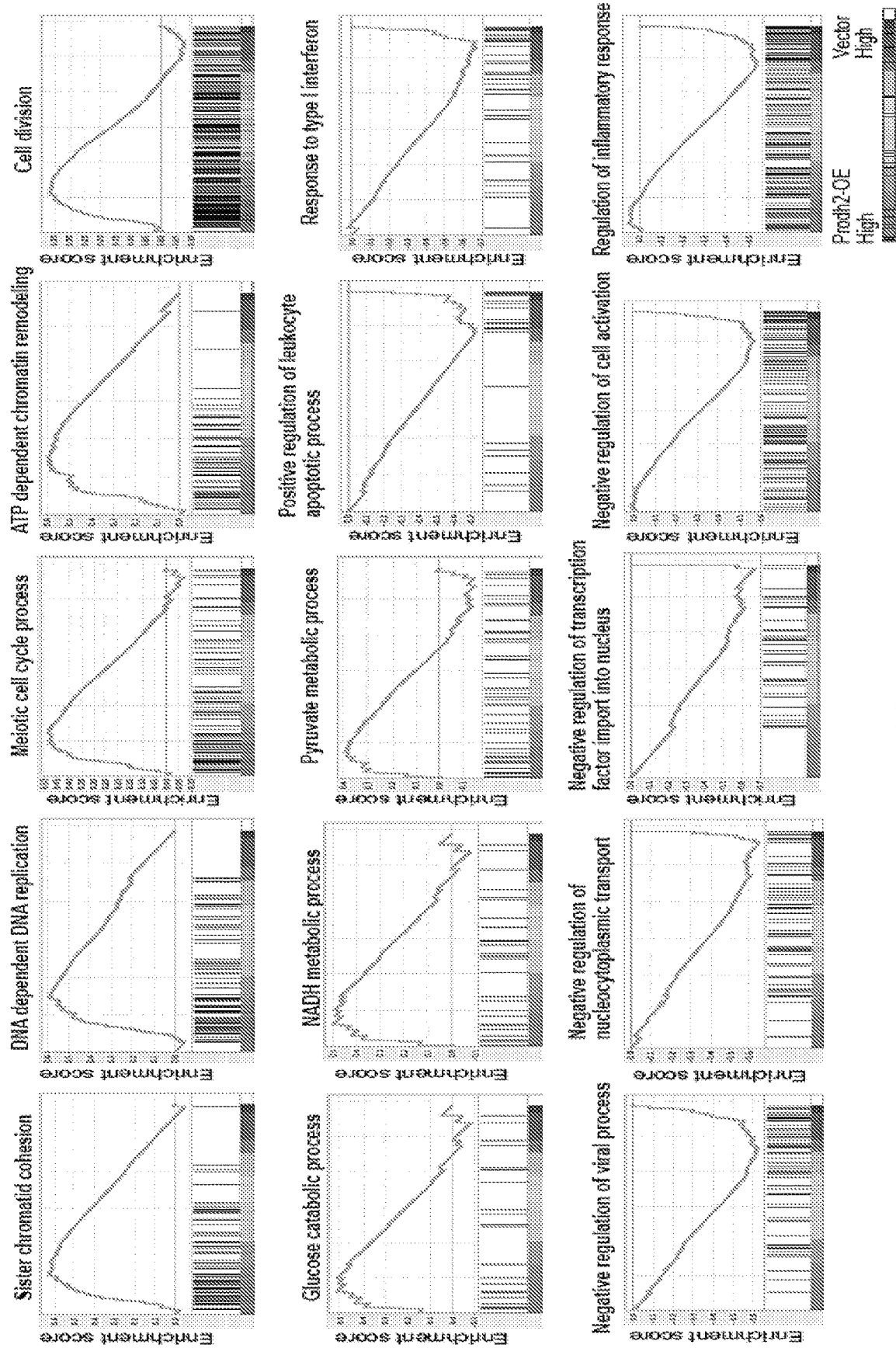
Figure 7F:
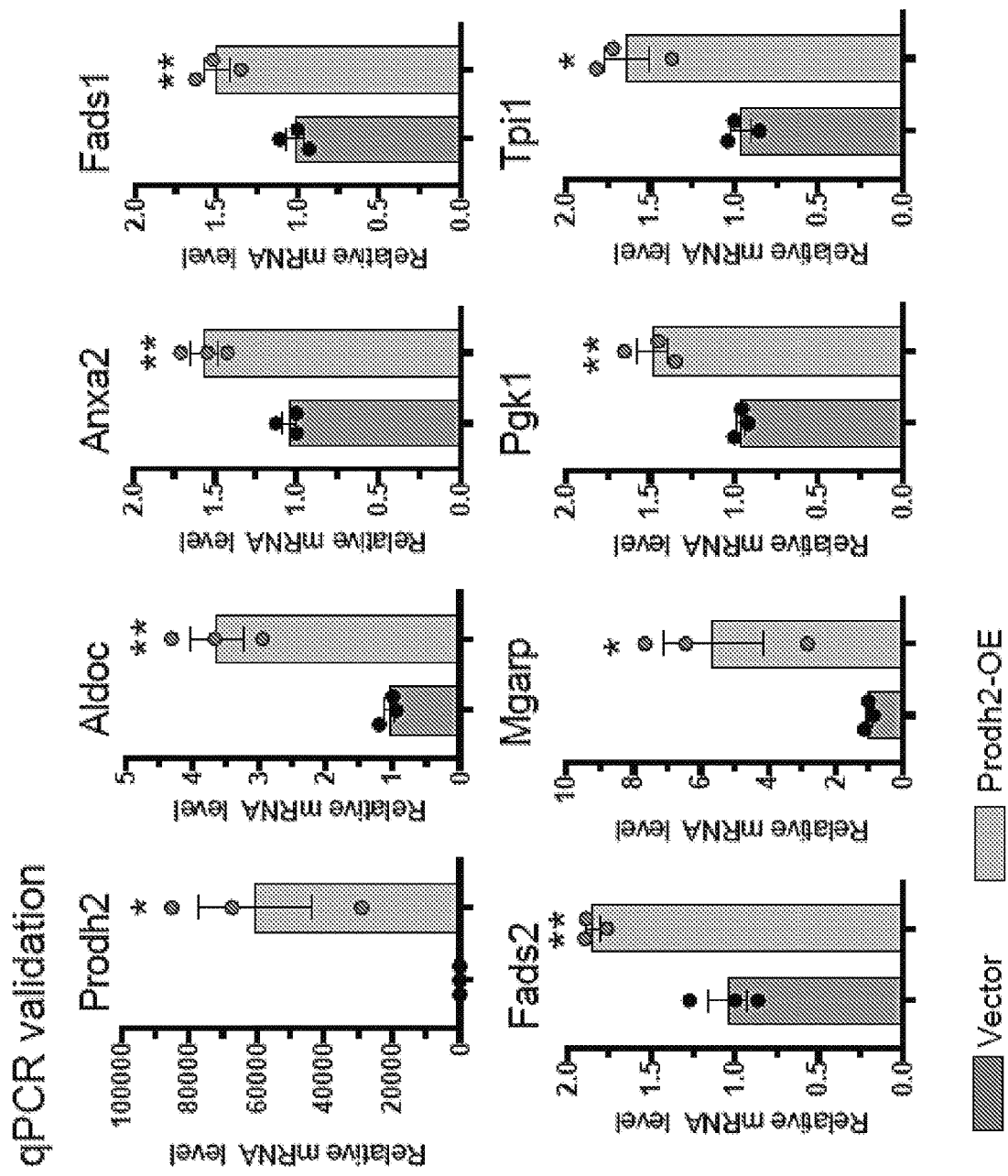

These phenotypes prompted the investigation of the molecular consequences of Prodh2 activation in CD8 T cells. To first provide a global map of the transcriptomic changes, bulk mRNA-seq was performed on Prodh2-OE mouse CD8+ T cells as compared to vector-transduced cells (Methods). Differential expression (DE) analysis revealed a broadly altered gene expression landscape upon augmentation of Prodh2, with 517 genes significantly upregulated and 480 genes significantly downregulated (FDR adjusted p value, q<0.05) (FIG. 7A), including Prodh2 as the second-most significantly upregulated genes ensuring the targeted effect of transduction (FIG. 7A). Biological processes pathway analysis of the upregulated genes revealed strong enrichment in two major transcriptomic programs: cell cycle program and the broadly-defined metabolic program (FIG. 7B-7C). On the other hand, biological processes of the downregulated genes revealed significant enrichment in immune systems processes, viral response and apoptosis (FIGS. 7B, 7D). In the cell cycle master program, a broad range of specific pathways were found to be augmented when the CD8+ T cells were supplied with high levels of exogenous Prodh2, where the populations of pathway-associated genes significantly shifted towards the Prodh2-OE direction, as revealed by gene set enrichment analysis (GSEA) (FIG. 7E). These include the pathways for cell division (sister chromatid cohesion, meiosis), DNA replication, and chromatin remodeling (FIG. 7C, 7E). In the metabolic master program, upregulated gene sets were linked to diverse metabolic pathways including proline metabolism, glucose metabolism, sterol metabolism, lipid metabolism, and fatty acid metabolism (FIG. 7C, 7E). Using qPCR, the upregulation of gene expression of multiple individual genes including Prodh2, those involved in cell cycle regulation (Anxa2), cytoskeletal function (Mgarp), as well as those involved in glucose metabolism (Aldoc, Pgk1, Tpi1) and fatty acid metabolism (Fads1, Fads2) were validated (FIG. 7F). Together, without wishing to be bound by theory, these data suggest that engineered exogenous Prodh2 expression significantly changes CD8+ T cell phenotypes, enhances anti-tumor activity and dramatically alters multiple transcriptional programs.

Example 7: PRODH2 Augmentation Alters Human CD8+ T Cell Metabolism

Figure 8D:
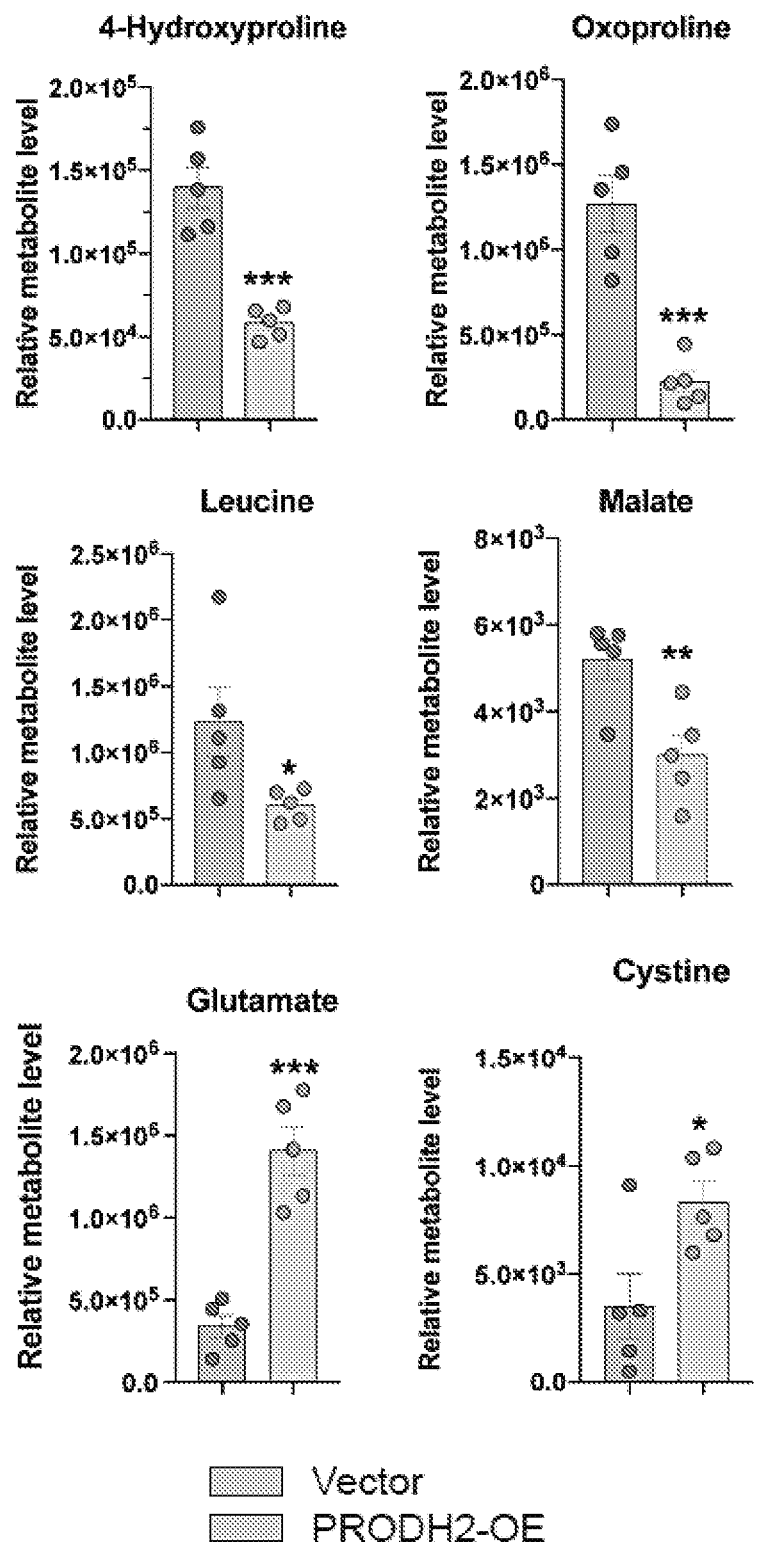
Figure 17:
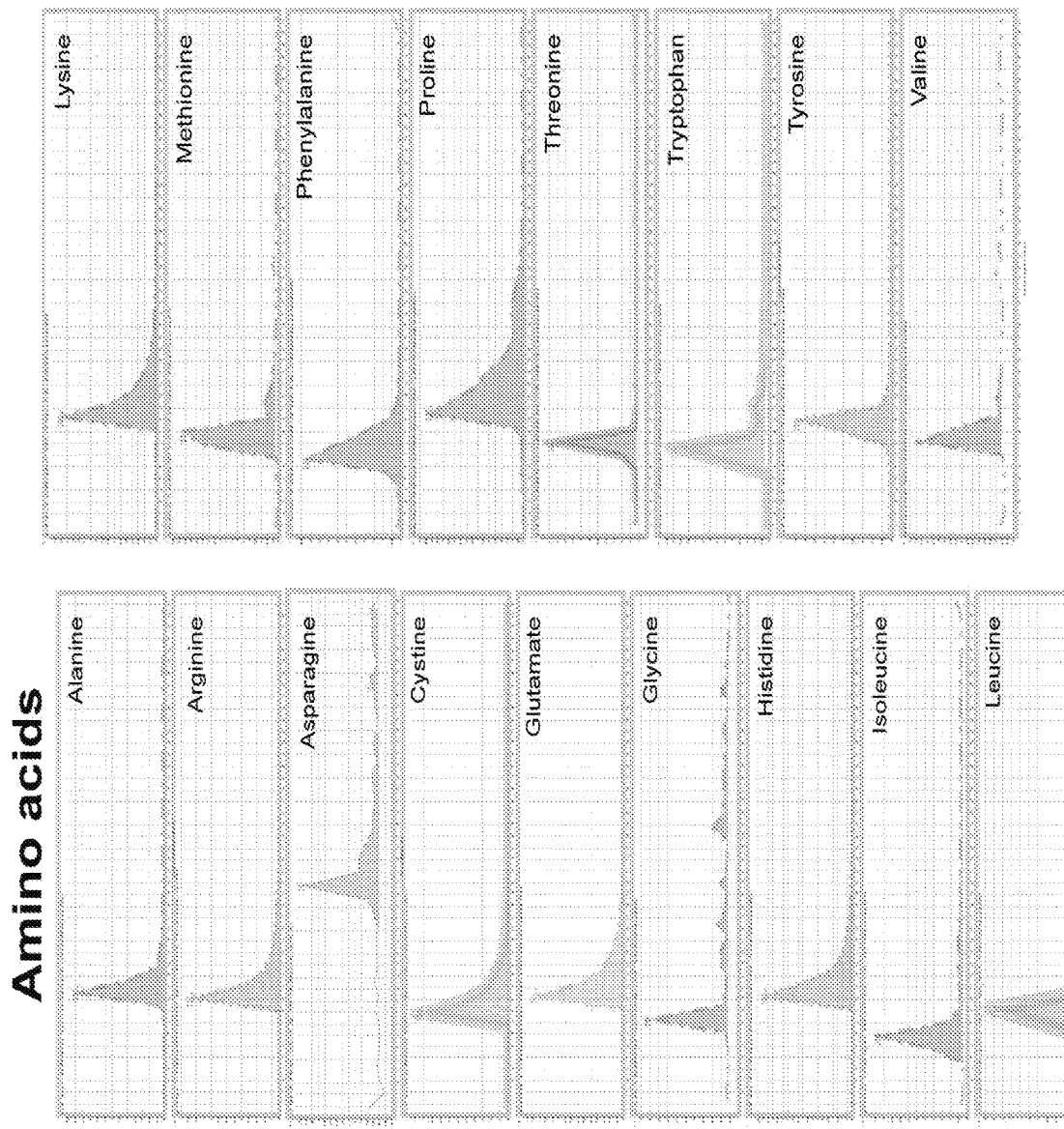
FIG. 17 illustrates representative mass-spec peaks of metabolites in T cell metabolomics analyses. The figure shows representative mass-spec peaks of metabolites in T cell metabolomics analyses, including proline metabolites, amino acids, and TCA cycle metabolites.

PRODH2/Prodh2 encodes an enzyme that catalyze the conversion of 4-Hydroxyproline (IUPAC name (2S,4R)-4-Hydroxypyrrolidine-2-carboxylic acid; Aliases: Hyp, Hydroxyproline, L-Hydroxyproline, Trans-4-Hydroxy-L-proline) into 1-Pyrroline-3-hydroxy-5-carboxylate (PHC), a key step of the proline metabolic pathway without known redundancy. This enzyme is lowly expressed across most organs or cell types in the human body, including primary CD4+ and CD8+ T cells. Although the baseline expression is low in normal tissues, Tumor Immune Dysfunction and Exclusion (TIDE) analysis of the tumor immune gene expression in human cancer showed that high level of PRODH2 is associated with stronger effective cytotoxic T lymphocyte (CTL) signatures that are beneficial for overall survival, across several solid tumor types including TNBC, melanoma, bladder cancer and lung adenocarcinoma (FIGS. 16A-16D). These features, together with the observations in mice, make it a promising candidate to be harnessed for T cell functional manipulation. Whether augmenting PRODH2 expression can change the characteristics of human T cells was then investigated (FIG. 8A). An overexpression construct for human PRODH2 (hPRODH2-OE) was generated, and a potent augmentation of 75-fold gene expression over endogenous level in human primary CD8+ T cells was confirmed (FIG. 8B). The human T cells with augmented PRODH2 also proliferated significantly faster than vector control (FIG. 8C), suggesting a conserved growth phenotype. A targeted metabolomics experiment focused on proline and arginine metabolism was then performed (Methods) (FIG. 8A, FIG. 17). In hPRODH2-OE CD8+ T cells, it was observed that 4-Hydroxyproline levels were significantly decreased, and the PHC level was significantly increased (FIG. 8D), suggestive of an increased level of biochemical activity consistent with the augmented gene expression. Moreover, hPRODH2-OE CD8+ T cells have significantly lower levels of metabolites including oxoproline, ornithine, pyruvate, aspartate, leucine, malate and oxaloacetate; and higher levels of metabolites including choline, glutamate, cysteine and lactate. Without wishing to be bound by theory, these data suggested that elevation of PRODH2 level in human CD8+ T cells significantly changed their proliferation and metabolism.

Example 8: PRODH2 Genomic Knockin Boosts CAR-T Cell Effector Function

Figure 9A:
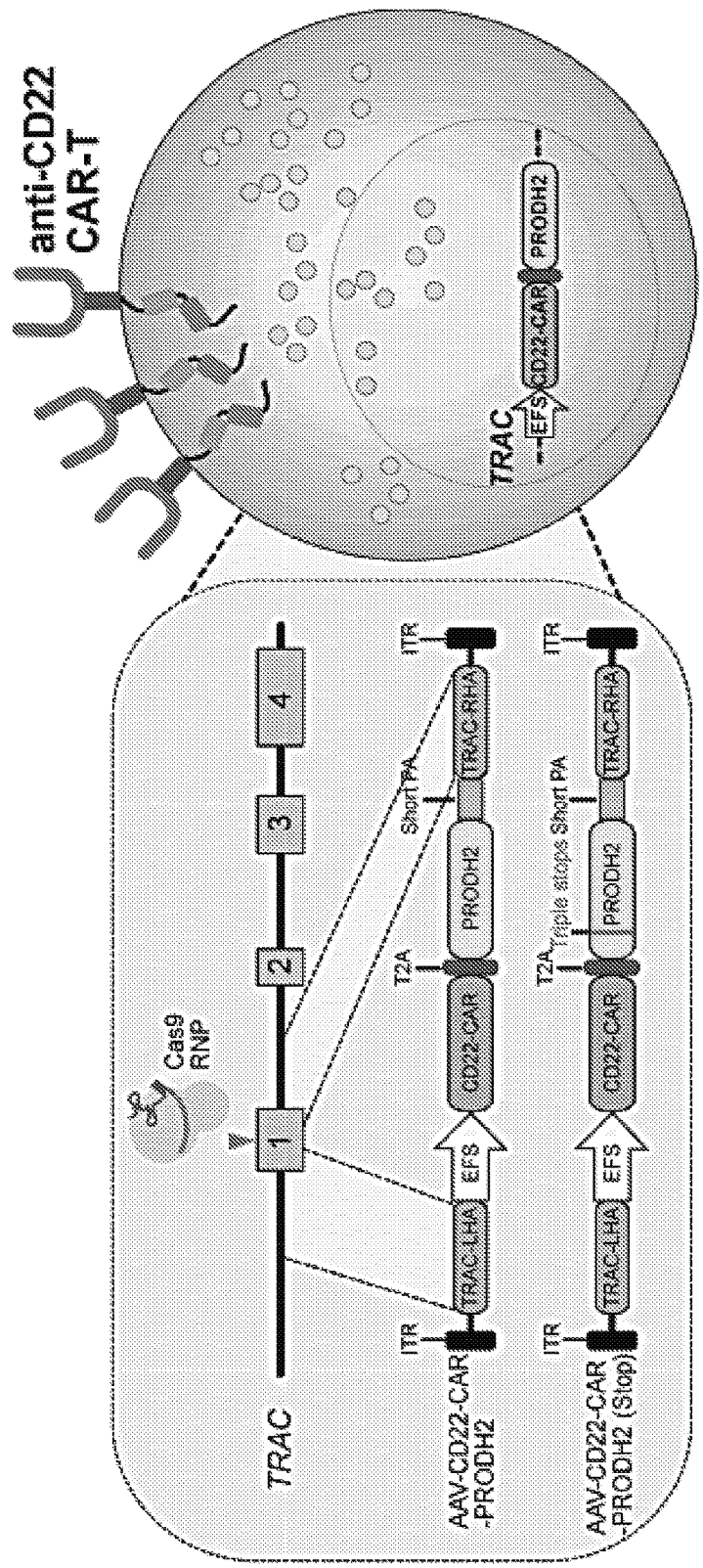
FIGS. 9A-9D illustrates that genomic knockin of PRODH2 boosts the effector function of CD22-specific CAR-T.
Figure 9B:
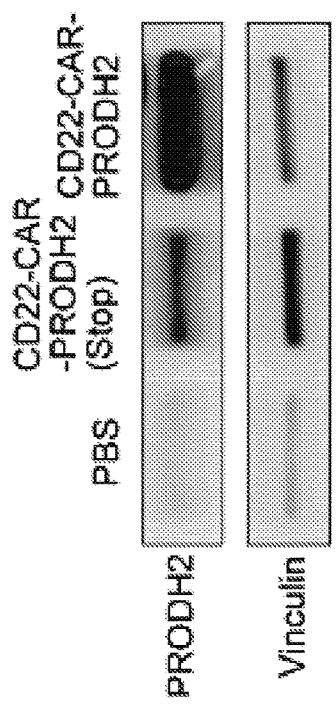
Figure 9C:
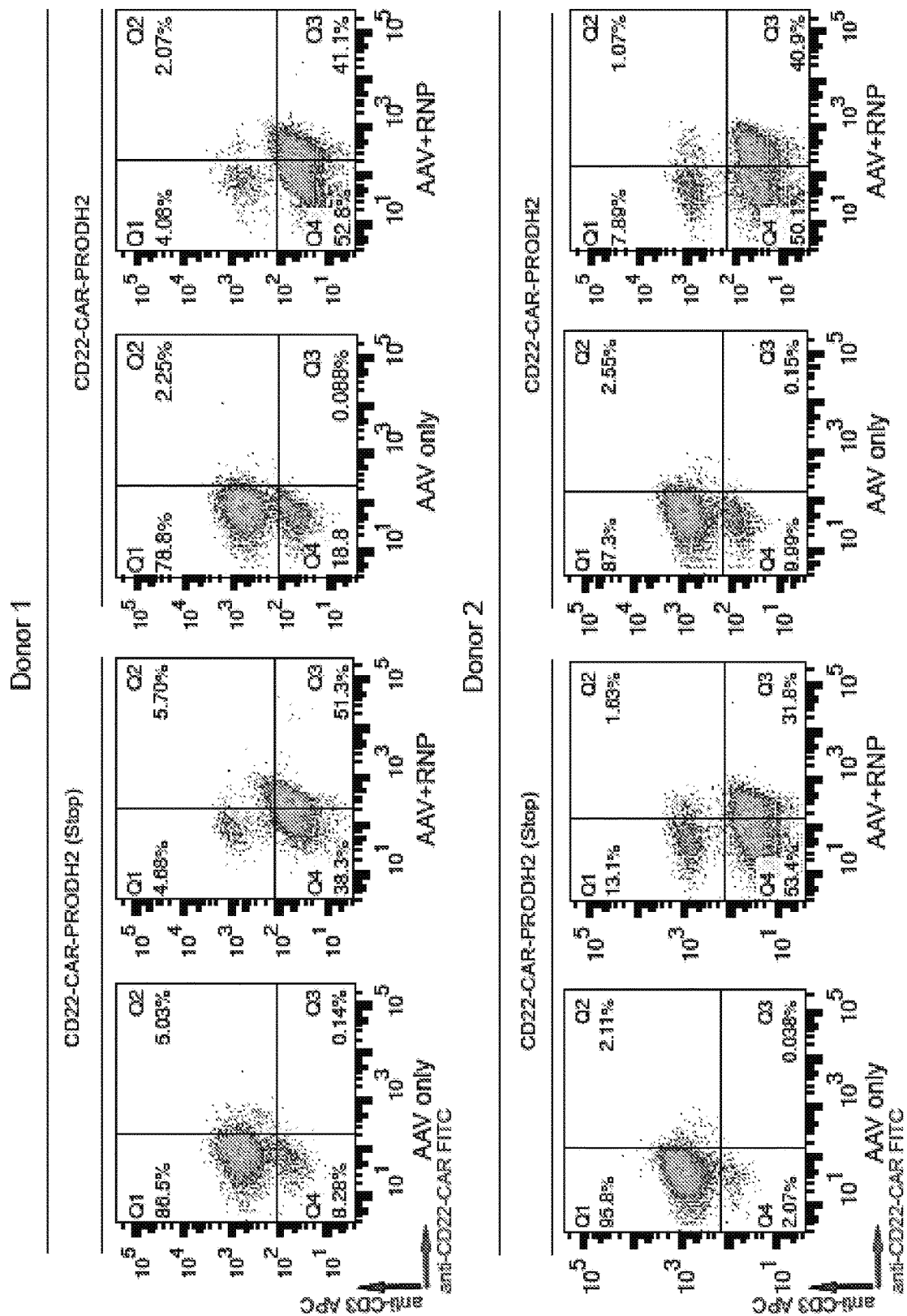
Figure 9D:
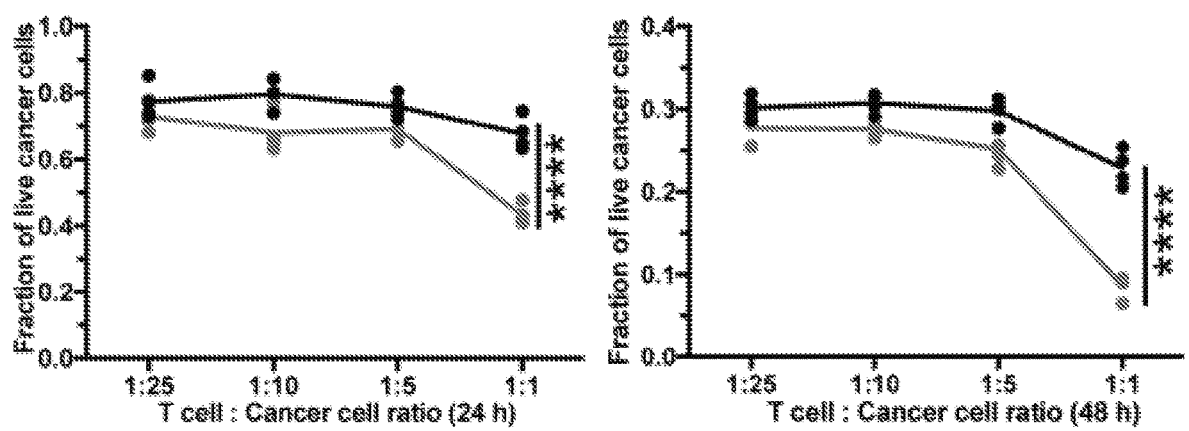
Figure 9D:
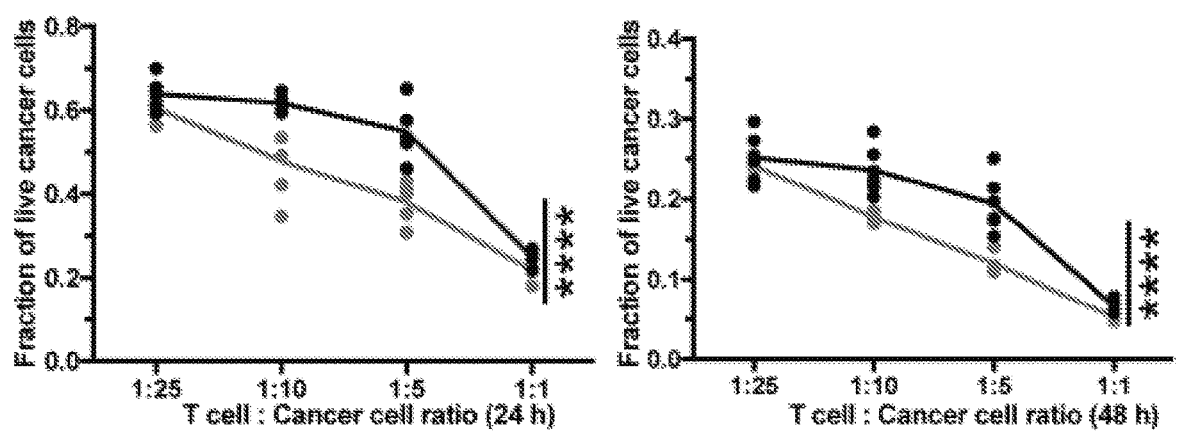
Figure 22:
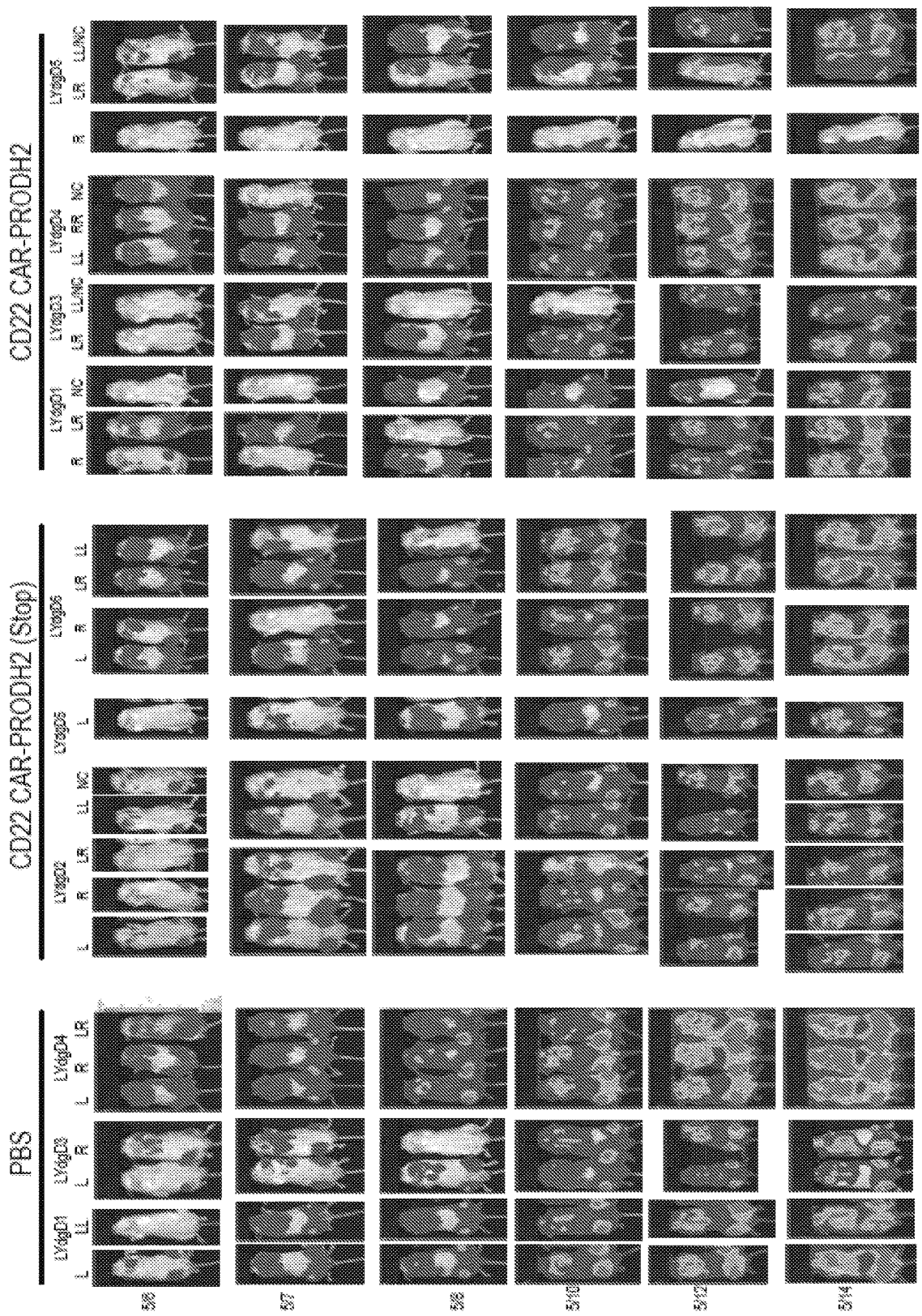
FIG. 22 is a series of images illustrating the in vivo efficacy testing of PRODH2-knockin CAR-T IVIS imaging pictures of NALM6-GL cancer cell injected NSG mice treated with PBS, CD22 CAR-T cells with PRODH2 (Stop) knockin, or CD22 CAR-T cells with PRODH2 knockin. Each column is an individual mouse in a matched manner. Each row is a time point.

To harness the function of PRODH2 to program T cells relevant to cell therapy, PRODH2 and CAR were co-engineered in human T cells. An anti-CD22 CAR (CD22-CAR) AAV construct specifically targeted to the TRAC locus was generated, with simultaneous knockin of the PRODH2 transgene (AAV-CD22-CAR-T2A-PRODH2), to allow simultaneous expression of CD22-CAR and PRODH2 in the same T cells (FIG. 9A). In parallel, for functional studies, because untargeted primary cells or CAR-T cells without any other transgene are imperfect controls, a matched control was generated with a prematurely stopped PRODH2 CDS (AAV-CD22-CAR-T2A-PRODH2 (Stop)) (Methods) (FIG. 9A). With electroporation of Cas9 ribonucleoprotein (RNP) targeting TRAC exon 1 followed by transduction of the AAV constructs, these transgenes were introduced into the endogenous TRAC locus of primary CD8 T cells to generate CD22-CAR;PRODH2 stable knockin CAR-T cells, as well as the CD22-CAR;PRODH2 (Stop) control knockin CAR-T cells (Methods) (FIG. 9A). Western blot analysis showed that CD22-CAR;PRODH2 knockin CAR-T cells express dramatically higher PRODH2 protein as compared to the endogenous level of untransduced primary $CD8^+$ T cells (FIG. 9B). Of note, PRODH2 protein is also detected in the CD22-CAR;PRODH2 (Stop) control knockin CAR-T cells (FIG. 9B), potentially due to baseline translational read-through or upregulated endogenous level, although still much lower than that of CD22-CAR;PRODH2 knockin as a direct comparison. Flow cytometry analysis of both AAV knockin constructs in the $CD8^+$ T cells from two human donors showed a near-complete TRAC editing by Cas9 RNP, as evident by the level of surface CD3 (FIG. 9C), as CD3 and TCR form a functional complex. CD22-CAR flow analysis showed that the bulk knockin efficiency of CD22-CAR;PRODH2 was at 41% for both donors; and the efficiency of CD22-CAR; PRODH2 (Stop) was at 51% and 32% for donors 1 and 2 (FIG. 9C). A co-culture assay to test the ability of CD22-CAR;PRODH2 CAR-T cells to kill cognate leukemic cells, NALM-6, was performed. As compared to the CD22-CAR; PRODH2 (Stop) control, CD22-CAR;PRODH2 CAR-T cells have a significantly stronger ability to kill the antigen-specific NALM-6 (FIG. 9D). This was confirmed at multiple doses, with two time points and in both donors, although with donor-specific variation of the optimal effector: target (E: T) ratio (FIG. 9D). Lastly, the ability of CD22-CAR; PRODH2 CAR-T cells to control tumor growth in vivo was examined. NALM6-GL cells were injected i.v. into NSG mice, imaged by IVIS, and randomized into 3 groups. Ten days after cancer cell injection, each mouse received CD22 CAR-T cells with PRODH2 (Stop) knockin, or CD22 CAR-T cells with PRODH2 knockin, or a PBS control. Mice were then imaged at subsequent time points (FIG. 22). Similar to in vitro assays, mice treated with CD22 CAR-PRODH2 cells displayed lower tumor burdens over the duration of the experiment. In total, without wishing to be bound by theory, these data suggest that PRODH2 knockin enhanced the cancer-killing ability of CD22-specific CAR-T cells.

Figure 10C:
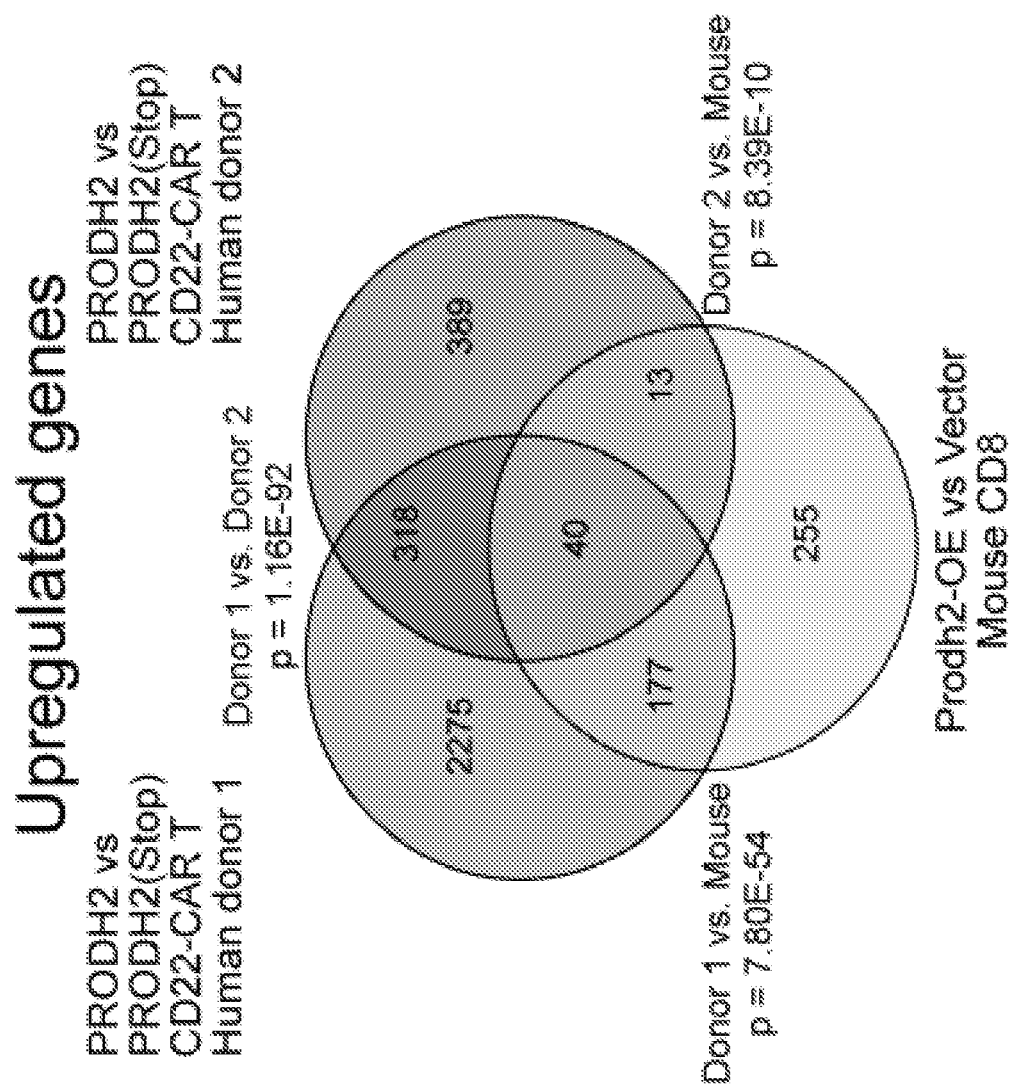
Figure 10D:
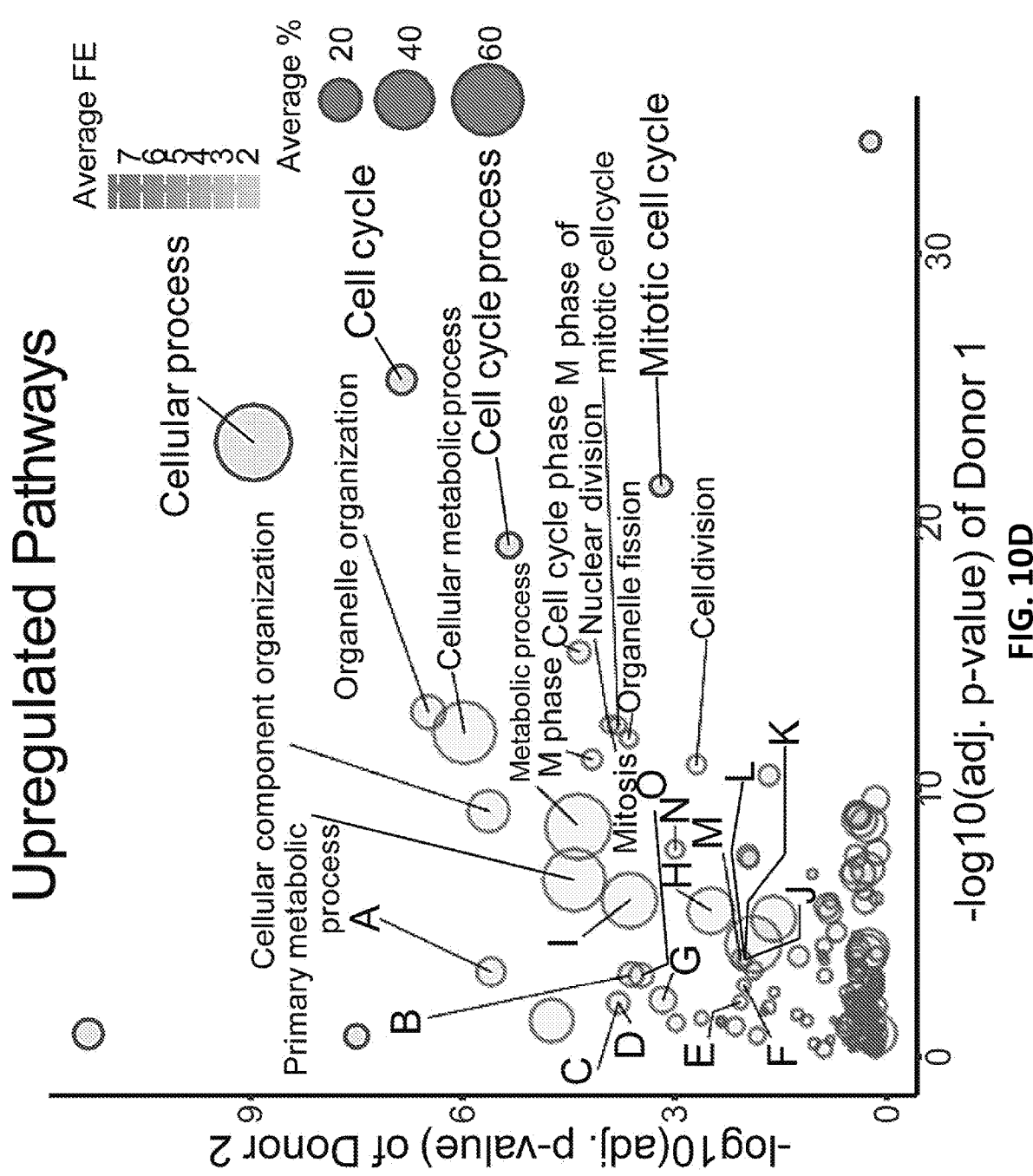
Figure 10F:
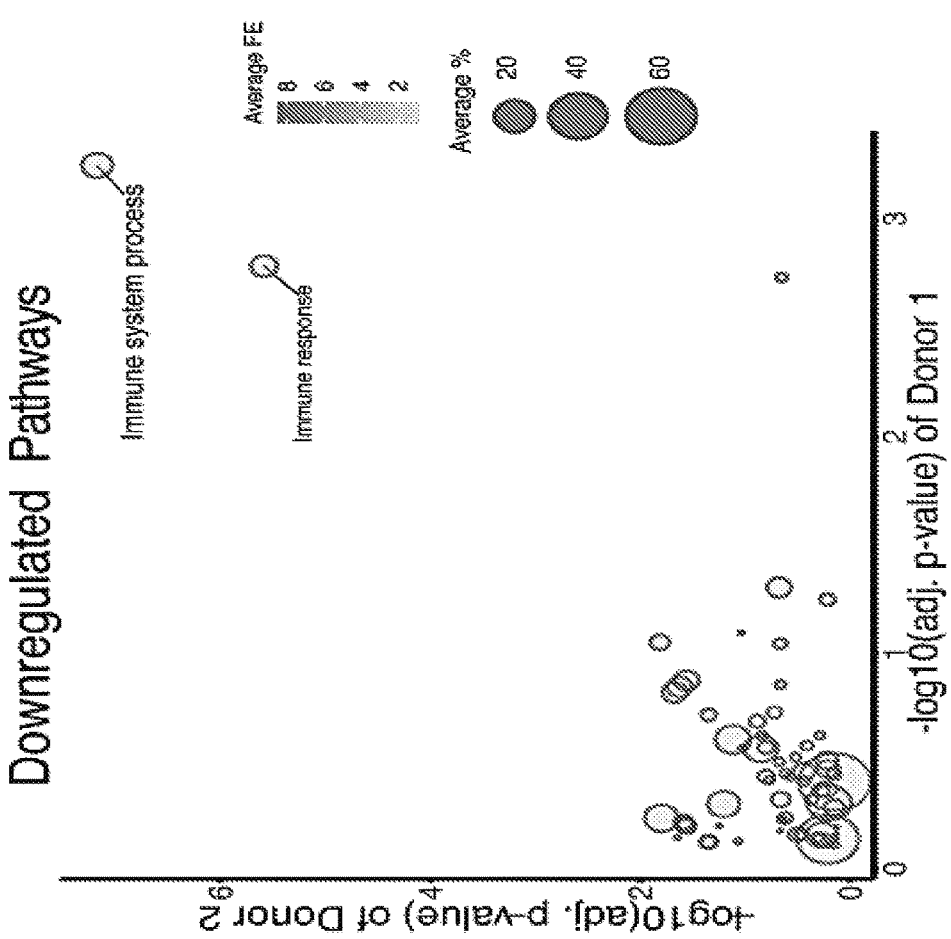
Figure 10E:
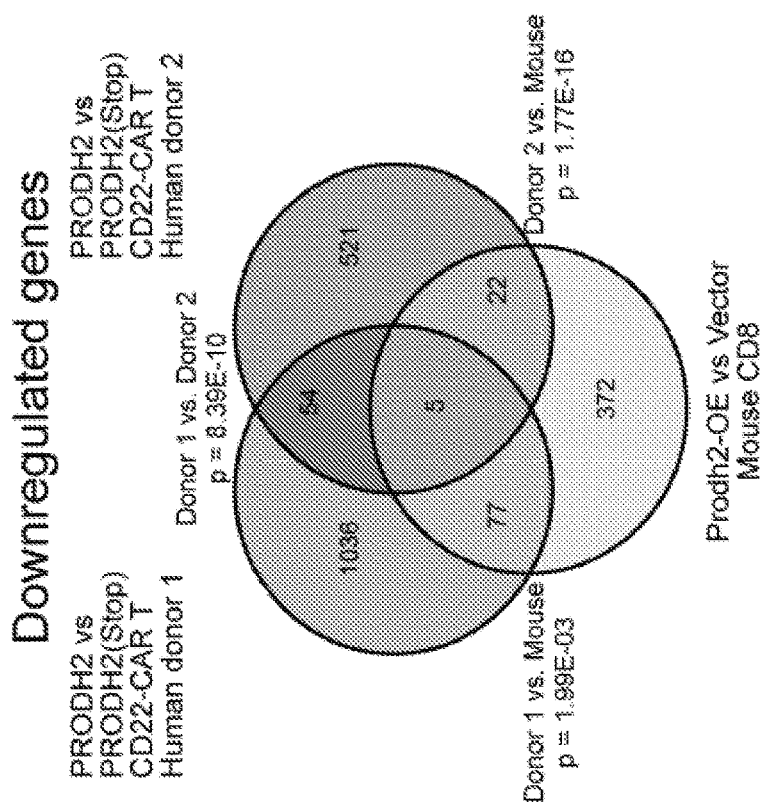
Figure 18A:
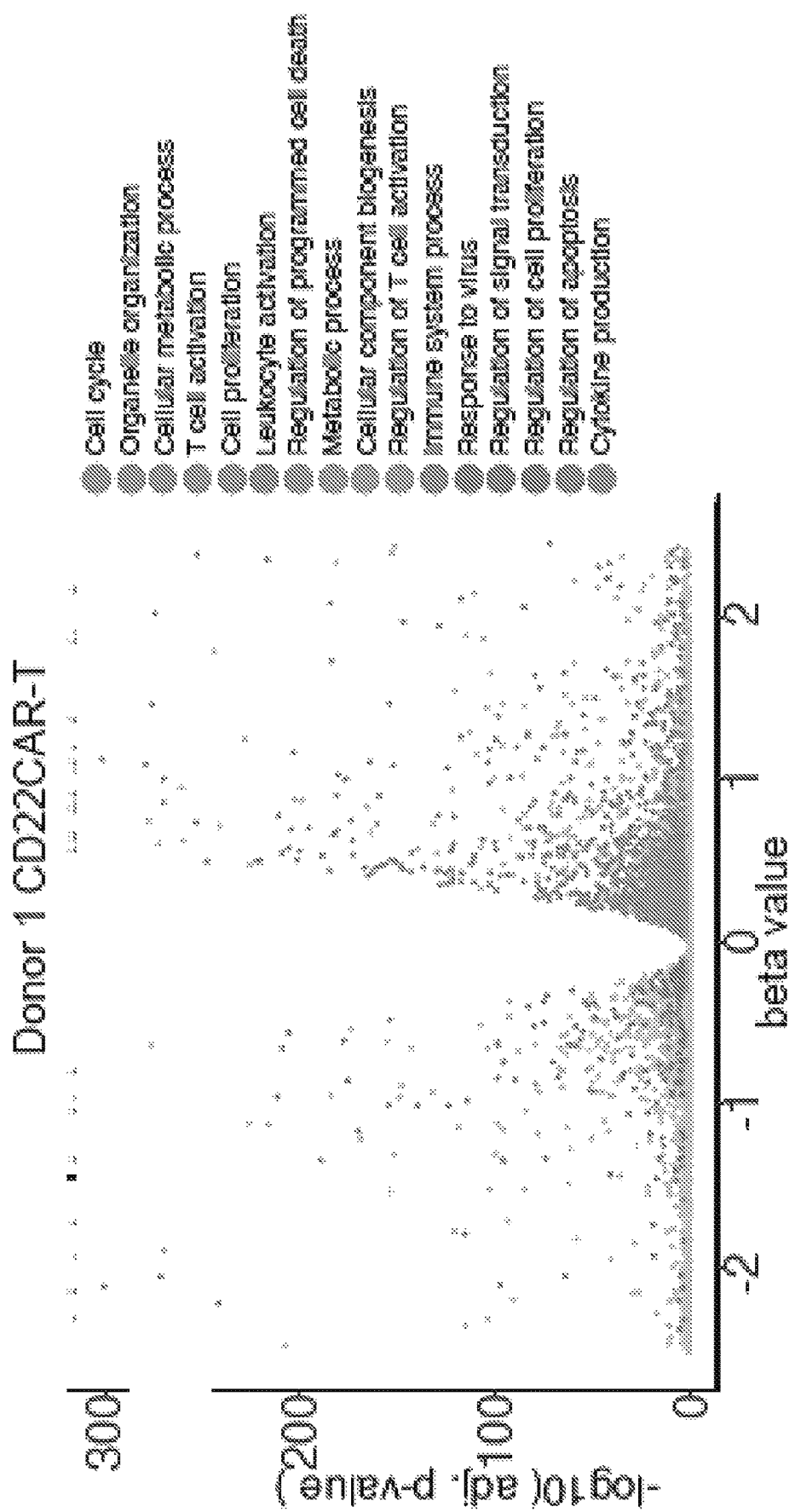
FIGS. 18A-18B illustrate whole transcriptome profiling of PRODH2 knockin CD22-CAR-T cells.
Figure 18B:
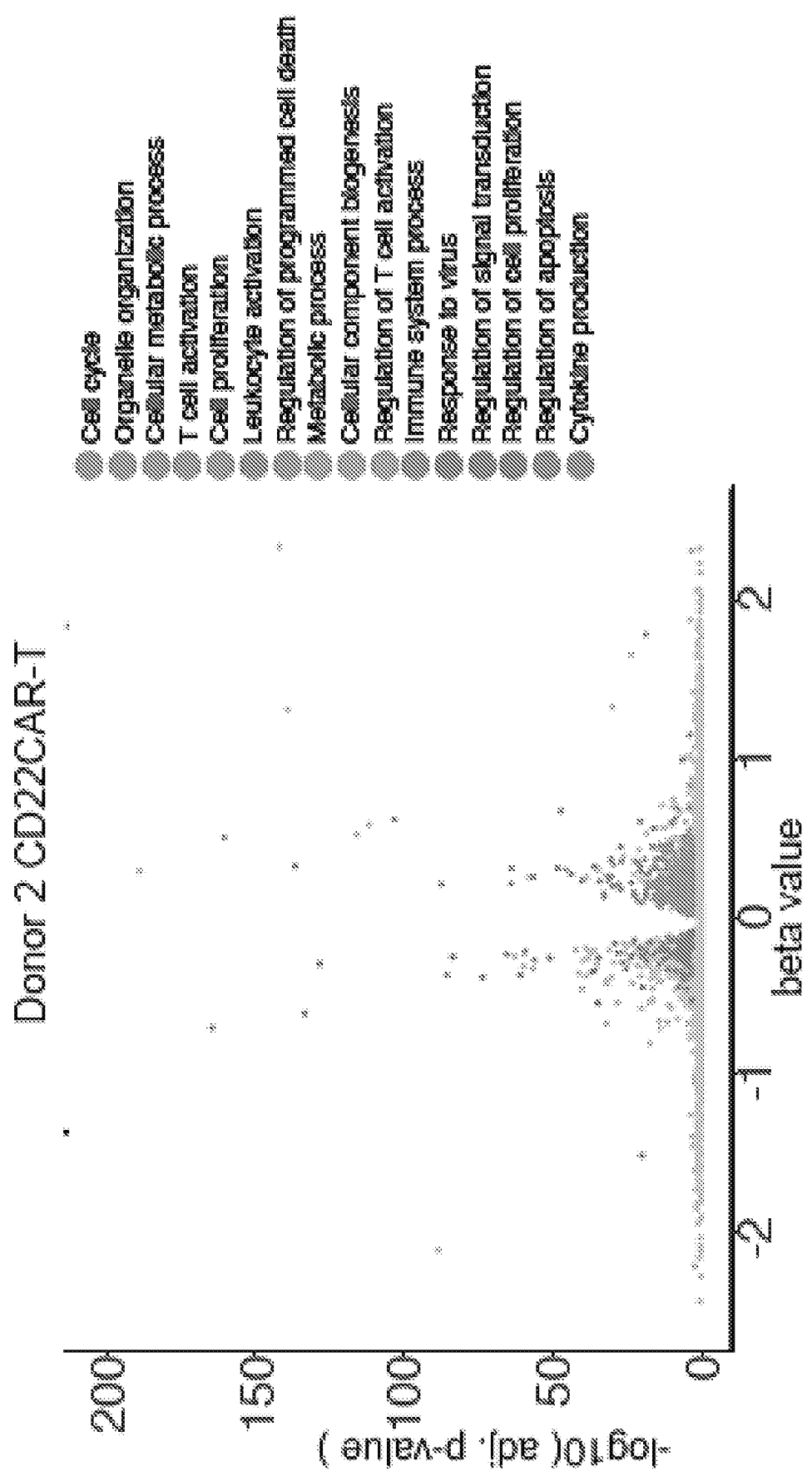
Figure 19:
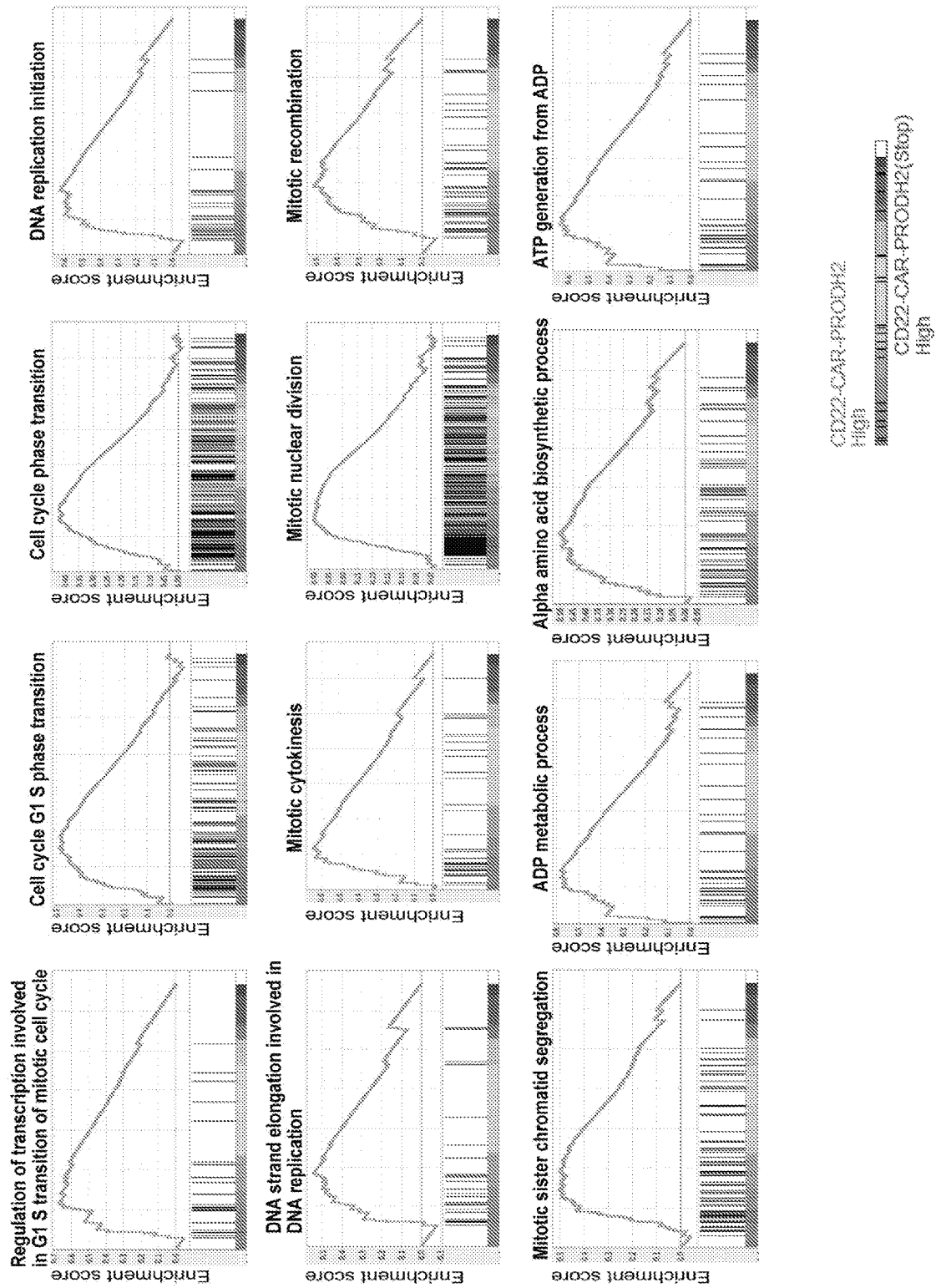
FIG. 19 illustrates GSEA individual pathways for mRNAseq of PRODH2 knockin CD22-CAR-T cells. The figure shows Gene Set Enrichment Analysis (GSEA) plots of individual pathways from the representative upregulated and downregulated gene sets between CD22-CAR-PRODH2 and CD22-CAR-PRODH2 (Stop) T cell groups.

Example 9: PRODH2 Knockin Restructured CAR-T Cell Gene Expression and Metabolic Programs To provide a molecular basis for how PRODH2 programs the engineered human CAR-T cell genetic circuits and metabolic states, multi-omics were performed by transcriptome profiling, untargeted metabolomics, targeted metabolomics and integrated analyses (Methods) (FIG. 10A). The mRNA-seq experiment profiled the transcriptomes of CD22-CAR;PRODH2 as well as CD22-CAR;PRODH2 (Stop) knockin CAR-T cells, both with source $CD8^+$ T cells from two human donors. DE analysis again uncovered broad transcriptomic changes as a result of PRODH2 knockin, with 4,420 upregulated and 2,454 downregulated genes in donor 1, and 1,627 upregulated and 1,348 downregulated genes in donor 2 (FDR adjusted p-value, q<0.05) (FIG. 10B). The DE genes in human CAR-T, both upregulated and downregulated, significantly overlap between donors and with those DE orthologs driven by lentiviral overexpression in mouse $CD8^+$ T cells (FIGS. 10C, 10E), suggesting a set of conserved function, regardless that these two technical systems do not have strict parity (human vs. mouse, AAV-knockin vs. lenti-overexpression, comparing to stop mutant vs. comparing to vector). Similar to the effect of Prodh2-OE in mouse $CD8^+$ T cells, knocking in PRODH2 co-cistronically with the CAR-T construct again showed strong changes in the transcriptomic programs of cell cycle, metabolism, apoptosis and immune response, in both donors (FIGS. 5D-5F, FIGS. 18A-18B). Representative significantly upregulated genes include CDCA7, CDCA3, CDCA2, CDC42BPA, KIFC1, ADCY3, E2F1, E2F8 (cell cycle); as well as CA9, CA4, ENO1, ATP 12A, ATP10D, PDE6G, LDHA (metabolism), with the note that cell cycle processes are often closely linked to metabolism especially those involved in biomacromolecule synthesis. In addition, PRODH2 knockin boosted a transcriptomic program of T cell activation, signal transduction and cytokine production, again in both donors (FIGS. 18A-18B). Representative significantly upregulated genes in these lines include those well-documented in T cell activation (e.g. CCR3, CCR5, CCR9, CXCR3, CXCR4, EOMES, ADA, SIRPG), T cell signaling (e.g. PLCG2, ZAP70, FYN, LCK, JAG2, PRKDC, PRKG2, PIK3CG, PIK3R6), and/or effector function (e.g. IFNG, TGFBR2, GZMB, GZMH, GZMK), while the terms are not mutually exclusive because these genes often play important roles in multiple T cell pathways. Breakdown of biological processes into more refined pathways revealed that the cell cycle signature is evident in multiple aspects of cell division, including M phase, mitosis, macromolecular complex assembly, biosynthetic process, organelle fission, and cell division (FIG. 10D). This is further corroborated by GSEA analysis, recapitulating a series of strong gene signatures in phase transition, G1/S transition, DNA replication, DNA strand elongation, mitotic cytokinesis, mitotic nuclear division, mitotic recombination and mitotic sister chromatid segregation (FIG. 19). The broad metabolic program also contains DE genes enriched in multiple metabolic pathways, including ATP/ADP metabolism, amino acid biosynthesis, protein metabolism, glucose metabolism, glutamine metabolism, glutathione metabolism, NADH metabolism, carbon metabolism, nucleotide metabolism, DNA/RNA metabolism and pyruvate metabolism (FIG. 10D, FIG. 19). These data suggest that PRODH2 knockin broadly and strongly altered the gene expression programs of CD22-CAR-T cells centered on cell cycle, T cell activation and metabolic processes.

Figure 11A:
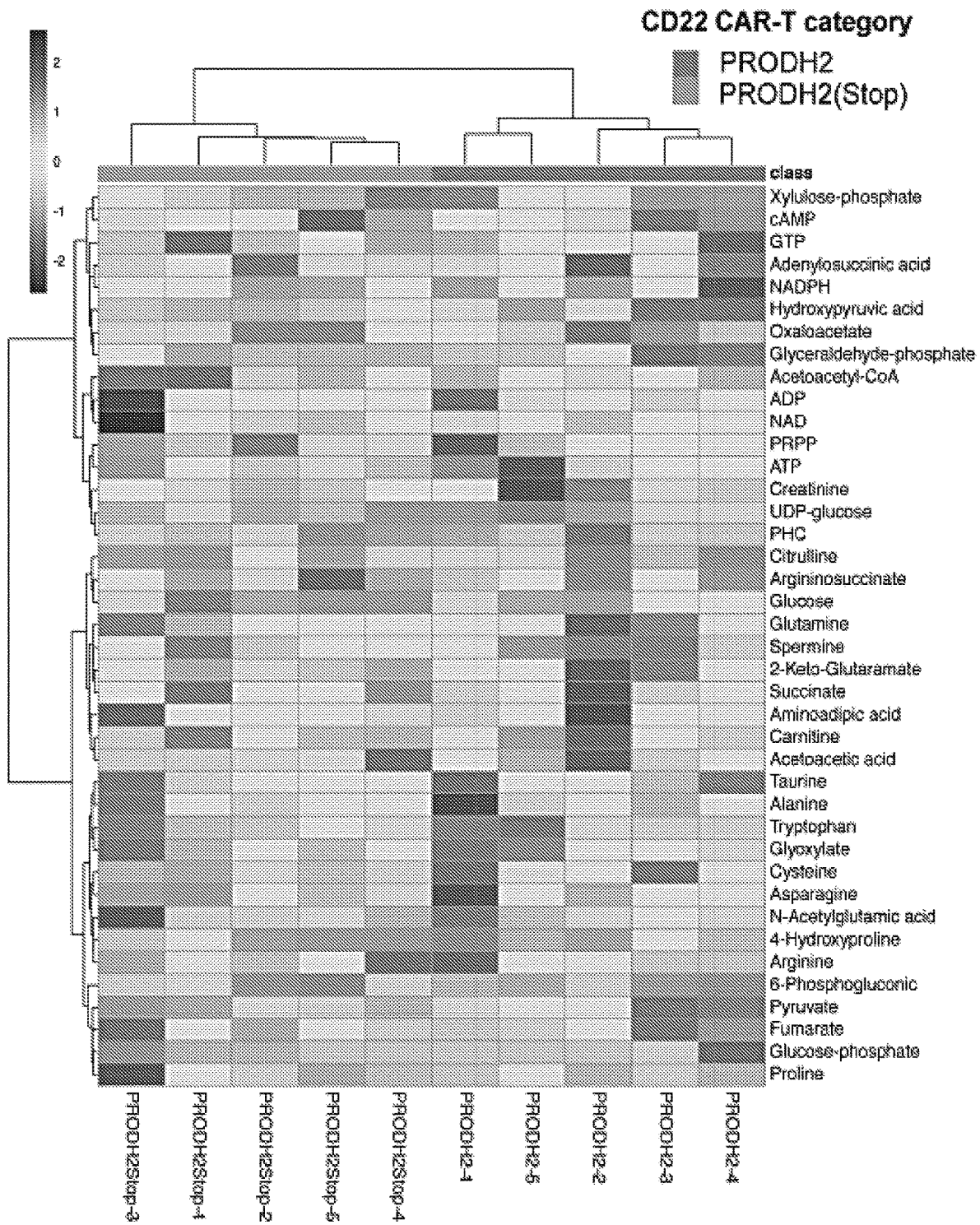
FIGS. 11A-11E illustrate Human CD22-CAR-PRODH2 CD8 T cell metabolomics and mRNA-seq analysis.
Figure 11B:
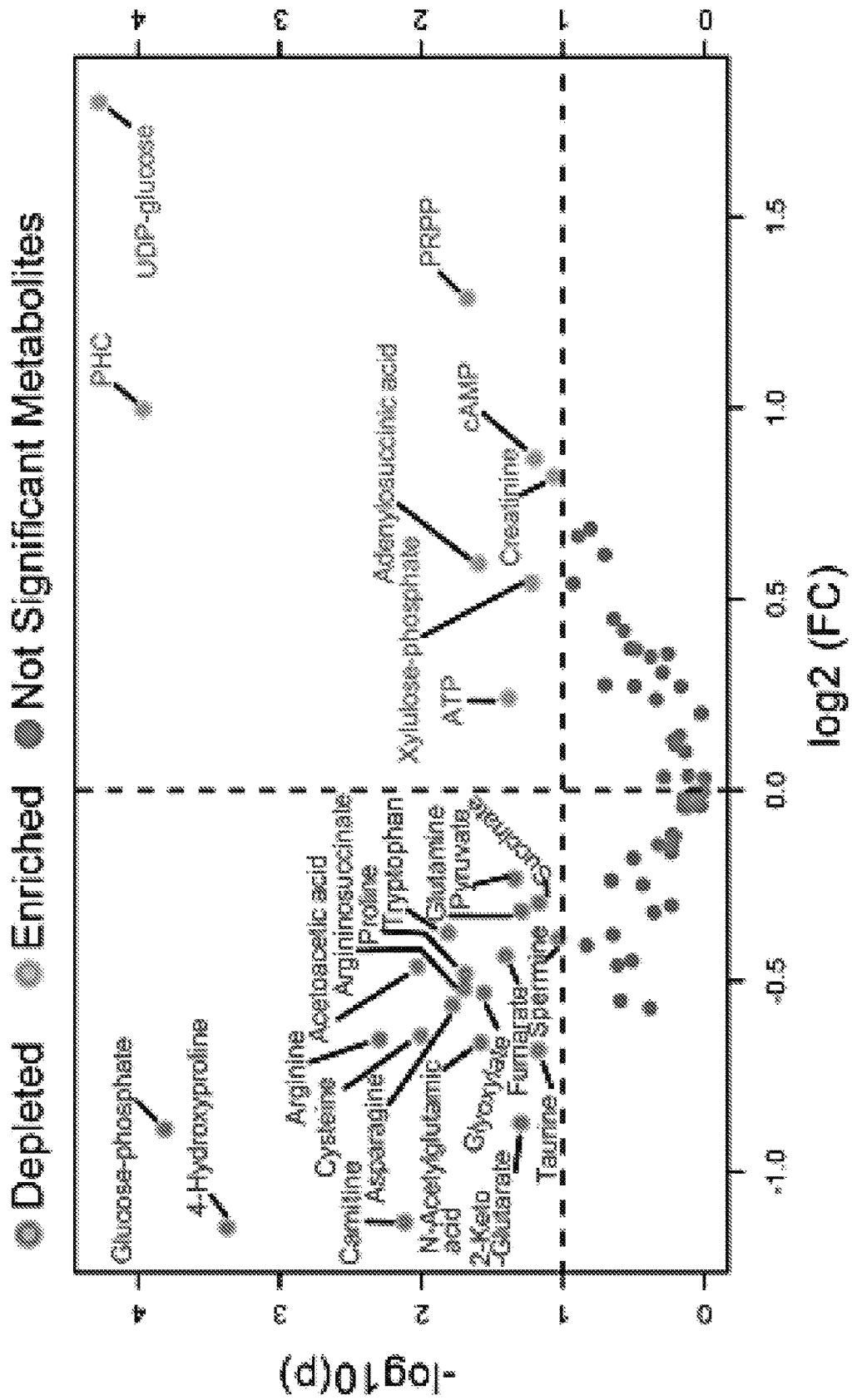
Figure 11C:
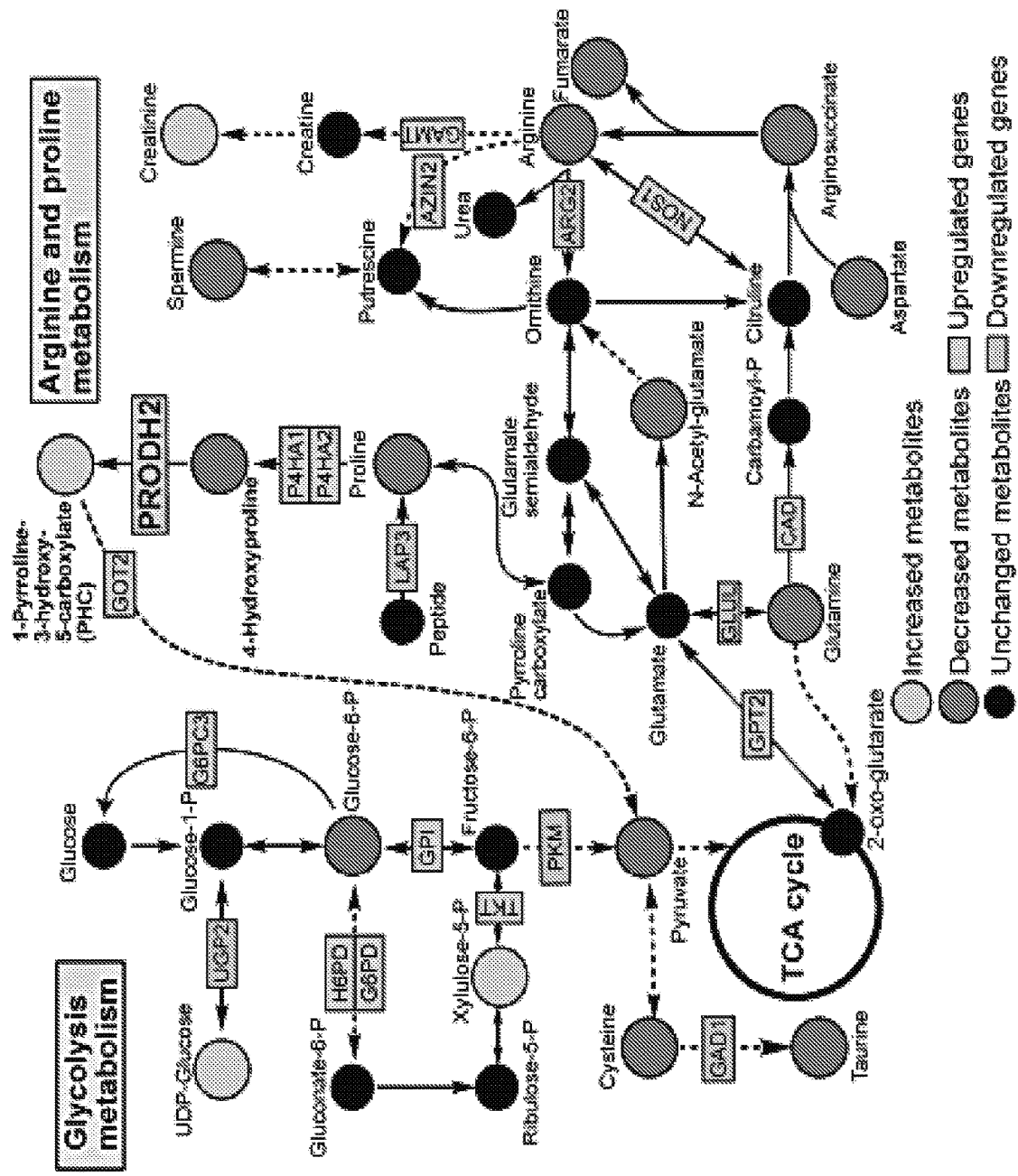
Figure 11D:
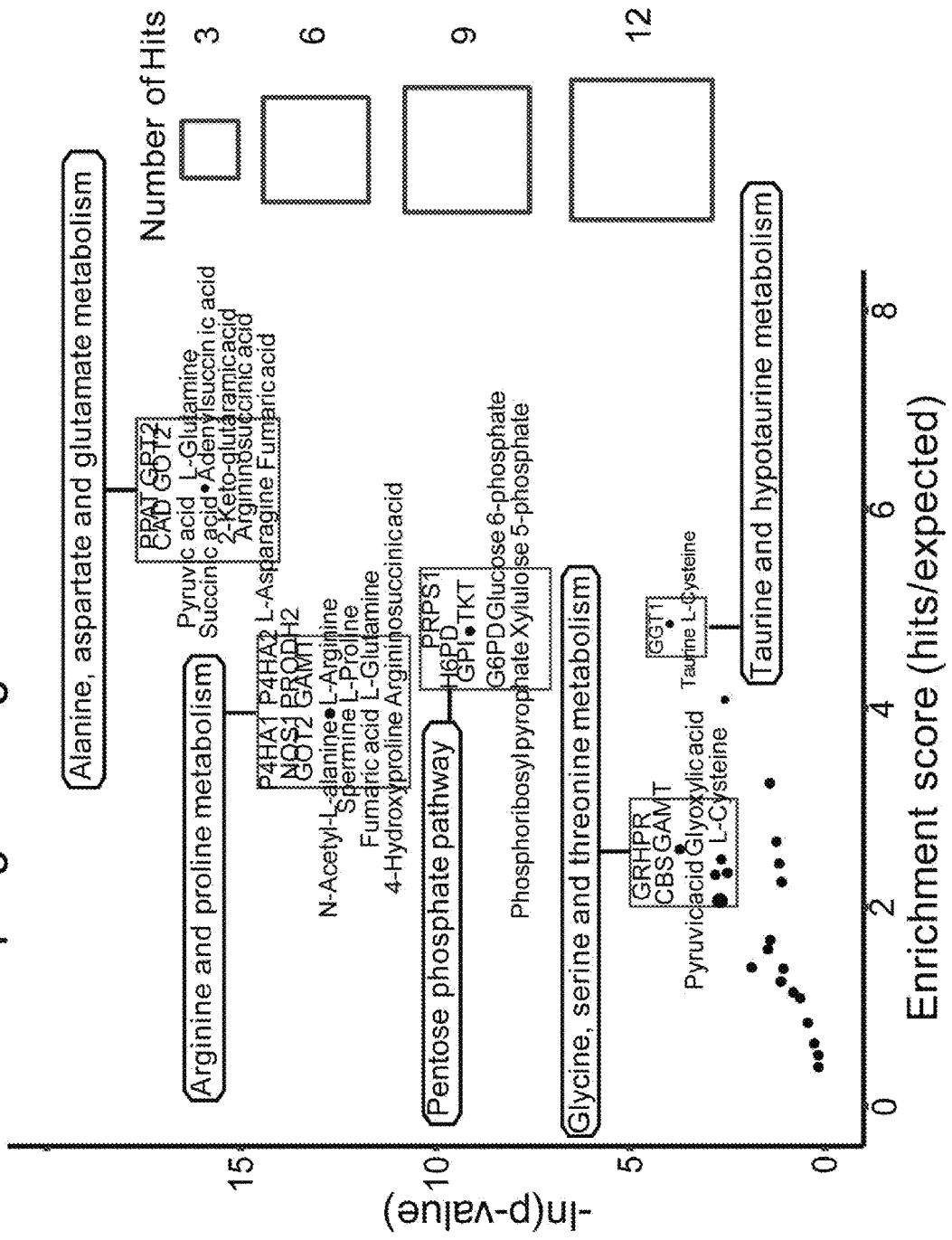
Figure 11E:
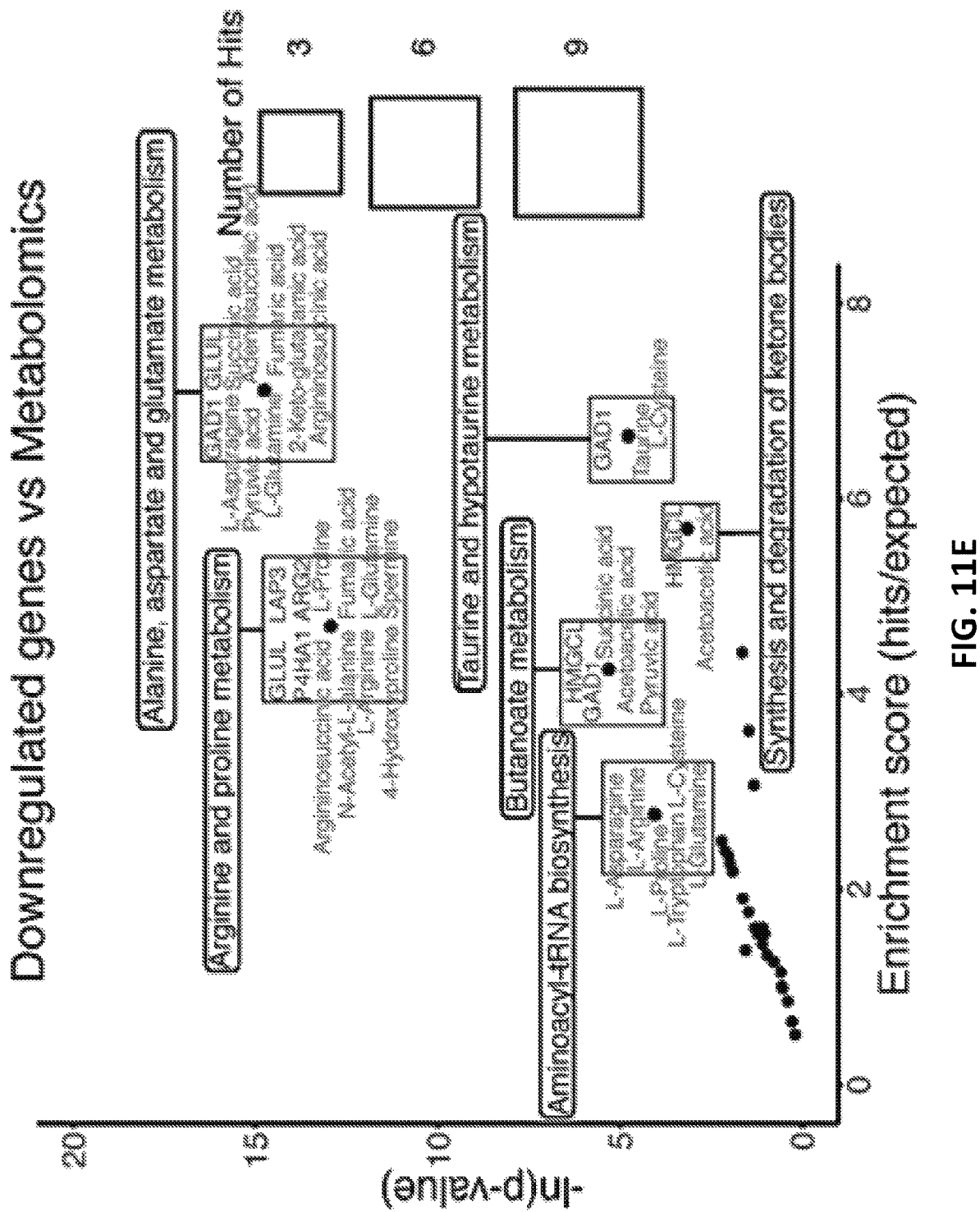
Figure 20:
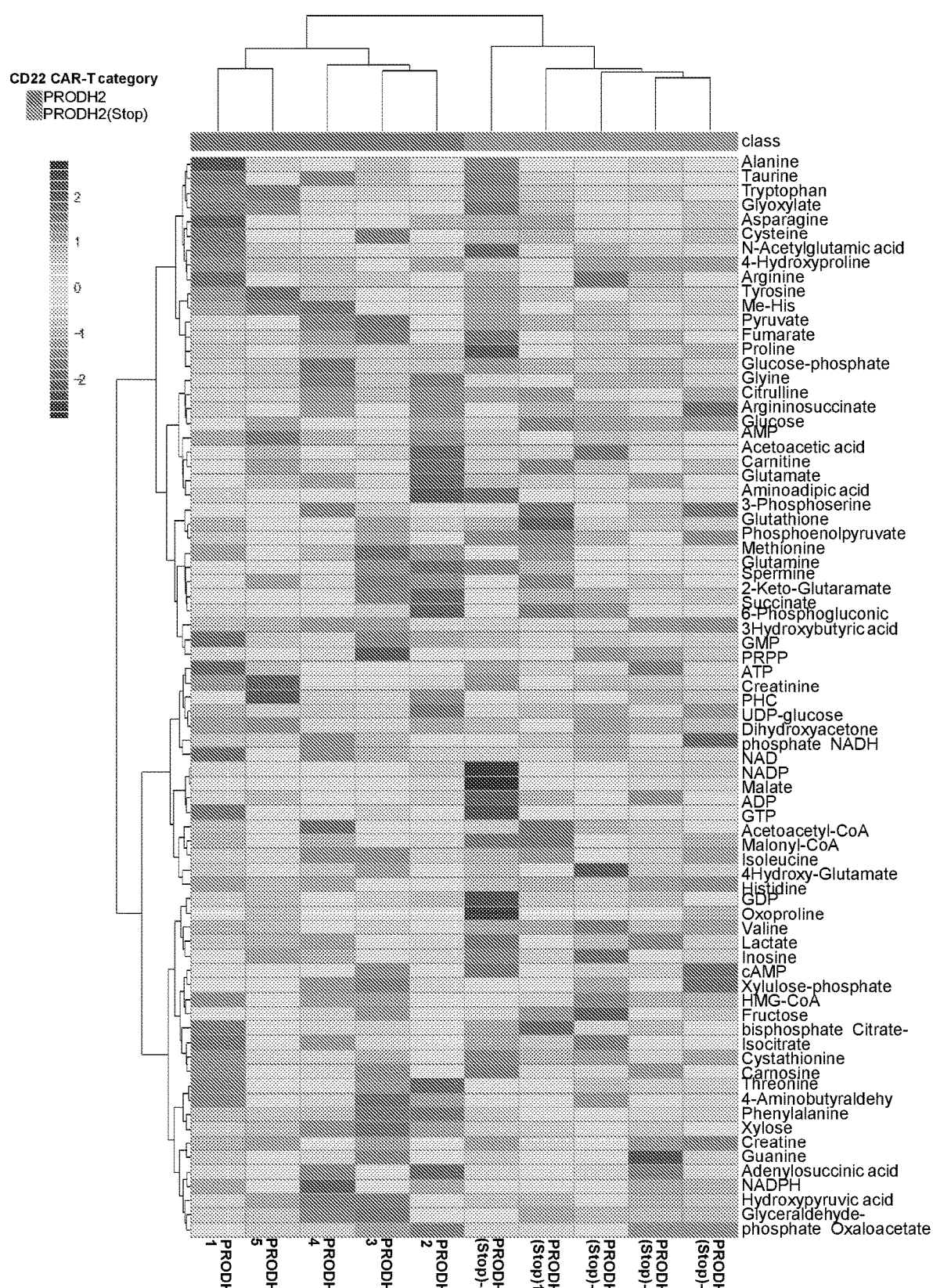
FIG. 20 illustrates a metabolomics analysis of human CD22-CAR-PRODH2 T cells. The figure shows a heatmap of the relative abundance of all QTOF/QQQ detected metabolites of PRODH2 vs. PRODH2 (Stop) CD22-CAR-T cells (n=5 biological replicates).
Figure 21:
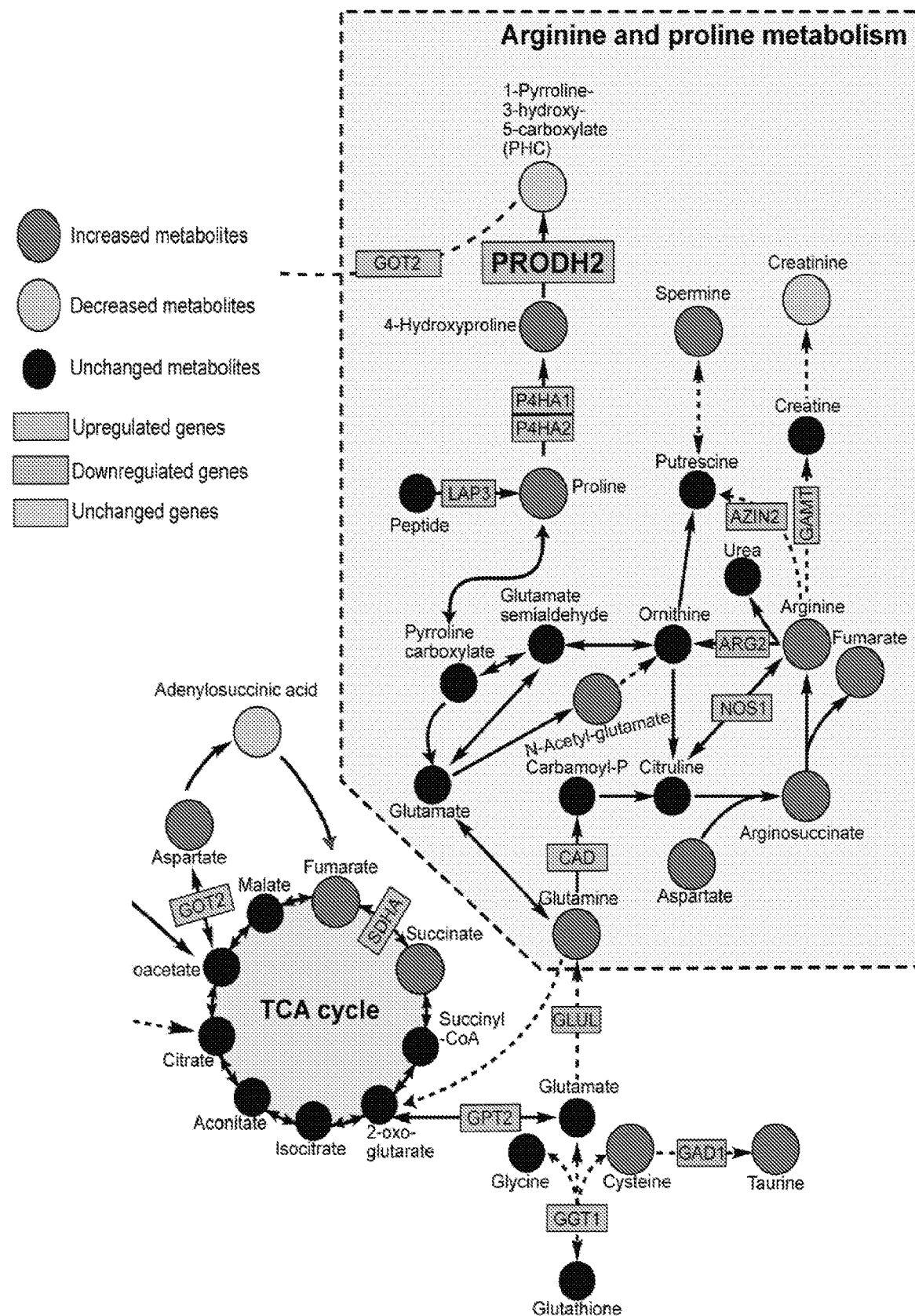
FIG. 21 illustrates KEGG-guided multi-omics analysis of human CD22-CAR-PRODH2 T cells. The figure shows a summary illustration highlighting representative enzymes encoded by DE genes, as well as DR metabolites on a metabolic map adapted from KEGG metabolic pathways. As in legend, blue circles indicate decreased metabolites; pink circles indicate increased metabolites; green squares indicate enzymes of downregulated genes; orange squares indicate enzymes of upregulated genes. Solid arrows indicate direct biochemical reactions; dashed arrows indicate indirect or multi-step biochemical reactions; bi-direction arrows indicate reversible reactions. All arrows were drawn according to the known reactions in KEGG. Only reactions related to DE genes or DR metabolites were shown. A simplified version is shown in a main figure panel.

Untargeted metabolomics jointly with targeted metabolomics identified a total of 75 metabolites in both CD22-CAR; PRODH2 and CD22-CAR;PRODH2(Stop) knockin CAR-T cells (FIG. 20). Among those, 8 metabolites are more abundant in CD22-CAR;PRODH2 knockin CAR-T cells, whereas 19 metabolites are less abundant (FIGS. 11A-11B). As established in the biochemical literature and KEGG database, these metabolites have clearly defined metabolic pathways with enzymes that catalyze their production and catabolismy intersecting the genes encoding those enzymes that produce or breakdown these metabolites, multiple DE genes whose upregulation or downregulation are consistent with the predicted metabolic activity, i.e. the directions of metabolite alterations were observed (FIG. 11C, FIG. 21). For example, besides the upregulation of PRODH2 that is consistent with decreased 4-Hydroxyproline and increased PHC levels, upregulation of GAMT that encodes a guanidinoacetate N-methyltransferase is consistent with the reduction of its substrate arginine and downstream product creatinine; upregulation of glucose-6-phosphatase 3 encoded by the G6PC3 gene is consistent with reduced glucose-6-phosphatase level; and reduced glutamine level is consistent with downregulation of GLUL that produces it from glutamate and upregulation of CAD that converts it into carbamoyl-phosphatase (FIG. 11C, FIG. 21). Furthermore, multi-omics analysis with MetaboAnalyst that integrates mRNA-seq DE analysis and metabolomics data identified enriched metabolic pathways in an unbiased manner, with the note that the significant changes of these metabolic pathways can be in both directions (for example, a pathway with both metabolites increased and decreased) (Methods). The second-most enriched metabolic pathway with the DE gene set in CD22-CAR;PRODH2 knockin CAR-T cells is arginine and proline metabolism, with significantly enriched intersecting DE genes involved in these pathways as well as differentially represented (DR) metabolites (FIG. 11D-11E), again highlighting the on-target activity of augmenting PRODH2. The most significantly enriched metabolic pathway is alanine, aspartate and glutamate metabolism, where the enzyme-encoding genes PPAT, GPT2, CAD, GOT2 are upregulated and GAD1, GLUL are downregulated, 8 relevant metabolites increased abundance, and 8 metabolites decreased abundance (FIGS. 11D-11E). In addition, other significantly altered metabolic pathways, potentially indirectly related to PRODH2's biochemical function, include pentose phosphate pathway, glycine, serine and threonine metabolism and taurine and hypotaurine metabolism in the upregulated gene vs. DR metabolite intersection; as well as butanoate metabolism, aminoacyl-tRNA biosynthesis, synthesis and degradation of ketone bodies and again taurine and hypotaurine metabolism in the downregulated gene vs. DR metabolite intersection (FIGS. 11D-11E). These data together showed that PRODH2 knockin broadly reprograms T cell's genetic circuit and metabolic states, further confirming it as a valid target for T cell engineering.

Example 10: Discussion

Activation screen in primary T cell. Catalytically dead guide RNAs (dgRNAs), which are 14-nt or 15-nt in length, can be utilized to modulate gene expression without introducing DSBs with catalytically active Cas9 at the target site. These innovations have expanded the potential applications of CRISPR technologies for genetic perturbations at the level of gene expression. High-throughput adaptations of these technologies can facilitate systematic interrogation of large numbers of genes or non-coding genetic elements for loss-of-function (LOF) and gain-of-function (GOF) screens. Recently, human $CD8^+$ T cell and mouse T helper cell LOF screens were performed to identify regulators which can boost T cell function and affect T helper cell activation and differentiation. While several studies demonstrated genome-scale GOF screen systems for protein-coding genes and long noncoding RNAs (lncRNAs) that confer resistance to the BRAF inhibitors in human melanoma cells, it is still challenging to introduce both dCas9-activator and a large-scale guide RNA library simultaneously into primary murine $CD8^+$ T cells, given their intrinsic resistance to various forms of genetic manipulation. The present study developed an orthogonal system for $CD8^+$ T cell GOF screen and identified endogenous factors for boosting T cell function. By designing a catalytically dead guide RNA library, we enabled high-throughput GOF screening using catalytically active Cas9. This allows leveraging Cas9 transgenic mice where $Cas9^+$ immune cells are readily available to be isolated and cultured in large scale. With the development of orthogonal screening technologies, the dgRNA library system may be used in conjunction with knockout systems to perform complex intersectional screens in individual $Cas9''$ cells. GOF identification of T cell functional boosters. Overexpression of STAT5 can improve anti-tumor effects by enhancing the cytotoxic ability of T cells against tumors and granting resistance to TGFβ and IL-6 signaling. Using a systems approach, a large number of ranked GOF candidates enriched in T cells with superior effector function was unveiled herein. Four genes, Prodh2, Ccnblip1, Sreklip1, and Wdr37 were validated, where augmenting their expression consistently enhanced $CD8^+$ T cell degranulation. Prodh2 encodes an enzyme in proline metabolism by catalyzing the first step in the catabolism of trans-4-hydroxy-L-proline. L-arginine metabolism in T cells enhances anti-tumor activity and is linked to proline metabolism, although the latter is less well-characterized. Wdr37 encodes a member of the WD repeat proteins that are involved in a diverse set of cellular processes. Ccnblip1 encodes an E3 ubiquitin ligase that regulates the progression of the cell cycle. Sreklip1 encodes a protein that interacts with Srek1, a serine/arginine-rich (SR) splicing protein that interacts with other SR proteins to modulate splice site selection. These previously undocumented genes highlight the ability of the dgTKS system for discovery of new GOF targets in primary T cells with relevance for cancer immunology.

T cell metabolism, activation and proliferation. T cell survival, activation, development, proliferation, differentiation and anti-tumor effector function are virtually all driven by metabolism. Naïve T cells are supported by ATP which are predominantly generated from oxidative phosphorylation before activation. The naïve T cell metabolic state will be rapidly changed after a sufficiently strong TCR signal is provided. A recent study established landscapes of T cell proteome and phosphoproteome and dynamic T cell activation signaling networks during T cell activation, which revealed various metabolic pathway changes during the T cell activation process. Activated T cells shifted metabolic state from oxidative metabolism to glycolysis for cell proliferation and effector functions, such as secretion of cytokines and cytolytic molecules important for tumor and pathogen clearance. Glycolysis is a relatively inefficiency pathway for generation ATP with only two ATPs per unit of glucose, however, this pathway can provide abundant biosynthetic intermediates for synthesis of nucleotides, amino acids, and fatty acids, which is important to support rapid T cell growth and proliferation. The total biomass is dramatically increased after T cell activation for proliferation, which requires substantial nucleotide, lipid, and amino acid synthesis. Program T cell metabolism using bioengineering approaches therefore may provide effective strategies for enhancement of T cell function relevant to the treatment of cancer, infection or immunological diseases. PRODH2 function in T cell. The dgTKS system and genome-scale GOF screen described herein identified Prodh2 as a top hit in cancer cell killing ability. Mouse whole transcriptome analysis, in vivo mouse models, human CAR T cell kill assays, and CAR-T cell multi-omics integrated analyses confirmed that engineered PRODH2/Prodh2 can reprogram T cell metabolism, promoted cell proliferation, activation, and enhanced anti-tumor effect. PRODH2/Prodh2 is a 4-Hydroxyproline dehydrogenase, which is a highly tissue-specific enzyme mainly expressed in livers and kidneys and only lowly expressed in most other cell types. In the present study, PRODH2/Prodh2 overexpression or genomic knockin was found to reprogram the T cell metabolic state, including distinct genetic and metabolic signatures, which demonstrated that hyperactivation of PRODH2 can boost T cell metabolism and immune function. The strong phenotypic strength and molecular effects of PRODH2 makes it an attractive target for T cell metabolic programming.

Engineering PRODH2 as a future approach for T cell programming in cell therapy. Cell therapies with engineered T cells including TCR-modified T cells and CAR-T cells have been proven as powerful cancer therapeutics. Successful clinical trials of anti-CD19 CAR for the CD19+ B lymphocyte molecule have recently been approved by the U.S. Food and Drug Administration (FDA) for treatment of refractory pre-B cell acute lymphoblastic leukemia and diffuse large B cell lymphoma. There remain many hurdles for CAR-T therapy because the adverse tumor microenvironment especially for solid tumors, such as T cell trafficking, tumor recognition and killing, and T cell proliferation and persistence. In the tumor microenvironment, tumors can metabolically restrict T cell anti-tumor functions by nutrient depletion. Thus, approaches to enhance T cell metabolic circuit in order to boost or at least maintain T cell anti-tumor immunity by reprogramming T cell metabolism is an emerged key goal for future immunotherapies. The second and third generation CARs designed with extra co-stimulatory domains (CD28 and/or 4-1BB) in addition to CD3ζ (CD3 zeta), exhibited better anti-tumor efficacy compared with first generation CARs. Interestingly, CD28 signaling domain has been proven with an extra function of enhancing aerobic glycolysis, and 4-1BB enhanced mitochondria biogenesis and fatty acid oxidation in the CAR-T cells. Recently, intracellular L-arginine (involved in arginine and proline metabolism) concentration impacted the metabolic fitness and survival capacity of T cells, and increased L-arginine level enhanced T cell survival and anti-tumor activity. Programming T cell metabolism is an emerging approach for immunotherapy. The present data showed that CD22-CAR;PRODH2 CAR-T cells are more robust than CD22-CAR;PRODH2 (Stop) cells in NALM-6 cancer cell killing, while the engineering and testing of PRODH2 in solid tumor CARs can be done in future studies. Integrated RNA-seq and metabolomics analyses demonstrated CAR-T cell's whole transcriptome and metabolic pathways were remodeled with PRODH2 knockin. Therefore, engineered PRODH2 mediates metabolism reprogramming, promotes nucleotide metabolism, amino acid biosynthesis, glucose metabolism, and ATP/ADP metabolism among the broad spectra of reshaped pathways, ultimately promoting T cell proliferation and boosting effector functions. Thus, PRODH2 is a promising T cell booster, which via engineering approaches can be applied for various T cell-mediated immunotherapies in the future, including modification of isolated tumor-infiltrating lymphocytes (TILs), autologous T cells, TCR-T cells, CAR-T cells and potentially other forms of T cells.

TABLE 1

Primer Sequences

| SEQ ID NO: | Primer/ Barcode Name | seq (5>3) |
|---|---|---|
| 84,615 | SAM_BC_F01 | AATGATACGGCGACCACCGAGATCTACACTCTTTCCCTACACGACGCTCT TCCGATCTaAACCGGTTGCTTTATATATCTTGTGGAAAGGACGAAACACC |
|  | Barcode | AACCGGTT |
| 84,616 | SAM_BC_F02 | AATGATACGGCGACCACCGAGATCTACACTCTTTCCCTACACGACGCTCT TCCGATCTcaGGCCAATTGCTTTATATATCTTGTGGAAAGGACGAAACAC C |
|  | Barcode | GGCCAATT |
| 84,617 | SAM_BC_F03 | AATGATACGGCGACCACCGAGATCTACACTCTTTCCCTACACGACGCTCT TCCGATCTgcaTTGGAACCGCTTTATATATCTTGTGGAAAGGACGAAACAC C |
|  | Barcode | TTGGAACC |
| 84,618 | SAM_BC_F04 | AATGATACGGCGACCACCGAGATCTACACTCTTTCCCTACACGACGCTCT TCCGATCTtgcaCCTTGGAAGCTTTATATATCTTGTGGAAAGGACGAAACA CC |
|  | Barcode | CCTTGGAA |
| 84,619 | SAM_BC_F05 | AATGATACGGCGACCACCGAGATCTACACTCTTTCCCTACACGACGCTCT TCCGATCTatgcaACACGTGTGCTTTATATATCTTGTG-GAAAGGACGAAACA CC |
|  | Barcode | ACACGTGT |
| 84,620 | SAM_BC_F06 | AATGATACGGCGACCACCGAGATCTACACTCTTTCCCTACACGACGCTCT TCCGATCTcatgcaGCGCATATGCTTTATATATCTTGTG-GAAAGGACGAAAC ACC |
|  | Barcode | GCGCATAT |

TABLE 1-continued

Primer Sequences

| SEQ ID NO: | Primer/ Barcode Name | seq (5>3) |
|---|---|---|
| 84,621 | SAM_BC_F07 | AATGATACGGCGACCACCGAGATCTACACTCTTTCCCTACACGACGCTCTTCCGATCTgcatgcaTGTGACACGCTTTATATATCTTGTGGAAAGGACGAAACACC |
|  | Barcode | TGTGACAC |
| 84,622 | SAM_BC_F08 | AATGATACGGCGACCACCGAGATCTACACTCTTTCCCTACACGACGCTCTTCCGATCTagctgcaCTCTGAGAGCTTTATATATCTTGTGGAAAGGACGAAACACC |
|  | Barcode | CTCTGAGA |
| 84,623 | SAM_BC_F09 | AATGATACGGCGACCACCGAGATCTACACTCTTTCCCTACACGACGCTCTTCCGATCTaAGGTTCCAGCTTTATATATCTTGTGGAAAGGACGAAACACC |
|  | Barcode | AGGTTCCA |
| 84,624 | SAM_BC_F10 | AATGATACGGCGACCACCGAGATCTACACTCTTTCCCTACACGACGCTCTTCCGATCTcaGAATTCCGGCTTTATATATCTTGTGGAAAGGACGAAACACC |
|  | Barcode | GAATTCCG |
| 84,625 | SAM_BC_F11 | AATGATACGGCGACCACCGAGATCTACACTCTTTCCCTACACGACGCTCTTCCGATCTgcaTAACCGGTGCTTTATATATCTTGTGGAAAGGACGAAACACC |
|  | Barcode | TAACCGGT |
| 84,626 | SAM_BC_F12 | AATGATACGGCGACCACCGAGATCTACACTCTTTCCCTACACGACGCTCTTCCGATCTtgcaCGGAATTCGCTTTATATATCTTGTGGAAAGGACGAAACACC |
|  | Barcode | CGGAATTC |
| 84,627 | SAM_BC_NR01 | CAAGCAGAAGACGGCATACGAGATATATCGCGGTGACTGGAGTTCAGACGTGTGCTCTTCCGATCTctcggtgccacttggccCTG |
|  | Barcode | ATATCGCG |
| 84,628 | SAM_BC_NR02 | CAAGCAGAAGACGGCATACGAGATGAGATCTCGTGACTGGAGTTCAGACGTGTGCTCTTCCGATCTctcggtgccacttggccCTG |
|  | Barcode | GAGATCTC |
| 84,629 | SAM_BC_NR03 | CAAGCAGAAGACGGCATACGAGATTGTGACACGTGACTGGAGTTCAGACGTGTGCTCTTCCGATCTctcggtgccacttggccCTG |
|  | Barcode | TGTGACAC |
| 84,630 | SAM_BC_NR04 | CAAGCAGAAGACGGCATACGAGATCTCTAGAGGTGACTGGAGTTCAGACGTGTGCTCTTCCGATCTctcggtgccacttggccCTG |
|  | Barcode | CTCTAGAG |

Other Embodiments

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

The disclosures of each and every patent, patent application, and publication cited herein are hereby incorporated herein by reference in their entirety. While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

SEQUENCE LISTING (84632 sequences)

SEQ ID NO: 1 - DNA, 15 bp, Artificial Sequence
  dgRNA
  Dysf
tcccggagagagatc

SEQ ID NO: 2 - DNA, 15 bp, Artificial Sequence
  dgRNA
  Dysf
ccagcccgcagcttc

SEQ ID NO: 3 - DNA, 15 bp, Artificial Sequence
  dgRNA
  Dysf
cagcccgcagcttca

SEQ ID NO: 4 - DNA, 15 bp, Artificial Sequence
  dgRNA
  Dysf
aaagtgccgtgtcat

SEQ ID NO: 5 - DNA, 15 bp, Artificial Sequence
  dgRNA
  Astn2
tggaggagacgcaag

SEQ ID NO: 6 - DNA, 15 bp, Artificial Sequence
  dgRNA
  Astn2
ggacctgtacgaagc

SEQ ID NO: 7 - DNA, 15 bp, Artificial Sequence
  dgRNA
  Astn2
gacctgtacgaagcc

SEQ ID NO: 8 - DNA, 15 bp, Artificial Sequence
  dgRNA
  Astn2
ctgtacgaagccggg

SEQ ID NO: 9 - DNA, 15 bp, Artificial Sequence
  dgRNA
  Pemt
agagggccactgtat

SEQ ID NO: 10 - DNA, 15 bp, Artificial Sequence
  dgRNA
  Pemt
tgcagcttgcaccct

SEQ ID NO: 11 - DNA, 15 bp, Artificial Sequence
  dgRNA
  Pemt
cttcatcccatacag

SEQ ID NO: 12 - DNA, 15 bp, Artificial Sequence
  dgRNA
  Pemt
tctcagaccggggac

SEQ ID NO: 13 - DNA, 15 bp, Artificial Sequence
  dgRNA
  Kif1a
gtgcgacaaaccagc

SEQ ID NO: 14 - DNA, 15 bp, Artificial Sequence
  dgRNA
  Kif1a
cgacaaaccagctgg

SEQ ID NO: 15 - DNA, 15 bp, Artificial Sequence
  dgRNA
  Kif1a
agccaaccagcgcat

SEQ ID NO: 16 - DNA, 15 bp, Artificial Sequence
  dgRNA
  Kif1a
gccaaccagcgcatc

SEQ ID NO: 17 - DNA, 15 bp, Artificial Sequence
  dgRNA
  Bcl2l10
gcaatcgctaccagc

SEQ ID NO: 18 - DNA, 15 bp, Artificial Sequence
  dgRNA
  Bcl2l10
caatcgctaccagct

SEQ ID NO: 19 - DNA, 15 bp, Artificial Sequence
  dgRNA
  Bcl2l10
ctcaacaataatccg

SEQ ID NO: 20 - DNA, 15 bp, Artificial Sequence
  dgRNA
  Bcl2l10
tcaacaataatccga

SEQ ID NO: 21 - DNA, 15 bp, Artificial Sequence
  dgRNA
  Rasgrp2
gaggggcggcagaat

SEQ ID NO: 22 - DNA, 15 bp, Artificial Sequence
  dgRNA
  Rasgrp2
ggtgtgtgcgcaacc

SEQ ID NO: 23 - DNA, 15 bp, Artificial Sequence
  dgRNA
  Rasgrp2
gtgtgtgcgcaacca

SEQ ID NO: 24 - DNA, 15 bp, Artificial Sequence
  dgRNA
  Rasgrp2
tgtgtgcgcaaccag

SEQ ID NO: 25 - DNA, 15 bp, Artificial Sequence
  dgRNA
  Armc8
agccggggtccggcg

SEQ ID NO: 26 - DNA, 15 bp, Artificial Sequence
  dgRNA
  Armc8
tgctcgagcgacgcc

SEQ ID NO: 27 - DNA, 15 bp, Artificial Sequence
  dgRNA
  Armc8
gctcgagcgacgcct

SEQ ID NO: 28 - DNA, 15 bp, Artificial Sequence
  dgRNA
  Armc8
ctcgagcgacgcctg

SEQ ID NO: 29 - DNA, 15 bp, Artificial Sequence
  dgRNA
  Kcnq5
ggcgcggcatagcag

SEQ ID NO: 30 - DNA, 15 bp, Artificial Sequence
  dgRNA
  Kcnq5
gcgcggcatagcagc

SEQ ID NO: 31 - DNA, 15 bp, Artificial Sequence
  dgRNA
  Kcnq5
tccagtttattcaag

SEQ ID NO: 32 - DNA, 15 bp, Artificial Sequence
  dgRNA
  Kcnq5
gcagacttcgccctc

SEQ ID NO: 33 - DNA, 15 bp, Artificial Sequence
  dgRNA
  Camk2d
ccgcgcatctccctt

SEQ ID NO: 34 - DNA, 15 bp, Artificial Sequence
  dgRNA
  Camk2d
ttcggtctccctaga

SEQ ID NO: 35 - DNA, 15 bp, Artificial Sequence
  dgRNA
  Camk2d
ctccctagacggctg

SEQ ID NO: 36 - DNA, 15 bp, Artificial Sequence
  dgRNA
  Camk2d
tccctagacggctgc

SEQ ID NO: 37 - DNA, 15 bp, Artificial Sequence
  dgRNA
  Ank1
caccctagacaagcc

SEQ ID NO: 38 - DNA, 15 bp, Artificial Sequence
  dgRNA
  Ank1
aaggctgacgtcctc

SEQ ID NO: 39 - DNA, 15 bp, Artificial Sequence
  dgRNA
  Ank1
aggctgacgtcctct

SEQ ID NO: 40 - DNA, 15 bp, Artificial Sequence
  dgRNA
  Ank1
ggctgacgtcctctg

SEQ ID NO: 41 - DNA, 15 bp, Artificial Sequence
  dgRNA
  Scamp1
attatcagtaacttg

SEQ ID NO: 42 - DNA, 15 bp, Artificial Sequence
  dgRNA
  Scamp1
cccattatttatgag

SEQ ID NO: 43 - DNA, 15 bp, Artificial Sequence
  dgRNA
  Scamp1
ccattatttatgagt

SEQ ID NO: 44 - DNA, 15 bp, Artificial Sequence
  dgRNA
  Scamp1
ttcttggagcaactc

SEQ ID NO: 45 - DNA, 15 bp, Artificial Sequence
  dgRNA
  Ly6g6f
caagtggttcagccc

SEQ ID NO: 46 - DNA, 15 bp, Artificial Sequence
  dgRNA
  Ly6g6f
gtcaggtcccagcgc

SEQ ID NO: 47 - DNA, 15 bp, Artificial Sequence
  dgRNA
  Ly6g6f
ttgcatgtcatctgg

SEQ ID NO: 48 - DNA, 15 bp, Artificial Sequence
  dgRNA
  Ly6g6f
cagttgcatgtcatc

SEQ ID NO: 49 - DNA, 15 bp, Artificial Sequence
  dgRNA
  Tcf4
ggccggccagggaac

SEQ ID NO: 50 - DNA, 15 bp, Artificial Sequence
  dgRNA
  Tcf4
gccggccagggaacg

SEQ ID NO: 51 - DNA, 15 bp, Artificial Sequence
  dgRNA
  Tcf4
gtgagtcccacccgc

SEQ ID NO: 52 - DNA, 15 bp, Artificial Sequence
  dgRNA
  Tcf4
agtcccacccgccgg

SEQ ID NO: 53 - DNA, 15 bp, Artificial Sequence
  dgRNA
  Foxb2
gtctagtcatccaag

SEQ ID NO: 54 - DNA, 15 bp, Artificial Sequence
  dgRNA
  Foxb2
gctggcgagtctctc

SEQ ID NO: 55 - DNA, 15 bp, Artificial Sequence
  dgRNA
  Foxb2
gccataaaactgtat

SEQ ID NO: 56 - DNA, 15 bp, Artificial Sequence
  dgRNA
  Foxb2
cctttatcggtacaa

SEQ ID NO: 57 - DNA, 15 bp, Artificial Sequence
  dgRNA
  Agr2
aacaggattagtggg

SEQ ID NO: 58 - DNA, 15 bp, Artificial Sequence
  dgRNA
  Agr2
tctgcccataaatac

SEQ ID NO: 59 - DNA, 15 bp, Artificial Sequence
  dgRNA
  Agr2
aagcagtcgttgaaa

SEQ ID NO: 60 - DNA, 15 bp, Artificial Sequence
  dgRNA
  Vrtn
aagcgctgagatagc

SEQ ID NO: 61 - DNA, 15 bp, Artificial Sequence
  dgRNA
  Vrtn
tcggcgagcgttttg

SEQ ID NO: 62 - DNA, 15 bp, Artificial Sequence
  dgRNA
  Vrtn
gcgagcgttttgagg

SEQ ID NO: 63 - DNA, 15 bp, Artificial Sequence
  dgRNA
  Vrtn
gagttggatgtgact

SEQ ID NO: 64 - DNA, 15 bp, Artificial Sequence
  dgRNA
  Midn
gtgctgcgaagccct

SEQ ID NO: 65 - DNA, 15 bp, Artificial Sequence
  dgRNA
  Midn
tgctgcgaagcccta

SEQ ID NO: 66 - DNA, 15 bp, Artificial Sequence
  dgRNA
  Midn
gcgaagccctagggc

SEQ ID NO: 67 - DNA, 15 bp, Artificial Sequence
  dgRNA
  Midn
aggcggcgcggataa

SEQ ID NO: 68 - DNA, 15 bp, Artificial Sequence
  dgRNA
  Myc
ggcttcgccgacgct

SEQ ID NO: 69 - DNA, 15 bp, Artificial Sequence
  dgRNA
  Myc
ttcgccgacgcttgg

SEQ ID NO: 70 - DNA, 15 bp, Artificial Sequence
  dgRNA
  Myc
tcgccgacgcttggc

SEQ ID NO: 71 - DNA, 15 bp, Artificial Sequence
  dgRNA
  Myc
ttggcgggaaaaaga

SEQ ID NO: 72 - DNA, 15 bp, Artificial Sequence
  dgRNA
  Inpp5j
tgaagtgttcctagc

SEQ ID NO: 73 - DNA, 15 bp, Artificial Sequence
  dgRNA
  Inpp5j
ttgccaccttcaata

SEQ ID NO: 74 - DNA, 15 bp, Artificial Sequence
  dgRNA
  Inpp5j
tgccaccttcaatat

SEQ ID NO: 75 - DNA, 15 bp, Artificial Sequence
  dgRNA
  Inpp5j
aagcacccatcagct

SEQ ID NO: 76 - DNA, 15 bp, Artificial Sequence
  dgRNA
  Fgf4
gcggagccaagagta

SEQ ID NO: 77 - DNA, 15 bp, Artificial Sequence
  dgRNA
  Fgf4
cggagccaagagtaa

SEQ ID NO: 78 - DNA, 15 bp, Artificial Sequence
  dgRNA
  Fgf4
acagtagccaccgcc

SEQ ID NO: 79 - DNA, 15 bp, Artificial Sequence
  dgRNA
  Fgf4
tcccccggcggtgat

SEQ ID NO: 80 - DNA, 15 bp, Artificial Sequence
  dgRNA
  Trabd2b
gcgctctcagaattc

SEQ ID NO: 81 - DNA, 15 bp, Artificial Sequence
  dgRNA
  Trabd2b
cgctctcagaattcc

SEQ ID NO: 82 - DNA, 15 bp, Artificial Sequence
  dgRNA
  Trabd2b
cagaattccggggct

SEQ ID NO: 83 - DNA, 15 bp, Artificial Sequence
  dgRNA
  Trabd2b
ggggctcggccaacc

SEQ ID NO: 84 - DNA, 15 bp, Artificial Sequence
  dgRNA
  Recql
ctcggcgacgccgcc

SEQ ID NO: 85 - DNA, 15 bp, Artificial Sequence
  dgRNA
  Recql
tcggcgacgccgccc

SEQ ID NO: 86 - DNA, 15 bp, Artificial Sequence
  dgRNA
  Recql
agccgccacgtcttc

SEQ ID NO: 87 - DNA, 15 bp, Artificial Sequence
  dgRNA
  Recql
cgccgccgggccgca

SEQ ID NO: 88 - DNA, 15 bp, Artificial Sequence
  dgRNA
  Cdh26
ttatagctgagccag

SEQ ID NO: 89 - DNA, 15 bp, Artificial Sequence
  dgRNA
  Cdh26
agggaagcgggcgct

SEQ ID NO: 90 - DNA, 15 bp, Artificial Sequence
  dgRNA
  Cdh26
gtataacctcatctg

SEQ ID NO: 91 - DNA, 15 bp, Artificial Sequence
  dgRNA
  Zfp579
cccctcccgggatcc

SEQ ID NO: 92 - DNA, 15 bp, Artificial Sequence
  dgRNA
  Zfp579
ctggccctccgcttc

SEQ ID NO: 93 - DNA, 15 bp, Artificial Sequence
  dgRNA
  Zfp579
cctccgaccaagcac

SEQ ID NO: 94 - DNA, 15 bp, Artificial Sequence
  dgRNA
  Zfp579
ctccgaccaagcacc

SEQ ID NO: 95 - DNA, 15 bp, Artificial Sequence
  dgRNA
  Slc2a5
aaccgcaagtgctct

SEQ ID NO: 96 - DNA, 15 bp, Artificial Sequence
  dgRNA
  Slc2a5
accgcaagtgctctt

SEQ ID NO: 97 - DNA, 15 bp, Artificial Sequence
  dgRNA
  Slc2a5
actgaggatgagcgt

SEQ ID NO: 98 - DNA, 15 bp, Artificial Sequence
  dgRNA
  Slc2a5
gctggcgattctgtc

SEQ ID NO: 99 - DNA, 15 bp, Artificial Sequence
  dgRNA
  Vps52
gattcctggcggaag

SEQ ID NO: 100 - DNA, 15 bp, Artificial Sequence
  dgRNA
  Vps52
ctggcggaagaggcg

SEQ ID NO: 101 - DNA, 15 bp, Artificial Sequence
  dgRNA
  Vps52
aggcggggctatccc

SEQ ID NO: 102 - DNA, 15 bp, Artificial Sequence
  dgRNA
  Vps52
cggggctatccccgg

SEQ ID NO: 103 - DNA, 15 bp, Artificial Sequence
  dgRNA
  Sfrp4
tatggcccttggctg

SEQ ID NO: 104 - DNA, 15 bp, Artificial Sequence
  dgRNA
  Sfrp4
tgtcatcgcttctgc

SEQ ID NO: 105 - DNA, 15 bp, Artificial Sequence
  dgRNA
  Sfrp4
gtggagcagcggagt

SEQ ID NO: 106 - DNA, 15 bp, Artificial Sequence
  dgRNA
  Sfrp4
cagcggagtgggagc

SEQ ID NO: 107 - DNA, 15 bp, Artificial Sequence
  dgRNA
  Arpc4
agcgacaagcactaa

SEQ ID NO: 108 - DNA, 15 bp, Artificial Sequence
  dgRNA
  Arpc4
aagcactaaaggcgc

SEQ ID NO: 109 - DNA, 15 bp, Artificial Sequence
  dgRNA
  Arpc4
cactaaaggcgctgg

SEQ ID NO: 110 - DNA, 15 bp, Artificial Sequence
  dgRNA
  Arpc4
atgtgtagcgatcca

SEQ ID NO: 111 - DNA, 15 bp, Artificial Sequence
  dgRNA
  Vash2
aatgaggccggcccg

SEQ ID NO: 112 - DNA, 15 bp, Artificial Sequence
  dgRNA
  Vash2
gaggccggcccgagg

SEQ ID NO: 113 - DNA, 15 bp, Artificial Sequence
  dgRNA
  Vash2
aggccggcccgaggt

SEQ ID NO: 114 - DNA, 15 bp, Artificial Sequence
  dgRNA
  Vash2
cccgaggtgggtccc

SEQ ID NO: 115 - DNA, 15 bp, Artificial Sequence
  dgRNA
  Pik3r5
tgtgttactcagtac

SEQ ID NO: 116 - DNA, 15 bp, Artificial Sequence
  dgRNA
  Pik3r5
gtacacaagccgaag

SEQ ID NO: 117 - DNA, 15 bp, Artificial Sequence
  dgRNA
  Pik3r5
acaagccgaagcgga

SEQ ID NO: 118 - DNA, 15 bp, Artificial Sequence
  dgRNA
  Pik3r5
caagccgaagcggat

SEQ ID NO: 119 - DNA, 15 bp, Artificial Sequence
  dgRNA
  Pms2
tccccgagctttcat

SEQ ID NO: 120 - DNA, 15 bp, Artificial Sequence
  dgRNA
  Pms2
cgagctttcattggc

SEQ ID NO: 121 - DNA, 15 bp, Artificial Sequence
  dgRNA
  Pms2
tttcattggccgggc

SEQ ID NO: 122 - DNA, 15 bp, Artificial Sequence
  dgRNA
  Pms2
gagttggccaatcac

SEQ ID NO: 123 - DNA, 15 bp, Artificial Sequence
  dgRNA
  Spink1
aagatacctattata

SEQ ID NO: 124 - DNA, 15 bp, Artificial Sequence
  dgRNA
  Spink1
tattatagggcacag

SEQ ID NO: 125 - DNA, 15 bp, Artificial Sequence
  dgRNA
  Spink1
attatagggcacagt

SEQ ID NO: 126 - DNA, 15 bp, Artificial Sequence
  dgRNA
  Spink1
aaatgtaacctaggt

SEQ ID NO: 127 - DNA, 15 bp, Artificial Sequence
  dgRNA
  Lrp8
gcagccccggcgccg

SEQ ID NO: 128 - DNA, 15 bp, Artificial Sequence
  dgRNA
  Lrp8
cccggcgccgcggca

SEQ ID NO: 129 - DNA, 15 bp, Artificial Sequence
  dgRNA
  Lrp8
gccgcggcaaggact

SEQ ID NO: 130 - DNA, 15 bp, Artificial Sequence
  dgRNA
  Lrp8
gcggcaaggacttgg

SEQ ID NO: 131 - DNA, 15 bp, Artificial Sequence
  dgRNA
  Dctd
aactcttaggcccgt

SEQ ID NO: 132 - DNA, 15 bp, Artificial Sequence
  dgRNA
  Dctd
tcttaggcccgtggg

SEQ ID NO: 133 - DNA, 15 bp, Artificial Sequence
  dgRNA
  Dctd
cttaggcccgtgggt

SEQ ID NO: 134 - DNA, 15 bp, Artificial Sequence
  dgRNA
  Dctd
catgcctgcaccaat

SEQ ID NO: 135 - DNA, 15 bp, Artificial Sequence
  dgRNA
  Rln1
tgattttgggatata

SEQ ID NO: 136 - DNA, 15 bp, Artificial Sequence
  dgRNA
  Rln1
ggatataaggttgtt

SEQ ID NO: 137 - DNA, 15 bp, Artificial Sequence
  dgRNA
  Rln1
gatataaggttgttt

SEQ ID NO: 138 - DNA, 15 bp, Artificial Sequence
  dgRNA
  Rln1
aagacaataccacgc

SEQ ID NO: 139 - DNA, 15 bp, Artificial Sequence
  dgRNA
  Tmem209
ctgcagctaagtagg

SEQ ID NO: 140 - DNA, 15 bp, Artificial Sequence
  dgRNA
  Tmem209
ggaggcacaaatccg

SEQ ID NO: 141 - DNA, 15 bp, Artificial Sequence
  dgRNA
  Tmem209
gaggcacaaatccga

SEQ ID NO: 142 - DNA, 15 bp, Artificial Sequence
  dgRNA
  Tmem209
ccgagggcgttcccc

SEQ ID NO: 143 - DNA, 15 bp, Artificial Sequence
  dgRNA
  Iqce
gttagtattgcctgc

SEQ ID NO: 144 - DNA, 15 bp, Artificial Sequence
  dgRNA
  Iqce
tgcgccgtgcaaccc

SEQ ID NO: 145 - DNA, 15 bp, Artificial Sequence
  dgRNA
  Iqce
gcgccgtgcaacccc

SEQ ID NO: 146 - DNA, 15 bp, Artificial Sequence
  dgRNA
  Iqce
ccccgggagagtgct

SEQ ID NO: 147 - DNA, 15 bp, Artificial Sequence
  dgRNA
  Hoxb6
gctaaaacccaatct

SEQ ID NO: 148 - DNA, 15 bp, Artificial Sequence
  dgRNA
  Hoxb6
ggctatactactaat

SEQ ID NO: 149 - DNA, 15 bp, Artificial Sequence
  dgRNA
  Hoxb6
tactactaataggcg

SEQ ID NO: 150 - DNA, 15 bp, Artificial Sequence
  dgRNA
  Hoxb6
aataggcgcggcgct

SEQ ID NO: 151 - DNA, 15 bp, Artificial Sequence
  dgRNA
  Trim66
atcaccttgttcacc

SEQ ID NO: 152 - DNA, 15 bp, Artificial Sequence
  dgRNA
  Trim66
gaggcgcaagtagtt

SEQ ID NO: 153 - DNA, 15 bp, Artificial Sequence
  dgRNA
  Trim66
aggcgcaagtagttt

SEQ ID NO: 154 - DNA, 15 bp, Artificial Sequence
  dgRNA
  Trim66
ggcgcaagtagtttg

SEQ ID NO: 155 - DNA, 15 bp, Artificial Sequence
  dgRNA
  Kcnk5
ggggccatgaagcct

SEQ ID NO: 156 - DNA, 15 bp, Artificial Sequence
  dgRNA
  Kcnk5
catgaagccttggcc

SEQ ID NO: 157 - DNA, 15 bp, Artificial Sequence
  dgRNA
  Kcnk5
ggagaacccggtgtt

SEQ ID NO: 158 - DNA, 15 bp, Artificial Sequence
  dgRNA
  Kcnk5
tggtgtaatgacttc

SEQ ID NO: 159 - DNA, 15 bp, Artificial Sequence
  dgRNA
  Rnf115
tctagccgacagtgt

SEQ ID NO: 160 - DNA, 15 bp, Artificial Sequence
  dgRNA
  Rnf115
agccgacagtgtcgg

SEQ ID NO: 161 - DNA, 15 bp, Artificial Sequence
  dgRNA
  Rnf115
agtgtcggtggtttc

SEQ ID NO: 162 - DNA, 15 bp, Artificial Sequence
  dgRNA
  Rnf115
gtgtcggtggtttcc

SEQ ID NO: 163 - DNA, 15 bp, Artificial Sequence
  dgRNA
  Anxa6
ggtcagaaacgaccc

SEQ ID NO: 164 - DNA, 15 bp, Artificial Sequence
  dgRNA
  Anxa6
aacgacccaggtaag

SEQ ID NO: 165 - DNA, 15 bp, Artificial Sequence
  dgRNA
  Anxa6
ggcaggtttcccccg

SEQ ID NO: 166 - DNA, 15 bp, Artificial Sequence
  dgRNA
  Anxa6
gcaggtttcccccga

SEQ ID NO: 167 - DNA, 15 bp, Artificial Sequence
  dgRNA
  Polr3d
gacttccgccttgcc

SEQ ID NO: 168 - DNA, 15 bp, Artificial Sequence
  dgRNA
  Polr3d
ttgcccggagacccg

SEQ ID NO: 169 - DNA, 15 bp, Artificial Sequence
  dgRNA
  Polr3d
gagacccgcggcccg

SEQ ID NO: 170 - DNA, 15 bp, Artificial Sequence
  dgRNA
  Polr3d
cgtggttgctctagt

SEQ ID NO: 171 - DNA, 15 bp, Artificial Sequence
  dgRNA
  Ndufa5
gatgttcttgggatc

SEQ ID NO: 172 - DNA, 15 bp, Artificial Sequence
  dgRNA
  Mgat4e
gatgctatgagtcag

SEQ ID NO: 173 - DNA, 15 bp, Artificial Sequence
  dgRNA
  Mgat4e
gctatgagtcagggg

SEQ ID NO: 174 - DNA, 15 bp, Artificial Sequence
  dgRNA
  Mgat4e
ctatgagtcaggggt

SEQ ID NO: 175 - DNA, 15 bp, Artificial Sequence
  dgRNA
  Mgat4e
gaggggcataggtac

SEQ ID NO: 176 - DNA, 15 bp, Artificial Sequence
  dgRNA
  Ss18
cgctccctcccgccg

SEQ ID NO: 177 - DNA, 15 bp, Artificial Sequence
  dgRNA
  Ss18
tccctcccgccgtgg

SEQ ID NO: 178 - DNA, 15 bp, Artificial Sequence
  dgRNA
  Ss18
ccctcccgccgtggc

SEQ ID NO: 179 - DNA, 15 bp, Artificial Sequence
  dgRNA
  Ss18
catttcctgagcgtc

SEQ ID NO: 180 - DNA, 15 bp, Artificial Sequence
  dgRNA
  Rptor
acgctcgaagaggtt

SEQ ID NO: 181 - DNA, 15 bp, Artificial Sequence
  dgRNA
  Rptor
acgcgccgtagatag

SEQ ID NO: 182 - DNA, 15 bp, Artificial Sequence
  dgRNA
  Rptor
gatagcggtgcatgc

SEQ ID NO: 183 - DNA, 15 bp, Artificial Sequence
  dgRNA
  Rptor
atagcggtgcatgct

SEQ ID NO: 184 - DNA, 15 bp, Artificial Sequence
  dgRNA
  Ssu72
gatcgagctctcaat

SEQ ID NO: 185 - DNA, 15 bp, Artificial Sequence
  dgRNA
  Ssu72
ataggcaacctaaac

SEQ ID NO: 186 - DNA, 15 bp, Artificial Sequence
  dgRNA
  Ssu72
tgccagttttccgat

SEQ ID NO: 187 - DNA, 15 bp, Artificial Sequence
  dgRNA
  Ssu72
catgttaagctgcaa

SEQ ID NO: 188 - DNA, 15 bp, Artificial Sequence
  dgRNA
  Slc6a8
cgtcgccccgtcccc

SEQ ID NO: 189 - DNA, 15 bp, Artificial Sequence
  dgRNA
  Slc6a8
gcccggccgcccccg

SEQ ID NO: 190 - DNA, 15 bp, Artificial Sequence
  dgRNA
  Slc6a8
ccgaggcccccgggc

SEQ ID NO: 191 - DNA, 15 bp, Artificial Sequence
  dgRNA
  Slc6a8
gcgggcccgcgcttt

SEQ ID NO: 192 - DNA, 15 bp, Artificial Sequence
  dgRNA
  Krt8
gagagggatcccggg

SEQ ID NO: 193 - DNA, 15 bp, Artificial Sequence
  dgRNA
  Krt8
agtgtctagccactc

SEQ ID NO: 194 - DNA, 15 bp, Artificial Sequence
  dgRNA
  Krt8
agccactcaggtaag

SEQ ID NO: 195 - DNA, 15 bp, Artificial Sequence
  dgRNA
  Krt8
aattgatccctgtga

SEQ ID NO: 196 - DNA, 15 bp, Artificial Sequence
  dgRNA
  Ereg
tggccagtcctccgc

SEQ ID NO: 197 - DNA, 15 bp, Artificial Sequence
  dgRNA
  Ereg
ccactcctccccccg

SEQ ID NO: 198 - DNA, 15 bp, Artificial Sequence
  dgRNA
  Ereg
cactcctccccccgg

SEQ ID NO: 199 - DNA, 15 bp, Artificial Sequence
  dgRNA
  Ereg
actcctccccccggg

SEQ ID NO: 200 - DNA, 15 bp, Artificial Sequence
  dgRNA
  Zcchc3
ttaggttatcaaaat

SEQ ID NO: 201 - DNA, 15 bp, Artificial Sequence
  dgRNA
  Zcchc3
ggttatcaaaattgg

SEQ ID NO: 202 - DNA, 15 bp, Artificial Sequence
  dgRNA
  Zcchc3
cctcacagtgcgcgc

SEQ ID NO: 203 - DNA, 15 bp, Artificial Sequence
  dgRNA
  Zcchc3
tccaatgtacatgat

SEQ ID NO: 204 - DNA, 15 bp, Artificial Sequence
  dgRNA
  Pea15a
atcgtgaccaaccaa

SEQ ID NO: 205 - DNA, 15 bp, Artificial Sequence
  dgRNA
  Pea15a
ttggtcacgatggcc

SEQ ID NO: 206 - DNA, 15 bp, Artificial Sequence
  dgRNA
  Pea15a
tttggttggtcacga

SEQ ID NO: 207 - DNA, 15 bp, Artificial Sequence
  dgRNA
  Pea15a
cgtttttttcctaat

SEQ ID NO: 208 - DNA, 15 bp, Artificial Sequence
  dgRNA
  Glipr2
tgttcagttacaacc

SEQ ID NO: 209 - DNA, 15 bp, Artificial Sequence
  dgRNA
  Glipr2
gttcagttacaacct

SEQ ID NO: 210 - DNA, 15 bp, Artificial Sequence
  dgRNA
  Glipr2
ttcagttacaacctg

SEQ ID NO: 211 - DNA, 15 bp, Artificial Sequence
  dgRNA
  Glipr2
gatgcatagcgggac

SEQ ID NO: 212 - DNA, 15 bp, Artificial Sequence
  dgRNA
  Ino80d
ctgtcagcctaggcg

SEQ ID NO: 213 - DNA, 15 bp, Artificial Sequence
  dgRNA
  Ino80d
tgtcagcctaggcga

SEQ ID NO: 214 - DNA, 15 bp, Artificial Sequence
  dgRNA
  Ino80d
cagcctaggcgaggg

SEQ ID NO: 215 - DNA, 15 bp, Artificial Sequence
  dgRNA
  Ino80d
agcctaggcgaggga

SEQ ID NO: 216 - DNA, 15 bp, Artificial Sequence
  dgRNA
  Fnd3c2
ctacttacgaacacc

SEQ ID NO: 217 - DNA, 15 bp, Artificial Sequence
  dgRNA
  Fnd3c2
tacttacgaacacca

SEQ ID NO: 218 - DNA, 15 bp, Artificial Sequence
  dgRNA
  Fnd3c2
ttacgaacaccaggg

SEQ ID NO: 219 - DNA, 15 bp, Artificial Sequence
  dgRNA
  Fnd3c2
gaggtaataatggtc

SEQ ID NO: 220 - DNA, 15 bp, Artificial Sequence
  dgRNA
  Ugt2b37
ccaaaaccttagttc

SEQ ID NO: 221 - DNA, 15 bp, Artificial Sequence
  dgRNA
  Ugt2b37
tcacgtctcttatga

SEQ ID NO: 222 - DNA, 15 bp, Artificial Sequence
  dgRNA
  Smim22
ttctctaggccccta

SEQ ID NO: 223 - DNA, 15 bp, Artificial Sequence
  dgRNA
  Smim22
taggcccctatggtc

SEQ ID NO: 224 - DNA, 15 bp, Artificial Sequence
  dgRNA
  Smim22
cgcttgcctggcagc

SEQ ID NO: 225 - DNA, 15 bp, Artificial Sequence
  dgRNA
  Smim22
cggggctggttgcta

SEQ ID NO: 226 - DNA, 15 bp, Artificial Sequence
  dgRNA
  Olfr835
ggccttttagaatat

SEQ ID NO: 227 - DNA, 15 bp, Artificial Sequence
  dgRNA
  Degs2
ggaatccaagattac

SEQ ID NO: 228 - DNA, 15 bp, Artificial Sequence
  dgRNA
  Degs2
atccaagattactgg

SEQ ID NO: 229 - DNA, 15 bp, Artificial Sequence
  dgRNA
  Degs2
actggcggcccctgc

SEQ ID NO: 230 - DNA, 15 bp, Artificial Sequence
  dgRNA
  Degs2
cgcatctcccaaccc

SEQ ID NO: 231 - DNA, 15 bp, Artificial Sequence
  dgRNA
  Mrpl32
gaggagagtcaccta

SEQ ID NO: 232 - DNA, 15 bp, Artificial Sequence
  dgRNA
  Mrpl32
tcacctaggggtagc

SEQ ID NO: 233 - DNA, 15 bp, Artificial Sequence
  dgRNA
  Mrpl32
cacctaggggtagct

SEQ ID NO: 234 - DNA, 15 bp, Artificial Sequence
  dgRNA
  Mrpl32
ttgcgcatgcgcaag

SEQ ID NO: 235 - DNA, 15 bp, Artificial Sequence
  dgRNA
  Papl
agcgcactttgctga

SEQ ID NO: 236 - DNA, 15 bp, Artificial Sequence
  dgRNA
  Papl
gttcccaccttgaca

SEQ ID NO: 237 - DNA, 15 bp, Artificial Sequence
  dgRNA
  Papl
tgaactcggttctta

SEQ ID NO: 238 - DNA, 15 bp, Artificial Sequence
  dgRNA
  Papl
cttagggtagcacac

SEQ ID NO: 239 - DNA, 15 bp, Artificial Sequence
  dgRNA
  Pip
aacttctccccagta

SEQ ID NO: 240 - DNA, 15 bp, Artificial Sequence
  dgRNA
  Pip
aggtgattcacgtca

SEQ ID NO: 241 - DNA, 15 bp, Artificial Sequence
  dgRNA
  Pip
aaaggccttctataa

SEQ ID NO: 242 - DNA, 15 bp, Artificial Sequence
  dgRNA
  Prss38
gcctccacacagttc

SEQ ID NO: 243 - DNA, 15 bp, Artificial Sequence
  dgRNA
  Prss38
gccaccaacgcatcc

SEQ ID NO: 244 - DNA, 15 bp, Artificial Sequence
  dgRNA
  Prss38
acgcatccaggatcc

SEQ ID NO: 245 - DNA, 15 bp, Artificial Sequence
  dgRNA
  Prss38
cgcatccaggatcca

SEQ ID NO: 246 - DNA, 15 bp, Artificial Sequence
  dgRNA
  Gm382
ttgcctattaatata

SEQ ID NO: 247 - DNA, 15 bp, Artificial Sequence
  dgRNA
  Nadk
agttacagccttcgg

SEQ ID NO: 248 - DNA, 15 bp, Artificial Sequence
  dgRNA
  Nadk
gttacagccttcggt

SEQ ID NO: 249 - DNA, 15 bp, Artificial Sequence
  dgRNA
  Nadk
ttcggtgggtgtggc

SEQ ID NO: 250 - DNA, 15 bp, Artificial Sequence
  dgRNA
  Nadk
ggctggcgttcactc

SEQ ID NO: 251 - DNA, 15 bp, Artificial Sequence
  dgRNA
  Btrc
cgagtgctctacatt

SEQ ID NO: 252 - DNA, 15 bp, Artificial Sequence
  dgRNA
  Btrc
ctacgcagtgacccg

SEQ ID NO: 253 - DNA, 15 bp, Artificial Sequence
  dgRNA
  Btrc
tacgcagtgacccgt

SEQ ID NO: 254 - DNA, 15 bp, Artificial Sequence
  dgRNA
  Btrc
cttgccttttgccgc

SEQ ID NO: 255 - DNA, 15 bp, Artificial Sequence
  dgRNA
  Alyref
acgaccgcgccgcgt

SEQ ID NO: 256 - DNA, 15 bp, Artificial Sequence
  dgRNA
  Alyref
cgaccgcgccgcgtc

SEQ ID NO: 257 - DNA, 15 bp, Artificial Sequence
  dgRNA
  Alyref
tagcgccagccaccg

SEQ ID NO: 258 - DNA, 15 bp, Artificial Sequence
  dgRNA
  Alyref
cggcgagccgtacgc

SEQ ID NO: 259 - DNA, 15 bp, Artificial Sequence
  dgRNA
  C87436
ggcggaaaaagtgtt

SEQ ID NO: 260 - DNA, 15 bp, Artificial Sequence
  dgRNA
  C87436
gcggaaaaagtgttc

SEQ ID NO: 261 - DNA, 15 bp, Artificial Sequence
  dgRNA
  C87436
cggaaaaagtgttcg

SEQ ID NO: 262 - DNA, 15 bp, Artificial Sequence
  dgRNA
  C87436
cggggaactgcgtgt

SEQ ID NO: 263 - DNA, 15 bp, Artificial Sequence
  dgRNA
  Haghl
aagtgggcataatca

SEQ ID NO: 264 - DNA, 15 bp, Artificial Sequence
  dgRNA
  Haghl
agtgggcataatcat

SEQ ID NO: 265 - DNA, 15 bp, Artificial Sequence
  dgRNA
  Haghl
atgggtagtggaccg

SEQ ID NO: 266 - DNA, 15 bp, Artificial Sequence
  dgRNA
  Haghl
tgggtagtggaccgc

SEQ ID NO: 267 - DNA, 15 bp, Artificial Sequence
  dgRNA
  Zfp748
cagcccgactcccta

SEQ ID NO: 268 - DNA, 15 bp, Artificial Sequence
  dgRNA
  Zfp748
cgtcgcacagacttg

SEQ ID NO: 269 - DNA, 15 bp, Artificial Sequence
  dgRNA
  Zfp748
gtcgcacagacttgt

SEQ ID NO: 270 - DNA, 15 bp, Artificial Sequence
  dgRNA
  Zfp748
agtgtagtcttccgt

SEQ ID NO: 271 - DNA, 15 bp, Artificial Sequence
  dgRNA
  Hspb8
tggacccggacgcca

SEQ ID NO: 272 - DNA, 15 bp, Artificial Sequence
  dgRNA
  Hspb8
tctcagcggattctc

SEQ ID NO: 273 - DNA, 15 bp, Artificial Sequence
  dgRNA
  Hspb8
ctcagcggattctca

SEQ ID NO: 274 - DNA, 15 bp, Artificial Sequence
  dgRNA
  Hspb8
cggattctcagggac

SEQ ID NO: 275 - DNA, 15 bp, Artificial Sequence
  dgRNA
  Clstn2
gcgagcgagcggcat

SEQ ID NO: 276 - DNA, 15 bp, Artificial Sequence
  dgRNA
  Clstn2
cgagcgagcggcata

SEQ ID NO: 277 - DNA, 15 bp, Artificial Sequence
  dgRNA
  Clstn2
gagcgagcggcatag

SEQ ID NO: 278 - DNA, 15 bp, Artificial Sequence
  dgRNA
  Clstn2
gagcggcatagggga

SEQ ID NO: 279 - DNA, 15 bp, Artificial Sequence
  dgRNA
  Rnaset2a
gagtcgaggtgggcc

SEQ ID NO: 280 - DNA, 15 bp, Artificial Sequence
  dgRNA
  Rnaset2a
agtcgaggtgggccg

SEQ ID NO: 281 - DNA, 15 bp, Artificial Sequence
  dgRNA
  Rnaset2a
ggggccgttacagcg

SEQ ID NO: 282 - DNA, 15 bp, Artificial Sequence
  dgRNA
  Rnaset2a
gggccgttacagcgt

SEQ ID NO: 283 - DNA, 15 bp, Artificial Sequence
  dgRNA
  Abr
gaccgagggcctcct

SEQ ID NO: 284 - DNA, 15 bp, Artificial Sequence
  dgRNA
  Abr
ctagggcccactttc

SEQ ID NO: 285 - DNA, 15 bp, Artificial Sequence
  dgRNA
  Abr
tagggcccactttct

SEQ ID NO: 286 - DNA, 15 bp, Artificial Sequence
  dgRNA
  Abr
cctgttcactcccta

SEQ ID NO: 287 - DNA, 15 bp, Artificial Sequence
  dgRNA
  2310079G19Rik
agaacttgaatacga

SEQ ID NO: 288 - DNA, 15 bp, Artificial Sequence
  dgRNA
  2310079G19Rik
tacgaaggaccagat

SEQ ID NO: 289 - DNA, 15 bp, Artificial Sequence
  dgRNA
  2310079G19Rik
ttatgagttagtggg

SEQ ID NO: 290 - DNA, 15 bp, Artificial Sequence
  dgRNA
  2310079G19Rik
tgcttagtaagcaac

SEQ ID NO: 291 - DNA, 15 bp, Artificial Sequence
  dgRNA
  Slc7a2
tagacaccgccttcc

SEQ ID NO: 292 - DNA, 15 bp, Artificial Sequence
  dgRNA
  Slc7a2
cgtgacaaacgctcc

SEQ ID NO: 293 - DNA, 15 bp, Artificial Sequence
  dgRNA
  Slc7a2
caaacgctccaggcg

SEQ ID NO: 294 - DNA, 15 bp, Artificial Sequence
  dgRNA
  Slc7a2
aaacgctccaggcga

SEQ ID NO: 295 - DNA, 15 bp, Artificial Sequence
  dgRNA
  Siglech
ttaatgtctgactgc

SEQ ID NO: 296 - DNA, 15 bp, Artificial Sequence
  dgRNA
  Tbc1d23
cgcccactccgttcg

SEQ ID NO: 297 - DNA, 15 bp, Artificial Sequence
  dgRNA
  Tbc1d23
gcccactccgttcgc

SEQ ID NO: 298 - DNA, 15 bp, Artificial Sequence
  dgRNA
  Tbc1d23
ccgttcgcgggccct

SEQ ID NO: 299 - DNA, 15 bp, Artificial Sequence
  dgRNA
  Tbc1d23
cctctcgcaaagctc

SEQ ID NO: 300 - DNA, 15 bp, Artificial Sequence
  dgRNA
  Fry
atgcaagggtgcagc

SEQ ID NO: 301 - DNA, 15 bp, Artificial Sequence
  dgRNA
  Fry
gcccgagcacacccc

SEQ ID NO: 302 - DNA, 15 bp, Artificial Sequence
  dgRNA
  Fry
aacctttctgcaccg

SEQ ID NO: 303 - DNA, 15 bp, Artificial Sequence
  dgRNA
  Fry
cctcccctagcgagc

SEQ ID NO: 304 - DNA, 15 bp, Artificial Sequence
  dgRNA
  Dpp8
cctcccgccgctcgg

SEQ ID NO: 305 - DNA, 15 bp, Artificial Sequence
  dgRNA
  Dpp8
gctcggtggcgctgt

SEQ ID NO: 306 - DNA, 15 bp, Artificial Sequence
  dgRNA
  Dpp8
gccttcctctgtcgg

SEQ ID NO: 307 - DNA, 15 bp, Artificial Sequence
  dgRNA
  Dpp8
ccttcctctgtcgga

SEQ ID NO: 308 - DNA, 15 bp, Artificial Sequence
  dgRNA
  Rmi2
cttctggcggttacg

SEQ ID NO: 309 - DNA, 15 bp, Artificial Sequence
  dgRNA
  Rmi2
cccgcccccatccat

SEQ ID NO: 310 - DNA, 15 bp, Artificial Sequence
  dgRNA
  Rmi2
ttggctgcctcgggc

SEQ ID NO: 311 - DNA, 15 bp, Artificial Sequence
  dgRNA
  Rmi2
aggcgcgctcttgat

SEQ ID NO: 312 - DNA, 15 bp, Artificial Sequence
  dgRNA
  B9d2
taacggtcaagtacg

SEQ ID NO: 313 - DNA, 15 bp, Artificial Sequence
  dgRNA
  B9d2
cggtcaagtacgcgg

SEQ ID NO: 314 - DNA, 15 bp, Artificial Sequence
  dgRNA
  B9d2
caagtacgcggaggt

SEQ ID NO: 315 - DNA, 15 bp, Artificial Sequence
  dgRNA
  B9d2
catgcgctacgccta

SEQ ID NO: 316 - DNA, 15 bp, Artificial Sequence
  dgRNA
  Vmn2r63
tcaatatatacctgc

SEQ ID NO: 317 - DNA, 15 bp, Artificial Sequence
  dgRNA
  Vmn2r63
atctaataatccagc

SEQ ID NO: 318 - DNA, 15 bp, Artificial Sequence
  dgRNA
  Gal3st1
gaccccttggcccat

SEQ ID NO: 319 - DNA, 15 bp, Artificial Sequence
  dgRNA
  Gal3st1
caaatagtccttgtt

SEQ ID NO: 320 - DNA, 15 bp, Artificial Sequence
  dgRNA
  Gal3st1
tagtccttgttaggc

SEQ ID NO: 321 - DNA, 15 bp, Artificial Sequence
  dgRNA
  Gal3st1
tccttgttaggccgg

SEQ ID NO: 322 - DNA, 15 bp, Artificial Sequence
  dgRNA
  Prpf6
aggactaatgcgttc

SEQ ID NO: 323 - DNA, 15 bp, Artificial Sequence
  dgRNA
  Prpf6
tccggctccgcgtca

SEQ ID NO: 324 - DNA, 15 bp, Artificial Sequence
  dgRNA
  Prpf6
gctccgcgtcaaggc

SEQ ID NO: 325 - DNA, 15 bp, Artificial Sequence
  dgRNA
  Prpf6
gaacccacgtccttg

SEQ ID NO: 326 - DNA, 15 bp, Artificial Sequence
  dgRNA
  Cox16
aaacccaattgcacc

SEQ ID NO: 327 - DNA, 15 bp, Artificial Sequence
  dgRNA
  Cox16
acccggcgtatcctg

SEQ ID NO: 328 - DNA, 15 bp, Artificial Sequence
  dgRNA
  Cox16
cgtatcctgaggtca

SEQ ID NO: 329 - DNA, 15 bp, Artificial Sequence
  dgRNA
  Cox16
agaagcctcgacttc

SEQ ID NO: 330 - DNA, 15 bp, Artificial Sequence
  dgRNA
  Ankrd55
gcataactactcagc

SEQ ID NO: 331 - DNA, 15 bp, Artificial Sequence
  dgRNA
  Ankrd55
actcagcagggcacg

SEQ ID NO: 332 - DNA, 15 bp, Artificial Sequence
  dgRNA
  Ankrd55
gttatgcactgctgc

SEQ ID NO: 333 - DNA, 15 bp, Artificial Sequence
  dgRNA
  Ankrd55
aaatattgtagcagg

SEQ ID NO: 334 - DNA, 15 bp, Artificial Sequence
  dgRNA
  Pkp4
cagcatcggtctcca

SEQ ID NO: 335 - DNA, 15 bp, Artificial Sequence
  dgRNA
  Pkp4
aaccgcagctcccat

SEQ ID NO: 336 - DNA, 15 bp, Artificial Sequence
  dgRNA
  Pkp4
ggctcgttcaatatg

SEQ ID NO: 337 - DNA, 15 bp, Artificial Sequence
  dgRNA
  Pkp4
gctcgttcaatatga

SEQ ID NO: 338 - DNA, 15 bp, Artificial Sequence
  dgRNA
  B3galt1
gggctcactcctaca

SEQ ID NO: 339 - DNA, 15 bp, Artificial Sequence
  dgRNA
  B3galt1
aaatgacgcccttgt

SEQ ID NO: 340 - DNA, 15 bp, Artificial Sequence
  dgRNA
  Dnali1
ttccgttttaatcaa

SEQ ID NO: 341 - DNA, 15 bp, Artificial Sequence
  dgRNA
  Dnali1
cgttttaatcaaagg

SEQ ID NO: 342 - DNA, 15 bp, Artificial Sequence
  dgRNA
  Dnali1
aacagacctaacgct

SEQ ID NO: 343 - DNA, 15 bp, Artificial Sequence
  dgRNA
  Dnali1
acagacctaacgcta

SEQ ID NO: 344 - DNA, 15 bp, Artificial Sequence
  dgRNA
  Cdkl3
aaaacgctctcttgc

SEQ ID NO: 345 - DNA, 15 bp, Artificial Sequence
  dgRNA
  Cdkl3
aaacgctctcttgcc

SEQ ID NO: 346 - DNA, 15 bp, Artificial Sequence
  dgRNA
  Cdkl3
cgggcgaaagcctcc

SEQ ID NO: 347 - DNA, 15 bp, Artificial Sequence
  dgRNA
  Cdkl3
ccacctgcaagcacg

SEQ ID NO: 348 - DNA, 15 bp, Artificial Sequence
  dgRNA
  Bivm
cgctattgttattat

SEQ ID NO: 349 - DNA, 15 bp, Artificial Sequence
  dgRNA
  Bivm
tataatcattcatcg

SEQ ID NO: 350 - DNA, 15 bp, Artificial Sequence
  dgRNA
  Bivm
cagtccctagcgcgt

SEQ ID NO: 351 - DNA, 15 bp, Artificial Sequence
  dgRNA
  Bivm
ctagcgcgtaggaag

SEQ ID NO: 352 - DNA, 15 bp, Artificial Sequence
  dgRNA
  Lrrc32
cctgaggcccgcgca

SEQ ID NO: 353 - DNA, 15 bp, Artificial Sequence
  dgRNA
  Lrrc32
ctcccgatttctgtc

SEQ ID NO: 354 - DNA, 15 bp, Artificial Sequence
  dgRNA
  Lrrc32
ctgtcaggatccccg

SEQ ID NO: 355 - DNA, 15 bp, Artificial Sequence
  dgRNA
  Lrrc32
tgtcaggatccccga

SEQ ID NO: 356 - DNA, 15 bp, Artificial Sequence
  dgRNA
  Krt26
taggatcactgtccc

SEQ ID NO: 357 - DNA, 15 bp, Artificial Sequence
  dgRNA
  Krt26
gaatcctataaaagc

SEQ ID NO: 358 - DNA, 15 bp, Artificial Sequence
  dgRNA
  Krt26
atagtgttcagtagg

SEQ ID NO: 359 - DNA, 15 bp, Artificial Sequence
  dgRNA
  Krt26
ttcaccggcttttat

SEQ ID NO: 360 - DNA, 15 bp, Artificial Sequence
  dgRNA
  Cdsn
ggggctagtgcccag

SEQ ID NO: 361 - DNA, 15 bp, Artificial Sequence
  dgRNA
  Cdsn
gcctaacccagaacc

SEQ ID NO: 362 - DNA, 15 bp, Artificial Sequence
  dgRNA
  Cdsn
gcggtgcaggggacc

SEQ ID NO: 363 - DNA, 15 bp, Artificial Sequence
  dgRNA
  Cdsn
gtgactgcggtgcag

SEQ ID NO: 364 - DNA, 15 bp, Artificial Sequence
  dgRNA
  Higd1b
agtgttgcgtctgtc

SEQ ID NO: 365 - DNA, 15 bp, Artificial Sequence
  dgRNA
  Higd1b
gtgttgcgtctgtca

SEQ ID NO: 366 - DNA, 15 bp, Artificial Sequence
  dgRNA
  Higd1b
tgacagacgcaacac

SEQ ID NO: 367 - DNA, 15 bp, Artificial Sequence
  dgRNA
  Higd1b
cacgatctggctctg

SEQ ID NO: 368 - DNA, 15 bp, Artificial Sequence
  dgRNA
  Epha5
aaacaccgagtagag

SEQ ID NO: 369 - DNA, 15 bp, Artificial Sequence
  dgRNA
  Epha5
agagcaaacggtgtg

SEQ ID NO: 370 - DNA, 15 bp, Artificial Sequence
  dgRNA
  Epha5
tgtctacggatcaag

SEQ ID NO: 371 - DNA, 15 bp, Artificial Sequence
  dgRNA
  Epha5
gtgtctacggatcaa

SEQ ID NO: 372 - DNA, 15 bp, Artificial Sequence
  dgRNA
  Psca
cagattggaatgggc

SEQ ID NO: 373 - DNA, 15 bp, Artificial Sequence
  dgRNA
  Psca
accatataaagcctc

SEQ ID NO: 374 - DNA, 15 bp, Artificial Sequence
  dgRNA
  Psca
ctcagctagtagggg

SEQ ID NO: 375 - DNA, 15 bp, Artificial Sequence
  dgRNA
  Psca
ggtctcagctagtag

SEQ ID NO: 376 - DNA, 15 bp, Artificial Sequence
  dgRNA
  Igflr1
taatctgttcgacac

SEQ ID NO: 377 - DNA, 15 bp, Artificial Sequence
  dgRNA
  Igflr1
gaagtttgtcaatca

SEQ ID NO: 378 - DNA, 15 bp, Artificial Sequence
  dgRNA
  Igflr1
gtcaatcaaggtctg

SEQ ID NO: 379 - DNA, 15 bp, Artificial Sequence
  dgRNA
  Igflr1
aaagggacgctggac

SEQ ID NO: 380 - DNA, 15 bp, Artificial Sequence
  dgRNA
  Gm5595
cactaaccttaagag

SEQ ID NO: 381 - DNA, 15 bp, Artificial Sequence
  dgRNA
  Gm5595
ccggtgctttgctgt

SEQ ID NO: 382 - DNA, 15 bp, Artificial Sequence
  dgRNA
  Gm5595
tccgtgctgtatccg

SEQ ID NO: 383 - DNA, 15 bp, Artificial Sequence
  dgRNA
  Gm5595
gtgctgtatccgagg

SEQ ID NO: 384 - DNA, 15 bp, Artificial Sequence
  dgRNA
  Gpr137
ggtgcttgctgcgtg

SEQ ID NO: 385 - DNA, 15 bp, Artificial Sequence
  dgRNA
  Gpr137
ccgccatccgtaacc

SEQ ID NO: 386 - DNA, 15 bp, Artificial Sequence
  dgRNA
  Gpr137
cgccatccgtaaccc

SEQ ID NO: 387 - DNA, 15 bp, Artificial Sequence
  dgRNA
  Gpr137
acccgggacacccgc

SEQ ID NO: 388 - DNA, 15 bp, Artificial Sequence
  dgRNA
  Sgk1
cggattcccttggga

SEQ ID NO: 389 - DNA, 15 bp, Artificial Sequence
  dgRNA
  Sgk1
acggattcccttggg

SEQ ID NO: 390 - DNA, 15 bp, Artificial Sequence
  dgRNA
  Sgk1
acaacggattccctt

SEQ ID NO: 391 - DNA, 15 bp, Artificial Sequence
  dgRNA
  Sgk1
aacaacggattccct

SEQ ID NO: 392 - DNA, 15 bp, Artificial Sequence
  dgRNA
  Cep57l1
aagccgaacaaataa

SEQ ID NO: 393 - DNA, 15 bp, Artificial Sequence
  dgRNA
  Cep57l1
ggcagggctttgcgt

SEQ ID NO: 394 - DNA, 15 bp, Artificial Sequence
  dgRNA
  Cep57l1
gcacctttatttgtt

SEQ ID NO: 395 - DNA, 15 bp, Artificial Sequence
  dgRNA
  Cep57l1
gtcgcggtggcatct

SEQ ID NO: 396 - DNA, 15 bp, Artificial Sequence
  dgRNA
  Ncstn
tcttcgtctcgaatt

SEQ ID NO: 397 - DNA, 15 bp, Artificial Sequence
  dgRNA
  Ncstn
tggttagcatccttc

SEQ ID NO: 398 - DNA, 15 bp, Artificial Sequence
  dgRNA
  Ncstn
tcgggctcctaggtc

SEQ ID NO: 399 - DNA, 15 bp, Artificial Sequence
  dgRNA
  Ncstn
cctaggtcaggttag

SEQ ID NO: 400 - DNA, 15 bp, Artificial Sequence
  dgRNA
  Anapc10
cgccaccggcaaaga

SEQ ID NO: 401 - DNA, 15 bp, Artificial Sequence
  dgRNA
  Anapc10
caccggcaaagatgg

SEQ ID NO: 402 - DNA, 15 bp, Artificial Sequence
  dgRNA
  Anapc10
ccgccgcctcgcgca

SEQ ID NO: 403 - DNA, 15 bp, Artificial Sequence
  dgRNA
  Anapc10
ctcgcgcaaggcatg

SEQ ID NO: 404 - DNA, 15 bp, Artificial Sequence
  dgRNA
  Pknox1
cgccgtcgcgctggg

SEQ ID NO: 405 - DNA, 15 bp, Artificial Sequence
  dgRNA
  Pknox1
gccgtcgcgctgggc

SEQ ID NO: 406 - DNA, 15 bp, Artificial Sequence
  dgRNA
  Pknox1
ccgtcgcgctgggcg

SEQ ID NO: 407 - DNA, 15 bp, Artificial Sequence
  dgRNA
  Pknox1
cgtcgcgctgggcgg

SEQ ID NO: 408 - DNA, 15 bp, Artificial Sequence
  dgRNA
  Neurl4
cagcccaaatcttcc

SEQ ID NO: 409 - DNA, 15 bp, Artificial Sequence
  dgRNA
  Neurl4
cctctgtcgtcccgc

SEQ ID NO: 410 - DNA, 15 bp, Artificial Sequence
  dgRNA
  Neurl4
ctctgtcgtcccgct

SEQ ID NO: 411 - DNA, 15 bp, Artificial Sequence
  dgRNA
  Neurl4
cctcgtgagagacct

SEQ ID NO: 412 - DNA, 15 bp, Artificial Sequence
  dgRNA
  F8
cactctaagcgacaa

SEQ ID NO: 413 - DNA, 15 bp, Artificial Sequence
  dgRNA
  F8
gttagcggccatttc

SEQ ID NO: 414 - DNA, 15 bp, Artificial Sequence
  dgRNA
  F8
ttagcggccatttcg

SEQ ID NO: 415 - DNA, 15 bp, Artificial Sequence
  dgRNA
  F8
tagcggccatttcgg

SEQ ID NO: 416 - DNA, 15 bp, Artificial Sequence
  dgRNA
  Eif4enif1
gggtacggcaagcgc

SEQ ID NO: 417 - DNA, 15 bp, Artificial Sequence
  dgRNA
  Eif4enif1
ggtacggcaagcgcg

SEQ ID NO: 418 - DNA, 15 bp, Artificial Sequence
  dgRNA
  Eif4enif1
gcaagcgcggggccc

SEQ ID NO: 419 - DNA, 15 bp, Artificial Sequence
  dgRNA
  Eif4enif1
cccggcctgcgtgcg

SEQ ID NO: 420 - DNA, 15 bp, Artificial Sequence
  dgRNA
  Tbpl2
cctgaggctgataaa

SEQ ID NO: 421 - DNA, 15 bp, Artificial Sequence
  dgRNA
  Tbpl2
tagagtagcatgata

SEQ ID NO: 422 - DNA, 15 bp, Artificial Sequence
  dgRNA
  Tbpl2
gagcacgcagtgagg

SEQ ID NO: 423 - DNA, 15 bp, Artificial Sequence
  dgRNA
  A330050F15Rik
agttgtgcgcctgcc

SEQ ID NO: 424 - DNA, 15 bp, Artificial Sequence
  dgRNA
  A330050F15Rik
cgcctgccgggaaac

SEQ ID NO: 425 - DNA, 15 bp, Artificial Sequence
  dgRNA
  A330050F15Rik
ctgcttcggtggaag

SEQ ID NO: 426 - DNA, 15 bp, Artificial Sequence
  dgRNA
  A330050F15Rik
agcgccctgctcctt

SEQ ID NO: 427 - DNA, 15 bp, Artificial Sequence
  dgRNA
  Gm1993
ctccatgtacgcacg

SEQ ID NO: 428 - DNA, 15 bp, Artificial Sequence
  dgRNA
  Gm1993
catgtacgcacgagg

SEQ ID NO: 429 - DNA, 15 bp, Artificial Sequence
  dgRNA
  Gm1993
ctcctcgtgcgtaca

SEQ ID NO: 430 - DNA, 15 bp, Artificial Sequence
  dgRNA
  Mrpl13
ttagttgcacgttcc

SEQ ID NO: 431 - DNA, 15 bp, Artificial Sequence
  dgRNA
  Mrpl13
tagttgcacgttccc

SEQ ID NO: 432 - DNA, 15 bp, Artificial Sequence
  dgRNA
  Mrpl13
ctatgcgcctccctc

SEQ ID NO: 433 - DNA, 15 bp, Artificial Sequence
  dgRNA
  Mrpl13
tatgcgcctccctcc

SEQ ID NO: 434 - DNA, 15 bp, Artificial Sequence
  dgRNA
  Rtel1
cgatattaagtgctt

SEQ ID NO: 435 - DNA, 15 bp, Artificial Sequence
  dgRNA
  Rtel1
ccccctggcgtccag

SEQ ID NO: 436 - DNA, 15 bp, Artificial Sequence
  dgRNA
  Rtel1
tggcgtccagaggcg

SEQ ID NO: 437 - DNA, 15 bp, Artificial Sequence
  dgRNA
  Rtel1
ggcgtccagaggcga

SEQ ID NO: 438 - DNA, 15 bp, Artificial Sequence
  dgRNA
  Etv3
gtgctcctgtcagcg

SEQ ID NO: 439 - DNA, 15 bp, Artificial Sequence
  dgRNA
  Etv3
agggttccagccccg

SEQ ID NO: 440 - DNA, 15 bp, Artificial Sequence
  dgRNA
  Etv3
gcggcctccgagcca

SEQ ID NO: 441 - DNA, 15 bp, Artificial Sequence
  dgRNA
  Etv3
gcctccgagccacgg

SEQ ID NO: 442 - DNA, 15 bp, Artificial Sequence
  dgRNA
  Lpxn
cattcagttccgttg

SEQ ID NO: 443 - DNA, 15 bp, Artificial Sequence
  dgRNA
  Gm15056
tgaatgcctagctga

SEQ ID NO: 444 - DNA, 15 bp, Artificial Sequence
  dgRNA
  Gm15056
ctgcacgtggtaggg

SEQ ID NO: 445 - DNA, 15 bp, Artificial Sequence
  dgRNA
  Gm15056
atggctgcacgtggt

SEQ ID NO: 446 - DNA, 15 bp, Artificial Sequence
  dgRNA
  Gm15056
cgtcatggctgcacg

SEQ ID NO: 447 - DNA, 15 bp, Artificial Sequence
  dgRNA
  Moap1
cccgagctcggctcc

SEQ ID NO: 448 - DNA, 15 bp, Artificial Sequence
  dgRNA
  Moap1
agctcggctcccggc

SEQ ID NO: 449 - DNA, 15 bp, Artificial Sequence
  dgRNA
  Moap1
ctcccggccggacgc

SEQ ID NO: 450 - DNA, 15 bp, Artificial Sequence
  dgRNA
  Moap1
tcccggccggacgcc

SEQ ID NO: 451 - DNA, 15 bp, Artificial Sequence
  dgRNA
  Ska3
acctcgcgtaccaac

SEQ ID NO: 452 - DNA, 15 bp, Artificial Sequence
  dgRNA
  Ska3
gcgtaccaaccggcc

SEQ ID NO: 453 - DNA, 15 bp, Artificial Sequence
  dgRNA
  Ska3
cgtaccaaccggccc

SEQ ID NO: 454 - DNA, 15 bp, Artificial Sequence
  dgRNA
  Ska3
gggacacgctcccct

SEQ ID NO: 455 - DNA, 15 bp, Artificial Sequence
  dgRNA
  Btg1-ps1
gtcacattgctagct

SEQ ID NO: 456 - DNA, 15 bp, Artificial Sequence
  dgRNA
  Btg1-ps1
actaccagctcagtc

SEQ ID NO: 457 - DNA, 15 bp, Artificial Sequence
  dgRNA
  Sidt1
ggcttctgctcgagc

SEQ ID NO: 458 - DNA, 15 bp, Artificial Sequence
  dgRNA
  Sidt1
gcttctgctcgagca

SEQ ID NO: 459 - DNA, 15 bp, Artificial Sequence
  dgRNA
  Sidt1
ctgcgagagtcttgc

SEQ ID NO: 460 - DNA, 15 bp, Artificial Sequence
  dgRNA
  Sidt1
actgtaaaatcgaat

SEQ ID NO: 461 - DNA, 15 bp, Artificial Sequence
  dgRNA
  Arih2
tcagtagttcctccc

SEQ ID NO: 462 - DNA, 15 bp, Artificial Sequence
  dgRNA
  Arih2
aggggctctcgctag

SEQ ID NO: 463 - DNA, 15 bp, Artificial Sequence
  dgRNA
  Arih2
gctctcgctagagga

SEQ ID NO: 464 - DNA, 15 bp, Artificial Sequence
  dgRNA
  Arih2
cgctagaggatggtg

SEQ ID NO: 465 - DNA, 15 bp, Artificial Sequence
  dgRNA
  Bbs1
aaagcgctcctcccc

SEQ ID NO: 466 - DNA, 15 bp, Artificial Sequence
  dgRNA
  Bbs1
ttatttggtcccagc

SEQ ID NO: 467 - DNA, 15 bp, Artificial Sequence
  dgRNA
  Bbs1
gggacaattttaccc

SEQ ID NO: 468 - DNA, 15 bp, Artificial Sequence
  dgRNA
  Bbs1
gtgctttcggatgcc

SEQ ID NO: 469 - DNA, 15 bp, Artificial Sequence
  dgRNA
  Mat2a
gctcgccccccccat

SEQ ID NO: 470 - DNA, 15 bp, Artificial Sequence
  dgRNA
  Mat2a
cccccatcggtagaa

SEQ ID NO: 471 - DNA, 15 bp, Artificial Sequence
  dgRNA
  Mat2a
ggttcagccggagct

SEQ ID NO: 472 - DNA, 15 bp, Artificial Sequence
  dgRNA
  Mat2a
agccggagctcggct

SEQ ID NO: 473 - DNA, 15 bp, Artificial Sequence
  dgRNA
  Mbd6
tgcgtcccctcctgt

SEQ ID NO: 474 - DNA, 15 bp, Artificial Sequence
  dgRNA
  Mbd6
ctcgctgctgtccgc

SEQ ID NO: 475 - DNA, 15 bp, Artificial Sequence
  dgRNA
  Mbd6
tcgctgctgtccgct

SEQ ID NO: 476 - DNA, 15 bp, Artificial Sequence
  dgRNA
  Mbd6
gctgtccgctgggcg

SEQ ID NO: 477 - DNA, 15 bp, Artificial Sequence
  dgRNA
  Uqcrq
tccgcccagccctct

SEQ ID NO: 478 - DNA, 15 bp, Artificial Sequence
  dgRNA
  Uqcrq
cagccctcttggtac

SEQ ID NO: 479 - DNA, 15 bp, Artificial Sequence
  dgRNA
  Uqcrq
ggtactggtcctttc

SEQ ID NO: 480 - DNA, 15 bp, Artificial Sequence
  dgRNA
  Uqcrq
tttccggctacacga

SEQ ID NO: 481 - DNA, 15 bp, Artificial Sequence
  dgRNA
  Ddx46
tccatagcgccaaaa

SEQ ID NO: 482 - DNA, 15 bp, Artificial Sequence
  dgRNA
  Ddx46
ccatagcgccaaaaa

SEQ ID NO: 483 - DNA, 15 bp, Artificial Sequence
  dgRNA
  Ddx46
cgccaaaaagggctg

SEQ ID NO: 484 - DNA, 15 bp, Artificial Sequence
  dgRNA
  Ddx46
gccaaaaagggctgc

SEQ ID NO: 485 - DNA, 15 bp, Artificial Sequence
  dgRNA
  Tle1
agaggccgcgcgagg

SEQ ID NO: 486 - DNA, 15 bp, Artificial Sequence
  dgRNA
  Tle1
gaggccgcgcgaggt

SEQ ID NO: 487 - DNA, 15 bp, Artificial Sequence
  dgRNA
  Tle1
gccgcgcgaggtggg

SEQ ID NO: 488 - DNA, 15 bp, Artificial Sequence
  dgRNA
  Tle1
aggtgggcggagcga

SEQ ID NO: 489 - DNA, 15 bp, Artificial Sequence
  dgRNA
  Hcfc1
aggacggtttcaaga

SEQ ID NO: 490 - DNA, 15 bp, Artificial Sequence
  dgRNA
  Hcfc1
acggtttcaagatgg

SEQ ID NO: 491 - DNA, 15 bp, Artificial Sequence
  dgRNA
  Hcfc1
cggcttccacaattg

SEQ ID NO: 492 - DNA, 15 bp, Artificial Sequence
  dgRNA
  Hcfc1
aagttgagacaaccg

SEQ ID NO: 493 - DNA, 15 bp, Artificial Sequence
  dgRNA
  Sult1a1
catactgtggactgt

SEQ ID NO: 494 - DNA, 15 bp, Artificial Sequence
  dgRNA
  Sult1a1
ctgttaaccatactg

SEQ ID NO: 495 - DNA, 15 bp, Artificial Sequence
  dgRNA
  Sult1a1
aaacagtgctaggac

SEQ ID NO: 496 - DNA, 15 bp, Artificial Sequence
  dgRNA
  Sult1a1
aattggtctttgagc

SEQ ID NO: 497 - DNA, 15 bp, Artificial Sequence
  dgRNA
  Ankrd46
gaatgtgcgcgatgc

SEQ ID NO: 498 - DNA, 15 bp, Artificial Sequence
  dgRNA
  Ankrd46
cgcgatgctggctag

SEQ ID NO: 499 - DNA, 15 bp, Artificial Sequence
  dgRNA
  Ankrd46
gagcctcccgcctgc

SEQ ID NO: 500 - DNA, 15 bp, Artificial Sequence
  dgRNA
  Ankrd46
agcctcccgcctgca

SEQ ID NO: 501 - DNA, 15 bp, Artificial Sequence
  dgRNA
  Adap1
atgagactatagact

SEQ ID NO: 502 - DNA, 15 bp, Artificial Sequence
  dgRNA
  Adap1
acttggacacgtgtg

SEQ ID NO: 503 - DNA, 15 bp, Artificial Sequence
  dgRNA
  Adap1
cttggacacgtgtga

SEQ ID NO: 504 - DNA, 15 bp, Artificial Sequence
  dgRNA
  Adap1
ggacacgtgtgaggg

SEQ ID NO: 505 - DNA, 15 bp, Artificial Sequence
  dgRNA
  Kdm4d
ggctcggttgagacc

SEQ ID NO: 506 - DNA, 15 bp, Artificial Sequence
  dgRNA
  Kdm4d
ccttcgcacttccaa

SEQ ID NO: 507 - DNA, 15 bp, Artificial Sequence
  dgRNA
  Kdm4d
cacttccaatggctg

SEQ ID NO: 508 - DNA, 15 bp, Artificial Sequence
  dgRNA
  Kdm4d
tgcgaactccacacc

SEQ ID NO: 509 - DNA, 15 bp, Artificial Sequence
  dgRNA
  2010107G23Rik
agttaccccggcagc

SEQ ID NO: 510 - DNA, 15 bp, Artificial Sequence
  dgRNA
  2010107G23Rik
cccggcagccggcag

SEQ ID NO: 511 - DNA, 15 bp, Artificial Sequence
  dgRNA
  2010107G23Rik
ccggcagccggcaga

SEQ ID NO: 512 - DNA, 15 bp, Artificial Sequence
  dgRNA
  2010107G23Rik
cggcagccggcagag

SEQ ID NO: 513 - DNA, 15 bp, Artificial Sequence
  dgRNA
  Cd40
tcagtgactagccat

SEQ ID NO: 514 - DNA, 15 bp, Artificial Sequence
  dgRNA
  Cd40
taggcccaccgcgat

SEQ ID NO: 515 - DNA, 15 bp, Artificial Sequence
  dgRNA
  Cd40
cccctcctcgcatcc

SEQ ID NO: 516 - DNA, 15 bp, Artificial Sequence
  dgRNA
  Cd40
tccccaagagtttaa

SEQ ID NO: 517 - DNA, 15 bp, Artificial Sequence
  dgRNA
  Prpf8
ggctcctaaactgac

SEQ ID NO: 518 - DNA, 15 bp, Artificial Sequence
  dgRNA
  Prpf8
gactggcagaaggcg

SEQ ID NO: 519 - DNA, 15 bp, Artificial Sequence
  dgRNA
  Prpf8
ttagacccgcctctc

SEQ ID NO: 520 - DNA, 15 bp, Artificial Sequence
  dgRNA
  Prpf8
cccgcctctccggct

SEQ ID NO: 521 - DNA, 15 bp, Artificial Sequence
  dgRNA
  Sema6d
agccgccgccagggc

SEQ ID NO: 522 - DNA, 15 bp, Artificial Sequence
  dgRNA
  Sema6d
cgagacccgagaccg

SEQ ID NO: 523 - DNA, 15 bp, Artificial Sequence
  dgRNA
  Sema6d
gagacccgagaccgt

SEQ ID NO: 524 - DNA, 15 bp, Artificial Sequence
  dgRNA
  Sema6d
aggcttccccatgag

SEQ ID NO: 525 - DNA, 15 bp, Artificial Sequence
  dgRNA
  Hk3
agttcttaacctcgt

SEQ ID NO: 526 - DNA, 15 bp, Artificial Sequence
  dgRNA
  Hk3
gttcttaacctcgtt

SEQ ID NO: 527 - DNA, 15 bp, Artificial Sequence
  dgRNA
  Hk3
cagatttcggttaag

SEQ ID NO: 528 - DNA, 15 bp, Artificial Sequence
  dgRNA
  Hk3
gttgaaggcccaacg

SEQ ID NO: 529 - DNA, 15 bp, Artificial Sequence
  dgRNA
  AW549877
ccttacatcatcgac

SEQ ID NO: 530 - DNA, 15 bp, Artificial Sequence
  dgRNA
  AW549877
tggcccctcgcagca

SEQ ID NO: 531 - DNA, 15 bp, Artificial Sequence
  dgRNA
  AW549877
cgcagcacgggattg

SEQ ID NO: 532 - DNA, 15 bp, Artificial Sequence
  dgRNA
  AW549877
cacgggattgtggga

SEQ ID NO: 533 - DNA, 15 bp, Artificial Sequence
  dgRNA
  A230050P20Rik
agcaaaacgccacgg

SEQ ID NO: 534 - DNA, 15 bp, Artificial Sequence
  dgRNA
  A230050P20Rik
ggtccgaagacgctt

SEQ ID NO: 535 - DNA, 15 bp, Artificial Sequence
  dgRNA
  A230050P20Rik
gtccgaagacgcttc

SEQ ID NO: 536 - DNA, 15 bp, Artificial Sequence
  dgRNA
  A230050P20Rik
cttcgggttctgcat

SEQ ID NO: 537 - DNA, 15 bp, Artificial Sequence
  dgRNA
  Rpl5
tccatgctcgttgag

SEQ ID NO: 538 - DNA, 15 bp, Artificial Sequence
  dgRNA
  Rpl5
atgctcgttgagagg

SEQ ID NO: 539 - DNA, 15 bp, Artificial Sequence
  dgRNA
  Rpl5
cattcatcctcctac

SEQ ID NO: 540 - DNA, 15 bp, Artificial Sequence
  dgRNA
  Rpl5
catcctcctaccggc

SEQ ID NO: 541 - DNA, 15 bp, Artificial Sequence
  dgRNA
  Zcchc4
ggtctgacggcggca

SEQ ID NO: 542 - DNA, 15 bp, Artificial Sequence
  dgRNA
  Zcchc4
cggcatggctcctcc

SEQ ID NO: 543 - DNA, 15 bp, Artificial Sequence
  dgRNA
  Zcchc4
ctcctccaggacgcg

SEQ ID NO: 544 - DNA, 15 bp, Artificial Sequence
  dgRNA
  Zcchc4
tcctccaggacgcgt

SEQ ID NO: 545 - DNA, 15 bp, Artificial Sequence
  dgRNA
  Ldha
cgaactgcctgccag

SEQ ID NO: 546 - DNA, 15 bp, Artificial Sequence
  dgRNA
  Ldha
cgcctgccagtcttc

SEQ ID NO: 547 - DNA, 15 bp, Artificial Sequence
  dgRNA
  Ldha
gctggtcatacaact

SEQ ID NO: 548 - DNA, 15 bp, Artificial Sequence
  dgRNA
  Ldha
acttgggttcttgcg

SEQ ID NO: 549 - DNA, 15 bp, Artificial Sequence
  dgRNA
  Nudt16
cgtaaattctaactc

SEQ ID NO: 550 - DNA, 15 bp, Artificial Sequence
  dgRNA
  Nudt16
gttccaaaacacctc

SEQ ID NO: 551 - DNA, 15 bp, Artificial Sequence
  dgRNA
  Nudt16
cccaccctagcctaa

SEQ ID NO: 552 - DNA, 15 bp, Artificial Sequence
  dgRNA
  Nudt16
cctaagggccaatcc

SEQ ID NO: 553 - DNA, 15 bp, Artificial Sequence
  dgRNA
  Adam1b
agagtatgcccacct

SEQ ID NO: 554 - DNA, 15 bp, Artificial Sequence
  dgRNA
  Adam1b
gagtatgcccaccta

SEQ ID NO: 555 - DNA, 15 bp, Artificial Sequence
  dgRNA
  Adam1b
agtatgcccacctag

SEQ ID NO: 556 - DNA, 15 bp, Artificial Sequence
  dgRNA
  Adam1b
ttgatttggaacatt

SEQ ID NO: 557 - DNA, 15 bp, Artificial Sequence
  dgRNA
  Olfr820
tatttgctcactggc

SEQ ID NO: 558 - DNA, 15 bp, Artificial Sequence
  dgRNA
  Stac3
tggcttatcaggaat

SEQ ID NO: 559 - DNA, 15 bp, Artificial Sequence
  dgRNA
  Lgi4
tagagttaattacaa

SEQ ID NO: 560 - DNA, 15 bp, Artificial Sequence
  dgRNA
  Lgi4
ttacaagggatcttc

SEQ ID NO: 561 - DNA, 15 bp, Artificial Sequence
  dgRNA
  Lgi4
caagggatcttctgg

SEQ ID NO: 562 - DNA, 15 bp, Artificial Sequence
  dgRNA
  Lgi4
ccgatggtgaccacc

SEQ ID NO: 563 - DNA, 15 bp, Artificial Sequence
  dgRNA
  Ndufa3
ctacaactcccgaaa

SEQ ID NO: 564 - DNA, 15 bp, Artificial Sequence
  dgRNA
  Ndufa3
ccacgtcctcgccca

SEQ ID NO: 565 - DNA, 15 bp, Artificial Sequence
  dgRNA
  Ndufa3
cacgtcctcgcccaa

SEQ ID NO: 566 - DNA, 15 bp, Artificial Sequence
  dgRNA
  Ndufa3
acgtcctcgcccaag

SEQ ID NO: 567 - DNA, 15 bp, Artificial Sequence
  dgRNA
  Ambp
gaactctattgtgct

SEQ ID NO: 568 - DNA, 15 bp, Artificial Sequence
  dgRNA
  Ambp
gggatcgattagagc

SEQ ID NO: 569 - DNA, 15 bp, Artificial Sequence
  dgRNA
  Ambp
gaccctgattggcct

SEQ ID NO: 570 - DNA, 15 bp, Artificial Sequence
  dgRNA
  Ambp
ggtcaactttcccca

SEQ ID NO: 571 - DNA, 15 bp, Artificial Sequence
  dgRNA
  5430421N21Rik
agggcaagcttgtaa

SEQ ID NO: 572 - DNA, 15 bp, Artificial Sequence
  dgRNA
  5430421N21Rik
agccacactaggagt

SEQ ID NO: 573 - DNA, 15 bp, Artificial Sequence
  dgRNA
  5430421N21Rik
gagttggagcttaag

SEQ ID NO: 574 - DNA, 15 bp, Artificial Sequence
  dgRNA
  5430421N21Rik
ggccttcaatgaccc

SEQ ID NO: 575 - DNA, 15 bp, Artificial Sequence
  dgRNA
  Zfp397
aaacagccgtaaaag

SEQ ID NO: 576 - DNA, 15 bp, Artificial Sequence
  dgRNA
  Zfp397
aggaaaatccgatta

SEQ ID NO: 577 - DNA, 15 bp, Artificial Sequence
  dgRNA
  Zfp397
ggaaaatccgattat

SEQ ID NO: 578 - DNA, 15 bp, Artificial Sequence
  dgRNA
  Zfp397
atccgattatgggac

SEQ ID NO: 579 - DNA, 15 bp, Artificial Sequence
  dgRNA
  1700018C11Rik
aagatggatcatgat

SEQ ID NO: 580 - DNA, 15 bp, Artificial Sequence
  dgRNA
  1700018C11Rik
tggatcatgatagga

SEQ ID NO: 581 - DNA, 15 bp, Artificial Sequence
  dgRNA
  1700018C11Rik
ttcctccccgcctta

SEQ ID NO: 582 - DNA, 15 bp, Artificial Sequence
  dgRNA
  1700018C11Rik
gtctagtccaaaagc

SEQ ID NO: 583 - DNA, 15 bp, Artificial Sequence
  dgRNA
  Gm11559
ggaaatgctctaagg

SEQ ID NO: 584 - DNA, 15 bp, Artificial Sequence
  dgRNA
  Gm11559
gtttccaatggctta

SEQ ID NO: 585 - DNA, 15 bp, Artificial Sequence
  dgRNA
  Gm11559
ttttatactctggac

SEQ ID NO: 586 - DNA, 15 bp, Artificial Sequence
  dgRNA
  Gm11559
ggggcttttatactc

SEQ ID NO: 587 - DNA, 15 bp, Artificial Sequence
  dgRNA
  Epha6
cgcgcgcgctctcct

SEQ ID NO: 588 - DNA, 15 bp, Artificial Sequence
  dgRNA
  Epha6
tagtcctcgctcgag

SEQ ID NO: 589 - DNA, 15 bp, Artificial Sequence
  dgRNA
  Epha6
agtcctcgctcgagc

SEQ ID NO: 590 - DNA, 15 bp, Artificial Sequence
  dgRNA
  Epha6
cgctcgagcgggaca

SEQ ID NO: 591 - DNA, 15 bp, Artificial Sequence
  dgRNA
  Arhgef18
gctgaagttgatata

SEQ ID NO: 592 - DNA, 15 bp, Artificial Sequence
  dgRNA
  Arhgef18
agttgatataaggac

SEQ ID NO: 593 - DNA, 15 bp, Artificial Sequence
  dgRNA
  Arhgef18
aactacctattgccg

SEQ ID NO: 594 - DNA, 15 bp, Artificial Sequence
  dgRNA
  Arhgef18
tactcatgcgcagct

SEQ ID NO: 595 - DNA, 15 bp, Artificial Sequence
  dgRNA
  Preb
cgccccacacaaaga

SEQ ID NO: 596 - DNA, 15 bp, Artificial Sequence
  dgRNA
  Preb
agcttcatcgtcatt

SEQ ID NO: 597 - DNA, 15 bp, Artificial Sequence
  dgRNA
  Preb
gcttcatcgtcattc

SEQ ID NO: 598 - DNA, 15 bp, Artificial Sequence
  dgRNA
  Preb
cttcatcgtcattcg

SEQ ID NO: 599 - DNA, 15 bp, Artificial Sequence
  dgRNA
  Uchl1
gagaccctcgagctt

SEQ ID NO: 600 - DNA, 15 bp, Artificial Sequence
  dgRNA
  Uchl1
tgattgagacgacag

SEQ ID NO: 601 - DNA, 15 bp, Artificial Sequence
  dgRNA
  Uchl1
ttgagacgacagagg

SEQ ID NO: 602 - DNA, 15 bp, Artificial Sequence
  dgRNA
  Uchl1
aaagctccctcaaat

SEQ ID NO: 603 - DNA, 15 bp, Artificial Sequence
  dgRNA
  Mob4
tcgcatcttcctttt

SEQ ID NO: 604 - DNA, 15 bp, Artificial Sequence
  dgRNA
  Mob4
ccttttcggcctcgg

SEQ ID NO: 605 - DNA, 15 bp, Artificial Sequence
  dgRNA
  Mob4
tcggcggagctccgc

SEQ ID NO: 606 - DNA, 15 bp, Artificial Sequence
  dgRNA
  Mob4
ctccgccggagccgc

SEQ ID NO: 607 - DNA, 15 bp, Artificial Sequence
  dgRNA
  Gpr137
tgagggtggacgcgg

SEQ ID NO: 608 - DNA, 15 bp, Artificial Sequence
  dgRNA
  Gpr137
gagggtggacgcggt

SEQ ID NO: 609 - DNA, 15 bp, Artificial Sequence
  dgRNA
  Gpr137
agggtggacgcggtg

SEQ ID NO: 610 - DNA, 15 bp, Artificial Sequence
  dgRNA
  Gpr137
gtgggggaacacgtc

SEQ ID NO: 611 - DNA, 15 bp, Artificial Sequence
  dgRNA
  Klrk1
aagccacgttgtgtg

SEQ ID NO: 612 - DNA, 15 bp, Artificial Sequence
  dgRNA
  Klrk1
cacgttgtgtgtggc

SEQ ID NO: 613 - DNA, 15 bp, Artificial Sequence
  dgRNA
  Klrk1
ctttcacaacggcct

SEQ ID NO: 614 - DNA, 15 bp, Artificial Sequence
  dgRNA
  Klrk1
gaggccgttgtgaaa

SEQ ID NO: 615 - DNA, 15 bp, Artificial Sequence
  dgRNA
  Krt27
gtaactatccaccta

SEQ ID NO: 616 - DNA, 15 bp, Artificial Sequence
  dgRNA
  Krt27
atccacctacggaag

SEQ ID NO: 617 - DNA, 15 bp, Artificial Sequence
  dgRNA
  Krt27
aatgtcacccactta

SEQ ID NO: 618 - DNA, 15 bp, Artificial Sequence
  dgRNA
  Krt27
taattctcaatgagc

SEQ ID NO: 619 - DNA, 15 bp, Artificial Sequence
  dgRNA
  Slc1a1
caaatcccttcgcac

SEQ ID NO: 620 - DNA, 15 bp, Artificial Sequence
  dgRNA
  Slc1a1
aaatcccttcgcact

SEQ ID NO: 621 - DNA, 15 bp, Artificial Sequence
  dgRNA
  Slc1a1
ccttcgcactgggct

SEQ ID NO: 622 - DNA, 15 bp, Artificial Sequence
  dgRNA
  Slc1a1
cttcgcactgggcta

SEQ ID NO: 623 - DNA, 15 bp, Artificial Sequence
  dgRNA
  Itsn2
aagggctgtcagccg

SEQ ID NO: 624 - DNA, 15 bp, Artificial Sequence
  dgRNA
  Itsn2
tcagccgcggagctt

SEQ ID NO: 625 - DNA, 15 bp, Artificial Sequence
  dgRNA
  Itsn2
cagccgcggagcttc

SEQ ID NO: 626 - DNA, 15 bp, Artificial Sequence
  dgRNA
  Itsn2
cggagcttcgggacc

SEQ ID NO: 627 - DNA, 15 bp, Artificial Sequence
  dgRNA
  Adam5
tacaaggagaaacgc

SEQ ID NO: 628 - DNA, 15 bp, Artificial Sequence
  dgRNA
  Adam5
accaacgagtgtttt

SEQ ID NO: 629 - DNA, 15 bp, Artificial Sequence
  dgRNA
  Adam5
ccaacgagtgtttta

SEQ ID NO: 630 - DNA, 15 bp, Artificial Sequence
  dgRNA
  Adam5
caacgagtgttttag

SEQ ID NO: 631 - DNA, 15 bp, Artificial Sequence
  dgRNA
  Tfr2
tgacgggaaccaagt

SEQ ID NO: 632 - DNA, 15 bp, Artificial Sequence
  dgRNA
  Tfr2
gtctgcccgcaacag

SEQ ID NO: 633 - DNA, 15 bp, Artificial Sequence
  dgRNA
  Tfr2
tctgcccgcaacagt

SEQ ID NO: 634 - DNA, 15 bp, Artificial Sequence
  dgRNA
  Tfr2
ctgcccgcaacagtg

SEQ ID NO: 635 - DNA, 15 bp, Artificial Sequence
  dgRNA
  Zmym1
aaaaacgggcagcta

SEQ ID NO: 636 - DNA, 15 bp, Artificial Sequence
  dgRNA
  Zmym1
cctccgcgccccagg

SEQ ID NO: 637 - DNA, 15 bp, Artificial Sequence
  dgRNA
  Zmym1
gccccaggcggaccg

SEQ ID NO: 638 - DNA, 15 bp, Artificial Sequence
  dgRNA
  Zmym1
catgctcagccgcaa

SEQ ID NO: 639 - DNA, 15 bp, Artificial Sequence
  dgRNA
  Krtcap2
cctccttgccacaag

SEQ ID NO: 640 - DNA, 15 bp, Artificial Sequence
  dgRNA
  Krtcap2
agggcgctgcaccca

SEQ ID NO: 641 - DNA, 15 bp, Artificial Sequence
  dgRNA
  Krtcap2
acccaaggcgcgtag

SEQ ID NO: 642 - DNA, 15 bp, Artificial Sequence
  dgRNA
  Krtcap2
aaagcaagtccacgt

SEQ ID NO: 643 - DNA, 15 bp, Artificial Sequence
  dgRNA
  Gpank1
ccatcccatcgtgac

SEQ ID NO: 644 - DNA, 15 bp, Artificial Sequence
  dgRNA
  Gpank1
tttacccatgaggcc

SEQ ID NO: 645 - DNA, 15 bp, Artificial Sequence
  dgRNA
  Gpank1
ctgtcacgatgggat

SEQ ID NO: 646 - DNA, 15 bp, Artificial Sequence
  dgRNA
  Gpank1
cctgtcacgatggga

SEQ ID NO: 647 - DNA, 15 bp, Artificial Sequence
  dgRNA
  Ddah1
tgaggcgtgcacctg

SEQ ID NO: 648 - DNA, 15 bp, Artificial Sequence
  dgRNA
  Ddah1
ggcgtgcacctgcgg

SEQ ID NO: 649 - DNA, 15 bp, Artificial Sequence
  dgRNA
  Ddah1
gcgtgcacctgcggt

SEQ ID NO: 650 - DNA, 15 bp, Artificial Sequence
  dgRNA
  Ddah1
catcccgattgaccc

SEQ ID NO: 651 - DNA, 15 bp, Artificial Sequence
  dgRNA
  Mei4
ctagtccagccaaac

SEQ ID NO: 652 - DNA, 15 bp, Artificial Sequence
  dgRNA
  Mei4
cccgcccgagcccgc

SEQ ID NO: 653 - DNA, 15 bp, Artificial Sequence
  dgRNA
  Mei4
tcccaagcccctccg

SEQ ID NO: 654 - DNA, 15 bp, Artificial Sequence
  dgRNA
  Mei4
tggcgcagaggcttc

SEQ ID NO: 655 - DNA, 15 bp, Artificial Sequence
  dgRNA
  Alcam
tttcatgcccttgcg

SEQ ID NO: 656 - DNA, 15 bp, Artificial Sequence
  dgRNA
  Alcam
catgcccttgcgagg

SEQ ID NO: 657 - DNA, 15 bp, Artificial Sequence
  dgRNA
  Alcam
cttgcgaggtggttc

SEQ ID NO: 658 - DNA, 15 bp, Artificial Sequence
  dgRNA
  Alcam
ttgcgaggtggttca

SEQ ID NO: 659 - DNA, 15 bp, Artificial Sequence
  dgRNA
  Zfp318
gggcctgcgcacttc

SEQ ID NO: 660 - DNA, 15 bp, Artificial Sequence
  dgRNA
  Zfp318
ggcctgcgcacttca

SEQ ID NO: 661 - DNA, 15 bp, Artificial Sequence
  dgRNA
  Zfp318
ccctggtgctcgcgc

SEQ ID NO: 662 - DNA, 15 bp, Artificial Sequence
  dgRNA
  Zfp318
cagcgctccgcccca

SEQ ID NO: 663 - DNA, 15 bp, Artificial Sequence
  dgRNA
  Ucma
cccccagtggcatcc

SEQ ID NO: 664 - DNA, 15 bp, Artificial Sequence
  dgRNA
  Ucma
ccgggatgccactgg

SEQ ID NO: 665 - DNA, 15 bp, Artificial Sequence
  dgRNA
  Ucma
gccgggatgccactg

SEQ ID NO: 666 - DNA, 15 bp, Artificial Sequence
  dgRNA
  Ucma
agccgggatgccact

SEQ ID NO: 667 - DNA, 15 bp, Artificial Sequence
  dgRNA
  Krt9
acgggcagtcaccaa

SEQ ID NO: 668 - DNA, 15 bp, Artificial Sequence
  dgRNA
  Krt9
ctatgggggggaagc

SEQ ID NO: 669 - DNA, 15 bp, Artificial Sequence
  dgRNA
  Krt9
gcagggggtataagt

SEQ ID NO: 670 - DNA, 15 bp, Artificial Sequence
  dgRNA
  Krt9
ataagtaggcagctc

SEQ ID NO: 671 - DNA, 15 bp, Artificial Sequence
  dgRNA
  Olfr731
cattggttgtttaag

SEQ ID NO: 672 - DNA, 15 bp, Artificial Sequence
  dgRNA
  Olfr731
actctaggtagccgg

SEQ ID NO: 673 - DNA, 15 bp, Artificial Sequence
  dgRNA
  Olfr731
atattatgtgttccc

SEQ ID NO: 674 - DNA, 15 bp, Artificial Sequence
  dgRNA
  Olfr731
tgggtaatacttcaa

SEQ ID NO: 675 - DNA, 15 bp, Artificial Sequence
  dgRNA
  Asb10
ctgtctcgggaacag

SEQ ID NO: 676 - DNA, 15 bp, Artificial Sequence
  dgRNA
  Asb10
caacaacctagccct

SEQ ID NO: 677 - DNA, 15 bp, Artificial Sequence
  dgRNA
  Asb10
tcctgttggacatcg

SEQ ID NO: 678 - DNA, 15 bp, Artificial Sequence
  dgRNA
  Asb10
aagggctaggttgtt

SEQ ID NO: 679 - DNA, 15 bp, Artificial Sequence
  dgRNA
  Mpp2
ccaagtaacacacgt

SEQ ID NO: 680 - DNA, 15 bp, Artificial Sequence
  dgRNA
  Mpp2
agagttgggggtcgt

SEQ ID NO: 681 - DNA, 15 bp, Artificial Sequence
  dgRNA
  Mpp2
cacccgcctgctcct

SEQ ID NO: 682 - DNA, 15 bp, Artificial Sequence
  dgRNA
  Mpp2
gagattactttacag

SEQ ID NO: 683 - DNA, 15 bp, Artificial Sequence
  dgRNA
  Mthfd1l
tggccatacaatctc

SEQ ID NO: 684 - DNA, 15 bp, Artificial Sequence
  dgRNA
  Mthfd1l
ggccatacaatctca

SEQ ID NO: 685 - DNA, 15 bp, Artificial Sequence
  dgRNA
  Mthfd1l
aagcttcacgtccgc

SEQ ID NO: 686 - DNA, 15 bp, Artificial Sequence
  dgRNA
  Mthfd1l
gccctgttaacgtca

SEQ ID NO: 687 - DNA, 15 bp, Artificial Sequence
  dgRNA
  Ift52
ccggaacctgcgtcc

SEQ ID NO: 688 - DNA, 15 bp, Artificial Sequence
  dgRNA
  Ift52
acctgcgtccaggcc

SEQ ID NO: 689 - DNA, 15 bp, Artificial Sequence
  dgRNA
  Ift52
gcgtccaggccaggc

SEQ ID NO: 690 - DNA, 15 bp, Artificial Sequence
  dgRNA
  Ift52
gcagtccccgcccat

SEQ ID NO: 691 - DNA, 15 bp, Artificial Sequence
  dgRNA
  Gm9376
acatgccttcgtgca

SEQ ID NO: 692 - DNA, 15 bp, Artificial Sequence
  dgRNA
  Gm9376
catgccttcgtgcat

SEQ ID NO: 693 - DNA, 15 bp, Artificial Sequence
  dgRNA
  Gm9376
gattgctaagagtgg

SEQ ID NO: 694 - DNA, 15 bp, Artificial Sequence
  dgRNA
  Gm9376
cgaaggcatgttaac

SEQ ID NO: 695 - DNA, 15 bp, Artificial Sequence
  dgRNA
  Apbb1
cgagaacaacaattg

SEQ ID NO: 696 - DNA, 15 bp, Artificial Sequence
  dgRNA
  Apbb1
ggaattgcacagcgc

SEQ ID NO: 697 - DNA, 15 bp, Artificial Sequence
  dgRNA
  Apbb1
cacagcgctggtttg

SEQ ID NO: 698 - DNA, 15 bp, Artificial Sequence
  dgRNA
  Apbb1
cgggatttgagaggc

SEQ ID NO: 699 - DNA, 15 bp, Artificial Sequence
  dgRNA
  Mrpl28
ccctaaaggaggcgg

SEQ ID NO: 700 - DNA, 15 bp, Artificial Sequence
  dgRNA
  Mrpl28
cctaaaggaggcgga

SEQ ID NO: 701 - DNA, 15 bp, Artificial Sequence
  dgRNA
  Mrpl28
agggattagtttaga

SEQ ID NO: 702 - DNA, 15 bp, Artificial Sequence
  dgRNA
  Mrpl28
attagtttagatgga

SEQ ID NO: 703 - DNA, 15 bp, Artificial Sequence
  dgRNA
  Gfi1b
gctactgaaagtttc

SEQ ID NO: 704 - DNA, 15 bp, Artificial Sequence
  dgRNA
  Gfi1b
tgcactttcgcgctc

SEQ ID NO: 705 - DNA, 15 bp, Artificial Sequence
  dgRNA
  Gfi1b
tcgcgctctggtcat

SEQ ID NO: 706 - DNA, 15 bp, Artificial Sequence
  dgRNA
  Gfi1b
tgtgtcaaaatctgg

SEQ ID NO: 707 - DNA, 15 bp, Artificial Sequence
  dgRNA
  Enpp1
atagcccacgcgccc

SEQ ID NO: 708 - DNA, 15 bp, Artificial Sequence
  dgRNA
  Enpp1
tagcccacgcgccca

SEQ ID NO: 709 - DNA, 15 bp, Artificial Sequence
  dgRNA
  Enpp1
ggcccgaaatcagac

SEQ ID NO: 710 - DNA, 15 bp, Artificial Sequence
  dgRNA
  Enpp1
gaagccaaatacccg

SEQ ID NO: 711 - DNA, 15 bp, Artificial Sequence
  dgRNA
  Inppl1
cccgtcttctcccgc

SEQ ID NO: 712 - DNA, 15 bp, Artificial Sequence
  dgRNA
  Inppl1
ccgtcttctcccgcc

SEQ ID NO: 713 - DNA, 15 bp, Artificial Sequence
  dgRNA
  Inppl1
cccttttccgcccca

SEQ ID NO: 714 - DNA, 15 bp, Artificial Sequence
  dgRNA
  Inppl1
cgccccaggggtcgg

SEQ ID NO: 715 - DNA, 15 bp, Artificial Sequence
  dgRNA
  Slc9b1
ccgcccttctgcttc

SEQ ID NO: 716 - DNA, 15 bp, Artificial Sequence
  dgRNA
  Slc9b1
tttagtcctacttca

SEQ ID NO: 717 - DNA, 15 bp, Artificial Sequence
  dgRNA
  Slc9b1
atagtaaacgtggca

SEQ ID NO: 718 - DNA, 15 bp, Artificial Sequence
  dgRNA
  Slc9b1
catagtaaacgtggc

SEQ ID NO: 719 - DNA, 15 bp, Artificial Sequence
  dgRNA
  Wipf3
taatcagatgagcta

SEQ ID NO: 720 - DNA, 15 bp, Artificial Sequence
  dgRNA
  Wipf3
caagagagtagtttc

SEQ ID NO: 721 - DNA, 15 bp, Artificial Sequence
  dgRNA
  Ptk6
gactcacacctcaag

SEQ ID NO: 722 - DNA, 15 bp, Artificial Sequence
  dgRNA
  Ptk6
cacctcaagaggata

SEQ ID NO: 723 - DNA, 15 bp, Artificial Sequence
  dgRNA
  Ptk6
gtgctcgctgtctca

SEQ ID NO: 724 - DNA, 15 bp, Artificial Sequence
  dgRNA
  Ptk6
tgctcgctgtctcat

SEQ ID NO: 725 - DNA, 15 bp, Artificial Sequence
  dgRNA
  Cnnm4
cgccgttctacctta

SEQ ID NO: 726 - DNA, 15 bp, Artificial Sequence
  dgRNA
  Cnnm4
gccgttctaccttaa

SEQ ID NO: 727 - DNA, 15 bp, Artificial Sequence
  dgRNA
  Cnnm4
cagacctccttaagc

SEQ ID NO: 728 - DNA, 15 bp, Artificial Sequence
  dgRNA
  Cnnm4
gggcgcgcgagccgt

SEQ ID NO: 729 - DNA, 15 bp, Artificial Sequence
  dgRNA
  Tmem116
ctgcgcatgcgtcgt

SEQ ID NO: 730 - DNA, 15 bp, Artificial Sequence
  dgRNA
  Tmem116
cgcatgcgtcgtagg

SEQ ID NO: 731 - DNA, 15 bp, Artificial Sequence
  dgRNA
  Tmem116
gcgtcgtaggcggag

SEQ ID NO: 732 - DNA, 15 bp, Artificial Sequence
  dgRNA
  Tmem116
aggcggagcggcgag

SEQ ID NO: 733 - DNA, 15 bp, Artificial Sequence
  dgRNA
  Spice1
aatagcttgctgcta

SEQ ID NO: 734 - DNA, 15 bp, Artificial Sequence
  dgRNA
  Spice1
tagcttgctgctatg

SEQ ID NO: 735 - DNA, 15 bp, Artificial Sequence
  dgRNA
  Spice1
ggaattgcctgtgca

SEQ ID NO: 736 - DNA, 15 bp, Artificial Sequence
  dgRNA
  Spice1
atatttcaatatcgc

SEQ ID NO: 737 - DNA, 15 bp, Artificial Sequence
  dgRNA
  Retn
caatccttctaatgt

SEQ ID NO: 738 - DNA, 15 bp, Artificial Sequence
  dgRNA
  Retn
ccttctaatgtagga

SEQ ID NO: 739 - DNA, 15 bp, Artificial Sequence
  dgRNA
  Retn
agttcacctctcttg

SEQ ID NO: 740 - DNA, 15 bp, Artificial Sequence
  dgRNA
  Retn
ggtacttattatcca

SEQ ID NO: 741 - DNA, 15 bp, Artificial Sequence
  dgRNA
  Rbm28
cccccgcgtgatatg

SEQ ID NO: 742 - DNA, 15 bp, Artificial Sequence
  dgRNA
  Rbm28
cacatatcacgcggg

SEQ ID NO: 743 - DNA, 15 bp, Artificial Sequence
  dgRNA
  Rbm28
ccacatatcacgcgg

SEQ ID NO: 744 - DNA, 15 bp, Artificial Sequence
  dgRNA
  Rbm28
gccacatatcacgcg

SEQ ID NO: 745 - DNA, 15 bp, Artificial Sequence
  dgRNA
  Ifitm3
ctgtgagcgtgagct

SEQ ID NO: 746 - DNA, 15 bp, Artificial Sequence
  dgRNA
  Ifitm3
agcttggttgactcc

SEQ ID NO: 747 - DNA, 15 bp, Artificial Sequence
  dgRNA
  Ifitm3
gacaagtcctgactt

SEQ ID NO: 748 - DNA, 15 bp, Artificial Sequence
  dgRNA
  Ifitm3
agtaatttgatccgc

SEQ ID NO: 749 - DNA, 15 bp, Artificial Sequence
  dgRNA
  Hsd11b2
ccgcctcatgcaact

SEQ ID NO: 750 - DNA, 15 bp, Artificial Sequence
  dgRNA
  Hsd11b2
cgcctcatgcaactt

SEQ ID NO: 751 - DNA, 15 bp, Artificial Sequence
  dgRNA
  Hsd11b2
gcctcatgcaacttg

SEQ ID NO: 752 - DNA, 15 bp, Artificial Sequence
  dgRNA
  Hsd11b2
cggcttcttcgaaaa

SEQ ID NO: 753 - DNA, 15 bp, Artificial Sequence
  dgRNA
  Tceb1
gcgatgtctcttaaa

SEQ ID NO: 754 - DNA, 15 bp, Artificial Sequence
  dgRNA
  Tceb1
cgatgtctcttaaat

SEQ ID NO: 755 - DNA, 15 bp, Artificial Sequence
  dgRNA
  Tceb1
ccagacgcaagttac

SEQ ID NO: 756 - DNA, 15 bp, Artificial Sequence
  dgRNA
  Tceb1
cggcagatcgcgtct

SEQ ID NO: 757 - DNA, 15 bp, Artificial Sequence
  dgRNA
  Gcfc2
gtgcaggtaatctcc

SEQ ID NO: 758 - DNA, 15 bp, Artificial Sequence
  dgRNA
  Gcfc2
tgcaggtaatctccc

SEQ ID NO: 759 - DNA, 15 bp, Artificial Sequence
  dgRNA
  Gcfc2
aactgcgagaatgtt

SEQ ID NO: 760 - DNA, 15 bp, Artificial Sequence
  dgRNA
  Gcfc2
gccaattcagaccat

SEQ ID NO: 761 - DNA, 15 bp, Artificial Sequence
  dgRNA
  Arfgap2
ctgccccggaatttc

SEQ ID NO: 762 - DNA, 15 bp, Artificial Sequence
  dgRNA
  Arfgap2
gagtgcaatctggac

SEQ ID NO: 763 - DNA, 15 bp, Artificial Sequence
  dgRNA
  Arfgap2
aaggttgttgtgtgc

SEQ ID NO: 764 - DNA, 15 bp, Artificial Sequence
  dgRNA
  Arfgap2
ctctaggccagttgc

SEQ ID NO: 765 - DNA, 15 bp, Artificial Sequence
  dgRNA
  Gcnt4
tccgctgataacgcc

SEQ ID NO: 766 - DNA, 15 bp, Artificial Sequence
  dgRNA
  Gcnt4
tgataacgcctggct

SEQ ID NO: 767 - DNA, 15 bp, Artificial Sequence
  dgRNA
  Gcnt4
ctggctaggcagcgc

SEQ ID NO: 768 - DNA, 15 bp, Artificial Sequence
  dgRNA
  Gcnt4
agcgctggccgatgc

SEQ ID NO: 769 - DNA, 15 bp, Artificial Sequence
  dgRNA
  Rab11fip5
taggcagctatatgc

SEQ ID NO: 770 - DNA, 15 bp, Artificial Sequence
  dgRNA
  Rab11fip5
gcagctatatgctgg

SEQ ID NO: 771 - DNA, 15 bp, Artificial Sequence
  dgRNA
  Rab11fip5
cggggcgtgacgtcg

SEQ ID NO: 772 - DNA, 15 bp, Artificial Sequence
  dgRNA
  Rab11fip5
ggggcgtgacgtcgc

SEQ ID NO: 773 - DNA, 15 bp, Artificial Sequence
  dgRNA
  Olfr987
tcttgcgttgttgtt

SEQ ID NO: 774 - DNA, 15 bp, Artificial Sequence
  dgRNA
  Olfr987
tgatgcaacttatgt

SEQ ID NO: 775 - DNA, 15 bp, Artificial Sequence
  dgRNA
  Ppm1j
tgcggaggcgaggag

SEQ ID NO: 776 - DNA, 15 bp, Artificial Sequence
  dgRNA
  Ppm1j
tgggcaccgcccacc

SEQ ID NO: 777 - DNA, 15 bp, Artificial Sequence
  dgRNA
  Ppm1j
ggaaccctaggggcg

SEQ ID NO: 778 - DNA, 15 bp, Artificial Sequence
  dgRNA
  Ppm1j
tttcaaccatgctgt

SEQ ID NO: 779 - DNA, 15 bp, Artificial Sequence
  dgRNA
  Agk
acggaagagcagggt

SEQ ID NO: 780 - DNA, 15 bp, Artificial Sequence
  dgRNA
  Agk
gatgatgatcaggtc

SEQ ID NO: 781 - DNA, 15 bp, Artificial Sequence
  dgRNA
  Agk
tgttaaattaacgag

SEQ ID NO: 782 - DNA, 15 bp, Artificial Sequence
  dgRNA
  Crybb2
ttcatactgaaggta

SEQ ID NO: 783 - DNA, 15 bp, Artificial Sequence
  dgRNA
  Crybb2
aagaaggctgagcgc

SEQ ID NO: 784 - DNA, 15 bp, Artificial Sequence
  dgRNA
  Crybb2
ctgagcgctggaaca

SEQ ID NO: 785 - DNA, 15 bp, Artificial Sequence
  dgRNA
  Crybb2
gcgctggaacaaggt

SEQ ID NO: 786 - DNA, 15 bp, Artificial Sequence
  dgRNA
  Cym
tagttcttatcagtg

SEQ ID NO: 787 - DNA, 15 bp, Artificial Sequence
  dgRNA
  Cym
gtggtctgaagtttc

SEQ ID NO: 788 - DNA, 15 bp, Artificial Sequence
  dgRNA
  Cym
agccccgctctataa

SEQ ID NO: 789 - DNA, 15 bp, Artificial Sequence
  dgRNA
  Cym
tctataaaggccgag

SEQ ID NO: 790 - DNA, 15 bp, Artificial Sequence
  dgRNA
  1-Mar
ggagagggtcagcga

SEQ ID NO: 791 - DNA, 15 bp, Artificial Sequence
  dgRNA
  1-Mar
gaccgaaggggggga

SEQ ID NO: 792 - DNA, 15 bp, Artificial Sequence
  dgRNA
  1-Mar
aaggcagcggaaagt

SEQ ID NO: 793 - DNA, 15 bp, Artificial Sequence
  dgRNA
  1-Mar
aggcagcggaaagta

SEQ ID NO: 794 - DNA, 15 bp, Artificial Sequence
  dgRNA
  Gm5878
gtccgatttttgcct

SEQ ID NO: 795 - DNA, 15 bp, Artificial Sequence
  dgRNA
  Gm5878
atttttgccttggac

SEQ ID NO: 796 - DNA, 15 bp, Artificial Sequence
  dgRNA
  Gm5878
ggaccacttctctac

SEQ ID NO: 797 - DNA, 15 bp, Artificial Sequence
  dgRNA
  Gm5878
agagaggcggccaac

SEQ ID NO: 798 - DNA, 15 bp, Artificial Sequence
  dgRNA
  Mat2b
gcttggttgactcct

SEQ ID NO: 799 - DNA, 15 bp, Artificial Sequence
  dgRNA
  Mat2b
cctgcatccatcgct

SEQ ID NO: 800 - DNA, 15 bp, Artificial Sequence
  dgRNA
  Mat2b
gactgcgaaatgcct

SEQ ID NO: 801 - DNA, 15 bp, Artificial Sequence
  dgRNA
  Mat2b
ggaatcgattcgcct

SEQ ID NO: 802 - DNA, 15 bp, Artificial Sequence
  dgRNA
  D3Ertd751e
ctgcgactttgaaag

SEQ ID NO: 803 - DNA, 15 bp, Artificial Sequence
  dgRNA
  D3Ertd751e
ccccagaccgttcct

SEQ ID NO: 804 - DNA, 15 bp, Artificial Sequence
  dgRNA
  D3Ertd751e
accgttccttggaga

SEQ ID NO: 805 - DNA, 15 bp, Artificial Sequence
  dgRNA
  D3Ertd751e
tcatcacgcgtgcgt

SEQ ID NO: 806 - DNA, 15 bp, Artificial Sequence
  dgRNA
  Gjc1
gtcacactactctta

SEQ ID NO: 807 - DNA, 15 bp, Artificial Sequence
  dgRNA
  Gjc1
acactactcttaagg

SEQ ID NO: 808 - DNA, 15 bp, Artificial Sequence
  dgRNA
  Gjc1
tactcttaaggaggt

SEQ ID NO: 809 - DNA, 15 bp, Artificial Sequence
  dgRNA
  Gjc1
taactcaaagtccta

SEQ ID NO: 810 - DNA, 15 bp, Artificial Sequence
  dgRNA
  Rnf182
tgaatttccgtttcg

SEQ ID NO: 811 - DNA, 15 bp, Artificial Sequence
  dgRNA
  Rnf182
gaatttccgtttcga

SEQ ID NO: 812 - DNA, 15 bp, Artificial Sequence
  dgRNA
  Rnf182
gatgtggtggtgacg

SEQ ID NO: 813 - DNA, 15 bp, Artificial Sequence
  dgRNA
  Rnf182
gggaccttagagctt

SEQ ID NO: 814 - DNA, 15 bp, Artificial Sequence
  dgRNA
  Arhgap24
ccctcatgctgcatt

SEQ ID NO: 815 - DNA, 15 bp, Artificial Sequence
  dgRNA
  Arhgap24
cctcatgctgcattt

SEQ ID NO: 816 - DNA, 15 bp, Artificial Sequence
  dgRNA
  Arhgap24
cgcagccaactgcag

SEQ ID NO: 817 - DNA, 15 bp, Artificial Sequence
  dgRNA
  Arhgap24
cgcccagcattgctc

SEQ ID NO: 818 - DNA, 15 bp, Artificial Sequence
  dgRNA
  Aspscr1
ggagcctcactgttc

SEQ ID NO: 819 - DNA, 15 bp, Artificial Sequence
  dgRNA
  Aspscr1
tgccaaggggctttc

SEQ ID NO: 820 - DNA, 15 bp, Artificial Sequence
  dgRNA
  Aspscr1
gcacataaacccctc

SEQ ID NO: 821 - DNA, 15 bp, Artificial Sequence
  dgRNA
  Aspscr1
ggggttttaaacatc

SEQ ID NO: 822 - DNA, 15 bp, Artificial Sequence
  dgRNA
  Slc17a6
taggaagttggcgag

SEQ ID NO: 823 - DNA, 15 bp, Artificial Sequence
  dgRNA
  Slc17a6
aggaagttggcgagc

SEQ ID NO: 824 - DNA, 15 bp, Artificial Sequence
  dgRNA
  Slc17a6
agcttcctctgtccg

SEQ ID NO: 825 - DNA, 15 bp, Artificial Sequence
  dgRNA
  Slc17a6
cgccgcgcgcactga

SEQ ID NO: 826 - DNA, 15 bp, Artificial Sequence
  dgRNA
  Puf60
ccccccgaccagggg

SEQ ID NO: 827 - DNA, 15 bp, Artificial Sequence
  dgRNA
  Puf60
cccccgaccagggga

SEQ ID NO: 828 - DNA, 15 bp, Artificial Sequence
  dgRNA
  Puf60
gccactccaaaaccc

SEQ ID NO: 829 - DNA, 15 bp, Artificial Sequence
  dgRNA
  Puf60
cgccccgtcctcctc

SEQ ID NO: 830 - DNA, 15 bp, Artificial Sequence
  dgRNA
  Olfr1148
atgaccaaattatta

SEQ ID NO: 831 - DNA, 15 bp, Artificial Sequence
  dgRNA
  Asb11
attgccccttcatgg

SEQ ID NO: 832 - DNA, 15 bp, Artificial Sequence
  dgRNA
  Asb11
gaatcatgctttagt

SEQ ID NO: 833 - DNA, 15 bp, Artificial Sequence
  dgRNA
  Asb11
gcaattctagcataa

SEQ ID NO: 834 - DNA, 15 bp, Artificial Sequence
  dgRNA
  Asb11
agcatgattcaatcc

SEQ ID NO: 835 - DNA, 15 bp, Artificial Sequence
  dgRNA
  Aplf
gccaaccctctccta

SEQ ID NO: 836 - DNA, 15 bp, Artificial Sequence
  dgRNA
  Aplf
agcacgaatcaacct

SEQ ID NO: 837 - DNA, 15 bp, Artificial Sequence
  dgRNA
  Aplf
gcgcgtattgccttc

SEQ ID NO: 838 - DNA, 15 bp, Artificial Sequence
  dgRNA
  Aplf
cgcgtattgccttct

SEQ ID NO: 839 - DNA, 15 bp, Artificial Sequence
  dgRNA
  Ffar3
cagttctgcagcgag

SEQ ID NO: 840 - DNA, 15 bp, Artificial Sequence
  dgRNA
  Ffar3
gtggagtgacgtcat

SEQ ID NO: 841 - DNA, 15 bp, Artificial Sequence
  dgRNA
  Ffar3
gctagcttactagcc

SEQ ID NO: 842 - DNA, 15 bp, Artificial Sequence
  dgRNA
  Ffar3
gcatctctgcgcaga

SEQ ID NO: 843 - DNA, 15 bp, Artificial Sequence
  dgRNA
  Arfgef2
accacgccccaccac

SEQ ID NO: 844 - DNA, 15 bp, Artificial Sequence
  dgRNA
  Arfgef2
gctccgcctcccggc

SEQ ID NO: 845 - DNA, 15 bp, Artificial Sequence
  dgRNA
  Arfgef2
cggccccccaccctt

SEQ ID NO: 846 - DNA, 15 bp, Artificial Sequence
  dgRNA
  Arfgef2
ggccccccacccttg

SEQ ID NO: 847 - DNA, 15 bp, Artificial Sequence
  dgRNA
  Cd70
tgggcaccgagcagc

SEQ ID NO: 848 - DNA, 15 bp, Artificial Sequence
  dgRNA
  Cd70
ggctgaatgcccaat

SEQ ID NO: 849 - DNA, 15 bp, Artificial Sequence
  dgRNA
  Cd70
gaagcatccgcatcc

SEQ ID NO: 850 - DNA, 15 bp, Artificial Sequence
  dgRNA
  Cd70
gaatgctaggaaatc

SEQ ID NO: 851 - DNA, 15 bp, Artificial Sequence
  dgRNA
  Tmem258
ttaagcagctagcag

SEQ ID NO: 852 - DNA, 15 bp, Artificial Sequence
  dgRNA
  Tmem258
gtccacagcgttctc

SEQ ID NO: 853 - DNA, 15 bp, Artificial Sequence
  dgRNA
  Tmem258
gcgcgaacagcctcc

SEQ ID NO: 854 - DNA, 15 bp, Artificial Sequence
  dgRNA
  Tmem258
cgcgaacagcctcct

SEQ ID NO: 855 - DNA, 15 bp, Artificial Sequence
  dgRNA
  Ifi203
aaagtattacagcta

SEQ ID NO: 856 - DNA, 15 bp, Artificial Sequence
  dgRNA
  Ifi203
tacagctaaggtagc

SEQ ID NO: 857 - DNA, 15 bp, Artificial Sequence
  dgRNA
  Ifi203
gcttcatcaattcca

SEQ ID NO: 858 - DNA, 15 bp, Artificial Sequence
  dgRNA
  Porcn
cctcctcgcgatgct

SEQ ID NO: 859 - DNA, 15 bp, Artificial Sequence
  dgRNA
  Porcn
ctcctcgcgatgctc

SEQ ID NO: 860 - DNA, 15 bp, Artificial Sequence
  dgRNA
  Porcn
cgggctcactcctcc

SEQ ID NO: 861 - DNA, 15 bp, Artificial Sequence
  dgRNA
  Porcn
ctcccgctttcggat

SEQ ID NO: 862 - DNA, 15 bp, Artificial Sequence
  dgRNA
  Zfp773
gaagagcttaaccaa

SEQ ID NO: 863 - DNA, 15 bp, Artificial Sequence
  dgRNA
  Zfp773
gtaaagtggattcct

SEQ ID NO: 864 - DNA, 15 bp, Artificial Sequence
  dgRNA
  Zfp773
agtaaagtggattcc

SEQ ID NO: 865 - DNA, 15 bp, Artificial Sequence
  dgRNA
  Zfp773
gggaagcgatatgta

SEQ ID NO: 866 - DNA, 15 bp, Artificial Sequence
  dgRNA
  Fgf10
tgacatttagactcc

SEQ ID NO: 867 - DNA, 15 bp, Artificial Sequence
  dgRNA
  Fgf10
gggtcaaacggcggt

SEQ ID NO: 868 - DNA, 15 bp, Artificial Sequence
  dgRNA
  Fgf10
ggggtcaaacggcgg

SEQ ID NO: 869 - DNA, 15 bp, Artificial Sequence
  dgRNA
  Fgf10
gagggggtcaaacgg

SEQ ID NO: 870 - DNA, 15 bp, Artificial Sequence
  dgRNA
  Rad9b
aatgagacgcgaagt

SEQ ID NO: 871 - DNA, 15 bp, Artificial Sequence
  dgRNA
  Rad9b
agagcctgtcttacg

SEQ ID NO: 872 - DNA, 15 bp, Artificial Sequence
  dgRNA
  Rad9b
gagcctgtcttacgg

SEQ ID NO: 873 - DNA, 15 bp, Artificial Sequence
  dgRNA
  Rad9b
ttacgggggcccgta

SEQ ID NO: 874 - DNA, 15 bp, Artificial Sequence
  dgRNA
  Hbb-y
gaccctcccatgacc

SEQ ID NO: 875 - DNA, 15 bp, Artificial Sequence
  dgRNA
  Hbb-y
tgaggaccacgggtc

SEQ ID NO: 876 - DNA, 15 bp, Artificial Sequence
  dgRNA
  Hbb-y
gcacattagatatgg

SEQ ID NO: 877 - DNA, 15 bp, Artificial Sequence
  dgRNA
  Hbb-y
aatgcacattagata

SEQ ID NO: 878 - DNA, 15 bp, Artificial Sequence
  dgRNA
  Secisbp2l
cccaacctgcctagg

SEQ ID NO: 879 - DNA, 15 bp, Artificial Sequence
  dgRNA
  Secisbp2l
ccaacctgcctaggt

SEQ ID NO: 880 - DNA, 15 bp, Artificial Sequence
  dgRNA
  Secisbp2l
aggagtaacccaacc

SEQ ID NO: 881 - DNA, 15 bp, Artificial Sequence
  dgRNA
  Secisbp2l
gcccccgtcgctcct

SEQ ID NO: 882 - DNA, 15 bp, Artificial Sequence
  dgRNA
  Fxyd5
ctcgtattcactctg

SEQ ID NO: 883 - DNA, 15 bp, Artificial Sequence
  dgRNA
  Fxyd5
tcgtattcactctgt

SEQ ID NO: 884 - DNA, 15 bp, Artificial Sequence
  dgRNA
  Fxyd5
gagcgcctccattgc

SEQ ID NO: 885 - DNA, 15 bp, Artificial Sequence
  dgRNA
  Fxyd5
atgatctgcccatca

SEQ ID NO: 886 - DNA, 15 bp, Artificial Sequence
  dgRNA
  Prkcb
ccagctacgcgcgcg

SEQ ID NO: 887 - DNA, 15 bp, Artificial Sequence
  dgRNA
  Prkcb
ggccgccgccagagc

SEQ ID NO: 888 - DNA, 15 bp, Artificial Sequence
  dgRNA
  Prkcb
ccagagccggcgcga

SEQ ID NO: 889 - DNA, 15 bp, Artificial Sequence
  dgRNA
  Prkcb
cagagccggcgcgaa

SEQ ID NO: 890 - DNA, 15 bp, Artificial Sequence
  dgRNA
  Mxra8
ggaatcttcacatcc

SEQ ID NO: 891 - DNA, 15 bp, Artificial Sequence
  dgRNA
  Mxra8
ctcgtcttctgtccc

SEQ ID NO: 892 - DNA, 15 bp, Artificial Sequence
  dgRNA
  Mxra8
accctcccaccaact

SEQ ID NO: 893 - DNA, 15 bp, Artificial Sequence
  dgRNA
  Mxra8
cccaccaactgggcc

SEQ ID NO: 894 - DNA, 15 bp, Artificial Sequence
  dgRNA
  Zfp830
acagccaaggccgct

SEQ ID NO: 895 - DNA, 15 bp, Artificial Sequence
  dgRNA
  Zfp830
aaggccgcttggctc

SEQ ID NO: 896 - DNA, 15 bp, Artificial Sequence
  dgRNA
  Zfp830
ggtcacttcagcgcc

SEQ ID NO: 897 - DNA, 15 bp, Artificial Sequence
  dgRNA
  Zfp830
ttttgatcgcagcca

SEQ ID NO: 898 - DNA, 15 bp, Artificial Sequence
  dgRNA
  Ccdc125
aaagtcttcggttaa

SEQ ID NO: 899 - DNA, 15 bp, Artificial Sequence
  dgRNA
  Ccdc125
ttcggttaagggtat

SEQ ID NO: 900 - DNA, 15 bp, Artificial Sequence
  dgRNA
  Ccdc125
gaagttgatccagta

SEQ ID NO: 901 - DNA, 15 bp, Artificial Sequence
  dgRNA
  Ccdc125
gttgatccagtatgg

SEQ ID NO: 902 - DNA, 15 bp, Artificial Sequence
  dgRNA
  Kcnma1
cagcgccccgagccc

SEQ ID NO: 903 - DNA, 15 bp, Artificial Sequence
  dgRNA
  Kcnma1
cctcccggcgctccg

SEQ ID NO: 904 - DNA, 15 bp, Artificial Sequence
  dgRNA
  Kcnma1
cccggcgctccgcgg

SEQ ID NO: 905 - DNA, 15 bp, Artificial Sequence
  dgRNA
  Kcnma1
ggcgctccgcggcgg

SEQ ID NO: 906 - DNA, 15 bp, Artificial Sequence
  dgRNA
  Pbld2
gctaaaacttgttag

SEQ ID NO: 907 - DNA, 15 bp, Artificial Sequence
  dgRNA
  Pbld2
gattggtatctctaa

SEQ ID NO: 908 - DNA, 15 bp, Artificial Sequence
  dgRNA
  Pbld2
taaaggtaaccatat

SEQ ID NO: 909 - DNA, 15 bp, Artificial Sequence
  dgRNA
  Pbld2
gtaaccatattggca

SEQ ID NO: 910 - DNA, 15 bp, Artificial Sequence
  dgRNA
  Ing3
tttcccagaataccg

SEQ ID NO: 911 - DNA, 15 bp, Artificial Sequence
  dgRNA
  Ing3
cgcggagatccgcac

SEQ ID NO: 912 - DNA, 15 bp, Artificial Sequence
  dgRNA
  Ing3
gagatccgcaccggc

SEQ ID NO: 913 - DNA, 15 bp, Artificial Sequence
  dgRNA
  Ing3
agccaatagcaacgg

SEQ ID NO: 914 - DNA, 15 bp, Artificial Sequence
  dgRNA
  Tmem247
ctaccgtgtaagcct

SEQ ID NO: 915 - DNA, 15 bp, Artificial Sequence
  dgRNA
  Tmem247
taccgtgtaagcctc

SEQ ID NO: 916 - DNA, 15 bp, Artificial Sequence
  dgRNA
  Tmem247
accgtgtaagcctcg

SEQ ID NO: 917 - DNA, 15 bp, Artificial Sequence
  dgRNA
  Tmem247
ctcggggattaaatt

SEQ ID NO: 918 - DNA, 15 bp, Artificial Sequence
  dgRNA
  Apba1
cacgcgcgcccgagc

SEQ ID NO: 919 - DNA, 15 bp, Artificial Sequence
  dgRNA
  Apba1
gctggactgtcgcgt

SEQ ID NO: 920 - DNA, 15 bp, Artificial Sequence
  dgRNA
  Apba1
ctggactgtcgcgtc

SEQ ID NO: 921 - DNA, 15 bp, Artificial Sequence
  dgRNA
  Apba1
gcacgcgggtgggcg

SEQ ID NO: 922 - DNA, 15 bp, Artificial Sequence
  dgRNA
  C330021F23Rik
gaccaaccgtaaagt

SEQ ID NO: 923 - DNA, 15 bp, Artificial Sequence
  dgRNA
  C330021F23Rik
accaaccgtaaagta

SEQ ID NO: 924 - DNA, 15 bp, Artificial Sequence
  dgRNA
  C330021F23Rik
tccctactttacggt

SEQ ID NO: 925 - DNA, 15 bp, Artificial Sequence
  dgRNA
  Zfp398
atgggaaacccgagt

SEQ ID NO: 926 - DNA, 15 bp, Artificial Sequence
  dgRNA
  Zfp398
gaaacccgagtaggt

SEQ ID NO: 927 - DNA, 15 bp, Artificial Sequence
  dgRNA
  Zfp398
tctgggaaggcgctc

SEQ ID NO: 928 - DNA, 15 bp, Artificial Sequence
  dgRNA
  Zfp398
aaggcgctccggatg

SEQ ID NO: 929 - DNA, 15 bp, Artificial Sequence
  dgRNA
  Npy
cttctccccgcagag

SEQ ID NO: 930 - DNA, 15 bp, Artificial Sequence
  dgRNA
  Npy
cgggccgcttagaat

SEQ ID NO: 931 - DNA, 15 bp, Artificial Sequence
  dgRNA
  Npy
gggccgcttagaatt

SEQ ID NO: 932 - DNA, 15 bp, Artificial Sequence
  dgRNA
  Npy
ggccgcttagaattg

SEQ ID NO: 933 - DNA, 15 bp, Artificial Sequence
  dgRNA
  Atp9a
atttaggaatgcagc

SEQ ID NO: 934 - DNA, 15 bp, Artificial Sequence
  dgRNA
  Atp9a
gggattgatgccaca

SEQ ID NO: 935 - DNA, 15 bp, Artificial Sequence
  dgRNA
  Atp9a
ccccggcccgaaact

SEQ ID NO: 936 - DNA, 15 bp, Artificial Sequence
  dgRNA
  Atp9a
cccggcccgaaactc

SEQ ID NO: 937 - DNA, 15 bp, Artificial Sequence
  dgRNA
  Fam57b
cgaactacatttggc

SEQ ID NO: 938 - DNA, 15 bp, Artificial Sequence
  dgRNA
  Fam57b
gaactacatttggca

SEQ ID NO: 939 - DNA, 15 bp, Artificial Sequence
  dgRNA
  Fam57b
gaaagttaactgggc

SEQ ID NO: 940 - DNA, 15 bp, Artificial Sequence
  dgRNA
  Fam57b
ctgggggtaattcag

SEQ ID NO: 941 - DNA, 15 bp, Artificial Sequence
  dgRNA
  Mark2
gctgactaccgctct

SEQ ID NO: 942 - DNA, 15 bp, Artificial Sequence
  dgRNA
  Mark2
ctctcggccgagcga

SEQ ID NO: 943 - DNA, 15 bp, Artificial Sequence
  dgRNA
  Mark2
ggccgagcgacggaa

SEQ ID NO: 944 - DNA, 15 bp, Artificial Sequence
  dgRNA
  Mark2
gccgagcgacggaac

SEQ ID NO: 945 - DNA, 15 bp, Artificial Sequence
  dgRNA
  Ascc1
ttccgagaacacttc

SEQ ID NO: 946 - DNA, 15 bp, Artificial Sequence
  dgRNA
  Ascc1
tccgagaacacttcc

SEQ ID NO: 947 - DNA, 15 bp, Artificial Sequence
  dgRNA
  Ascc1
acttccgggtcgctg

SEQ ID NO: 948 - DNA, 15 bp, Artificial Sequence
  dgRNA
  Ascc1
ttggttttcttgcgt

SEQ ID NO: 949 - DNA, 15 bp, Artificial Sequence
  dgRNA
  Parp10
accccactagctaag

SEQ ID NO: 950 - DNA, 15 bp, Artificial Sequence
  dgRNA
  Parp10
tagctaagaggctag

SEQ ID NO: 951 - DNA, 15 bp, Artificial Sequence
  dgRNA
  Parp10
agctaagaggctagt

SEQ ID NO: 952 - DNA, 15 bp, Artificial Sequence
  dgRNA
  Parp10
ggtggttcggcagaa

SEQ ID NO: 953 - DNA, 15 bp, Artificial Sequence
  dgRNA
  Eno1b
gcgagagaggtgcca

SEQ ID NO: 954 - DNA, 15 bp, Artificial Sequence
  dgRNA
  Eno1b
gggcgatacaagtaa

SEQ ID NO: 955 - DNA, 15 bp, Artificial Sequence
  dgRNA
  Eno1b
cgatacaagtaaagg

SEQ ID NO: 956 - DNA, 15 bp, Artificial Sequence
  dgRNA
  Ccr6
tcacattcaaggtcg

SEQ ID NO: 957 - DNA, 15 bp, Artificial Sequence
  dgRNA
  Ccr6
ttctgtagtgcggaa

SEQ ID NO: 958 - DNA, 15 bp, Artificial Sequence
  dgRNA
  Ccr6
agccagtccgggccc

SEQ ID NO: 959 - DNA, 15 bp, Artificial Sequence
  dgRNA
  Ccr6
gccagtccgggccct

SEQ ID NO: 960 - DNA, 15 bp, Artificial Sequence
  dgRNA
  Ephb4
cgggctccagggtgt

SEQ ID NO: 961 - DNA, 15 bp, Artificial Sequence
  dgRNA
  Ephb4
gactcagtctcgact

SEQ ID NO: 962 - DNA, 15 bp, Artificial Sequence
  dgRNA
  Ephb4
gactcggcccagccc

SEQ ID NO: 963 - DNA, 15 bp, Artificial Sequence
  dgRNA
  Ephb4
gcacggggagctgat

SEQ ID NO: 964 - DNA, 15 bp, Artificial Sequence
  dgRNA
  Cd38
gttcacccaaatgcc

SEQ ID NO: 965 - DNA, 15 bp, Artificial Sequence
  dgRNA
  Slc39a7
ctcaagagccgcgct

SEQ ID NO: 966 - DNA, 15 bp, Artificial Sequence
  dgRNA
  Slc39a7
gagccgcgctcggct

SEQ ID NO: 967 - DNA, 15 bp, Artificial Sequence
  dgRNA
  Slc39a7
atgacagcaccggcg

SEQ ID NO: 968 - DNA, 15 bp, Artificial Sequence
  dgRNA
  Slc39a7
gccccttcgccgagg

SEQ ID NO: 969 - DNA, 15 bp, Artificial Sequence
  dgRNA
  Nudt8
tcagcaggcctcgtc

SEQ ID NO: 970 - DNA, 15 bp, Artificial Sequence
  dgRNA
  Nudt8
tctggaacgcctccg

SEQ ID NO: 971 - DNA, 15 bp, Artificial Sequence
  dgRNA
  Nudt8
ccttgtccatctcgg

SEQ ID NO: 972 - DNA, 15 bp, Artificial Sequence
  dgRNA
  Nudt8
ctcggaggctctacc

SEQ ID NO: 973 - DNA, 15 bp, Artificial Sequence
  dgRNA
  Tsen2
ctcattagacttagc

SEQ ID NO: 974 - DNA, 15 bp, Artificial Sequence
  dgRNA
  Tsen2
tcattagacttagcc

SEQ ID NO: 975 - DNA, 15 bp, Artificial Sequence
  dgRNA
  Tsen2
cattagacttagccg

SEQ ID NO: 976 - DNA, 15 bp, Artificial Sequence
  dgRNA
  Tsen2
attagacttagccgg

SEQ ID NO: 977 - DNA, 15 bp, Artificial Sequence
  dgRNA
  Slc25a21
atattgtgcgcagcg

SEQ ID NO: 978 - DNA, 15 bp, Artificial Sequence
  dgRNA
  Slc25a21
ataacaagtccttta

SEQ ID NO: 979 - DNA, 15 bp, Artificial Sequence
  dgRNA
  Slc25a21
gaaagccgagttctt

SEQ ID NO: 980 - DNA, 15 bp, Artificial Sequence
  dgRNA
  Slc25a21
cgggggaagtggttt

SEQ ID NO: 981 - DNA, 15 bp, Artificial Sequence
  dgRNA
  Olfr906
actctattccactca

SEQ ID NO: 982 - DNA, 15 bp, Artificial Sequence
  dgRNA
  Olfr906
tatcatgaccatgag

SEQ ID NO: 983 - DNA, 15 bp, Artificial Sequence
  dgRNA
  Htatip2
caactagggttatgg

SEQ ID NO: 984 - DNA, 15 bp, Artificial Sequence
  dgRNA
  Htatip2
ggttatgggggacgg

SEQ ID NO: 985 - DNA, 15 bp, Artificial Sequence
  dgRNA
  Htatip2
gttatgggggacgga

SEQ ID NO: 986 - DNA, 15 bp, Artificial Sequence
  dgRNA
  Htatip2
gtgtggttcgagccc

SEQ ID NO: 987 - DNA, 15 bp, Artificial Sequence
  dgRNA
  Tlx2
tcccctttaacagcg

SEQ ID NO: 988 - DNA, 15 bp, Artificial Sequence
  dgRNA
  Tlx2
tctccacaccggact

SEQ ID NO: 989 - DNA, 15 bp, Artificial Sequence
  dgRNA
  Tlx2
ctccacaccggactc

SEQ ID NO: 990 - DNA, 15 bp, Artificial Sequence
  dgRNA
  Tlx2
accggactcgggcag

SEQ ID NO: 991 - DNA, 15 bp, Artificial Sequence
  dgRNA
  Pqbp1
gcactgtgccaatga

SEQ ID NO: 992 - DNA, 15 bp, Artificial Sequence
  dgRNA
  Pqbp1
atcgcacagttgtac

SEQ ID NO: 993 - DNA, 15 bp, Artificial Sequence
  dgRNA
  Pqbp1
acagttgtactggta

SEQ ID NO: 994 - DNA, 15 bp, Artificial Sequence
  dgRNA
  Pqbp1
ttgtactggtaaggc

SEQ ID NO: 995 - DNA, 15 bp, Artificial Sequence
  dgRNA
  Gdf2
gggtggatgaccctc

SEQ ID NO: 996 - DNA, 15 bp, Artificial Sequence
  dgRNA
  Gdf2
cggcatttctccgga

SEQ ID NO: 997 - DNA, 15 bp, Artificial Sequence
  dgRNA
  Gdf2
tcggcatttctccgg

SEQ ID NO: 998 - DNA, 15 bp, Artificial Sequence
  dgRNA
  Gdf2
ggatcggcatttctc

SEQ ID NO: 999 - DNA, 15 bp, Artificial Sequence
  dgRNA
  Cadm1
gtccgccgcggcgag

SEQ ID NO: 1000 - DNA, 15 bp, Artificial Sequence
  dgRNA
  Cadm1
cggcgagtggcgtaa

SEQ ID NO: 1001 - DNA, 15 bp, Artificial Sequence
  dgRNA
  Cadm1
ccccagccaccgagc

SEQ ID NO: 1002 - DNA, 15 bp, Artificial Sequence
  dgRNA
  Cadm1
ccaccgagccggacg

SEQ ID NO: 1003 - DNA, 15 bp, Artificial Sequence
  dgRNA
  Acta1
tgcaggagacccggg

SEQ ID NO: 1004 - DNA, 15 bp, Artificial Sequence
  dgRNA
  Acta1
caggagacccgggcg

SEQ ID NO: 1005 - DNA, 15 bp, Artificial Sequence
  dgRNA
  Acta1
ctgagaaccagccga

SEQ ID NO: 1006 - DNA, 15 bp, Artificial Sequence
  dgRNA
  Acta1
gaaccagccgaagga

SEQ ID NO: 1007 - DNA, 15 bp, Artificial Sequence
  dgRNA
  Gp5
ctagaatatgcccta

SEQ ID NO: 1008 - DNA, 15 bp, Artificial Sequence
  dgRNA
  Gp5
actttttatctggta

SEQ ID NO: 1009 - DNA, 15 bp, Artificial Sequence
  dgRNA
  Gp5
catagggcatattct

SEQ ID NO: 1010 - DNA, 15 bp, Artificial Sequence
  dgRNA
  Gp5
aagactatctccata

SEQ ID NO: 1011 - DNA, 15 bp, Artificial Sequence
  dgRNA
  Ptrh2
tctcacacccgccgc

SEQ ID NO: 1012 - DNA, 15 bp, Artificial Sequence
  dgRNA
  Ptrh2
ctcacacccgccgct

SEQ ID NO: 1013 - DNA, 15 bp, Artificial Sequence
  dgRNA
  Ptrh2
cgctcgcgtcacttc

SEQ ID NO: 1014 - DNA, 15 bp, Artificial Sequence
  dgRNA
  Ptrh2
gcgtcacttccggtc

SEQ ID NO: 1015 - DNA, 15 bp, Artificial Sequence
  dgRNA
  Uros
gcgactagaaagctc

SEQ ID NO: 1016 - DNA, 15 bp, Artificial Sequence
  dgRNA
  Uros
gactagaaagctccg

SEQ ID NO: 1017 - DNA, 15 bp, Artificial Sequence
  dgRNA
  Uros
ctgcgttccttccgc

SEQ ID NO: 1018 - DNA, 15 bp, Artificial Sequence
  dgRNA
  Uros
gtcgcgccggatccg

SEQ ID NO: 1019 - DNA, 15 bp, Artificial Sequence
  dgRNA
  Ubr2
gtcaagcccctctca

SEQ ID NO: 1020 - DNA, 15 bp, Artificial Sequence
  dgRNA
  Ubr2
ttccaggcttccgcc

SEQ ID NO: 1021 - DNA, 15 bp, Artificial Sequence
  dgRNA
  Ubr2
tccaggcttccgcca

SEQ ID NO: 1022 - DNA, 15 bp, Artificial Sequence
  dgRNA
  Ubr2
ccaggcttccgccag

SEQ ID NO: 1023 - DNA, 15 bp, Artificial Sequence
  dgRNA
  Wdr17
ctccaatcagatact

SEQ ID NO: 1024 - DNA, 15 bp, Artificial Sequence
  dgRNA
  Wdr17
tccaatcagatacta

SEQ ID NO: 1025 - DNA, 15 bp, Artificial Sequence
  dgRNA
  Wdr17
tgtcacgtgcaattc

SEQ ID NO: 1026 - DNA, 15 bp, Artificial Sequence
  dgRNA
  Wdr17
gtcacgtgcaattct

SEQ ID NO: 1027 - DNA, 15 bp, Artificial Sequence
  dgRNA
  Ccdc39
cagatttgcacgttt

SEQ ID NO: 1028 - DNA, 15 bp, Artificial Sequence
  dgRNA
  Ccdc39
acgttttggaagtcc

SEQ ID NO: 1029 - DNA, 15 bp, Artificial Sequence
  dgRNA
  Ccdc39
cgttttggaagtcct

SEQ ID NO: 1030 - DNA, 15 bp, Artificial Sequence
  dgRNA
  Ccdc39
gcaagcaaattctac

SEQ ID NO: 1031 - DNA, 15 bp, Artificial Sequence
  dgRNA
  Chil6
tatggccttggaata

SEQ ID NO: 1032 - DNA, 15 bp, Artificial Sequence
  dgRNA
  Chil6
atggccttggaatat

SEQ ID NO: 1033 - DNA, 15 bp, Artificial Sequence
  dgRNA
  Chil6
tggccttggaatatg

SEQ ID NO: 1034 - DNA, 15 bp, Artificial Sequence
  dgRNA
  Chil6
cagaattttcatacc

SEQ ID NO: 1035 - DNA, 15 bp, Artificial Sequence
  dgRNA
  Hhatl
tctttgtgcggtgcc

SEQ ID NO: 1036 - DNA, 15 bp, Artificial Sequence
  dgRNA
  Vmn2r70
ataaatactggtatc

SEQ ID NO: 1037 - DNA, 15 bp, Artificial Sequence
  dgRNA
  Vmn2r70
atactggtatctgga

SEQ ID NO: 1038 - DNA, 15 bp, Artificial Sequence
  dgRNA
  Vmn2r70
tactggtatctggat

SEQ ID NO: 1039 - DNA, 15 bp, Artificial Sequence
  dgRNA
  Hibadh
acacccctcagcttt

SEQ ID NO: 1040 - DNA, 15 bp, Artificial Sequence
  dgRNA
  Hibadh
aaggcagggcgtcta

SEQ ID NO: 1041 - DNA, 15 bp, Artificial Sequence
  dgRNA
  Hibadh
ggcgtctatggattt

SEQ ID NO: 1042 - DNA, 15 bp, Artificial Sequence
  dgRNA
  Hibadh
gcgtctatggatttc

SEQ ID NO: 1043 - DNA, 15 bp, Artificial Sequence
  dgRNA
  Htr6
ttacccgagtactcc

SEQ ID NO: 1044 - DNA, 15 bp, Artificial Sequence
  dgRNA
  Htr6
cccgagtactccagg

SEQ ID NO: 1045 - DNA, 15 bp, Artificial Sequence
  dgRNA
  Htr6
aggtggccccgccat

SEQ ID NO: 1046 - DNA, 15 bp, Artificial Sequence
  dgRNA
  Htr6
tggccccgccatagg

SEQ ID NO: 1047 - DNA, 15 bp, Artificial Sequence
  dgRNA
  Clcc1
cagaggagcgcggcc

SEQ ID NO: 1048 - DNA, 15 bp, Artificial Sequence
  dgRNA
  Clcc1
aatcagcaacgcgcg

SEQ ID NO: 1049 - DNA, 15 bp, Artificial Sequence
  dgRNA
  Clcc1
atcagcaacgcgcgc

SEQ ID NO: 1050 - DNA, 15 bp, Artificial Sequence
  dgRNA
  Clcc1
gcaacgcgcgcggga

SEQ ID NO: 1051 - DNA, 15 bp, Artificial Sequence
  dgRNA
  Gm4787
ggggcttctgccata

SEQ ID NO: 1052 - DNA, 15 bp, Artificial Sequence
  dgRNA
  Spopl
gggaaaacttcctat

SEQ ID NO: 1053 - DNA, 15 bp, Artificial Sequence
  dgRNA
  Spopl
ctatcggtagttgcg

SEQ ID NO: 1054 - DNA, 15 bp, Artificial Sequence
  dgRNA
  Spopl
tagttgcgaggtata

SEQ ID NO: 1055 - DNA, 15 bp, Artificial Sequence
  dgRNA
  Spopl
agttgcgaggtatat

SEQ ID NO: 1056 - DNA, 15 bp, Artificial Sequence
  dgRNA
  Prss56
ctttgaagcaaccgc

SEQ ID NO: 1057 - DNA, 15 bp, Artificial Sequence
  dgRNA
  Prss56
gcaaccgcaggaaca

SEQ ID NO: 1058 - DNA, 15 bp, Artificial Sequence
  dgRNA
  Prss56
caaccgcaggaacaa

SEQ ID NO: 1059 - DNA, 15 bp, Artificial Sequence
  dgRNA
  Prss56
ccgctttcacagaag

SEQ ID NO: 1060 - DNA, 15 bp, Artificial Sequence
  dgRNA
  Spg20
ctcagtgcccgaccc

SEQ ID NO: 1061 - DNA, 15 bp, Artificial Sequence
  dgRNA
  Spg20
acccaggtctccccc

SEQ ID NO: 1062 - DNA, 15 bp, Artificial Sequence
  dgRNA
  Spg20
aagctgtcattgccg

SEQ ID NO: 1063 - DNA, 15 bp, Artificial Sequence
  dgRNA
  Spg20
ttgccgtggcactgc

SEQ ID NO: 1064 - DNA, 15 bp, Artificial Sequence
  dgRNA
  Rab34
tggaaggaggctcga

SEQ ID NO: 1065 - DNA, 15 bp, Artificial Sequence
  dgRNA
  Rab34
ggaaggaggctcgac

SEQ ID NO: 1066 - DNA, 15 bp, Artificial Sequence
  dgRNA
  Rab34
cagatctgggacgtc

SEQ ID NO: 1067 - DNA, 15 bp, Artificial Sequence
  dgRNA
  Rab34
acgtctggtccttag

SEQ ID NO: 1068 - DNA, 15 bp, Artificial Sequence
  dgRNA
  Epb41l1
tactcgcacaccctt

SEQ ID NO: 1069 - DNA, 15 bp, Artificial Sequence
  dgRNA
  Epb41l1
ccttcggacgctgcc

SEQ ID NO: 1070 - DNA, 15 bp, Artificial Sequence
  dgRNA
  Epb41l1
gggggctgagcgccg

SEQ ID NO: 1071 - DNA, 15 bp, Artificial Sequence
  dgRNA
  Epb41l1
ggggctgagcgccgt

SEQ ID NO: 1072 - DNA, 15 bp, Artificial Sequence
  dgRNA
  Rbm17
ttgggagtgaatacc

SEQ ID NO: 1073 - DNA, 15 bp, Artificial Sequence
  dgRNA
  Rbm17
tacctggagcctagt

SEQ ID NO: 1074 - DNA, 15 bp, Artificial Sequence
  dgRNA
  Rbm17
gcctagtaggggatt

SEQ ID NO: 1075 - DNA, 15 bp, Artificial Sequence
  dgRNA
  Rbm17
tcggctcctactcca

SEQ ID NO: 1076 - DNA, 15 bp, Artificial Sequence
  dgRNA
  Tacstd2
gttttggtcagcaga

SEQ ID NO: 1077 - DNA, 15 bp, Artificial Sequence
  dgRNA
  Tacstd2
tgccggcttcttccg

SEQ ID NO: 1078 - DNA, 15 bp, Artificial Sequence
  dgRNA
  Tacstd2
gccggcttcttccgc

SEQ ID NO: 1079 - DNA, 15 bp, Artificial Sequence
  dgRNA
  Tacstd2
ttcttccgcgggacc

SEQ ID NO: 1080 - DNA, 15 bp, Artificial Sequence
  dgRNA
  Vcan
tgagactgcacagcg

SEQ ID NO: 1081 - DNA, 15 bp, Artificial Sequence
  dgRNA
  Vcan
gactgcacagcgagg

SEQ ID NO: 1082 - DNA, 15 bp, Artificial Sequence
  dgRNA
  Vcan
ccgagtcgttgaatg

SEQ ID NO: 1083 - DNA, 15 bp, Artificial Sequence
  dgRNA
  Vcan
ccacccccagccgat

SEQ ID NO: 1084 - DNA, 15 bp, Artificial Sequence
  dgRNA
  Cd6
cttggaagaccctca

SEQ ID NO: 1085 - DNA, 15 bp, Artificial Sequence
  dgRNA
  Cd6
cagggatgcgttcat

SEQ ID NO: 1086 - DNA, 15 bp, Artificial Sequence
  dgRNA
  Cd6
tgcgttcattggaca

SEQ ID NO: 1087 - DNA, 15 bp, Artificial Sequence
  dgRNA
  Cd6
tgaacgcatccctga

SEQ ID NO: 1088 - DNA, 15 bp, Artificial Sequence
  dgRNA
  Mettl21a
accgtagggcctcac

SEQ ID NO: 1089 - DNA, 15 bp, Artificial Sequence
  dgRNA
  Mettl21a
ggaactacacagcac

SEQ ID NO: 1090 - DNA, 15 bp, Artificial Sequence
  dgRNA
  Mettl21a
acacagcacgggcca

SEQ ID NO: 1091 - DNA, 15 bp, Artificial Sequence
  dgRNA
  Mettl21a
gccaggggaaagcgg

SEQ ID NO: 1092 - DNA, 15 bp, Artificial Sequence
  dgRNA
  Mbnl1
ttccgtctaaccttg

SEQ ID NO: 1093 - DNA, 15 bp, Artificial Sequence
  dgRNA
  Mbnl1
tccgtctaaccttgc

SEQ ID NO: 1094 - DNA, 15 bp, Artificial Sequence
  dgRNA
  Mbnl1
accttgcgggcctcg

SEQ ID NO: 1095 - DNA, 15 bp, Artificial Sequence
  dgRNA
  Mbnl1
tgggcgcggagcccc

SEQ ID NO: 1096 - DNA, 15 bp, Artificial Sequence
  dgRNA
  Snrpg
ctatagtaggatctg

SEQ ID NO: 1097 - DNA, 15 bp, Artificial Sequence
  dgRNA
  Snrpg
cctcccctggcgcgc

SEQ ID NO: 1098 - DNA, 15 bp, Artificial Sequence
  dgRNA
  Snrpg
cctgcgcgccagggg

SEQ ID NO: 1099 - DNA, 15 bp, Artificial Sequence
  dgRNA
  Snrpg
acacctgcgcgccag

SEQ ID NO: 1100 - DNA, 15 bp, Artificial Sequence
  dgRNA
  Gm14920
catagtacggtacaa

SEQ ID NO: 1101 - DNA, 15 bp, Artificial Sequence
  dgRNA
  Gm14920
atagtacggtacaaa

SEQ ID NO: 1102 - DNA, 15 bp, Artificial Sequence
  dgRNA
  Lingo2
tttcaccaaccgcat

SEQ ID NO: 1103 - DNA, 15 bp, Artificial Sequence
  dgRNA
  Lingo2
ttactatgaacaatc

SEQ ID NO: 1104 - DNA, 15 bp, Artificial Sequence
  dgRNA
  Lingo2
tgctagtaatatccg

SEQ ID NO: 1105 - DNA, 15 bp, Artificial Sequence
  dgRNA
  Lingo2
ctgctagtaatatcc

SEQ ID NO: 1106 - DNA, 15 bp, Artificial Sequence
  dgRNA
  Htr1f
aacagataatctcca

SEQ ID NO: 1107 - DNA, 15 bp, Artificial Sequence
  dgRNA
  Htr1f
tctccaaggtatcag

SEQ ID NO: 1108 - DNA, 15 bp, Artificial Sequence
  dgRNA
  Htr1f
atcagtccaagggga

SEQ ID NO: 1109 - DNA, 15 bp, Artificial Sequence
  dgRNA
  Htr1f
tctgttcgggaaatc

SEQ ID NO: 1110 - DNA, 15 bp, Artificial Sequence
  dgRNA
  Gdf9
tagggtgacgatact

SEQ ID NO: 1111 - DNA, 15 bp, Artificial Sequence
  dgRNA
  Gdf9
ggtgacgatacttgg

SEQ ID NO: 1112 - DNA, 15 bp, Artificial Sequence
  dgRNA
  Gdf9
gtgacgatacttggt

SEQ ID NO: 1113 - DNA, 15 bp, Artificial Sequence
  dgRNA
  Gdf9
agctaggcatgcttg

SEQ ID NO: 1114 - DNA, 15 bp, Artificial Sequence
  dgRNA
  Asb2
ccctaaagtagaggc

SEQ ID NO: 1115 - DNA, 15 bp, Artificial Sequence
  dgRNA
  Asb2
tacccaggcgggagc

SEQ ID NO: 1116 - DNA, 15 bp, Artificial Sequence
  dgRNA
  Asb2
tagaactacccaggc

SEQ ID NO: 1117 - DNA, 15 bp, Artificial Sequence
  dgRNA
  Rangap1
gagccagaagccgag

SEQ ID NO: 1118 - DNA, 15 bp, Artificial Sequence
  dgRNA
  Rangap1
gccgagagggcggag

SEQ ID NO: 1119 - DNA, 15 bp, Artificial Sequence
  dgRNA
  Rangap1
gagcgctctgcatca

SEQ ID NO: 1120 - DNA, 15 bp, Artificial Sequence
  dgRNA
  Rangap1
ccgccatgccagcgc

SEQ ID NO: 1121 - DNA, 15 bp, Artificial Sequence
  dgRNA
  Krtap10-4
agcacacaagatgtc

SEQ ID NO: 1122 - DNA, 15 bp, Artificial Sequence
  dgRNA
  Krtap10-4
ggaaggagtgctcat

SEQ ID NO: 1123 - DNA, 15 bp, Artificial Sequence
  dgRNA
  Krtap10-4
tgcttgttgatcacg

SEQ ID NO: 1124 - DNA, 15 bp, Artificial Sequence
  dgRNA
  Krtap10-4
atgtttagtctcatc

SEQ ID NO: 1125 - DNA, 15 bp, Artificial Sequence
  dgRNA
  Tmem52b
accattgttagcacc

SEQ ID NO: 1126 - DNA, 15 bp, Artificial Sequence
  dgRNA
  Tmem52b
tacctactctaaagt

SEQ ID NO: 1127 - DNA, 15 bp, Artificial Sequence
  dgRNA
  Tmem52b
acctactctaaagta

SEQ ID NO: 1128 - DNA, 15 bp, Artificial Sequence
  dgRNA
  Tmem52b
ggttgattatcaaca

SEQ ID NO: 1129 - DNA, 15 bp, Artificial Sequence
  dgRNA
  Ctsq
gccaatcaaaagtag

SEQ ID NO: 1130 - DNA, 15 bp, Artificial Sequence
  dgRNA
  Ctsq
ctagattaagcctct

SEQ ID NO: 1131 - DNA, 15 bp, Artificial Sequence
  dgRNA
  Ctsq
gcccctacttttgat

SEQ ID NO: 1132 - DNA, 15 bp, Artificial Sequence
  dgRNA
  Bag5
ggcgtcccgcttacc

SEQ ID NO: 1133 - DNA, 15 bp, Artificial Sequence
  dgRNA
  Bag5
tcccgcttacccggc

SEQ ID NO: 1134 - DNA, 15 bp, Artificial Sequence
  dgRNA
  Bag5
atccctgtgatccgt

SEQ ID NO: 1135 - DNA, 15 bp, Artificial Sequence
  dgRNA
  Bag5
tccctgtgatccgta

SEQ ID NO: 1136 - DNA, 15 bp, Artificial Sequence
  dgRNA
  Shank2
gctgacaaatagact

SEQ ID NO: 1137 - DNA, 15 bp, Artificial Sequence
  dgRNA
  Shank2
ttagccacaggcgca

SEQ ID NO: 1138 - DNA, 15 bp, Artificial Sequence
  dgRNA
  Shank2
gcagccgggtttcct

SEQ ID NO: 1139 - DNA, 15 bp, Artificial Sequence
  dgRNA
  Shank2
cgctccgtgcgcctg

SEQ ID NO: 1140 - DNA, 15 bp, Artificial Sequence
  dgRNA
  Dusp7
agccaggtcccggct

SEQ ID NO: 1141 - DNA, 15 bp, Artificial Sequence
  dgRNA
  Dusp7
caggtcccggctagg

SEQ ID NO: 1142 - DNA, 15 bp, Artificial Sequence
  dgRNA
  Dusp7
gctaggcgggcccgt

SEQ ID NO: 1143 - DNA, 15 bp, Artificial Sequence
  dgRNA
  Dusp7
cgggcccgtaggagc

SEQ ID NO: 1144 - DNA, 15 bp, Artificial Sequence
  dgRNA
  H1fx
gctcggatgctgtcc

SEQ ID NO: 1145 - DNA, 15 bp, Artificial Sequence
  dgRNA
  H1fx
ctcggatgctgtcca

SEQ ID NO: 1146 - DNA, 15 bp, Artificial Sequence
  dgRNA
  H1fx
gggtgcagccgcgcc

SEQ ID NO: 1147 - DNA, 15 bp, Artificial Sequence
  dgRNA
  H1fx
ggtgcagccgcgccc

SEQ ID NO: 1148 - DNA, 15 bp, Artificial Sequence
  dgRNA
  Zfp113
gcaagtggcgcagtc

SEQ ID NO: 1149 - DNA, 15 bp, Artificial Sequence
  dgRNA
  Zfp113
ggcatttgttgtcct

SEQ ID NO: 1150 - DNA, 15 bp, Artificial Sequence
  dgRNA
  Zfp113
tgagaaaggacgacc

SEQ ID NO: 1151 - DNA, 15 bp, Artificial Sequence
  dgRNA
  Zfp113
cgccacttgctggcc

SEQ ID NO: 1152 - DNA, 15 bp, Artificial Sequence
  dgRNA
  Prdm16
cgagctgcgctgaaa

SEQ ID NO: 1153 - DNA, 15 bp, Artificial Sequence
  dgRNA
  Prdm16
gagctgcgctgaaaa

SEQ ID NO: 1154 - DNA, 15 bp, Artificial Sequence
  dgRNA
  Prdm16
agctgcgctgaaaag

SEQ ID NO: 1155 - DNA, 15 bp, Artificial Sequence
  dgRNA
  Prdm16
gctgcgctgaaaagg

SEQ ID NO: 1156 - DNA, 15 bp, Artificial Sequence
  dgRNA
  2900026A02Rik
ttgtcccgcccctcc

SEQ ID NO: 1157 - DNA, 15 bp, Artificial Sequence
  dgRNA
  2900026A02Rik
gttagggggcacgca

SEQ ID NO: 1158 - DNA, 15 bp, Artificial Sequence
  dgRNA
  2900026A02Rik
ggttagggggcacgc

SEQ ID NO: 1159 - DNA, 15 bp, Artificial Sequence
  dgRNA
  2900026A02Rik
tggtggggtgcgcag

SEQ ID NO: 1160 - DNA, 15 bp, Artificial Sequence
  dgRNA
  Olfr784
gtgttagtagttgtt

SEQ ID NO: 1161 - DNA, 15 bp, Artificial Sequence
  dgRNA
  Olfr784
ttatgtagacttact

SEQ ID NO: 1162 - DNA, 15 bp, Artificial Sequence
  dgRNA
  Olfr784
tatgtagacttacta

SEQ ID NO: 1163 - DNA, 15 bp, Artificial Sequence
  dgRNA
  Olfr784
cttactagggacaaa

SEQ ID NO: 1164 - DNA, 15 bp, Artificial Sequence
  dgRNA
  Timp1
cccttcaaggccgcc

SEQ ID NO: 1165 - DNA, 15 bp, Artificial Sequence
  dgRNA
  Timp1
tcaaggccgccagga

SEQ ID NO: 1166 - DNA, 15 bp, Artificial Sequence
  dgRNA
  Timp1
ggactgtgcatgacg

SEQ ID NO: 1167 - DNA, 15 bp, Artificial Sequence
  dgRNA
  Timp1
tgcatgacgtggagc

SEQ ID NO: 1168 - DNA, 15 bp, Artificial Sequence
  dgRNA
  C3ar1
agcatctcgtagcta

SEQ ID NO: 1169 - DNA, 15 bp, Artificial Sequence
  dgRNA
  C3ar1
cgtagctaaggtgac

SEQ ID NO: 1170 - DNA, 15 bp, Artificial Sequence
  dgRNA
  C3ar1
ttttcttatctacgc

SEQ ID NO: 1171 - DNA, 15 bp, Artificial Sequence
  dgRNA
  C3ar1
ccggctaagtttaag

SEQ ID NO: 1172 - DNA, 15 bp, Artificial Sequence
  dgRNA
  Plekhf2
gcgtcacctctgcag

SEQ ID NO: 1173 - DNA, 15 bp, Artificial Sequence
  dgRNA
  Plekhf2
gttccccaaccccgc

SEQ ID NO: 1174 - DNA, 15 bp, Artificial Sequence
  dgRNA
  Plekhf2
ttccccaaccccgcc

SEQ ID NO: 1175 - DNA, 15 bp, Artificial Sequence
  dgRNA
  Plekhf2
ccccaaccccgccgg

SEQ ID NO: 1176 - DNA, 15 bp, Artificial Sequence
  dgRNA
  Lsm11
atctatgctgccccc

SEQ ID NO: 1177 - DNA, 15 bp, Artificial Sequence
  dgRNA
  Lsm11
cgtccccttgagccg

SEQ ID NO: 1178 - DNA, 15 bp, Artificial Sequence
  dgRNA
  Lsm11
cttgagccgcggctg

SEQ ID NO: 1179 - DNA, 15 bp, Artificial Sequence
  dgRNA
  Lsm11
cgcagtgccgccctc

SEQ ID NO: 1180 - DNA, 15 bp, Artificial Sequence
  dgRNA
  Kif21a
cacgtcccaagagat

SEQ ID NO: 1181 - DNA, 15 bp, Artificial Sequence
  dgRNA
  Kif21a
acgtcccaagagatc

SEQ ID NO: 1182 - DNA, 15 bp, Artificial Sequence
  dgRNA
  Kif21a
caagagatcgggcag

SEQ ID NO: 1183 - DNA, 15 bp, Artificial Sequence
  dgRNA
  Kif21a
gatcgggcagaggac

SEQ ID NO: 1184 - DNA, 15 bp, Artificial Sequence
  dgRNA
  Ltbr
caggcttccgaagaa

SEQ ID NO: 1185 - DNA, 15 bp, Artificial Sequence
  dgRNA
  Ltbr
gcttccgaagaaagg

SEQ ID NO: 1186 - DNA, 15 bp, Artificial Sequence
  dgRNA
  Ltbr
tccgaagaaaggtgg

SEQ ID NO: 1187 - DNA, 15 bp, Artificial Sequence
  dgRNA
  Ltbr
gtggaggccgggttc

SEQ ID NO: 1188 - DNA, 15 bp, Artificial Sequence
  dgRNA
  Arhgap4
gtcgccccgcccctc

SEQ ID NO: 1189 - DNA, 15 bp, Artificial Sequence
  dgRNA
  Arhgap4
tccggggactgtgct

SEQ ID NO: 1190 - DNA, 15 bp, Artificial Sequence
  dgRNA
  Arhgap4
cggggactgtgctgg

SEQ ID NO: 1191 - DNA, 15 bp, Artificial Sequence
  dgRNA
  Arhgap4
ggcggggcccgcgga

SEQ ID NO: 1192 - DNA, 15 bp, Artificial Sequence
  dgRNA
  Mtcl1
tggtcctctgctgcg

SEQ ID NO: 1193 - DNA, 15 bp, Artificial Sequence
  dgRNA
  Mtcl1
tgctgcgtggacgcg

SEQ ID NO: 1194 - DNA, 15 bp, Artificial Sequence
  dgRNA
  Mtcl1
gctgcgtggacgcgt

SEQ ID NO: 1195 - DNA, 15 bp, Artificial Sequence
  dgRNA
  Mtcl1
ggacgcgtgggcact

SEQ ID NO: 1196 - DNA, 15 bp, Artificial Sequence
  dgRNA
  8-Sep
tgctatgcactaatc

SEQ ID NO: 1197 - DNA, 15 bp, Artificial Sequence
  dgRNA
  8-Sep
gcctcggagaggccc

SEQ ID NO: 1198 - DNA, 15 bp, Artificial Sequence
  dgRNA
  8-Sep
cgggtcccccagacg

SEQ ID NO: 1199 - DNA, 15 bp, Artificial Sequence
  dgRNA
  8-Sep
cagacgtggcagtcc

SEQ ID NO: 1200 - DNA, 15 bp, Artificial Sequence
  dgRNA
  Tfam
agcccacaaggctac

SEQ ID NO: 1201 - DNA, 15 bp, Artificial Sequence
  dgRNA
  Tfam
gtttcatgagtccgc

SEQ ID NO: 1202 - DNA, 15 bp, Artificial Sequence
  dgRNA
  Tfam
gaagttagagatccg

SEQ ID NO: 1203 - DNA, 15 bp, Artificial Sequence
  dgRNA
  Tfam
tgagcttcgtgacgc

SEQ ID NO: 1204 - DNA, 15 bp, Artificial Sequence
  dgRNA
  Cntrob
cctgaagccaatccg

SEQ ID NO: 1205 - DNA, 15 bp, Artificial Sequence
  dgRNA
  Cntrob
gcgtgcccacgttcc

SEQ ID NO: 1206 - DNA, 15 bp, Artificial Sequence
  dgRNA
  Cntrob
cgtgcccacgttccc

SEQ ID NO: 1207 - DNA, 15 bp, Artificial Sequence
  dgRNA
  Cntrob
gcccagtgatgtgcg

SEQ ID NO: 1208 - DNA, 15 bp, Artificial Sequence
  dgRNA
  Mfap4
taaggagttaatgtc

SEQ ID NO: 1209 - DNA, 15 bp, Artificial Sequence
  dgRNA
  Mfap4
ggcctaatgagaccc

SEQ ID NO: 1210 - DNA, 15 bp, Artificial Sequence
  dgRNA
  Mfap4
tgtaagctgatgccg

SEQ ID NO: 1211 - DNA, 15 bp, Artificial Sequence
  dgRNA
  Mfap4
gtaagctgatgccgg

SEQ ID NO: 1212 - DNA, 15 bp, Artificial Sequence
  dgRNA
  Rbsn
ctatagggtgagtga

SEQ ID NO: 1213 - DNA, 15 bp, Artificial Sequence
  dgRNA
  Rbsn
tatagggtgagtgaa

SEQ ID NO: 1214 - DNA, 15 bp, Artificial Sequence
  dgRNA
  Rbsn
gtgaagggcgagtgt

SEQ ID NO: 1215 - DNA, 15 bp, Artificial Sequence
  dgRNA
  Rbsn
tgaagggcgagtgta

SEQ ID NO: 1216 - DNA, 15 bp, Artificial Sequence
  dgRNA
  Syap1
ggggagtcgatgcag

SEQ ID NO: 1217 - DNA, 15 bp, Artificial Sequence
  dgRNA
  Syap1
gggagtcgatgcaga

SEQ ID NO: 1218 - DNA, 15 bp, Artificial Sequence
  dgRNA
  Syap1
ggagtcgatgcagag

SEQ ID NO: 1219 - DNA, 15 bp, Artificial Sequence
  dgRNA
  Syap1
tcgatgcagaggggg

SEQ ID NO: 1220 - DNA, 15 bp, Artificial Sequence
  dgRNA
  Smcr8
caatgggtagttaac

SEQ ID NO: 1221 - DNA, 15 bp, Artificial Sequence
  dgRNA
  Smcr8
acgggacttgtcctc

SEQ ID NO: 1222 - DNA, 15 bp, Artificial Sequence
  dgRNA
  Smcr8
gaagatctgattggc

SEQ ID NO: 1223 - DNA, 15 bp, Artificial Sequence
  dgRNA
  Smcr8
aagatctgattggca

SEQ ID NO: 1224 - DNA, 15 bp, Artificial Sequence
  dgRNA
  Hdgfrp2
cctagtccacgccct

SEQ ID NO: 1225 - DNA, 15 bp, Artificial Sequence
  dgRNA
  Hdgfrp2
aacccctccctttat

SEQ ID NO: 1226 - DNA, 15 bp, Artificial Sequence
  dgRNA
  Hdgfrp2
ccgcgcgcgtctctg

SEQ ID NO: 1227 - DNA, 15 bp, Artificial Sequence
  dgRNA
  Hdgfrp2
tgtggtcatgagcga

SEQ ID NO: 1228 - DNA, 15 bp, Artificial Sequence
  dgRNA
  Tuba3a
acatccaatcattag

SEQ ID NO: 1229 - DNA, 15 bp, Artificial Sequence
  dgRNA
  Tuba3a
catccaatcattagt

SEQ ID NO: 1230 - DNA, 15 bp, Artificial Sequence
  dgRNA
  Tuba3a
atcattagtgggatg

SEQ ID NO: 1231 - DNA, 15 bp, Artificial Sequence
  dgRNA
  Tuba3a
ctaaggccgccccta

SEQ ID NO: 1232 - DNA, 15 bp, Artificial Sequence
  dgRNA
  Tango2
gtgcatcgccagcct

SEQ ID NO: 1233 - DNA, 15 bp, Artificial Sequence
  dgRNA
  Tango2
cttggtgcagctgcg

SEQ ID NO: 1234 - DNA, 15 bp, Artificial Sequence
  dgRNA
  Tango2
ttggtgcagctgcgg

SEQ ID NO: 1235 - DNA, 15 bp, Artificial Sequence
  dgRNA
  Tango2
aagcgacagcacata

SEQ ID NO: 1236 - DNA, 15 bp, Artificial Sequence
  dgRNA
  Tpbgl
gccccacgtgtgctt

SEQ ID NO: 1237 - DNA, 15 bp, Artificial Sequence
  dgRNA
  Tpbgl
ccacgtgtgcttcgg

SEQ ID NO: 1238 - DNA, 15 bp, Artificial Sequence
  dgRNA
  Tpbgl
cacgtgtgcttcgga

SEQ ID NO: 1239 - DNA, 15 bp, Artificial Sequence
  dgRNA
  Tpbgl
aagctgcctaaacga

SEQ ID NO: 1240 - DNA, 15 bp, Artificial Sequence
  dgRNA
  Pla2g7
gcaggccttctagtc

SEQ ID NO: 1241 - DNA, 15 bp, Artificial Sequence
  dgRNA
  Pla2g7
cgtaatctcctcaag

SEQ ID NO: 1242 - DNA, 15 bp, Artificial Sequence
  dgRNA
  Pla2g7
ggtgaagcgggattc

SEQ ID NO: 1243 - DNA, 15 bp, Artificial Sequence
  dgRNA
  Pla2g7
gtgaagcgggattct

SEQ ID NO: 1244 - DNA, 15 bp, Artificial Sequence
  dgRNA
  Tomm5
ggcactctcccggct

SEQ ID NO: 1245 - DNA, 15 bp, Artificial Sequence
  dgRNA
  Tomm5
gcactctcccggcta

SEQ ID NO: 1246 - DNA, 15 bp, Artificial Sequence
  dgRNA
  Tomm5
gtccagatccaccca

SEQ ID NO: 1247 - DNA, 15 bp, Artificial Sequence
  dgRNA
  Tomm5
agagacttaaggcgg

SEQ ID NO: 1248 - DNA, 15 bp, Artificial Sequence
  dgRNA
  Esrrg
aatgcaaccggtgcc

SEQ ID NO: 1249 - DNA, 15 bp, Artificial Sequence
  dgRNA
  Esrrg
cgggtcttttcccca

SEQ ID NO: 1250 - DNA, 15 bp, Artificial Sequence
  dgRNA
  Esrrg
tttatagtctacgcc

SEQ ID NO: 1251 - DNA, 15 bp, Artificial Sequence
  dgRNA
  Esrrg
ccgacattcctcttc

SEQ ID NO: 1252 - DNA, 15 bp, Artificial Sequence
  dgRNA
  Adcyap1r1
tggcttgtgtcagcg

SEQ ID NO: 1253 - DNA, 15 bp, Artificial Sequence
  dgRNA
  Adcyap1r1
cttgtgtcagcgcgg

SEQ ID NO: 1254 - DNA, 15 bp, Artificial Sequence
  dgRNA
  Adcyap1r1
cccccgggctctcat

SEQ ID NO: 1255 - DNA, 15 bp, Artificial Sequence
  dgRNA
  Adcyap1r1
caccccccgcctgcg

SEQ ID NO: 1256 - DNA, 15 bp, Artificial Sequence
  dgRNA
  Tmem79
taggcagattctgta

SEQ ID NO: 1257 - DNA, 15 bp, Artificial Sequence
  dgRNA
  Tmem79
cctgcgcctttaatc

SEQ ID NO: 1258 - DNA, 15 bp, Artificial Sequence
  dgRNA
  Tmem79
gggtttgtgtatcaa

SEQ ID NO: 1259 - DNA, 15 bp, Artificial Sequence
  dgRNA
  Tmem79
ggacttaatgtattc

SEQ ID NO: 1260 - DNA, 15 bp, Artificial Sequence
  dgRNA
  Ube3a
aggcccctgcgccgc

SEQ ID NO: 1261 - DNA, 15 bp, Artificial Sequence
  dgRNA
  Ube3a
ctgcgccgcaggcga

SEQ ID NO: 1262 - DNA, 15 bp, Artificial Sequence
  dgRNA
  Ube3a
gcgaaggcgagctag

SEQ ID NO: 1263 - DNA, 15 bp, Artificial Sequence
  dgRNA
  Ube3a
aaggcgagctagagg

SEQ ID NO: 1264 - DNA, 15 bp, Artificial Sequence
  dgRNA
  Ulbp1
caccccgcaaagcac

SEQ ID NO: 1265 - DNA, 15 bp, Artificial Sequence
  dgRNA
  Ulbp1
gcttttgacaagatc

SEQ ID NO: 1266 - DNA, 15 bp, Artificial Sequence
  dgRNA
  Ulbp1
tttgacaagatcggg

SEQ ID NO: 1267 - DNA, 15 bp, Artificial Sequence
  dgRNA
  Ulbp1
gcgggaagaagtgcc

SEQ ID NO: 1268 - DNA, 15 bp, Artificial Sequence
  dgRNA
  Magel2
gaactagcttagttg

SEQ ID NO: 1269 - DNA, 15 bp, Artificial Sequence
  dgRNA
  Magel2
gaggatctataccgc

SEQ ID NO: 1270 - DNA, 15 bp, Artificial Sequence
  dgRNA
  Magel2
ctataccgcaggaga

SEQ ID NO: 1271 - DNA, 15 bp, Artificial Sequence
  dgRNA
  Magel2
gatattgagtcagtc

SEQ ID NO: 1272 - DNA, 15 bp, Artificial Sequence
  dgRNA
  Atg4d
ggctgtaaatgggcg

SEQ ID NO: 1273 - DNA, 15 bp, Artificial Sequence
  dgRNA
  Atg4d
ccggctctgacccat

SEQ ID NO: 1274 - DNA, 15 bp, Artificial Sequence
  dgRNA
  Atg4d
attggtctgagataa

SEQ ID NO: 1275 - DNA, 15 bp, Artificial Sequence
  dgRNA
  Atg4d
agataagggccccca

SEQ ID NO: 1276 - DNA, 15 bp, Artificial Sequence
  dgRNA
  Gpr152
tgcttatggccccct

SEQ ID NO: 1277 - DNA, 15 bp, Artificial Sequence
  dgRNA
  Gpr152
acagtgaggcggatt

SEQ ID NO: 1278 - DNA, 15 bp, Artificial Sequence
  dgRNA
  Gpr152
cagtgaggcggatta

SEQ ID NO: 1279 - DNA, 15 bp, Artificial Sequence
  dgRNA
  Gpr152
tagggtaaatgagtc

SEQ ID NO: 1280 - DNA, 15 bp, Artificial Sequence
  dgRNA
  Ankrd7
gggctatacactaat

SEQ ID NO: 1281 - DNA, 15 bp, Artificial Sequence
  dgRNA
  Ankrd7
gcaagattgtgtatg

SEQ ID NO: 1282 - DNA, 15 bp, Artificial Sequence
  dgRNA
  Rnf20
agagaccggtcactt

SEQ ID NO: 1283 - DNA, 15 bp, Artificial Sequence
  dgRNA
  Rnf20
gagaccggtcacttt

SEQ ID NO: 1284 - DNA, 15 bp, Artificial Sequence
  dgRNA
  Rnf20
cggtcactttgggac

SEQ ID NO: 1285 - DNA, 15 bp, Artificial Sequence
  dgRNA
  Rnf20
cgcgtcacttccgcc

SEQ ID NO: 1286 - DNA, 15 bp, Artificial Sequence
  dgRNA
  Ttc4
ccacgccccaaagcg

SEQ ID NO: 1287 - DNA, 15 bp, Artificial Sequence
  dgRNA
  Ttc4
aagcgaggagactag

SEQ ID NO: 1288 - DNA, 15 bp, Artificial Sequence
  dgRNA
  Ttc4
acgcccccaggccgg

SEQ ID NO: 1289 - DNA, 15 bp, Artificial Sequence
  dgRNA
  Ttc4
ccggcggaacccgag

SEQ ID NO: 1290 - DNA, 15 bp, Artificial Sequence
  dgRNA
  Stra6
gggggatggtctcaa

SEQ ID NO: 1291 - DNA, 15 bp, Artificial Sequence
  dgRNA
  Stra6
cgggcgggctgtggc

SEQ ID NO: 1292 - DNA, 15 bp, Artificial Sequence
  dgRNA
  Stra6
gccgcagagatgaaa

SEQ ID NO: 1293 - DNA, 15 bp, Artificial Sequence
  dgRNA
  Olfr429
agttgactgcaggac

SEQ ID NO: 1294 - DNA, 15 bp, Artificial Sequence
  dgRNA
  Olfr429
ttgattggatgccaa

SEQ ID NO: 1295 - DNA, 15 bp, Artificial Sequence
  dgRNA
  Olfr429
attggcatccaatca

SEQ ID NO: 1296 - DNA, 15 bp, Artificial Sequence
  dgRNA
  Cbfa2t3
ggagaaccggcaacc

SEQ ID NO: 1297 - DNA, 15 bp, Artificial Sequence
  dgRNA
  Cbfa2t3
cggcaaccaggcaga

SEQ ID NO: 1298 - DNA, 15 bp, Artificial Sequence
  dgRNA
  Cbfa2t3
agatggttcctgacg

SEQ ID NO: 1299 - DNA, 15 bp, Artificial Sequence
  dgRNA
  Cbfa2t3
ctgacgaggaagctc

SEQ ID NO: 1300 - DNA, 15 bp, Artificial Sequence
  dgRNA
  Insl3
gcttcacccttacaa

SEQ ID NO: 1301 - DNA, 15 bp, Artificial Sequence
  dgRNA
  Insl3
ttacaaaggggcgct

SEQ ID NO: 1302 - DNA, 15 bp, Artificial Sequence
  dgRNA
  Insl3
ttggggagcggctcc

SEQ ID NO: 1303 - DNA, 15 bp, Artificial Sequence
  dgRNA
  Insl3
gcacagcgccgcacc

SEQ ID NO: 1304 - DNA, 15 bp, Artificial Sequence
  dgRNA
  Fndc1
gaccgtgtgcaaaca

SEQ ID NO: 1305 - DNA, 15 bp, Artificial Sequence
  dgRNA
  Fndc1
tgcacgcaaatcttt

SEQ ID NO: 1306 - DNA, 15 bp, Artificial Sequence
  dgRNA
  Fndc1
atgcaatggcaggct

SEQ ID NO: 1307 - DNA, 15 bp, Artificial Sequence
  dgRNA
  Fndc1
tatgcaatggcaggc

SEQ ID NO: 1308 - DNA, 15 bp, Artificial Sequence
  dgRNA
  Atat1
gatacttggttgccc

SEQ ID NO: 1309 - DNA, 15 bp, Artificial Sequence
  dgRNA
  Atat1
ggcggggcgagccct

SEQ ID NO: 1310 - DNA, 15 bp, Artificial Sequence
  dgRNA
  Atat1
gcggggcgagccctc

SEQ ID NO: 1311 - DNA, 15 bp, Artificial Sequence
  dgRNA
  Atat1
cggggcgagccctcg

SEQ ID NO: 1312 - DNA, 15 bp, Artificial Sequence
  dgRNA
  Mutyh
ccctcgccagccttc

SEQ ID NO: 1313 - DNA, 15 bp, Artificial Sequence
  dgRNA
  Mutyh
tcgccagccttctgg

SEQ ID NO: 1314 - DNA, 15 bp, Artificial Sequence
  dgRNA
  Mutyh
aagcgacacggatct

SEQ ID NO: 1315 - DNA, 15 bp, Artificial Sequence
  dgRNA
  Mutyh
gacacggatctagga

SEQ ID NO: 1316 - DNA, 15 bp, Artificial Sequence
  dgRNA
  Hnrnpf
tgggctacacgaaaa

SEQ ID NO: 1317 - DNA, 15 bp, Artificial Sequence
  dgRNA
  Hnrnpf
ccttatcggctcaga

SEQ ID NO: 1318 - DNA, 15 bp, Artificial Sequence
  dgRNA
  Hnrnpf
ccttctgagccgata

SEQ ID NO: 1319 - DNA, 15 bp, Artificial Sequence
  dgRNA
  Hnrnpf
agccgtgctgctgag

SEQ ID NO: 1320 - DNA, 15 bp, Artificial Sequence
  dgRNA
  Serpinb12
aagagcggaaattcc

SEQ ID NO: 1321 - DNA, 15 bp, Artificial Sequence
  dgRNA
  Serpinb12
ctagcccctaatcta

SEQ ID NO: 1322 - DNA, 15 bp, Artificial Sequence
  dgRNA
  Serpinb12
tttctcgaaataagc

SEQ ID NO: 1323 - DNA, 15 bp, Artificial Sequence
  dgRNA
  Serpinb12
gagcctttaataatt

SEQ ID NO: 1324 - DNA, 15 bp, Artificial Sequence
  dgRNA
  Rab31
cataaactgttccaa

SEQ ID NO: 1325 - DNA, 15 bp, Artificial Sequence
  dgRNA
  Rab31
ctctttatgacgcga

SEQ ID NO: 1326 - DNA, 15 bp, Artificial Sequence
  dgRNA
  Rab31
tctttatgacgcgac

SEQ ID NO: 1327 - DNA, 15 bp, Artificial Sequence
  dgRNA
  Rab31
acgggtcgtgtgtcc

SEQ ID NO: 1328 - DNA, 15 bp, Artificial Sequence
  dgRNA
  Ahnak
tcaccggcccattcc

SEQ ID NO: 1329 - DNA, 15 bp, Artificial Sequence
  dgRNA
  Ahnak
caccggcccattcca

SEQ ID NO: 1330 - DNA, 15 bp, Artificial Sequence
  dgRNA
  Ahnak
cggcccattccaggg

SEQ ID NO: 1331 - DNA, 15 bp, Artificial Sequence
  dgRNA
  Ahnak
tgttagtcgtgctct

SEQ ID NO: 1332 - DNA, 15 bp, Artificial Sequence
  dgRNA
  Lyrm9
gtatccaaggttgta

SEQ ID NO: 1333 - DNA, 15 bp, Artificial Sequence
  dgRNA
  Lyrm9
tatccaaggttgtaa

SEQ ID NO: 1334 - DNA, 15 bp, Artificial Sequence
  dgRNA
  Lyrm9
ccagccaactgggcg

SEQ ID NO: 1335 - DNA, 15 bp, Artificial Sequence
  dgRNA
  Lyrm9
ccaactgggcggggt

SEQ ID NO: 1336 - DNA, 15 bp, Artificial Sequence
  dgRNA
  Timp2
cggcggtcatgggga

SEQ ID NO: 1337 - DNA, 15 bp, Artificial Sequence
  dgRNA
  Timp2
ggcggtcatggggat

SEQ ID NO: 1338 - DNA, 15 bp, Artificial Sequence
  dgRNA
  Timp2
gcggtcatggggatg

SEQ ID NO: 1339 - DNA, 15 bp, Artificial Sequence
  dgRNA
  Timp2
gttccacccagagtc

SEQ ID NO: 1340 - DNA, 15 bp, Artificial Sequence
  dgRNA
  Shc1
ttagttccccgcctc

SEQ ID NO: 1341 - DNA, 15 bp, Artificial Sequence
  dgRNA
  Shc1
tagttccccgcctct

SEQ ID NO: 1342 - DNA, 15 bp, Artificial Sequence
  dgRNA
  Shc1
agttccccgcctctg

SEQ ID NO: 1343 - DNA, 15 bp, Artificial Sequence
  dgRNA
  Shc1
tccccgcctctgggg

SEQ ID NO: 1344 - DNA, 15 bp, Artificial Sequence
  dgRNA
  Ccdc28b
gaactgttaaatcga

SEQ ID NO: 1345 - DNA, 15 bp, Artificial Sequence
  dgRNA
  Ccdc28b
ggaagtactctcctc

SEQ ID NO: 1346 - DNA, 15 bp, Artificial Sequence
  dgRNA
  Ccdc28b
tccggctccgctccc

SEQ ID NO: 1347 - DNA, 15 bp, Artificial Sequence
  dgRNA
  Ccdc28b
ccggctccgctccca

SEQ ID NO: 1348 - DNA, 15 bp, Artificial Sequence
  dgRNA
  Lrfn1
agagcccattcattg

SEQ ID NO: 1349 - DNA, 15 bp, Artificial Sequence
  dgRNA
  Lrfn1
gagcccattcattgg

SEQ ID NO: 1350 - DNA, 15 bp, Artificial Sequence
  dgRNA
  Lrfn1
agcagctagcataca

SEQ ID NO: 1351 - DNA, 15 bp, Artificial Sequence
  dgRNA
  Lrfn1
tatcccccaatgaat

SEQ ID NO: 1352 - DNA, 15 bp, Artificial Sequence
  dgRNA
  Dock1
gcctgggtccctcga

SEQ ID NO: 1353 - DNA, 15 bp, Artificial Sequence
  dgRNA
  Dock1
gtccctcgagggacc

SEQ ID NO: 1354 - DNA, 15 bp, Artificial Sequence
  dgRNA
  Dock1
cctcgagggacccgg

SEQ ID NO: 1355 - DNA, 15 bp, Artificial Sequence
  dgRNA
  Dock1
ctcgagggacccggc

SEQ ID NO: 1356 - DNA, 15 bp, Artificial Sequence
  dgRNA
  Fabp12
tggcggccctgcgtg

SEQ ID NO: 1357 - DNA, 15 bp, Artificial Sequence
  dgRNA
  Fabp12
ggtgacgcagaagca

SEQ ID NO: 1358 - DNA, 15 bp, Artificial Sequence
  dgRNA
  Fabp12
gaaatcctctaaccc

SEQ ID NO: 1359 - DNA, 15 bp, Artificial Sequence
  dgRNA
  Fabp12
attgctcctcacgca

SEQ ID NO: 1360 - DNA, 15 bp, Artificial Sequence
  dgRNA
  Thg1l
aagtttgagtacgtg

SEQ ID NO: 1361 - DNA, 15 bp, Artificial Sequence
  dgRNA
  Thg1l
acgtgcggaattttg

SEQ ID NO: 1362 - DNA, 15 bp, Artificial Sequence
  dgRNA
  Thg1l
tgcctgccgcactgc

SEQ ID NO: 1363 - DNA, 15 bp, Artificial Sequence
  dgRNA
  Thg1l
gcctgccgcactgct

SEQ ID NO: 1364 - DNA, 15 bp, Artificial Sequence
  dgRNA
  Gsto2
agaccagcggctgag

SEQ ID NO: 1365 - DNA, 15 bp, Artificial Sequence
  dgRNA
  Gsto2
accgacttcctcttt

SEQ ID NO: 1366 - DNA, 15 bp, Artificial Sequence
  dgRNA
  Gsto2
gtagccatagatttc

SEQ ID NO: 1367 - DNA, 15 bp, Artificial Sequence
  dgRNA
  Gsto2
caagctgctataacg

SEQ ID NO: 1368 - DNA, 15 bp, Artificial Sequence
  dgRNA
  Espn
ccgggatcgcagagc

SEQ ID NO: 1369 - DNA, 15 bp, Artificial Sequence
  dgRNA
  Espn
gatcgcagagccggc

SEQ ID NO: 1370 - DNA, 15 bp, Artificial Sequence
  dgRNA
  Espn
tccgcactcctccga

SEQ ID NO: 1371 - DNA, 15 bp, Artificial Sequence
  dgRNA
  Espn
cctccgacggctgca

SEQ ID NO: 1372 - DNA, 15 bp, Artificial Sequence
  dgRNA
  Mettl21e
tctagttgtgttccc

SEQ ID NO: 1373 - DNA, 15 bp, Artificial Sequence
  dgRNA
  Smek1
gcagcccgcgccccc

SEQ ID NO: 1374 - DNA, 15 bp, Artificial Sequence
  dgRNA
  Smek1
cagcccgcgccccca

SEQ ID NO: 1375 - DNA, 15 bp, Artificial Sequence
  dgRNA
  Smek1
cagggccgactgcaa

SEQ ID NO: 1376 - DNA, 15 bp, Artificial Sequence
  dgRNA
  Smek1
cctccctaaagcgtc

SEQ ID NO: 1377 - DNA, 15 bp, Artificial Sequence
  dgRNA
  Nap1l5
gggtgtctaagtggc

SEQ ID NO: 1378 - DNA, 15 bp, Artificial Sequence
  dgRNA
  Nap1l5
agcatagcaacaatt

SEQ ID NO: 1379 - DNA, 15 bp, Artificial Sequence
  dgRNA
  Nap1l5
ccgcgagccgcgaag

SEQ ID NO: 1380 - DNA, 15 bp, Artificial Sequence
  dgRNA
  Nap1l5
cgcgaagcggccgcg

SEQ ID NO: 1381 - DNA, 15 bp, Artificial Sequence
  dgRNA
  Htra1
cggagggtggagtcg

SEQ ID NO: 1382 - DNA, 15 bp, Artificial Sequence
  dgRNA
  Htra1
caggcagtccccgat

SEQ ID NO: 1383 - DNA, 15 bp, Artificial Sequence
  dgRNA
  Htra1
gatcggcccccctcc

SEQ ID NO: 1384 - DNA, 15 bp, Artificial Sequence
  dgRNA
  Htra1
atcggcccccctccc

SEQ ID NO: 1385 - DNA, 15 bp, Artificial Sequence
  dgRNA
  Itgb4
gctccaaacttacac

SEQ ID NO: 1386 - DNA, 15 bp, Artificial Sequence
  dgRNA
  Itgb4
atcgtgtatccacta

SEQ ID NO: 1387 - DNA, 15 bp, Artificial Sequence
  dgRNA
  Itgb4
ggttagctggccact

SEQ ID NO: 1388 - DNA, 15 bp, Artificial Sequence
  dgRNA
  Itgb4
cggttagctggccac

SEQ ID NO: 1389 - DNA, 15 bp, Artificial Sequence
  dgRNA
  Hnrnpf
ctctccgggactcag

SEQ ID NO: 1390 - DNA, 15 bp, Artificial Sequence
  dgRNA
  Hnrnpf
cccccggccaatcct

SEQ ID NO: 1391 - DNA, 15 bp, Artificial Sequence
  dgRNA
  Hnrnpf
tcctaggctccgttc

SEQ ID NO: 1392 - DNA, 15 bp, Artificial Sequence
  dgRNA
  Hnrnpf
ctgggctcgtcagaa

SEQ ID NO: 1393 - DNA, 15 bp, Artificial Sequence
  dgRNA
  Tmem192
caaatctctgataaa

SEQ ID NO: 1394 - DNA, 15 bp, Artificial Sequence
  dgRNA
  Tmem192
gaagcaacagtttag

SEQ ID NO: 1395 - DNA, 15 bp, Artificial Sequence
  dgRNA
  Tmem192
cccaaaacaaccgcc

SEQ ID NO: 1396 - DNA, 15 bp, Artificial Sequence
  dgRNA
  Tmem192
ccaaaacaaccgcct

SEQ ID NO: 1397 - DNA, 15 bp, Artificial Sequence
  dgRNA
  Rltpr
tgcagtcactatccg

SEQ ID NO: 1398 - DNA, 15 bp, Artificial Sequence
  dgRNA
  Rltpr
tccgtggctgagtcg

SEQ ID NO: 1399 - DNA, 15 bp, Artificial Sequence
  dgRNA
  Rltpr
agtcgcggttgaagc

SEQ ID NO: 1400 - DNA, 15 bp, Artificial Sequence
  dgRNA
  Rltpr
gtcgcggttgaagca

SEQ ID NO: 1401 - DNA, 15 bp, Artificial Sequence
  dgRNA
  Cldn34d
gcactcctacactaa

SEQ ID NO: 1402 - DNA, 15 bp, Artificial Sequence
  dgRNA
  Cldn34d
ctaatggctaaagct

SEQ ID NO: 1403 - DNA, 15 bp, Artificial Sequence
  dgRNA
  Cldn34d
taatggctaaagctt

SEQ ID NO: 1404 - DNA, 15 bp, Artificial Sequence
  dgRNA
  Cldn34d
tcagaaccctcaata

SEQ ID NO: 1405 - DNA, 15 bp, Artificial Sequence
  dgRNA
  Rdh8
gctctgcaagggatc

SEQ ID NO: 1406 - DNA, 15 bp, Artificial Sequence
  dgRNA
  Rdh8
ctgcaagggatcagg

SEQ ID NO: 1407 - DNA, 15 bp, Artificial Sequence
  dgRNA
  Rdh8
agcagtaggcccagt

SEQ ID NO: 1408 - DNA, 15 bp, Artificial Sequence
  dgRNA
  Rdh8
cagtaggcccagtgg

SEQ ID NO: 1409 - DNA, 15 bp, Artificial Sequence
  dgRNA
  Avpr2
atccaagatgctgtc

SEQ ID NO: 1410 - DNA, 15 bp, Artificial Sequence
  dgRNA
  Avpr2
tagaccaccactgaa

SEQ ID NO: 1411 - DNA, 15 bp, Artificial Sequence
  dgRNA
  Avpr2
gtgattagggatcag

SEQ ID NO: 1412 - DNA, 15 bp, Artificial Sequence
  dgRNA
  Avpr2
tcagactggtgatta

SEQ ID NO: 1413 - DNA, 15 bp, Artificial Sequence
  dgRNA
  Adamtsl1
gcatgtctgattagc

SEQ ID NO: 1414 - DNA, 15 bp, Artificial Sequence
  dgRNA
  Adamtsl1
gctgagcccgagaag

SEQ ID NO: 1415 - DNA, 15 bp, Artificial Sequence
  dgRNA
  Adamtsl1
acaaagcggttgggg

SEQ ID NO: 1416 - DNA, 15 bp, Artificial Sequence
  dgRNA
  Adamtsl1
taacaaagcggttgg

SEQ ID NO: 1417 - DNA, 15 bp, Artificial Sequence
  dgRNA
  Eda
gccccgccccacggc

SEQ ID NO: 1418 - DNA, 15 bp, Artificial Sequence
  dgRNA
  Eda
gaggcccgagtggaa

SEQ ID NO: 1419 - DNA, 15 bp, Artificial Sequence
  dgRNA
  Eda
cccgagtggaacggc

SEQ ID NO: 1420 - DNA, 15 bp, Artificial Sequence
  dgRNA
  Eda
ccgagtggaacggca

SEQ ID NO: 1421 - DNA, 15 bp, Artificial Sequence
  dgRNA
  Rpn2
cgctcccctcccaac

SEQ ID NO: 1422 - DNA, 15 bp, Artificial Sequence
  dgRNA
  Rpn2
ggacccttttaaaat

SEQ ID NO: 1423 - DNA, 15 bp, Artificial Sequence
  dgRNA
  Rpn2
aattggccgggctgc

SEQ ID NO: 1424 - DNA, 15 bp, Artificial Sequence
  dgRNA
  Rpn2
aggtggccccgtctt

SEQ ID NO: 1425 - DNA, 15 bp, Artificial Sequence
  dgRNA
  Plk1
tagttgcttcgttcc

SEQ ID NO: 1426 - DNA, 15 bp, Artificial Sequence
  dgRNA
  Plk1
cattaaaaatttcgc

SEQ ID NO: 1427 - DNA, 15 bp, Artificial Sequence
  dgRNA
  Plk1
tttcgccggcaagat

SEQ ID NO: 1428 - DNA, 15 bp, Artificial Sequence
  dgRNA
  Plk1
aagatcggagtttaa

SEQ ID NO: 1429 - DNA, 15 bp, Artificial Sequence
  dgRNA
  Oasl1
atgccaaccctgtta

SEQ ID NO: 1430 - DNA, 15 bp, Artificial Sequence
  dgRNA
  Oasl1
ccaaccctgttaagg

SEQ ID NO: 1431 - DNA, 15 bp, Artificial Sequence
  dgRNA
  Oasl1
taaggcggtccagac

SEQ ID NO: 1432 - DNA, 15 bp, Artificial Sequence
  dgRNA
  Oasl1
taacagggttggcat

SEQ ID NO: 1433 - DNA, 15 bp, Artificial Sequence
  dgRNA
  Cnksr1
atcccatgccagttc

SEQ ID NO: 1434 - DNA, 15 bp, Artificial Sequence
  dgRNA
  Cnksr1
caggcggtggaccaa

SEQ ID NO: 1435 - DNA, 15 bp, Artificial Sequence
  dgRNA
  Cnksr1
gtggaccaatggcag

SEQ ID NO: 1436 - DNA, 15 bp, Artificial Sequence
  dgRNA
  Cnksr1
acctggttggccacg

SEQ ID NO: 1437 - DNA, 15 bp, Artificial Sequence
  dgRNA
  Tomm6
ctgcccagcgcctac

SEQ ID NO: 1438 - DNA, 15 bp, Artificial Sequence
  dgRNA
  Tomm6
aacccctatccgcag

SEQ ID NO: 1439 - DNA, 15 bp, Artificial Sequence
  dgRNA
  Tomm6
ctatccgcagaggct

SEQ ID NO: 1440 - DNA, 15 bp, Artificial Sequence
  dgRNA
  Tomm6
ttgcttaaactaact

SEQ ID NO: 1441 - DNA, 15 bp, Artificial Sequence
  dgRNA
  Eprs
agacgtcagtatccg

SEQ ID NO: 1442 - DNA, 15 bp, Artificial Sequence
  dgRNA
  Eprs
gacgtcagtatccgc

SEQ ID NO: 1443 - DNA, 15 bp, Artificial Sequence
  dgRNA
  Eprs
tcagtatccgcgggc

SEQ ID NO: 1444 - DNA, 15 bp, Artificial Sequence
  dgRNA
  Eprs
cagtatccgcgggcc

SEQ ID NO: 1445 - DNA, 15 bp, Artificial Sequence
  dgRNA
  0610030E20Rik
ctccttctttcgttc

SEQ ID NO: 1446 - DNA, 15 bp, Artificial Sequence
  dgRNA
  0610030E20Rik
ggcgctcacagatga

SEQ ID NO: 1447 - DNA, 15 bp, Artificial Sequence
  dgRNA
  0610030E20Rik
ctgctccgctgcgcc

SEQ ID NO: 1448 - DNA, 15 bp, Artificial Sequence
  dgRNA
  0610030E20Rik
ctggccctacgcaac

SEQ ID NO: 1449 - DNA, 15 bp, Artificial Sequence
  dgRNA
  Lsm1
tccgcccttccgacc

SEQ ID NO: 1450 - DNA, 15 bp, Artificial Sequence
  dgRNA
  Lsm1
tggtcggccaccgac

SEQ ID NO: 1451 - DNA, 15 bp, Artificial Sequence
  dgRNA
  Lsm1
gactggcaacacgcc

SEQ ID NO: 1452 - DNA, 15 bp, Artificial Sequence
  dgRNA
  Lsm1
ccggcacgcctcttt

SEQ ID NO: 1453 - DNA, 15 bp, Artificial Sequence
  dgRNA
  Kat2b
ccaggagaagacgat

SEQ ID NO: 1454 - DNA, 15 bp, Artificial Sequence
  dgRNA
  Kat2b
ttcacgccatgattt

SEQ ID NO: 1455 - DNA, 15 bp, Artificial Sequence
  dgRNA
  Kat2b
aggattggccgctga

SEQ ID NO: 1456 - DNA, 15 bp, Artificial Sequence
  dgRNA
  Kat2b
ggattggccgctgac

SEQ ID NO: 1457 - DNA, 15 bp, Artificial Sequence
  dgRNA
  Zfp827
gaagaatattacgct

SEQ ID NO: 1458 - DNA, 15 bp, Artificial Sequence
  dgRNA
  Zfp827
agaatattacgctcg

SEQ ID NO: 1459 - DNA, 15 bp, Artificial Sequence
  dgRNA
  Zfp827
gctcggggacaagcc

SEQ ID NO: 1460 - DNA, 15 bp, Artificial Sequence
  dgRNA
  Zfp827
agaaaacccctcttc

SEQ ID NO: 1461 - DNA, 15 bp, Artificial Sequence
  dgRNA
  Atg16l2
cctggacgcgcccac

SEQ ID NO: 1462 - DNA, 15 bp, Artificial Sequence
  dgRNA
  Atg16l2
gcgcccacaggcgac

SEQ ID NO: 1463 - DNA, 15 bp, Artificial Sequence
  dgRNA
  Atg16l2
cgcccacaggcgaca

SEQ ID NO: 1464 - DNA, 15 bp, Artificial Sequence
  dgRNA
  Atg16l2
ccacaggcgacaggg

SEQ ID NO: 1465 - DNA, 15 bp, Artificial Sequence
  dgRNA
  Pdha1
cccacgcaggcgccc

SEQ ID NO: 1466 - DNA, 15 bp, Artificial Sequence
  dgRNA
  Pdha1
ccacgcaggcgccct

SEQ ID NO: 1467 - DNA, 15 bp, Artificial Sequence
  dgRNA
  Pdha1
ggcgccctgggacac

SEQ ID NO: 1468 - DNA, 15 bp, Artificial Sequence
  dgRNA
  Pdha1
gcctgcagactagcg

SEQ ID NO: 1469 - DNA, 15 bp, Artificial Sequence
  dgRNA
  Fam46d
tcgcttcggttagga

SEQ ID NO: 1470 - DNA, 15 bp, Artificial Sequence
  dgRNA
  Fam46d
cggttaggatggctc

SEQ ID NO: 1471 - DNA, 15 bp, Artificial Sequence
  dgRNA
  Fam46d
tggctctggtcgctt

SEQ ID NO: 1472 - DNA, 15 bp, Artificial Sequence
  dgRNA
  Fam46d
ggctctggtcgcttg

SEQ ID NO: 1473 - DNA, 15 bp, Artificial Sequence
  dgRNA
  Mgat4c
tcatggcataagggt

SEQ ID NO: 1474 - DNA, 15 bp, Artificial Sequence
  dgRNA
  Mgat4c
ttaactcatggcata

SEQ ID NO: 1475 - DNA, 15 bp, Artificial Sequence
  dgRNA
  Mgat4c
tgtatgcgcagatca

SEQ ID NO: 1476 - DNA, 15 bp, Artificial Sequence
  dgRNA
  Chn2
cacgtctcccataaa

SEQ ID NO: 1477 - DNA, 15 bp, Artificial Sequence
  dgRNA
  Chn2
ctcccataaacggct

SEQ ID NO: 1478 - DNA, 15 bp, Artificial Sequence
  dgRNA
  Chn2
gattaaagaatcctc

SEQ ID NO: 1479 - DNA, 15 bp, Artificial Sequence
  dgRNA
  Chn2
aatcctctgggttaa

SEQ ID NO: 1480 - DNA, 15 bp, Artificial Sequence
  dgRNA
  Neurog2
gcgggggaccaggac

SEQ ID NO: 1481 - DNA, 15 bp, Artificial Sequence
  dgRNA
  Neurog2
gaccaggacaggcgg

SEQ ID NO: 1482 - DNA, 15 bp, Artificial Sequence
  dgRNA
  Neurog2
tcttggtggtatata

SEQ ID NO: 1483 - DNA, 15 bp, Artificial Sequence
  dgRNA
  Neurog2
cttggtggtatataa

SEQ ID NO: 1484 - DNA, 15 bp, Artificial Sequence
  dgRNA
  Mapk8ip3
caccagcaacgcagc

SEQ ID NO: 1485 - DNA, 15 bp, Artificial Sequence
  dgRNA
  Mapk8ip3
gttcctttagcgtca

SEQ ID NO: 1486 - DNA, 15 bp, Artificial Sequence
  dgRNA
  Mapk8ip3
tagcgtcaaggcgct

SEQ ID NO: 1487 - DNA, 15 bp, Artificial Sequence
  dgRNA
  Mapk8ip3
agcgtcaaggcgctc

SEQ ID NO: 1488 - DNA, 15 bp, Artificial Sequence
  dgRNA
  Foxf1
cgcgtggcctcccgc

SEQ ID NO: 1489 - DNA, 15 bp, Artificial Sequence
  dgRNA
  Foxf1
gcgtggcctcccgca

SEQ ID NO: 1490 - DNA, 15 bp, Artificial Sequence
  dgRNA
  Foxf1
tggcctcccgcaggg

SEQ ID NO: 1491 - DNA, 15 bp, Artificial Sequence
  dgRNA
  Foxf1
ggagaatagcgcgcc

SEQ ID NO: 1492 - DNA, 15 bp, Artificial Sequence
  dgRNA
  Aif1l
atatcggtgttatcg

SEQ ID NO: 1493 - DNA, 15 bp, Artificial Sequence
  dgRNA
  Aif1l
ttatcgtggcactgc

SEQ ID NO: 1494 - DNA, 15 bp, Artificial Sequence
  dgRNA
  Aif1l
tatcgtggcactgcc

SEQ ID NO: 1495 - DNA, 15 bp, Artificial Sequence
  dgRNA
  Aif1l
ggcactgccgggcaa

SEQ ID NO: 1496 - DNA, 15 bp, Artificial Sequence
  dgRNA
  Tspan18
gacccggtgagagag

SEQ ID NO: 1497 - DNA, 15 bp, Artificial Sequence
  dgRNA
  Tspan18
gtgagagagcggccg

SEQ ID NO: 1498 - DNA, 15 bp, Artificial Sequence
  dgRNA
  Tspan18
gagccgtgtccgccc

SEQ ID NO: 1499 - DNA, 15 bp, Artificial Sequence
  dgRNA
  Tspan18
gacgcgccagcaccg

SEQ ID NO: 1500 - DNA, 15 bp, Artificial Sequence
  dgRNA
  Tas2r104
attcttgatgtcctc

SEQ ID NO: 1501 - DNA, 15 bp, Artificial Sequence
  dgRNA
  Tas2r104
gagtcattatttaag

SEQ ID NO: 1502 - DNA, 15 bp, Artificial Sequence
  dgRNA
  Tas2r104
caacaattctgcagc

SEQ ID NO: 1503 - DNA, 15 bp, Artificial Sequence
  dgRNA
  Phf2
tttgtgtcccgcgcg

SEQ ID NO: 1504 - DNA, 15 bp, Artificial Sequence
  dgRNA
  Phf2
tgtcccgcgcgcggc

SEQ ID NO: 1505 - DNA, 15 bp, Artificial Sequence
  dgRNA
  Phf2
gtcccgcgcgcggcc

SEQ ID NO: 1506 - DNA, 15 bp, Artificial Sequence
  dgRNA
  Phf2
ctgcgccccgcggcc

SEQ ID NO: 1507 - DNA, 15 bp, Artificial Sequence
  dgRNA
  Urgcp
aggctctaggttaat

SEQ ID NO: 1508 - DNA, 15 bp, Artificial Sequence
  dgRNA
  Urgcp
gctaatacaaaccta

SEQ ID NO: 1509 - DNA, 15 bp, Artificial Sequence
  dgRNA
  Urgcp
ctaatacaaacctac

SEQ ID NO: 1510 - DNA, 15 bp, Artificial Sequence
  dgRNA
  Urgcp
tcgtgctaggcaccc

SEQ ID NO: 1511 - DNA, 15 bp, Artificial Sequence
  dgRNA
  Gstm4
cttaatcagcacttc

SEQ ID NO: 1512 - DNA, 15 bp, Artificial Sequence
  dgRNA
  Gstm4
ttaatcagcacttcc

SEQ ID NO: 1513 - DNA, 15 bp, Artificial Sequence
  dgRNA
  Gstm4
tcagcacttccgggt

SEQ ID NO: 1514 - DNA, 15 bp, Artificial Sequence
  dgRNA
  Gstm4
cagcacttccgggtt

SEQ ID NO: 1515 - DNA, 15 bp, Artificial Sequence
  dgRNA
  Tldc1
gtgttccgctgttac

SEQ ID NO: 1516 - DNA, 15 bp, Artificial Sequence
  dgRNA
  Tldc1
cagttcttcgatccc

SEQ ID NO: 1517 - DNA, 15 bp, Artificial Sequence
  dgRNA
  Tldc1
ggttaagatctgact

SEQ ID NO: 1518 - DNA, 15 bp, Artificial Sequence
  dgRNA
  Tldc1
gttaagatctgactc

SEQ ID NO: 1519 - DNA, 15 bp, Artificial Sequence
  dgRNA
  AB124611
actaccaagattctc

SEQ ID NO: 1520 - DNA, 15 bp, Artificial Sequence
  dgRNA
  AB124611
ctaccaagattctcg

SEQ ID NO: 1521 - DNA, 15 bp, Artificial Sequence
  dgRNA
  AB124611
gattctcggggttga

SEQ ID NO: 1522 - DNA, 15 bp, Artificial Sequence
  dgRNA
  AB124611
ctcggggttgaaggg

SEQ ID NO: 1523 - DNA, 15 bp, Artificial Sequence
  dgRNA
  F830045P16Rik
cccccgagttgaacc

SEQ ID NO: 1524 - DNA, 15 bp, Artificial Sequence
  dgRNA
  F830045P16Rik
ccaggttcaactcgg

SEQ ID NO: 1525 - DNA, 15 bp, Artificial Sequence
  dgRNA
  F830045P16Rik
tccaggttcaactcg

SEQ ID NO: 1526 - DNA, 15 bp, Artificial Sequence
  dgRNA
  F830045P16Rik
gtccaggttcaactc

SEQ ID NO: 1527 - DNA, 15 bp, Artificial Sequence
  dgRNA
  Atp6v1b1
gggggcagccactac

SEQ ID NO: 1528 - DNA, 15 bp, Artificial Sequence
  dgRNA
  Atp6v1b1
tgtttacagtcaacc

SEQ ID NO: 1529 - DNA, 15 bp, Artificial Sequence
  dgRNA
  Atp6v1b1
atgcgccagctccca

SEQ ID NO: 1530 - DNA, 15 bp, Artificial Sequence
  dgRNA
  Atp6v1b1
ggttgactgtaaaca

SEQ ID NO: 1531 - DNA, 15 bp, Artificial Sequence
  dgRNA
  Tmem194
gacggaagcagattg

SEQ ID NO: 1532 - DNA, 15 bp, Artificial Sequence
  dgRNA
  Tmem194
acggaagcagattgc

SEQ ID NO: 1533 - DNA, 15 bp, Artificial Sequence
  dgRNA
  Tmem194
cggaagcagattgcg

SEQ ID NO: 1534 - DNA, 15 bp, Artificial Sequence
  dgRNA
  Tmem194
gcagattgcggggaa

SEQ ID NO: 1535 - DNA, 15 bp, Artificial Sequence
  dgRNA
  Rnd3
tgcacgccaccctag

SEQ ID NO: 1536 - DNA, 15 bp, Artificial Sequence
  dgRNA
  Rnd3
gcacgccaccctaga

SEQ ID NO: 1537 - DNA, 15 bp, Artificial Sequence
  dgRNA
  Rnd3
tacactttccgccaa

SEQ ID NO: 1538 - DNA, 15 bp, Artificial Sequence
  dgRNA
  Rnd3
acactttccgccaac

SEQ ID NO: 1539 - DNA, 15 bp, Artificial Sequence
  dgRNA
  Rnaseh2a
cgtaaacgaccacgc

SEQ ID NO: 1540 - DNA, 15 bp, Artificial Sequence
  dgRNA
  Rnaseh2a
aaacgaccacgccgg

SEQ ID NO: 1541 - DNA, 15 bp, Artificial Sequence
  dgRNA
  Rnaseh2a
aacgaccacgccgga

SEQ ID NO: 1542 - DNA, 15 bp, Artificial Sequence
  dgRNA
  Rnaseh2a
ccggagggcgcatcg

SEQ ID NO: 1543 - DNA, 15 bp, Artificial Sequence
  dgRNA
  Rhod
cttgagtgtctagac

SEQ ID NO: 1544 - DNA, 15 bp, Artificial Sequence
  dgRNA
  Rhod
tctagacaggacgcc

SEQ ID NO: 1545 - DNA, 15 bp, Artificial Sequence
  dgRNA
  Rhod
aggagaccggacccc

SEQ ID NO: 1546 - DNA, 15 bp, Artificial Sequence
  dgRNA
  Rhod
aggagcgtccaccct

SEQ ID NO: 1547 - DNA, 15 bp, Artificial Sequence
  dgRNA
  Mink1
acgcgcaccagcggg

SEQ ID NO: 1548 - DNA, 15 bp, Artificial Sequence
  dgRNA
  Mink1
aggctctagcgagac

SEQ ID NO: 1549 - DNA, 15 bp, Artificial Sequence
  dgRNA
  Mink1
ggctctagcgagact

SEQ ID NO: 1550 - DNA, 15 bp, Artificial Sequence
  dgRNA
  Mink1
cctgcgcgcaggtgt

SEQ ID NO: 1551 - DNA, 15 bp, Artificial Sequence
  dgRNA
  Rpl38
tgaacgcatcctttc

SEQ ID NO: 1552 - DNA, 15 bp, Artificial Sequence
  dgRNA
  Rpl38
ttcctctgttgggcg

SEQ ID NO: 1553 - DNA, 15 bp, Artificial Sequence
  dgRNA
  Rpl38
gcggggttaaccgtc

SEQ ID NO: 1554 - DNA, 15 bp, Artificial Sequence
  dgRNA
  Rpl38
ttaaccgtccggaag

SEQ ID NO: 1555 - DNA, 15 bp, Artificial Sequence
  dgRNA
  Lyrm1
gccctttactgtaca

SEQ ID NO: 1556 - DNA, 15 bp, Artificial Sequence
  dgRNA
  Lyrm1
attagtaatgatcag

SEQ ID NO: 1557 - DNA, 15 bp, Artificial Sequence
  dgRNA
  Lyrm1
agtaaataaccctgc

SEQ ID NO: 1558 - DNA, 15 bp, Artificial Sequence
  dgRNA
  Lyrm1
atccctgtacagtaa

SEQ ID NO: 1559 - DNA, 15 bp, Artificial Sequence
  dgRNA
  Gm21992
ctcaacctgtttgat

SEQ ID NO: 1560 - DNA, 15 bp, Artificial Sequence
  dgRNA
  Gm21992
gatgccgcctccaat

SEQ ID NO: 1561 - DNA, 15 bp, Artificial Sequence
  dgRNA
  Gm21992
cgcctccaattggtt

SEQ ID NO: 1562 - DNA, 15 bp, Artificial Sequence
  dgRNA
  Gm21992
gttagagcgcctgcg

SEQ ID NO: 1563 - DNA, 15 bp, Artificial Sequence
  dgRNA
  Gimap4
tagctacttagcact

SEQ ID NO: 1564 - DNA, 15 bp, Artificial Sequence
  dgRNA
  Gimap4
tcatgtggtacccat

SEQ ID NO: 1565 - DNA, 15 bp, Artificial Sequence
  dgRNA
  Gimap4
aataggagtgtgcaa

SEQ ID NO: 1566 - DNA, 15 bp, Artificial Sequence
  dgRNA
  Ceacam16
tcctccctggcgacc

SEQ ID NO: 1567 - DNA, 15 bp, Artificial Sequence
  dgRNA
  Ceacam16
ctcagtaccaaatct

SEQ ID NO: 1568 - DNA, 15 bp, Artificial Sequence
  dgRNA
  Ceacam16
gcctttggcacaaag

SEQ ID NO: 1569 - DNA, 15 bp, Artificial Sequence
  dgRNA
  Ceacam16
ccctagtgcccaaac

SEQ ID NO: 1570 - DNA, 15 bp, Artificial Sequence
  dgRNA
  Islr2
tagaagcgaagctcg

SEQ ID NO: 1571 - DNA, 15 bp, Artificial Sequence
  dgRNA
  Islr2
agaagcgaagctcgc

SEQ ID NO: 1572 - DNA, 15 bp, Artificial Sequence
  dgRNA
  Islr2
gaagctcgcgggcgc

SEQ ID NO: 1573 - DNA, 15 bp, Artificial Sequence
  dgRNA
  Islr2
gctcgcgggcgctgg

SEQ ID NO: 1574 - DNA, 15 bp, Artificial Sequence
  dgRNA
  Cnbp
ggacgaactgctagt

SEQ ID NO: 1575 - DNA, 15 bp, Artificial Sequence
  dgRNA
  Cnbp
gtagacacggaaccc

SEQ ID NO: 1576 - DNA, 15 bp, Artificial Sequence
  dgRNA
  Cnbp
cacggaacccaggta

SEQ ID NO: 1577 - DNA, 15 bp, Artificial Sequence
  dgRNA
  Cnbp
acggaacccaggtac

SEQ ID NO: 1578 - DNA, 15 bp, Artificial Sequence
  dgRNA
  Tcirg1
cagattgtacgtact

SEQ ID NO: 1579 - DNA, 15 bp, Artificial Sequence
  dgRNA
  Tcirg1
ttgtacgtactagga

SEQ ID NO: 1580 - DNA, 15 bp, Artificial Sequence
  dgRNA
  Tcirg1
ggtggcctatcctta

SEQ ID NO: 1581 - DNA, 15 bp, Artificial Sequence
  dgRNA
  Tcirg1
tcatctcccgattat

SEQ ID NO: 1582 - DNA, 15 bp, Artificial Sequence
  dgRNA
  Nadk2
cagaccagttccaac

SEQ ID NO: 1583 - DNA, 15 bp, Artificial Sequence
  dgRNA
  Nadk2
attagctgacagatc

SEQ ID NO: 1584 - DNA, 15 bp, Artificial Sequence
  dgRNA
  Nadk2
gacagatctggcccg

SEQ ID NO: 1585 - DNA, 15 bp, Artificial Sequence
  dgRNA
  Nadk2
acagatctggcccgg

SEQ ID NO: 1586 - DNA, 15 bp, Artificial Sequence
  dgRNA
  Heyl
ttggtcccctataga

SEQ ID NO: 1587 - DNA, 15 bp, Artificial Sequence
  dgRNA
  Heyl
ctgtcgcacagaact

SEQ ID NO: 1588 - DNA, 15 bp, Artificial Sequence
  dgRNA
  Heyl
tgtcgcacagaacta

SEQ ID NO: 1589 - DNA, 15 bp, Artificial Sequence
  dgRNA
  Heyl
aactagggacagatc

SEQ ID NO: 1590 - DNA, 15 bp, Artificial Sequence
  dgRNA
  Slc29a1
catgtgcgacctgtg

SEQ ID NO: 1591 - DNA, 15 bp, Artificial Sequence
  dgRNA
  Slc29a1
gcgacctgtgtggac

SEQ ID NO: 1592 - DNA, 15 bp, Artificial Sequence
  dgRNA
  Slc29a1
cacggcccctcccac

SEQ ID NO: 1593 - DNA, 15 bp, Artificial Sequence
  dgRNA
  Slc29a1
cctccttcggccacc

SEQ ID NO: 1594 - DNA, 15 bp, Artificial Sequence
  dgRNA
  Rtn4
gacgagcctccagcg

SEQ ID NO: 1595 - DNA, 15 bp, Artificial Sequence
  dgRNA
  Rtn4
ctccagcgcggcctc

SEQ ID NO: 1596 - DNA, 15 bp, Artificial Sequence
  dgRNA
  Rtn4
gcctccggcgccagc

SEQ ID NO: 1597 - DNA, 15 bp, Artificial Sequence
  dgRNA
  Rtn4
gcgcgagccccctag

SEQ ID NO: 1598 - DNA, 15 bp, Artificial Sequence
  dgRNA
  Pradc1
tggccaatcagcgcc

SEQ ID NO: 1599 - DNA, 15 bp, Artificial Sequence
  dgRNA
  Pradc1
cggttccacttctcc

SEQ ID NO: 1600 - DNA, 15 bp, Artificial Sequence
  dgRNA
  Pradc1
ataggaagtggccta

SEQ ID NO: 1601 - DNA, 15 bp, Artificial Sequence
  dgRNA
  Pradc1
tggcctagggcgcag

SEQ ID NO: 1602 - DNA, 15 bp, Artificial Sequence
  dgRNA
  Actr1a
gaccccaccatgtgt

SEQ ID NO: 1603 - DNA, 15 bp, Artificial Sequence
  dgRNA
  Actr1a
ctcctaaatccgatc

SEQ ID NO: 1604 - DNA, 15 bp, Artificial Sequence
  dgRNA
  Actr1a
taaatccgatcgggc

SEQ ID NO: 1605 - DNA, 15 bp, Artificial Sequence
  dgRNA
  Actr1a
aaatccgatcgggct

SEQ ID NO: 1606 - DNA, 15 bp, Artificial Sequence
  dgRNA
  Dffb
tcttcggaggggtct

SEQ ID NO: 1607 - DNA, 15 bp, Artificial Sequence
  dgRNA
  Dffb
tgcgcgtccgcccgc

SEQ ID NO: 1608 - DNA, 15 bp, Artificial Sequence
  dgRNA
  Dffb
cctgcgtgcgcatcc

SEQ ID NO: 1609 - DNA, 15 bp, Artificial Sequence
  dgRNA
  Dffb
cgcatccaggcctcg

SEQ ID NO: 1610 - DNA, 15 bp, Artificial Sequence
  dgRNA
  Chac2
ggtgccctataagac

SEQ ID NO: 1611 - DNA, 15 bp, Artificial Sequence
  dgRNA
  Chac2
actctaaagaattgt

SEQ ID NO: 1612 - DNA, 15 bp, Artificial Sequence
  dgRNA
  Chac2
gactcctgtcttata

SEQ ID NO: 1613 - DNA, 15 bp, Artificial Sequence
  dgRNA
  Chac2
ggactcctgtcttat

SEQ ID NO: 1614 - DNA, 15 bp, Artificial Sequence
  dgRNA
  Rbm45
gcttaagaatcaggc

SEQ ID NO: 1615 - DNA, 15 bp, Artificial Sequence
  dgRNA
  Rbm45
gatctttttagccac

SEQ ID NO: 1616 - DNA, 15 bp, Artificial Sequence
  dgRNA
  Rbm45
gcataaacccattct

SEQ ID NO: 1617 - DNA, 15 bp, Artificial Sequence
  dgRNA
  Rbm45
ttgctgagtccaccg

SEQ ID NO: 1618 - DNA, 15 bp, Artificial Sequence
  dgRNA
  Nlrc3
gaatgtcaacaattt

SEQ ID NO: 1619 - DNA, 15 bp, Artificial Sequence
  dgRNA
  Nlrc3
cgagcacatgctgtg

SEQ ID NO: 1620 - DNA, 15 bp, Artificial Sequence
  dgRNA
  Nlrc3
ataacttccctactc

SEQ ID NO: 1621 - DNA, 15 bp, Artificial Sequence
  dgRNA
  Nlrc3
taacttccctactct

SEQ ID NO: 1622 - DNA, 15 bp, Artificial Sequence
  dgRNA
  Ctu1
tcggttcccaggccc

SEQ ID NO: 1623 - DNA, 15 bp, Artificial Sequence
  dgRNA
  Ctu1
tgcgccctacagagt

SEQ ID NO: 1624 - DNA, 15 bp, Artificial Sequence
  dgRNA
  Ctu1
tacagagtcggcccg

SEQ ID NO: 1625 - DNA, 15 bp, Artificial Sequence
  dgRNA
  Ctu1
acagagtcggcccgt

SEQ ID NO: 1626 - DNA, 15 bp, Artificial Sequence
  dgRNA
  Taf3
cactcggcttccggc

SEQ ID NO: 1627 - DNA, 15 bp, Artificial Sequence
  dgRNA
  Taf3
tcgctctcctcccac

SEQ ID NO: 1628 - DNA, 15 bp, Artificial Sequence
  dgRNA
  Taf3
gggccgcctatctct

SEQ ID NO: 1629 - DNA, 15 bp, Artificial Sequence
  dgRNA
  Taf3
cgtactgcctcgccc

SEQ ID NO: 1630 - DNA, 15 bp, Artificial Sequence
  dgRNA
  Rpf1
accagcgtccagcct

SEQ ID NO: 1631 - DNA, 15 bp, Artificial Sequence
  dgRNA
  Rpf1
gcaaagcgctagttc

SEQ ID NO: 1632 - DNA, 15 bp, Artificial Sequence
  dgRNA
  Rpf1
gctagttccggaact

SEQ ID NO: 1633 - DNA, 15 bp, Artificial Sequence
  dgRNA
  Rpf1
agttccggaacttgg

SEQ ID NO: 1634 - DNA, 15 bp, Artificial Sequence
  dgRNA
  Tgfb1
ccccgcagggctgaa

SEQ ID NO: 1635 - DNA, 15 bp, Artificial Sequence
  dgRNA
  Tgfb1
tgaagggacccccct

SEQ ID NO: 1636 - DNA, 15 bp, Artificial Sequence
  dgRNA
  Tgfb1
cccgcgcgcgcttcc

SEQ ID NO: 1637 - DNA, 15 bp, Artificial Sequence
  dgRNA
  Tgfb1
ccgcgcgcgcttcct

SEQ ID NO: 1638 - DNA, 15 bp, Artificial Sequence
  dgRNA
  Dnajc6
gcgctgtccagccta

SEQ ID NO: 1639 - DNA, 15 bp, Artificial Sequence
  dgRNA
  Dnajc6
cgctgtccagcctac

SEQ ID NO: 1640 - DNA, 15 bp, Artificial Sequence
  dgRNA
  Dnajc6
tgtccagcctacggg

SEQ ID NO: 1641 - DNA, 15 bp, Artificial Sequence
  dgRNA
  Dnajc6
cagcctacgggtggc

SEQ ID NO: 1642 - DNA, 15 bp, Artificial Sequence
  dgRNA
  Msr1
agcatctagcccaca

SEQ ID NO: 1643 - DNA, 15 bp, Artificial Sequence
  dgRNA
  Treml1
ccctcacttgcctac

SEQ ID NO: 1644 - DNA, 15 bp, Artificial Sequence
  dgRNA
  Treml1
tgcctaccggtctct

SEQ ID NO: 1645 - DNA, 15 bp, Artificial Sequence
  dgRNA
  Treml1
gcctaccggtctctc

SEQ ID NO: 1646 - DNA, 15 bp, Artificial Sequence
  dgRNA
  Treml1
cctaccggtctctcg

SEQ ID NO: 1647 - DNA, 15 bp, Artificial Sequence
  dgRNA
  Kctd17
aatcactgttttcgc

SEQ ID NO: 1648 - DNA, 15 bp, Artificial Sequence
  dgRNA
  Kctd17
atcactgttttcgca

SEQ ID NO: 1649 - DNA, 15 bp, Artificial Sequence
  dgRNA
  Kctd17
ttctgctttgtacgg

SEQ ID NO: 1650 - DNA, 15 bp, Artificial Sequence
  dgRNA
  Kctd17
gttctgctttgtacg

SEQ ID NO: 1651 - DNA, 15 bp, Artificial Sequence
  dgRNA
  Kynu
agatgtttggcaacc

SEQ ID NO: 1652 - DNA, 15 bp, Artificial Sequence
  dgRNA
  Kynu
gatgtttggcaacct

SEQ ID NO: 1653 - DNA, 15 bp, Artificial Sequence
  dgRNA
  Kynu
gcaacctgattcaac

SEQ ID NO: 1654 - DNA, 15 bp, Artificial Sequence
  dgRNA
  Kynu
caacctgattcaaca

SEQ ID NO: 1655 - DNA, 15 bp, Artificial Sequence
  dgRNA
  Tnfsf8
gcaaagagactaatc

SEQ ID NO: 1656 - DNA, 15 bp, Artificial Sequence
  dgRNA
  Tnfsf8
agggtccccgcggca

SEQ ID NO: 1657 - DNA, 15 bp, Artificial Sequence
  dgRNA
  Tnfsf8
tggtgtacactcacg

SEQ ID NO: 1658 - DNA, 15 bp, Artificial Sequence
  dgRNA
  Tnfsf8
cagcatgctctaaac

SEQ ID NO: 1659 - DNA, 15 bp, Artificial Sequence
  dgRNA
  Cad
tgtttctagcttgac

SEQ ID NO: 1660 - DNA, 15 bp, Artificial Sequence
  dgRNA
  Cad
tctagcttgaccggc

SEQ ID NO: 1661 - DNA, 15 bp, Artificial Sequence
  dgRNA
  Cad
cttgaccggctggtt

SEQ ID NO: 1662 - DNA, 15 bp, Artificial Sequence
  dgRNA
  Cad
tgaccggctggtttg

SEQ ID NO: 1663 - DNA, 15 bp, Artificial Sequence
  dgRNA
  Fam109b
caccgacgagtcctg

SEQ ID NO: 1664 - DNA, 15 bp, Artificial Sequence
  dgRNA
  Fam109b
cgagtcctgtggcgc

SEQ ID NO: 1665 - DNA, 15 bp, Artificial Sequence
  dgRNA
  Fam109b
ccaatatgcgagccg

SEQ ID NO: 1666 - DNA, 15 bp, Artificial Sequence
  dgRNA
  Fam109b
gccgaggcgactttg

SEQ ID NO: 1667 - DNA, 15 bp, Artificial Sequence
  dgRNA
  Ccdc122
cccaaagtcaccggc

SEQ ID NO: 1668 - DNA, 15 bp, Artificial Sequence
  dgRNA
  Ccdc122
aagtcaccggccggc

SEQ ID NO: 1669 - DNA, 15 bp, Artificial Sequence
  dgRNA
  Ccdc122
gcctcaccgcgtccc

SEQ ID NO: 1670 - DNA, 15 bp, Artificial Sequence
  dgRNA
  Ccdc122
cctcaccgcgtcccc

SEQ ID NO: 1671 - DNA, 15 bp, Artificial Sequence
  dgRNA
  Trpc2
ggagacgtcatcatg

SEQ ID NO: 1672 - DNA, 15 bp, Artificial Sequence
  dgRNA
  Trpc2
tgtccccaaggtacg

SEQ ID NO: 1673 - DNA, 15 bp, Artificial Sequence
  dgRNA
  Trpc2
cccaaggtacgaggc

SEQ ID NO: 1674 - DNA, 15 bp, Artificial Sequence
  dgRNA
  Trpc2
ccaaggtacgaggca

SEQ ID NO: 1675 - DNA, 15 bp, Artificial Sequence
  dgRNA
  Pgm3
gcagccgcagttccg

SEQ ID NO: 1676 - DNA, 15 bp, Artificial Sequence
  dgRNA
  Pgm3
cagccgcagttccgc

SEQ ID NO: 1677 - DNA, 15 bp, Artificial Sequence
  dgRNA
  Pgm3
ggcgcgagcagcgcg

SEQ ID NO: 1678 - DNA, 15 bp, Artificial Sequence
  dgRNA
  Pgm3
cgagcagcgcgcgga

SEQ ID NO: 1679 - DNA, 15 bp, Artificial Sequence
  dgRNA
  Aoc1
gtggccacctattaa

SEQ ID NO: 1680 - DNA, 15 bp, Artificial Sequence
  dgRNA
  Aoc1
tggccacctattaaa

SEQ ID NO: 1681 - DNA, 15 bp, Artificial Sequence
  dgRNA
  Aoc1
ggccacctattaaag

SEQ ID NO: 1682 - DNA, 15 bp, Artificial Sequence
  dgRNA
  Aoc1
ccctagcacctgtcc

SEQ ID NO: 1683 - DNA, 15 bp, Artificial Sequence
  dgRNA
  Slc25a39
caagcgccgtccagt

SEQ ID NO: 1684 - DNA, 15 bp, Artificial Sequence
  dgRNA
  Slc25a39
gcgaccttgacctgc

SEQ ID NO: 1685 - DNA, 15 bp, Artificial Sequence
  dgRNA
  Slc25a39
gacctgccggccgca

SEQ ID NO: 1686 - DNA, 15 bp, Artificial Sequence
  dgRNA
  Slc25a39
cggccgcaaggagcg

SEQ ID NO: 1687 - DNA, 15 bp, Artificial Sequence
  dgRNA
  Rfx3
ccgcagccccccgcc

SEQ ID NO: 1688 - DNA, 15 bp, Artificial Sequence
  dgRNA
  Rfx3
cgaagccgcttcttc

SEQ ID NO: 1689 - DNA, 15 bp, Artificial Sequence
  dgRNA
  Rfx3
ttcttccggcgctct

SEQ ID NO: 1690 - DNA, 15 bp, Artificial Sequence
  dgRNA
  Rfx3
tcttccggcgctctc

SEQ ID NO: 1691 - DNA, 15 bp, Artificial Sequence
  dgRNA
  Pde5a
cacctttgcgcatag

SEQ ID NO: 1692 - DNA, 15 bp, Artificial Sequence
  dgRNA
  Pde5a
acctttgcgcataga

SEQ ID NO: 1693 - DNA, 15 bp, Artificial Sequence
  dgRNA
  Pde5a
agcgcaccccagcgg

SEQ ID NO: 1694 - DNA, 15 bp, Artificial Sequence
  dgRNA
  Pde5a
cgttcttagtagtac

SEQ ID NO: 1695 - DNA, 15 bp, Artificial Sequence
  dgRNA
  Clec4a4
agtgattccgtgctg

SEQ ID NO: 1696 - DNA, 15 bp, Artificial Sequence
  dgRNA
  Clec4a4
acctgttgctgcaat

SEQ ID NO: 1697 - DNA, 15 bp, Artificial Sequence
  dgRNA
  Clec4a4
agcacggaatcactc

SEQ ID NO: 1698 - DNA, 15 bp, Artificial Sequence
  dgRNA
  Clec4a4
accaattgcagcaac

SEQ ID NO: 1699 - DNA, 15 bp, Artificial Sequence
  dgRNA
  Pik3r4
ctgcttgaggcagcg

SEQ ID NO: 1700 - DNA, 15 bp, Artificial Sequence
  dgRNA
  Pik3r4
acttccgatctcaac

SEQ ID NO: 1701 - DNA, 15 bp, Artificial Sequence
  dgRNA
  Pik3r4
gtgaggtcaacccgg

SEQ ID NO: 1702 - DNA, 15 bp, Artificial Sequence
  dgRNA
  Pik3r4
acccggaggctttcc

SEQ ID NO: 1703 - DNA, 15 bp, Artificial Sequence
  dgRNA
  Tbc1d25
aggatattaattcga

SEQ ID NO: 1704 - DNA, 15 bp, Artificial Sequence
  dgRNA
  Tbc1d25
attcaaagccggttc

SEQ ID NO: 1705 - DNA, 15 bp, Artificial Sequence
  dgRNA
  Tbc1d25
tatgtcagcacgctg

SEQ ID NO: 1706 - DNA, 15 bp, Artificial Sequence
  dgRNA
  Tbc1d25
gaattaatatcctga

SEQ ID NO: 1707 - DNA, 15 bp, Artificial Sequence
  dgRNA
  4930539E08Rik
gagcgggaagcaacc

SEQ ID NO: 1708 - DNA, 15 bp, Artificial Sequence
  dgRNA
  4930539E08Rik
agcgggaagcaacct

SEQ ID NO: 1709 - DNA, 15 bp, Artificial Sequence
  dgRNA
  4930539E08Rik
gggcgggaagcaacc

SEQ ID NO: 1710 - DNA, 15 bp, Artificial Sequence
  dgRNA
  4930539E08Rik
gcttcccgctcctct

SEQ ID NO: 1711 - DNA, 15 bp, Artificial Sequence
  dgRNA
  Nlrp5
agggcttgacatcac

SEQ ID NO: 1712 - DNA, 15 bp, Artificial Sequence
  dgRNA
  Nlrp5
ctataaaggggttta

SEQ ID NO: 1713 - DNA, 15 bp, Artificial Sequence
  dgRNA
  Slc26a6
gttaacaagaatcgc

SEQ ID NO: 1714 - DNA, 15 bp, Artificial Sequence
  dgRNA
  Slc26a6
acaagaatcgcaggc

SEQ ID NO: 1715 - DNA, 15 bp, Artificial Sequence
  dgRNA
  Slc26a6
caagaatcgcaggca

SEQ ID NO: 1716 - DNA, 15 bp, Artificial Sequence
  dgRNA
  Slc26a6
cagaagctaggccga

SEQ ID NO: 1717 - DNA, 15 bp, Artificial Sequence
  dgRNA
  Chn1
ggaggcaatccaaca

SEQ ID NO: 1718 - DNA, 15 bp, Artificial Sequence
  dgRNA
  Chn1
gggctataacatctc

SEQ ID NO: 1719 - DNA, 15 bp, Artificial Sequence
  dgRNA
  Chn1
ctgaagctactcctc

SEQ ID NO: 1720 - DNA, 15 bp, Artificial Sequence
  dgRNA
  Cib1
ccgccccgatgcgtc

SEQ ID NO: 1721 - DNA, 15 bp, Artificial Sequence
  dgRNA
  Cib1
gtccggctcctcccc

SEQ ID NO: 1722 - DNA, 15 bp, Artificial Sequence
  dgRNA
  Cib1
tctcctgggcccgcg

SEQ ID NO: 1723 - DNA, 15 bp, Artificial Sequence
  dgRNA
  Cib1
agccggcccgctgag

SEQ ID NO: 1724 - DNA, 15 bp, Artificial Sequence
  dgRNA
  Eri2
tggccctcgcaaaaa

SEQ ID NO: 1725 - DNA, 15 bp, Artificial Sequence
  dgRNA
  Eri2
ttaaagcgctccctg

SEQ ID NO: 1726 - DNA, 15 bp, Artificial Sequence
  dgRNA
  Eri2
gtcgtgcgcagagcg

SEQ ID NO: 1727 - DNA, 15 bp, Artificial Sequence
  dgRNA
  Eri2
tcgtgcgcagagcga

SEQ ID NO: 1728 - DNA, 15 bp, Artificial Sequence
  dgRNA
  Kif23
ctgcgtcagaacgga

SEQ ID NO: 1729 - DNA, 15 bp, Artificial Sequence
  dgRNA
  Kif23
tgcgtcagaacggaa

SEQ ID NO: 1730 - DNA, 15 bp, Artificial Sequence
  dgRNA
  Kif23
gtcagaacggaaggg

SEQ ID NO: 1731 - DNA, 15 bp, Artificial Sequence
  dgRNA
  Kif23
gaacggaagggcgga

SEQ ID NO: 1732 - DNA, 15 bp, Artificial Sequence
  dgRNA
  Tef
agggcccgacgctcc

SEQ ID NO: 1733 - DNA, 15 bp, Artificial Sequence
  dgRNA
  Tef
gggcccgacgctccc

SEQ ID NO: 1734 - DNA, 15 bp, Artificial Sequence
  dgRNA
  Tef
ccgacgctcccgggc

SEQ ID NO: 1735 - DNA, 15 bp, Artificial Sequence
  dgRNA
  Tef
acgctcccgggcagg

SEQ ID NO: 1736 - DNA, 15 bp, Artificial Sequence
  dgRNA
  Cldn15
taatgcctcccttgg

SEQ ID NO: 1737 - DNA, 15 bp, Artificial Sequence
  dgRNA
  Cldn15
cccactcctagggcg

SEQ ID NO: 1738 - DNA, 15 bp, Artificial Sequence
  dgRNA
  Cldn15
tagggcggggagtct

SEQ ID NO: 1739 - DNA, 15 bp, Artificial Sequence
  dgRNA
  Cldn15
ggggagtctcgggct

SEQ ID NO: 1740 - DNA, 15 bp, Artificial Sequence
  dgRNA
  Eya3
tcgtgcgtaagatcc

SEQ ID NO: 1741 - DNA, 15 bp, Artificial Sequence
  dgRNA
  Eya3
cgtgcgtaagatcca

SEQ ID NO: 1742 - DNA, 15 bp, Artificial Sequence
  dgRNA
  Eya3
agtcaatcacgcaac

SEQ ID NO: 1743 - DNA, 15 bp, Artificial Sequence
  dgRNA
  Eya3
gtcaatcacgcaact

SEQ ID NO: 1744 - DNA, 15 bp, Artificial Sequence
  dgRNA
  Bfsp1
aatggcggaacaaag

SEQ ID NO: 1745 - DNA, 15 bp, Artificial Sequence
  dgRNA
  Bfsp1
cacccgggagctgta

SEQ ID NO: 1746 - DNA, 15 bp, Artificial Sequence
  dgRNA
  Bfsp1
acccgggagctgtat

SEQ ID NO: 1747 - DNA, 15 bp, Artificial Sequence
  dgRNA
  Bfsp1
cacacaaagcacccg

SEQ ID NO: 1748 - DNA, 15 bp, Artificial Sequence
  dgRNA
  Mad1l1
cgcaccccggggcag

SEQ ID NO: 1749 - DNA, 15 bp, Artificial Sequence
  dgRNA
  Mad1l1
tggaagagcgccctg

SEQ ID NO: 1750 - DNA, 15 bp, Artificial Sequence
  dgRNA
  Mad1l1
ggaagagcgccctgc

SEQ ID NO: 1751 - DNA, 15 bp, Artificial Sequence
  dgRNA
  Mad1l1
agcgccctgcgggac

SEQ ID NO: 1752 - DNA, 15 bp, Artificial Sequence
  dgRNA
  Elavl2
ttgccccggccgccc

SEQ ID NO: 1753 - DNA, 15 bp, Artificial Sequence
  dgRNA
  Elavl2
ccccgggaagcccaa

SEQ ID NO: 1754 - DNA, 15 bp, Artificial Sequence
  dgRNA
  Elavl2
cgggaagcccaatgg

SEQ ID NO: 1755 - DNA, 15 bp, Artificial Sequence
  dgRNA
  Elavl2
tgggcactcgcgggc

SEQ ID NO: 1756 - DNA, 15 bp, Artificial Sequence
  dgRNA
  Ggt7
gtagcgtcttcatcc

SEQ ID NO: 1757 - DNA, 15 bp, Artificial Sequence
  dgRNA
  Ggt7
cagtagactttaagc

SEQ ID NO: 1758 - DNA, 15 bp, Artificial Sequence
  dgRNA
  Ggt7
tagactttaagcagg

SEQ ID NO: 1759 - DNA, 15 bp, Artificial Sequence
  dgRNA
  Ggt7
gactttaagcaggcg

SEQ ID NO: 1760 - DNA, 15 bp, Artificial Sequence
  dgRNA
  Ppp1r14b
ccctttcaggaggcg

SEQ ID NO: 1761 - DNA, 15 bp, Artificial Sequence
  dgRNA
  Ppp1r14b
agggggcctgaagcg

SEQ ID NO: 1762 - DNA, 15 bp, Artificial Sequence
  dgRNA
  Ppp1r14b
ggggctggcccttta

SEQ ID NO: 1763 - DNA, 15 bp, Artificial Sequence
  dgRNA
  Ppp1r14b
agaaagcggcagcgg

SEQ ID NO: 1764 - DNA, 15 bp, Artificial Sequence
  dgRNA
  Ccdc70
ctccttacctaagtc

SEQ ID NO: 1765 - DNA, 15 bp, Artificial Sequence
  dgRNA
  Ccdc70
ttacctaagtctgga

SEQ ID NO: 1766 - DNA, 15 bp, Artificial Sequence
  dgRNA
  Ccdc70
tagttcaagctatct

SEQ ID NO: 1767 - DNA, 15 bp, Artificial Sequence
  dgRNA
  Ccdc70
gttcaagctatctag

SEQ ID NO: 1768 - DNA, 15 bp, Artificial Sequence
  dgRNA
  Cylc2
ttccccttatgtcac

SEQ ID NO: 1769 - DNA, 15 bp, Artificial Sequence
  dgRNA
  Cylc2
tccccttatgtcaca

SEQ ID NO: 1770 - DNA, 15 bp, Artificial Sequence
  dgRNA
  Cylc2
atagccacttatgct

SEQ ID NO: 1771 - DNA, 15 bp, Artificial Sequence
  dgRNA
  Cylc2
accctgtgacataag

SEQ ID NO: 1772 - DNA, 15 bp, Artificial Sequence
  dgRNA
  Nasp
aaggaaaaacgggct

SEQ ID NO: 1773 - DNA, 15 bp, Artificial Sequence
  dgRNA
  Nasp
aggaaaaacgggcta

SEQ ID NO: 1774 - DNA, 15 bp, Artificial Sequence
  dgRNA
  Nasp
aaaaacgggctaggg

SEQ ID NO: 1775 - DNA, 15 bp, Artificial Sequence
  dgRNA
  Nasp
aaaacgggctagggc

SEQ ID NO: 1776 - DNA, 15 bp, Artificial Sequence
  dgRNA
  Serpinb9c
gtcacacctgaagat

SEQ ID NO: 1777 - DNA, 15 bp, Artificial Sequence
  dgRNA
  Serpinb9c
aatagtcccctgcag

SEQ ID NO: 1778 - DNA, 15 bp, Artificial Sequence
  dgRNA
  Serpinb9c
actctgccgtgctgc

SEQ ID NO: 1779 - DNA, 15 bp, Artificial Sequence
  dgRNA
  Serpinb9c
atgagaccggaagac

SEQ ID NO: 1780 - DNA, 15 bp, Artificial Sequence
  dgRNA
  Cabp2
gagataatcccggat

SEQ ID NO: 1781 - DNA, 15 bp, Artificial Sequence
  dgRNA
  Cabp2
atcccggattggatt

SEQ ID NO: 1782 - DNA, 15 bp, Artificial Sequence
  dgRNA
  Cabp2
tcccggattggatta

SEQ ID NO: 1783 - DNA, 15 bp, Artificial Sequence
  dgRNA
  Cabp2
tagggcccaagcccc

SEQ ID NO: 1784 - DNA, 15 bp, Artificial Sequence
  dgRNA
  Rrp7a
acttcccaataggac

SEQ ID NO: 1785 - DNA, 15 bp, Artificial Sequence
  dgRNA
  Rrp7a
cttcccaataggaca

SEQ ID NO: 1786 - DNA, 15 bp, Artificial Sequence
  dgRNA
  Rrp7a
ggaaggctaaatctt

SEQ ID NO: 1787 - DNA, 15 bp, Artificial Sequence
  dgRNA
  Rrp7a
gaaggctaaatctta

SEQ ID NO: 1788 - DNA, 15 bp, Artificial Sequence
  dgRNA
  BC005537
ccctccgtcgccgcc

SEQ ID NO: 1789 - DNA, 15 bp, Artificial Sequence
  dgRNA
  BC005537
cctccgtcgccgccc

SEQ ID NO: 1790 - DNA, 15 bp, Artificial Sequence
  dgRNA
  BC005537
cgccgagcccgacta

SEQ ID NO: 1791 - DNA, 15 bp, Artificial Sequence
  dgRNA
  BC005537
gccgagcccgactat

SEQ ID NO: 1792 - DNA, 15 bp, Artificial Sequence
  dgRNA
  Slc17a3
tttcaaaccggaaaa

SEQ ID NO: 1793 - DNA, 15 bp, Artificial Sequence
  dgRNA
  Slc17a3
tttccggtttgaaat

SEQ ID NO: 1794 - DNA, 15 bp, Artificial Sequence
  dgRNA
  Slc17a3
ttttccggtttgaaa

SEQ ID NO: 1795 - DNA, 15 bp, Artificial Sequence
  dgRNA
  Ppp4r2
gcgcagctccagccg

SEQ ID NO: 1796 - DNA, 15 bp, Artificial Sequence
  dgRNA
  Ppp4r2
cgcagctccagccgc

SEQ ID NO: 1797 - DNA, 15 bp, Artificial Sequence
  dgRNA
  Ppp4r2
ccgcgcacgcgcact

SEQ ID NO: 1798 - DNA, 15 bp, Artificial Sequence
  dgRNA
  Ppp4r2
cgcacgcgcactggg

SEQ ID NO: 1799 - DNA, 15 bp, Artificial Sequence
  dgRNA
  Csad
cgcttagattcacag

SEQ ID NO: 1800 - DNA, 15 bp, Artificial Sequence
  dgRNA
  Csad
gcttagattcacagt

SEQ ID NO: 1801 - DNA, 15 bp, Artificial Sequence
  dgRNA
  Csad
ggctaatgattatgc

SEQ ID NO: 1802 - DNA, 15 bp, Artificial Sequence
  dgRNA
  Csad
gctaatgattatgca

SEQ ID NO: 1803 - DNA, 15 bp, Artificial Sequence
  dgRNA
  Tmem190
ctcttctcctaagta

SEQ ID NO: 1804 - DNA, 15 bp, Artificial Sequence
  dgRNA
  Tmem190
cctagatagaattga

SEQ ID NO: 1805 - DNA, 15 bp, Artificial Sequence
  dgRNA
  Tmem190
ctagatagaattgat

SEQ ID NO: 1806 - DNA, 15 bp, Artificial Sequence
  dgRNA
  Tmem190
gaaccccttgctgag

SEQ ID NO: 1807 - DNA, 15 bp, Artificial Sequence
  dgRNA
  Sytl5
gacactaggttgagc

SEQ ID NO: 1808 - DNA, 15 bp, Artificial Sequence
  dgRNA
  Sytl5
tattcgttcactttc

SEQ ID NO: 1809 - DNA, 15 bp, Artificial Sequence
  dgRNA
  Sytl5
tttgttgacaagtgc

SEQ ID NO: 1810 - DNA, 15 bp, Artificial Sequence
  dgRNA
  Pacrgl
cgtaaacttccttta

SEQ ID NO: 1811 - DNA, 15 bp, Artificial Sequence
  dgRNA
  Pacrgl
cacaggtgagcctta

SEQ ID NO: 1812 - DNA, 15 bp, Artificial Sequence
  dgRNA
  Pacrgl
tagtctccctataat

SEQ ID NO: 1813 - DNA, 15 bp, Artificial Sequence
  dgRNA
  Pacrgl
ttcgctctagttctc

SEQ ID NO: 1814 - DNA, 15 bp, Artificial Sequence
  dgRNA
  Bpifb1
aacccaaccctgtaa

SEQ ID NO: 1815 - DNA, 15 bp, Artificial Sequence
  dgRNA
  Bpifb1
acccaaccctgtaaa

SEQ ID NO: 1816 - DNA, 15 bp, Artificial Sequence
  dgRNA
  Bpifb1
cccaaccctgtaaag

SEQ ID NO: 1817 - DNA, 15 bp, Artificial Sequence
  dgRNA
  Bpifb1
gtaaaggggtcatga

SEQ ID NO: 1818 - DNA, 15 bp, Artificial Sequence
  dgRNA
  Trpc7
gttatgcactattct

SEQ ID NO: 1819 - DNA, 15 bp, Artificial Sequence
  dgRNA
  Trpc7
tatgcactattctag

SEQ ID NO: 1820 - DNA, 15 bp, Artificial Sequence
  dgRNA
  Trpc7
atgcactattctagg

SEQ ID NO: 1821 - DNA, 15 bp, Artificial Sequence
  dgRNA
  Trpc7
cactattctaggggg

SEQ ID NO: 1822 - DNA, 15 bp, Artificial Sequence
  dgRNA
  Wdr59
agagctcacggcagg

SEQ ID NO: 1823 - DNA, 15 bp, Artificial Sequence
  dgRNA
  Wdr59
cggcagggggcgtgt

SEQ ID NO: 1824 - DNA, 15 bp, Artificial Sequence
  dgRNA
  Wdr59
gcgtgtcggcagccg

SEQ ID NO: 1825 - DNA, 15 bp, Artificial Sequence
  dgRNA
  Wdr59
cgtgtcggcagccgc

SEQ ID NO: 1826 - DNA, 15 bp, Artificial Sequence
  dgRNA
  Zfp672
gctttgaggtgaacg

SEQ ID NO: 1827 - DNA, 15 bp, Artificial Sequence
  dgRNA
  Zfp672
gaggtgaacgcggct

SEQ ID NO: 1828 - DNA, 15 bp, Artificial Sequence
  dgRNA
  Zfp672
gaacgcggctcggag

SEQ ID NO: 1829 - DNA, 15 bp, Artificial Sequence
  dgRNA
  Zfp672
cggccctccgaagac

SEQ ID NO: 1830 - DNA, 15 bp, Artificial Sequence
  dgRNA
  Ccdc13
actccggaagagtgg

SEQ ID NO: 1831 - DNA, 15 bp, Artificial Sequence
  dgRNA
  Ccdc13
ctttagaggctctct

SEQ ID NO: 1832 - DNA, 15 bp, Artificial Sequence
  dgRNA
  Ccdc13
cgcgcgcgaccgtgc

SEQ ID NO: 1833 - DNA, 15 bp, Artificial Sequence
  dgRNA
  Ccdc13
ccgtgctggtttccc

SEQ ID NO: 1834 - DNA, 15 bp, Artificial Sequence
  dgRNA
  Nqo2
cagatgccggaagca

SEQ ID NO: 1835 - DNA, 15 bp, Artificial Sequence
  dgRNA
  Nqo2
tttgcccacaactac

SEQ ID NO: 1836 - DNA, 15 bp, Artificial Sequence
  dgRNA
  Nqo2
tactggagcccagcg

SEQ ID NO: 1837 - DNA, 15 bp, Artificial Sequence
  dgRNA
  Nqo2
ttgaagtccactgat

SEQ ID NO: 1838 - DNA, 15 bp, Artificial Sequence
  dgRNA
  Muc1
ataaggttgagtgat

SEQ ID NO: 1839 - DNA, 15 bp, Artificial Sequence
  dgRNA
  Muc1
tgactgtgcctaggg

SEQ ID NO: 1840 - DNA, 15 bp, Artificial Sequence
  dgRNA
  Muc1
tgtgcctagggcggg

SEQ ID NO: 1841 - DNA, 15 bp, Artificial Sequence
  dgRNA
  Muc1
gtgcctagggcggga

SEQ ID NO: 1842 - DNA, 15 bp, Artificial Sequence
  dgRNA
  Raph1
tgcggctgtccaggc

SEQ ID NO: 1843 - DNA, 15 bp, Artificial Sequence
  dgRNA
  Raph1
gcggctgtccaggcc

SEQ ID NO: 1844 - DNA, 15 bp, Artificial Sequence
  dgRNA
  Raph1
tgtccaggccgggag

SEQ ID NO: 1845 - DNA, 15 bp, Artificial Sequence
  dgRNA
  Raph1
cgtgcgcgcgtgccg

SEQ ID NO: 1846 - DNA, 15 bp, Artificial Sequence
  dgRNA
  Ptk7
ggatagattaggcgg

SEQ ID NO: 1847 - DNA, 15 bp, Artificial Sequence
  dgRNA
  Ptk7
gatagattaggcggt

SEQ ID NO: 1848 - DNA, 15 bp, Artificial Sequence
  dgRNA
  Ptk7
agctcctcccctcga

SEQ ID NO: 1849 - DNA, 15 bp, Artificial Sequence
  dgRNA
  Ptk7
tcctcccctcgacgg

SEQ ID NO: 1850 - DNA, 15 bp, Artificial Sequence
  dgRNA
  Sntn
gactgttgcttagga

SEQ ID NO: 1851 - DNA, 15 bp, Artificial Sequence
  dgRNA
  Sntn
aataggacagctatc

SEQ ID NO: 1852 - DNA, 15 bp, Artificial Sequence
  dgRNA
  Sntn
ggttctgaaatcaat

SEQ ID NO: 1853 - DNA, 15 bp, Artificial Sequence
  dgRNA
  Sntn
ggtcatgtgctatgc

SEQ ID NO: 1854 - DNA, 15 bp, Artificial Sequence
  dgRNA
  Cyp2g1
aatatacctctgcgc

SEQ ID NO: 1855 - DNA, 15 bp, Artificial Sequence
  dgRNA
  Cyp2g1
ttgatggcataatac

SEQ ID NO: 1856 - DNA, 15 bp, Artificial Sequence
  dgRNA
  Cyp2g1
tggcataatactggt

SEQ ID NO: 1857 - DNA, 15 bp, Artificial Sequence
  dgRNA
  Cyp2g1
atattgatttcatgc

SEQ ID NO: 1858 - DNA, 15 bp, Artificial Sequence
  dgRNA
  Tfap2a
gtgaagccgccgcta

SEQ ID NO: 1859 - DNA, 15 bp, Artificial Sequence
  dgRNA
  Tfap2a
cgccgctaaggaaag

SEQ ID NO: 1860 - DNA, 15 bp, Artificial Sequence
  dgRNA
  Tfap2a
gccgctaaggaaaga

SEQ ID NO: 1861 - DNA, 15 bp, Artificial Sequence
  dgRNA
  Tfap2a
ccgctaaggaaagag

SEQ ID NO: 1862 - DNA, 15 bp, Artificial Sequence
  dgRNA
  Rnf170
tccttccctcgctcg

SEQ ID NO: 1863 - DNA, 15 bp, Artificial Sequence
  dgRNA
  Rnf170
tcccttgcgcgcacc

SEQ ID NO: 1864 - DNA, 15 bp, Artificial Sequence
  dgRNA
  Rnf170
gtagcgcgagtcccg

SEQ ID NO: 1865 - DNA, 15 bp, Artificial Sequence
  dgRNA
  Rnf170
gagtcccgaggtccg

SEQ ID NO: 1866 - DNA, 15 bp, Artificial Sequence
  dgRNA
  1700016H13Rik
gcttgggaccctaag

SEQ ID NO: 1867 - DNA, 15 bp, Artificial Sequence
  dgRNA
  1700016H13Rik
ggtgcctacatgaac

SEQ ID NO: 1868 - DNA, 15 bp, Artificial Sequence
  dgRNA
  1700016H13Rik
acacggagctgtcgc

SEQ ID NO: 1869 - DNA, 15 bp, Artificial Sequence
  dgRNA
  1700016H13Rik
ctggatcctcgagag

SEQ ID NO: 1870 - DNA, 15 bp, Artificial Sequence
  dgRNA
  Alox8
acccattgtgactcc

SEQ ID NO: 1871 - DNA, 15 bp, Artificial Sequence
  dgRNA
  Alox8
cttaacctggtctga

SEQ ID NO: 1872 - DNA, 15 bp, Artificial Sequence
  dgRNA
  Alox8
acctggtctgatggg

SEQ ID NO: 1873 - DNA, 15 bp, Artificial Sequence
  dgRNA
  Alox8
ctggtctgatgggcg

SEQ ID NO: 1874 - DNA, 15 bp, Artificial Sequence
  dgRNA
  Nat8l
agcacgaggatgatt

SEQ ID NO: 1875 - DNA, 15 bp, Artificial Sequence
  dgRNA
  Nat8l
aggatgattcggctt

SEQ ID NO: 1876 - DNA, 15 bp, Artificial Sequence
  dgRNA
  Nat8l
ggatgattcggcttt

SEQ ID NO: 1877 - DNA, 15 bp, Artificial Sequence
  dgRNA
  Nat8l
gatgattcggctttg

SEQ ID NO: 1878 - DNA, 15 bp, Artificial Sequence
  dgRNA
  Gpc6
cgctcacactcgcgc

SEQ ID NO: 1879 - DNA, 15 bp, Artificial Sequence
  dgRNA
  Gpc6
tgtccatctccctcg

SEQ ID NO: 1880 - DNA, 15 bp, Artificial Sequence
  dgRNA
  Gpc6
ccatctccctcgggg

SEQ ID NO: 1881 - DNA, 15 bp, Artificial Sequence
  dgRNA
  Gpc6
catctccctcggggt

SEQ ID NO: 1882 - DNA, 15 bp, Artificial Sequence
  dgRNA
  Cdkn2b
tcaaaaatagccaac

SEQ ID NO: 1883 - DNA, 15 bp, Artificial Sequence
  dgRNA
  Cdkn2b
atagccaaccggcca

SEQ ID NO: 1884 - DNA, 15 bp, Artificial Sequence
  dgRNA
  Cdkn2b
ggtaagttccagact

SEQ ID NO: 1885 - DNA, 15 bp, Artificial Sequence
  dgRNA
  Cdkn2b
cttaaagttctgcgc

SEQ ID NO: 1886 - DNA, 15 bp, Artificial Sequence
  dgRNA
  AU019823
cacttaatccaaacg

SEQ ID NO: 1887 - DNA, 15 bp, Artificial Sequence
  dgRNA
  AU019823
acttaatccaaacgt

SEQ ID NO: 1888 - DNA, 15 bp, Artificial Sequence
  dgRNA
  AU019823
cttaatccaaacgtg

SEQ ID NO: 1889 - DNA, 15 bp, Artificial Sequence
  dgRNA
  AU019823
ttaatccaaacgtgg

SEQ ID NO: 1890 - DNA, 15 bp, Artificial Sequence
  dgRNA
  Ei24
ccagaccacgccccc

SEQ ID NO: 1891 - DNA, 15 bp, Artificial Sequence
  dgRNA
  Ei24
ccacgccccccggta

SEQ ID NO: 1892 - DNA, 15 bp, Artificial Sequence
  dgRNA
  Ei24
cccctgcccagcgac

SEQ ID NO: 1893 - DNA, 15 bp, Artificial Sequence
  dgRNA
  Ei24
tgcccagcgaccggc

SEQ ID NO: 1894 - DNA, 15 bp, Artificial Sequence
  dgRNA
  Bmper
cctgcattcgatccg

SEQ ID NO: 1895 - DNA, 15 bp, Artificial Sequence
  dgRNA
  Bmper
ggctccttccgaagc

SEQ ID NO: 1896 - DNA, 15 bp, Artificial Sequence
  dgRNA
  Bmper
gctccttccgaagct

SEQ ID NO: 1897 - DNA, 15 bp, Artificial Sequence
  dgRNA
  Bmper
gcagcgggaagcgcc

SEQ ID NO: 1898 - DNA, 15 bp, Artificial Sequence
  dgRNA
  Slc16a4
ccttggtttacccaa

SEQ ID NO: 1899 - DNA, 15 bp, Artificial Sequence
  dgRNA
  Slc16a4
atggcttttggccgg

SEQ ID NO: 1900 - DNA, 15 bp, Artificial Sequence
  dgRNA
  Slc16a4
ccattgggtaaacca

SEQ ID NO: 1901 - DNA, 15 bp, Artificial Sequence
  dgRNA
  Slc16a4
cggccaaaagccatt

SEQ ID NO: 1902 - DNA, 15 bp, Artificial Sequence
  dgRNA
  Il10
acaaaaacctttgcc

SEQ ID NO: 1903 - DNA, 15 bp, Artificial Sequence
  dgRNA
  Il10
aaacctttgccagga

SEQ ID NO: 1904 - DNA, 15 bp, Artificial Sequence
  dgRNA
  Il10
cagctatttttagta

SEQ ID NO: 1905 - DNA, 15 bp, Artificial Sequence
  dgRNA
  Il10
cgctaaagaactggt

SEQ ID NO: 1906 - DNA, 15 bp, Artificial Sequence
  dgRNA
  Lims2
ggttgacactagctt

SEQ ID NO: 1907 - DNA, 15 bp, Artificial Sequence
  dgRNA
  Lims2
cccctgtgccccgtg

SEQ ID NO: 1908 - DNA, 15 bp, Artificial Sequence
  dgRNA
  Lims2
gtggagccgccctcg

SEQ ID NO: 1909 - DNA, 15 bp, Artificial Sequence
  dgRNA
  Lims2
gccgccctcgcggtt

SEQ ID NO: 1910 - DNA, 15 bp, Artificial Sequence
  dgRNA
  E130012A19Rik
gtctgtgtgcggaat

SEQ ID NO: 1911 - DNA, 15 bp, Artificial Sequence
  dgRNA
  E130012A19Rik
tctgtgtgcggaatg

SEQ ID NO: 1912 - DNA, 15 bp, Artificial Sequence
  dgRNA
  E130012A19Rik
gtgcggaatggggac

SEQ ID NO: 1913 - DNA, 15 bp, Artificial Sequence
  dgRNA
  E130012A19Rik
tgcggaatggggacg

SEQ ID NO: 1914 - DNA, 15 bp, Artificial Sequence
  dgRNA
  Grxcr2
acctgcgttttcaag

SEQ ID NO: 1915 - DNA, 15 bp, Artificial Sequence
  dgRNA
  Grxcr2
ttaatcatatgcagg

SEQ ID NO: 1916 - DNA, 15 bp, Artificial Sequence
  dgRNA
  Grxcr2
cacggttatgtggag

SEQ ID NO: 1917 - DNA, 15 bp, Artificial Sequence
  dgRNA
  Grxcr2
gtgatcacggttatg

SEQ ID NO: 1918 - DNA, 15 bp, Artificial Sequence
  dgRNA
  Lgals2
cagaagcggggccag

SEQ ID NO: 1919 - DNA, 15 bp, Artificial Sequence
  dgRNA
  Lgals2
agaccgggtgatatt

SEQ ID NO: 1920 - DNA, 15 bp, Artificial Sequence
  dgRNA
  Lgals2
cttatttatggcctc

SEQ ID NO: 1921 - DNA, 15 bp, Artificial Sequence
  dgRNA
  Lgals2
ttatttatggcctcg

SEQ ID NO: 1922 - DNA, 15 bp, Artificial Sequence
  dgRNA
  Gatm
atccctgctaggcat

SEQ ID NO: 1923 - DNA, 15 bp, Artificial Sequence
  dgRNA
  Gatm
gggtagcctcttcat

SEQ ID NO: 1924 - DNA, 15 bp, Artificial Sequence
  dgRNA
  Gatm
gacctgagccagtac

SEQ ID NO: 1925 - DNA, 15 bp, Artificial Sequence
  dgRNA
  Gatm
ccgggacgtgaccca

SEQ ID NO: 1926 - DNA, 15 bp, Artificial Sequence
  dgRNA
  Srd5a3
tcggaattagattag

SEQ ID NO: 1927 - DNA, 15 bp, Artificial Sequence
  dgRNA
  Srd5a3
cctgagcgcctagcc

SEQ ID NO: 1928 - DNA, 15 bp, Artificial Sequence
  dgRNA
  Srd5a3
ctgagcgcctagcca

SEQ ID NO: 1929 - DNA, 15 bp, Artificial Sequence
  dgRNA
  Srd5a3
tgagcgcctagccag

SEQ ID NO: 1930 - DNA, 15 bp, Artificial Sequence
  dgRNA
  4933405L10Rik
cgccaagccccagcg

SEQ ID NO: 1931 - DNA, 15 bp, Artificial Sequence
  dgRNA
  4933405L10Rik
gccaagccccagcga

SEQ ID NO: 1932 - DNA, 15 bp, Artificial Sequence
  dgRNA
  4933405L10Rik
agcgagggctctcac

SEQ ID NO: 1933 - DNA, 15 bp, Artificial Sequence
  dgRNA
  4933405L10Rik
ccaactgttgcaagc

SEQ ID NO: 1934 - DNA, 15 bp, Artificial Sequence
  dgRNA
  Dsc2
cccaggtaactccac

SEQ ID NO: 1935 - DNA, 15 bp, Artificial Sequence
  dgRNA
  Dsc2
taactccaccggcag

SEQ ID NO: 1936 - DNA, 15 bp, Artificial Sequence
  dgRNA
  Dsc2
aactccaccggcagt

SEQ ID NO: 1937 - DNA, 15 bp, Artificial Sequence
  dgRNA
  Dsc2
aatcttagtacagtc

SEQ ID NO: 1938 - DNA, 15 bp, Artificial Sequence
  dgRNA
  Armc5
ctacataagtactgc

SEQ ID NO: 1939 - DNA, 15 bp, Artificial Sequence
  dgRNA
  Armc5
agcattttttccacg

SEQ ID NO: 1940 - DNA, 15 bp, Artificial Sequence
  dgRNA
  Armc5
gcattttttccacgg

SEQ ID NO: 1941 - DNA, 15 bp, Artificial Sequence
  dgRNA
  Armc5
gggggctggttgttc

SEQ ID NO: 1942 - DNA, 15 bp, Artificial Sequence
  dgRNA
  Neurl3
actgtgagccacgag

SEQ ID NO: 1943 - DNA, 15 bp, Artificial Sequence
  dgRNA
  Neurl3
agccacgagaggtca

SEQ ID NO: 1944 - DNA, 15 bp, Artificial Sequence
  dgRNA
  Neurl3
ccacgagaggtcatg

SEQ ID NO: 1945 - DNA, 15 bp, Artificial Sequence
  dgRNA
  Neurl3
ccccatgacctctcg

SEQ ID NO: 1946 - DNA, 15 bp, Artificial Sequence
  dgRNA
  Strada
gcggagctcccttct

SEQ ID NO: 1947 - DNA, 15 bp, Artificial Sequence
  dgRNA
  Strada
cggagctcccttctt

SEQ ID NO: 1948 - DNA, 15 bp, Artificial Sequence
  dgRNA
  Strada
gctcccttcttgggt

SEQ ID NO: 1949 - DNA, 15 bp, Artificial Sequence
  dgRNA
  Strada
gcagggcttctccgt

SEQ ID NO: 1950 - DNA, 15 bp, Artificial Sequence
  dgRNA
  Ralgds
caagcgctgtccacc

SEQ ID NO: 1951 - DNA, 15 bp, Artificial Sequence
  dgRNA
  Ralgds
cctgccaactagagg

SEQ ID NO: 1952 - DNA, 15 bp, Artificial Sequence
  dgRNA
  Ralgds
cagctgacatcagcg

SEQ ID NO: 1953 - DNA, 15 bp, Artificial Sequence
  dgRNA
  Ralgds
gacatcagcgaggcc

SEQ ID NO: 1954 - DNA, 15 bp, Artificial Sequence
  dgRNA
  Synpo
gagcaggaatccgcc

SEQ ID NO: 1955 - DNA, 15 bp, Artificial Sequence
  dgRNA
  Synpo
caggaatccgcccgg

SEQ ID NO: 1956 - DNA, 15 bp, Artificial Sequence
  dgRNA
  Synpo
atccgcccggaggtg

SEQ ID NO: 1957 - DNA, 15 bp, Artificial Sequence
  dgRNA
  Synpo
ccggaggtgaggcct

SEQ ID NO: 1958 - DNA, 15 bp, Artificial Sequence
  dgRNA
  Gsk3a
cgggtgacattagcc

SEQ ID NO: 1959 - DNA, 15 bp, Artificial Sequence
  dgRNA
  Gsk3a
agtcagctactctga

SEQ ID NO: 1960 - DNA, 15 bp, Artificial Sequence
  dgRNA
  Gsk3a
tgccaaaagctaact

SEQ ID NO: 1961 - DNA, 15 bp, Artificial Sequence
  dgRNA
  Gsk3a
cgggaaatagagtcc

SEQ ID NO: 1962 - DNA, 15 bp, Artificial Sequence
  dgRNA
  Foxo4
ggacaagtgacgccc

SEQ ID NO: 1963 - DNA, 15 bp, Artificial Sequence
  dgRNA
  Foxo4
agtgacgcccgggag

SEQ ID NO: 1964 - DNA, 15 bp, Artificial Sequence
  dgRNA
  Foxo4
gtgacgcccgggagc

SEQ ID NO: 1965 - DNA, 15 bp, Artificial Sequence
  dgRNA
  Foxo4
tgacgcccgggagcg

SEQ ID NO: 1966 - DNA, 15 bp, Artificial Sequence
  dgRNA
  Eif2ak3
attggccgtcgttcc

SEQ ID NO: 1967 - DNA, 15 bp, Artificial Sequence
  dgRNA
  Eif2ak3
cgtcgttcccggaaa

SEQ ID NO: 1968 - DNA, 15 bp, Artificial Sequence
  dgRNA
  Eif2ak3
gtcgttcccggaaaa

SEQ ID NO: 1969 - DNA, 15 bp, Artificial Sequence
  dgRNA
  Eif2ak3
ttcccggaaaagggc

SEQ ID NO: 1970 - DNA, 15 bp, Artificial Sequence
  dgRNA
  Tert
ttccgctacaacgct

SEQ ID NO: 1971 - DNA, 15 bp, Artificial Sequence
  dgRNA
  Tert
tcatctttttcgtcg

SEQ ID NO: 1972 - DNA, 15 bp, Artificial Sequence
  dgRNA
  Tert
gtcgtggactctcag

SEQ ID NO: 1973 - DNA, 15 bp, Artificial Sequence
  dgRNA
  Tert
caatgctggtgcatg

SEQ ID NO: 1974 - DNA, 15 bp, Artificial Sequence
  dgRNA
  Traf4
caccatcgtaacgca

SEQ ID NO: 1975 - DNA, 15 bp, Artificial Sequence
  dgRNA
  Traf4
accatcgtaacgcaa

SEQ ID NO: 1976 - DNA, 15 bp, Artificial Sequence
  dgRNA
  Traf4
ccatcgtaacgcaag

SEQ ID NO: 1977 - DNA, 15 bp, Artificial Sequence
  dgRNA
  Traf4
aaggggacccgcttc

SEQ ID NO: 1978 - DNA, 15 bp, Artificial Sequence
  dgRNA
  Fam131b
atggcgaggagctca

SEQ ID NO: 1979 - DNA, 15 bp, Artificial Sequence
  dgRNA
  Fam131b
gggcgggggttgcga

SEQ ID NO: 1980 - DNA, 15 bp, Artificial Sequence
  dgRNA
  Fam131b
ggggttgcgaaggac

SEQ ID NO: 1981 - DNA, 15 bp, Artificial Sequence
  dgRNA
  Fam131b
gttgcgaaggacagg

SEQ ID NO: 1982 - DNA, 15 bp, Artificial Sequence
  dgRNA
  Mrpl45
caccgattgtaaata

SEQ ID NO: 1983 - DNA, 15 bp, Artificial Sequence
  dgRNA
  Mrpl45
ctccccgtctccgac

SEQ ID NO: 1984 - DNA, 15 bp, Artificial Sequence
  dgRNA
  Mrpl45
cgcgtgacagccgtg

SEQ ID NO: 1985 - DNA, 15 bp, Artificial Sequence
  dgRNA
  Mrpl45
accctacttccaaag

SEQ ID NO: 1986 - DNA, 15 bp, Artificial Sequence
  dgRNA
  Adamts20
gcgcctcccgctgat

SEQ ID NO: 1987 - DNA, 15 bp, Artificial Sequence
  dgRNA
  Adamts20
gctgattggtcgacc

SEQ ID NO: 1988 - DNA, 15 bp, Artificial Sequence
  dgRNA
  Adamts20
tggtcgaccaggtcc

SEQ ID NO: 1989 - DNA, 15 bp, Artificial Sequence
  dgRNA
  Adamts20
ggtcgaccaggtcct

SEQ ID NO: 1990 - DNA, 15 bp, Artificial Sequence
  dgRNA
  Olfr1436
acatcattggttcaa

SEQ ID NO: 1991 - DNA, 15 bp, Artificial Sequence
  dgRNA
  Spc25
ccgcgagaattccgc

SEQ ID NO: 1992 - DNA, 15 bp, Artificial Sequence
  dgRNA
  Spc25
caaccaatccttgca

SEQ ID NO: 1993 - DNA, 15 bp, Artificial Sequence
  dgRNA
  Spc25
gaagacggagttgaa

SEQ ID NO: 1994 - DNA, 15 bp, Artificial Sequence
  dgRNA
  Spc25
acggagttgaagggc

SEQ ID NO: 1995 - DNA, 15 bp, Artificial Sequence
  dgRNA
  Fbxo39
tcctgcctccgcccg

SEQ ID NO: 1996 - DNA, 15 bp, Artificial Sequence
  dgRNA
  Fbxo39
cgcgggctttcctat

SEQ ID NO: 1997 - DNA, 15 bp, Artificial Sequence
  dgRNA
  Fbxo39
gcgggctttcctatt

SEQ ID NO: 1998 - DNA, 15 bp, Artificial Sequence
  dgRNA
  Fbxo39
tggcaactccggatt

SEQ ID NO: 1999 - DNA, 15 bp, Artificial Sequence
  dgRNA
  Sparc
agggcctttgagtgg

SEQ ID NO: 2000 - DNA, 15 bp, Artificial Sequence
  dgRNA
  Sparc
ttgagtggaggcgga

SEQ ID NO: 2001 - DNA, 15 bp, Artificial Sequence
  dgRNA
  Sparc
tccgcctccactcaa

SEQ ID NO: 2002 - DNA, 15 bp, Artificial Sequence
  dgRNA
  Prim1
ggtctctccttttcg

SEQ ID NO: 2003 - DNA, 15 bp, Artificial Sequence
  dgRNA
  Prim1
tgttgttaaatggat

SEQ ID NO: 2004 - DNA, 15 bp, Artificial Sequence
  dgRNA
  Prim1
cagcagtccctccgg

SEQ ID NO: 2005 - DNA, 15 bp, Artificial Sequence
  dgRNA
  Prim1
tccctccggcggcgc

SEQ ID NO: 2006 - DNA, 15 bp, Artificial Sequence
  dgRNA
  Atg16l1
catcaccgacgcttc

SEQ ID NO: 2007 - DNA, 15 bp, Artificial Sequence
  dgRNA
  Atg16l1
acgcttccggcttca

SEQ ID NO: 2008 - DNA, 15 bp, Artificial Sequence
  dgRNA
  Atg16l1
cgtcccgcgaagtct

SEQ ID NO: 2009 - DNA, 15 bp, Artificial Sequence
  dgRNA
  Atg16l1
ccgcgaagtctcggc

SEQ ID NO: 2010 - DNA, 15 bp, Artificial Sequence
  dgRNA
  Olfr328
tctgcacttatcaat

SEQ ID NO: 2011 - DNA, 15 bp, Artificial Sequence
  dgRNA
  Olfr328
tgcagaagtgtacca

SEQ ID NO: 2012 - DNA, 15 bp, Artificial Sequence
  dgRNA
  Ptpn9
ccctcccgctcccgt

SEQ ID NO: 2013 - DNA, 15 bp, Artificial Sequence
  dgRNA
  Ptpn9
cctcccgctcccgta

SEQ ID NO: 2014 - DNA, 15 bp, Artificial Sequence
  dgRNA
  Ptpn9
ctcccgctcccgtag

SEQ ID NO: 2015 - DNA, 15 bp, Artificial Sequence
  dgRNA
  Ptpn9
gacaacgtccccgtc

SEQ ID NO: 2016 - DNA, 15 bp, Artificial Sequence
  dgRNA
  Olfr916
ctgtacacctagtta

SEQ ID NO: 2017 - DNA, 15 bp, Artificial Sequence
  dgRNA
  Olfr916
cttctagccataact

SEQ ID NO: 2018 - DNA, 15 bp, Artificial Sequence
  dgRNA
  Olfr916
atagagctatgttag

SEQ ID NO: 2019 - DNA, 15 bp, Artificial Sequence
  dgRNA
  Sall4
agtcgatccacgcct

SEQ ID NO: 2020 - DNA, 15 bp, Artificial Sequence
  dgRNA
  Sall4
cggccaatctgagcc

SEQ ID NO: 2021 - DNA, 15 bp, Artificial Sequence
  dgRNA
  Sall4
tagggccggactaca

SEQ ID NO: 2022 - DNA, 15 bp, Artificial Sequence
  dgRNA
  Sall4
cctccctgatcaatg

SEQ ID NO: 2023 - DNA, 15 bp, Artificial Sequence
  dgRNA
  Clec16a
ttgtcccgcctcctc

SEQ ID NO: 2024 - DNA, 15 bp, Artificial Sequence
  dgRNA
  Clec16a
cccgcctcctctgga

SEQ ID NO: 2025 - DNA, 15 bp, Artificial Sequence
  dgRNA
  Clec16a
tcgcgcgagtcatgc

SEQ ID NO: 2026 - DNA, 15 bp, Artificial Sequence
  dgRNA
  Clec16a
cgtcaagagcctcgc

SEQ ID NO: 2027 - DNA, 15 bp, Artificial Sequence
  dgRNA
  Cep135
tgtaatgtagcaata

SEQ ID NO: 2028 - DNA, 15 bp, Artificial Sequence
  dgRNA
  Cep135
ggagatcatatgtat

SEQ ID NO: 2029 - DNA, 15 bp, Artificial Sequence
  dgRNA
  Cep135
ctacattacaacatg

SEQ ID NO: 2030 - DNA, 15 bp, Artificial Sequence
  dgRNA
  Cep135
acatcaaagaatcgt

SEQ ID NO: 2031 - DNA, 15 bp, Artificial Sequence
  dgRNA
  Pou2f1
aatgtcagtcctcgc

SEQ ID NO: 2032 - DNA, 15 bp, Artificial Sequence
  dgRNA
  Pou2f1
agttgaagattgcta

SEQ ID NO: 2033 - DNA, 15 bp, Artificial Sequence
  dgRNA
  Pou2f1
ggactgacattgtca

SEQ ID NO: 2034 - DNA, 15 bp, Artificial Sequence
  dgRNA
  Pou2f1
tctcttctaccagcg

SEQ ID NO: 2035 - DNA, 15 bp, Artificial Sequence
  dgRNA
  Gm7325
tggaccgaatatacc

SEQ ID NO: 2036 - DNA, 15 bp, Artificial Sequence
  dgRNA
  Gm7325
gaattccccatgggg

SEQ ID NO: 2037 - DNA, 15 bp, Artificial Sequence
  dgRNA
  Gm7325
gcaggaattccccat

SEQ ID NO: 2038 - DNA, 15 bp, Artificial Sequence
  dgRNA
  Gm7325
tcttgccatcttagg

SEQ ID NO: 2039 - DNA, 15 bp, Artificial Sequence
  dgRNA
  Zfp746
taccgccaaaccagg

SEQ ID NO: 2040 - DNA, 15 bp, Artificial Sequence
  dgRNA
  Zfp746
caggtggcacatcgc

SEQ ID NO: 2041 - DNA, 15 bp, Artificial Sequence
  dgRNA
  Zfp746
atcgctggtgagcac

SEQ ID NO: 2042 - DNA, 15 bp, Artificial Sequence
  dgRNA
  Zfp746
tgagcactggcgccg

SEQ ID NO: 2043 - DNA, 15 bp, Artificial Sequence
  dgRNA
  Fkbp2
gtcacgcagtcactc

SEQ ID NO: 2044 - DNA, 15 bp, Artificial Sequence
  dgRNA
  Fkbp2
acgcagtcactcagg

SEQ ID NO: 2045 - DNA, 15 bp, Artificial Sequence
  dgRNA
  Fkbp2
gcagcgggttttgga

SEQ ID NO: 2046 - DNA, 15 bp, Artificial Sequence
  dgRNA
  Fkbp2
ttggacggtccaatg

SEQ ID NO: 2047 - DNA, 15 bp, Artificial Sequence
  dgRNA
  Fzd8
actgagtgcgactca

SEQ ID NO: 2048 - DNA, 15 bp, Artificial Sequence
  dgRNA
  Fzd8
ctgagtgcgactcag

SEQ ID NO: 2049 - DNA, 15 bp, Artificial Sequence
  dgRNA
  Fzd8
tgagtgcgactcagg

SEQ ID NO: 2050 - DNA, 15 bp, Artificial Sequence
  dgRNA
  Fzd8
cgactcagggggcgc

SEQ ID NO: 2051 - DNA, 15 bp, Artificial Sequence
  dgRNA
  Serpina3f
tagttcagcaaacag

SEQ ID NO: 2052 - DNA, 15 bp, Artificial Sequence
  dgRNA
  Serpina3f
ctggtcccacatctt

SEQ ID NO: 2053 - DNA, 15 bp, Artificial Sequence
  dgRNA
  Olfm3
aggcccttgcaatga

SEQ ID NO: 2054 - DNA, 15 bp, Artificial Sequence
  dgRNA
  Olfm3
cccttgcaatgaggg

SEQ ID NO: 2055 - DNA, 15 bp, Artificial Sequence
  dgRNA
  Olfm3
ccttgcaatgagggt

SEQ ID NO: 2056 - DNA, 15 bp, Artificial Sequence
  dgRNA
  Olfm3
cctggtgattagagc

SEQ ID NO: 2057 - DNA, 15 bp, Artificial Sequence
  dgRNA
  Oxnad1
ttaggggcgggacta

SEQ ID NO: 2058 - DNA, 15 bp, Artificial Sequence
  dgRNA
  Oxnad1
tatgctagacagcct

SEQ ID NO: 2059 - DNA, 15 bp, Artificial Sequence
  dgRNA
  Oxnad1
taggttactacttta

SEQ ID NO: 2060 - DNA, 15 bp, Artificial Sequence
  dgRNA
  Oxnad1
aggttactactttag

SEQ ID NO: 2061 - DNA, 15 bp, Artificial Sequence
  dgRNA
  Cpne3
cctaaagtcaattac

SEQ ID NO: 2062 - DNA, 15 bp, Artificial Sequence
  dgRNA
  Cpne3
aaggtcagcgggttg

SEQ ID NO: 2063 - DNA, 15 bp, Artificial Sequence
  dgRNA
  Cpne3
ctcgcccctccgctc

SEQ ID NO: 2064 - DNA, 15 bp, Artificial Sequence
  dgRNA
  Cpne3
tcgcccctccgctcc

SEQ ID NO: 2065 - DNA, 15 bp, Artificial Sequence
  dgRNA
  Mff
agaaaccccctcaac

SEQ ID NO: 2066 - DNA, 15 bp, Artificial Sequence
  dgRNA
  Mff
tgcccacgacaaaaa

SEQ ID NO: 2067 - DNA, 15 bp, Artificial Sequence
  dgRNA
  Mff
ccgcgtcgacgtctc

SEQ ID NO: 2068 - DNA, 15 bp, Artificial Sequence
  dgRNA
  Mff
aacctacttccgcta

SEQ ID NO: 2069 - DNA, 15 bp, Artificial Sequence
  dgRNA
  Palmd
ttcttcggttactaa

SEQ ID NO: 2070 - DNA, 15 bp, Artificial Sequence
  dgRNA
  Palmd
agtttatctcggggg

SEQ ID NO: 2071 - DNA, 15 bp, Artificial Sequence
  dgRNA
  Palmd
tagtttatctcgggg

SEQ ID NO: 2072 - DNA, 15 bp, Artificial Sequence
  dgRNA
  Palmd
ttagtttatctcggg

SEQ ID NO: 2073 - DNA, 15 bp, Artificial Sequence
  dgRNA
  Whrn
acagccaggcgcgcc

SEQ ID NO: 2074 - DNA, 15 bp, Artificial Sequence
  dgRNA
  Whrn
gccaggcgcgccagg

SEQ ID NO: 2075 - DNA, 15 bp, Artificial Sequence
  dgRNA
  Whrn
ccaggcgcgccaggc

SEQ ID NO: 2076 - DNA, 15 bp, Artificial Sequence
  dgRNA
  Whrn
ttcctgaagagcccg

SEQ ID NO: 2077 - DNA, 15 bp, Artificial Sequence
  dgRNA
  Sod2
ggacagggcggcccg

SEQ ID NO: 2078 - DNA, 15 bp, Artificial Sequence
  dgRNA
  Sod2
agggcggcccgagga

SEQ ID NO: 2079 - DNA, 15 bp, Artificial Sequence
  dgRNA
  Sod2
gggcggcccgaggag

SEQ ID NO: 2080 - DNA, 15 bp, Artificial Sequence
  dgRNA
  Sod2
cggcccgaggagggg

SEQ ID NO: 2081 - DNA, 15 bp, Artificial Sequence
  dgRNA
  Smad2
gcgtaccaacccacc

SEQ ID NO: 2082 - DNA, 15 bp, Artificial Sequence
  dgRNA
  Smad2
tcgcctcacgctcga

SEQ ID NO: 2083 - DNA, 15 bp, Artificial Sequence
  dgRNA
  Smad2
cgcctcacgctcgac

SEQ ID NO: 2084 - DNA, 15 bp, Artificial Sequence
  dgRNA
  Smad2
gcctcacgctcgacg

SEQ ID NO: 2085 - DNA, 15 bp, Artificial Sequence
  dgRNA
  Shd
gcaccgattaccagt

SEQ ID NO: 2086 - DNA, 15 bp, Artificial Sequence
  dgRNA
  Shd
caccgattaccagtt

SEQ ID NO: 2087 - DNA, 15 bp, Artificial Sequence
  dgRNA
  Shd
accgattaccagttg

SEQ ID NO: 2088 - DNA, 15 bp, Artificial Sequence
  dgRNA
  Shd
gttggccatggcttt

SEQ ID NO: 2089 - DNA, 15 bp, Artificial Sequence
  dgRNA
  Cant1
gaggcctgtccacgc

SEQ ID NO: 2090 - DNA, 15 bp, Artificial Sequence
  dgRNA
  Cant1
ctgtccacgctggtg

SEQ ID NO: 2091 - DNA, 15 bp, Artificial Sequence
  dgRNA
  Cant1
ccacgctggtgtgga

SEQ ID NO: 2092 - DNA, 15 bp, Artificial Sequence
  dgRNA
  Cant1
acaggccactcgtga

SEQ ID NO: 2093 - DNA, 15 bp, Artificial Sequence
  dgRNA
  Olfml3
ctctcccctttccgg

SEQ ID NO: 2094 - DNA, 15 bp, Artificial Sequence
  dgRNA
  Olfml3
acaagtctaagttgc

SEQ ID NO: 2095 - DNA, 15 bp, Artificial Sequence
  dgRNA
  Olfml3
ggtagttaaggcttc

SEQ ID NO: 2096 - DNA, 15 bp, Artificial Sequence
  dgRNA
  Olfml3
ctggcgactgtgcaa

SEQ ID NO: 2097 - DNA, 15 bp, Artificial Sequence
  dgRNA
  Arsj
gtagttgagcaatga

SEQ ID NO: 2098 - DNA, 15 bp, Artificial Sequence
  dgRNA
  Dmpk
gtgggtagagtcaat

SEQ ID NO: 2099 - DNA, 15 bp, Artificial Sequence
  dgRNA
  Dmpk
gggtagagtcaatgg

SEQ ID NO: 2100 - DNA, 15 bp, Artificial Sequence
  dgRNA
  Dmpk
ggtagagtcaatggg

SEQ ID NO: 2101 - DNA, 15 bp, Artificial Sequence
  dgRNA
  Dmpk
gtagagtcaatgggg

SEQ ID NO: 2102 - DNA, 15 bp, Artificial Sequence
  dgRNA
  Cort
ccgagtctttaatta

SEQ ID NO: 2103 - DNA, 15 bp, Artificial Sequence
  dgRNA
  Cort
cgagtctttaattaa

SEQ ID NO: 2104 - DNA, 15 bp, Artificial Sequence
  dgRNA
  Cort
gagtctttaattaag

SEQ ID NO: 2105 - DNA, 15 bp, Artificial Sequence
  dgRNA
  Cort
atgcgcgcttgctct

SEQ ID NO: 2106 - DNA, 15 bp, Artificial Sequence
  dgRNA
  Pde4d
gtgatttgttgctag

SEQ ID NO: 2107 - DNA, 15 bp, Artificial Sequence
  dgRNA
  Olfr143
gctcaaattttgttc

SEQ ID NO: 2108 - DNA, 15 bp, Artificial Sequence
  dgRNA
  Olfr143
atccaacgttactct

SEQ ID NO: 2109 - DNA, 15 bp, Artificial Sequence
  dgRNA
  Olfr143
gtaaatgatggctta

SEQ ID NO: 2110 - DNA, 15 bp, Artificial Sequence
  dgRNA
  Olfr143
catactcaaaacgtt

SEQ ID NO: 2111 - DNA, 15 bp, Artificial Sequence
  dgRNA
  Olfr358
ggtttacatgcgtat

SEQ ID NO: 2112 - DNA, 15 bp, Artificial Sequence
  dgRNA
  Olfr358
tacatgcgtataggt

SEQ ID NO: 2113 - DNA, 15 bp, Artificial Sequence
  dgRNA
  Olfr358
atctcccctctttgc

SEQ ID NO: 2114 - DNA, 15 bp, Artificial Sequence
  dgRNA
  Olfr358
acttacccaagatga

SEQ ID NO: 2115 - DNA, 15 bp, Artificial Sequence
  dgRNA
  Dusp15
gcgcctgacggtgcc

SEQ ID NO: 2116 - DNA, 15 bp, Artificial Sequence
  dgRNA
  Dusp15
cgcctgacggtgcca

SEQ ID NO: 2117 - DNA, 15 bp, Artificial Sequence
  dgRNA
  Dusp15
gacggtgccagggtt

SEQ ID NO: 2118 - DNA, 15 bp, Artificial Sequence
  dgRNA
  Dusp15
acggtgccagggttg

SEQ ID NO: 2119 - DNA, 15 bp, Artificial Sequence
  dgRNA
  Erp29
cccgcgagaacgcag

SEQ ID NO: 2120 - DNA, 15 bp, Artificial Sequence
  dgRNA
  Erp29
gaacgcagcggaaca

SEQ ID NO: 2121 - DNA, 15 bp, Artificial Sequence
  dgRNA
  Erp29
ctgcgttctcgcggg

SEQ ID NO: 2122 - DNA, 15 bp, Artificial Sequence
  dgRNA
  Erp29
ccgctgcgttctcgc

SEQ ID NO: 2123 - DNA, 15 bp, Artificial Sequence
  dgRNA
  Wisp2
gggctcaggacaccg

SEQ ID NO: 2124 - DNA, 15 bp, Artificial Sequence
  dgRNA
  Wisp2
ggctcaggacaccgt

SEQ ID NO: 2125 - DNA, 15 bp, Artificial Sequence
  dgRNA
  Wisp2
gcctccctatcctcc

SEQ ID NO: 2126 - DNA, 15 bp, Artificial Sequence
  dgRNA
  Cdca4
agccgtcgacaaaca

SEQ ID NO: 2127 - DNA, 15 bp, Artificial Sequence
  dgRNA
  Cdca4
gccgtcgacaaacaa

SEQ ID NO: 2128 - DNA, 15 bp, Artificial Sequence
  dgRNA
  Cdca4
cgacaaacaagggat

SEQ ID NO: 2129 - DNA, 15 bp, Artificial Sequence
  dgRNA
  Cdca4
gacaaacaagggatc

SEQ ID NO: 2130 - DNA, 15 bp, Artificial Sequence
  dgRNA
  Mgll
tctcgactgtgcgca

SEQ ID NO: 2131 - DNA, 15 bp, Artificial Sequence
  dgRNA
  Mgll
ctcgactgtgcgcat

SEQ ID NO: 2132 - DNA, 15 bp, Artificial Sequence
  dgRNA
  Mgll
actgtgcgcatgggc

SEQ ID NO: 2133 - DNA, 15 bp, Artificial Sequence
  dgRNA
  Mgll
tgcgcatgggctgga

SEQ ID NO: 2134 - DNA, 15 bp, Artificial Sequence
  dgRNA
  Tbk1
ctctgcgaaagcgat

SEQ ID NO: 2135 - DNA, 15 bp, Artificial Sequence
  dgRNA
  Tbk1
tgcgaaagcgatcgg

SEQ ID NO: 2136 - DNA, 15 bp, Artificial Sequence
  dgRNA
  Tbk1
ccagcccgctgtcca

SEQ ID NO: 2137 - DNA, 15 bp, Artificial Sequence
  dgRNA
  Tbk1
cccgctgtccacggg

SEQ ID NO: 2138 - DNA, 15 bp, Artificial Sequence
  dgRNA
  Irak2
ggtccaggggtcggg

SEQ ID NO: 2139 - DNA, 15 bp, Artificial Sequence
  dgRNA
  Irak2
gctactgaatgccac

SEQ ID NO: 2140 - DNA, 15 bp, Artificial Sequence
  dgRNA
  Irak2
ctactgaatgccact

SEQ ID NO: 2141 - DNA, 15 bp, Artificial Sequence
  dgRNA
  Irak2
tcgcttgcccgctct

SEQ ID NO: 2142 - DNA, 15 bp, Artificial Sequence
  dgRNA
  Mfap1a
tctggaaaatgtcga

SEQ ID NO: 2143 - DNA, 15 bp, Artificial Sequence
  dgRNA
  Mfap1a
ggaaaatgtcgaagg

SEQ ID NO: 2144 - DNA, 15 bp, Artificial Sequence
  dgRNA
  Mfap1a
gaaaatgtcgaaggc

SEQ ID NO: 2145 - DNA, 15 bp, Artificial Sequence
  dgRNA
  Mfap1a
ggaaacttgctcgaa

SEQ ID NO: 2146 - DNA, 15 bp, Artificial Sequence
  dgRNA
  Vps72
atctaggtaaggagg

SEQ ID NO: 2147 - DNA, 15 bp, Artificial Sequence
  dgRNA
  Vps72
ctggtactgtgccct

SEQ ID NO: 2148 - DNA, 15 bp, Artificial Sequence
  dgRNA
  Vps72
ggcgctgcctatgag

SEQ ID NO: 2149 - DNA, 15 bp, Artificial Sequence
  dgRNA
  Vps72
ggacctctcgacgct

SEQ ID NO: 2150 - DNA, 15 bp, Artificial Sequence
  dgRNA
  Tmsb15a
tctgaagttgaaccg

SEQ ID NO: 2151 - DNA, 15 bp, Artificial Sequence
  dgRNA
  Tmsb15a
gttatgtggcaagta

SEQ ID NO: 2152 - DNA, 15 bp, Artificial Sequence
  dgRNA
  Tmsb15a
gccatccaatcagag

SEQ ID NO: 2153 - DNA, 15 bp, Artificial Sequence
  dgRNA
  Tmsb15a
aggcccgtgactcat

SEQ ID NO: 2154 - DNA, 15 bp, Artificial Sequence
  dgRNA
  Adgre5
tgtcggagccgcgcg

SEQ ID NO: 2155 - DNA, 15 bp, Artificial Sequence
  dgRNA
  Adgre5
gtcggagccgcgcgc

SEQ ID NO: 2156 - DNA, 15 bp, Artificial Sequence
  dgRNA
  Adgre5
tcggagccgcgcgcg

SEQ ID NO: 2157 - DNA, 15 bp, Artificial Sequence
  dgRNA
  Adgre5
cgtttgttccagacg

SEQ ID NO: 2158 - DNA, 15 bp, Artificial Sequence
  dgRNA
  Shprh
aagccacgggaggcg

SEQ ID NO: 2159 - DNA, 15 bp, Artificial Sequence
  dgRNA
  Shprh
taaaccgtcttctac

SEQ ID NO: 2160 - DNA, 15 bp, Artificial Sequence
  dgRNA
  Shprh
aaaccgtcttctacc

SEQ ID NO: 2161 - DNA, 15 bp, Artificial Sequence
  dgRNA
  Shprh
ttctaccgggacctc

SEQ ID NO: 2162 - DNA, 15 bp, Artificial Sequence
  dgRNA
  Rab33a
aacccaccacagaac

SEQ ID NO: 2163 - DNA, 15 bp, Artificial Sequence
  dgRNA
  Rab33a
gagaaggctcgcctg

SEQ ID NO: 2164 - DNA, 15 bp, Artificial Sequence
  dgRNA
  Rab33a
ggagggtctaagcaa

SEQ ID NO: 2165 - DNA, 15 bp, Artificial Sequence
  dgRNA
  Rab33a
gtctaagcaaaggcg

SEQ ID NO: 2166 - DNA, 15 bp, Artificial Sequence
  dgRNA
  Larp6
cttggcgggtttgtc

SEQ ID NO: 2167 - DNA, 15 bp, Artificial Sequence
  dgRNA
  Larp6
ttggcgggtttgtca

SEQ ID NO: 2168 - DNA, 15 bp, Artificial Sequence
  dgRNA
  Larp6
gctgcgtctctgcgc

SEQ ID NO: 2169 - DNA, 15 bp, Artificial Sequence
  dgRNA
  Larp6
ctgcgtctctgcgcc

SEQ ID NO: 2170 - DNA, 15 bp, Artificial Sequence
  dgRNA
  Rab2b
tccgcttcccctagt

SEQ ID NO: 2171 - DNA, 15 bp, Artificial Sequence
  dgRNA
  Rab2b
cgcgtcacttcctca

SEQ ID NO: 2172 - DNA, 15 bp, Artificial Sequence
  dgRNA
  Rab2b
caggggggctcggga

SEQ ID NO: 2173 - DNA, 15 bp, Artificial Sequence
  dgRNA
  Rab2b
ccaggggggctcggg

SEQ ID NO: 2174 - DNA, 15 bp, Artificial Sequence
  dgRNA
  Fam83f
ccagccgggctaagt

SEQ ID NO: 2175 - DNA, 15 bp, Artificial Sequence
  dgRNA
  Fam83f
gtaggccagagacgc

SEQ ID NO: 2176 - DNA, 15 bp, Artificial Sequence
  dgRNA
  Fam83f
taggccagagacgca

SEQ ID NO: 2177 - DNA, 15 bp, Artificial Sequence
  dgRNA
  Fam83f
agagacgcagggcgt

SEQ ID NO: 2178 - DNA, 15 bp, Artificial Sequence
  dgRNA
  Plcl1
agtaccggggccagc

SEQ ID NO: 2179 - DNA, 15 bp, Artificial Sequence
  dgRNA
  Plcl1
gtaccggggccagct

SEQ ID NO: 2180 - DNA, 15 bp, Artificial Sequence
  dgRNA
  Plcl1
tccattcttcgcgct

SEQ ID NO: 2181 - DNA, 15 bp, Artificial Sequence
  dgRNA
  Plcl1
ccattcttcgcgctc

SEQ ID NO: 2182 - DNA, 15 bp, Artificial Sequence
  dgRNA
  Mbip
atctaagagccaagt

SEQ ID NO: 2183 - DNA, 15 bp, Artificial Sequence
  dgRNA
  Mbip
atacacaagttccct

SEQ ID NO: 2184 - DNA, 15 bp, Artificial Sequence
  dgRNA
  Mbip
gctccctgtgaatgt

SEQ ID NO: 2185 - DNA, 15 bp, Artificial Sequence
  dgRNA
  Mbip
gatagctgtgctccg

SEQ ID NO: 2186 - DNA, 15 bp, Artificial Sequence
  dgRNA
  Cbfb
ttcactgcaacccag

SEQ ID NO: 2187 - DNA, 15 bp, Artificial Sequence
  dgRNA
  Cbfb
cagcggccccgcaag

SEQ ID NO: 2188 - DNA, 15 bp, Artificial Sequence
  dgRNA
  Cbfb
agcggccccgcaagc

SEQ ID NO: 2189 - DNA, 15 bp, Artificial Sequence
  dgRNA
  Cbfb
ggccccgcaagcggg

SEQ ID NO: 2190 - DNA, 15 bp, Artificial Sequence
  dgRNA
  Cited4
ctgggacgcccttgc

SEQ ID NO: 2191 - DNA, 15 bp, Artificial Sequence
  dgRNA
  Cited4
cccttgcaggcccaa

SEQ ID NO: 2192 - DNA, 15 bp, Artificial Sequence
  dgRNA
  Cited4
ccttgcaggcccaaa

SEQ ID NO: 2193 - DNA, 15 bp, Artificial Sequence
  dgRNA
  Cited4
gggcggagctctggt

SEQ ID NO: 2194 - DNA, 15 bp, Artificial Sequence
  dgRNA
  Tfeb
ggagtccgaggcccg

SEQ ID NO: 2195 - DNA, 15 bp, Artificial Sequence
  dgRNA
  Tfeb
gtccgaggcccgagg

SEQ ID NO: 2196 - DNA, 15 bp, Artificial Sequence
  dgRNA
  Tfeb
cccgaggaggtgtgc

SEQ ID NO: 2197 - DNA, 15 bp, Artificial Sequence
  dgRNA
  Tfeb
aggcaccaaggccgg

SEQ ID NO: 2198 - DNA, 15 bp, Artificial Sequence
  dgRNA
  Akap1
agagcgccagcaagg

SEQ ID NO: 2199 - DNA, 15 bp, Artificial Sequence
  dgRNA
  Akap1
gagcgccagcaaggc

SEQ ID NO: 2200 - DNA, 15 bp, Artificial Sequence
  dgRNA
  Akap1
gggcccgtacagctc

SEQ ID NO: 2201 - DNA, 15 bp, Artificial Sequence
  dgRNA
  Akap1
ggcccgtacagctcc

SEQ ID NO: 2202 - DNA, 15 bp, Artificial Sequence
  dgRNA
  Whsc1l1
cgcccctcctctccg

SEQ ID NO: 2203 - DNA, 15 bp, Artificial Sequence
  dgRNA
  Whsc1l1
ctcagcgccgagctc

SEQ ID NO: 2204 - DNA, 15 bp, Artificial Sequence
  dgRNA
  Whsc1l1
ccggactgcatttcc

SEQ ID NO: 2205 - DNA, 15 bp, Artificial Sequence
  dgRNA
  Whsc1l1
actgcatttcccggc

SEQ ID NO: 2206 - DNA, 15 bp, Artificial Sequence
  dgRNA
  Epn1
tgcggaagtgacgca

SEQ ID NO: 2207 - DNA, 15 bp, Artificial Sequence
  dgRNA
  Epn1
gcggaagtgacgcaa

SEQ ID NO: 2208 - DNA, 15 bp, Artificial Sequence
  dgRNA
  Epn1
tgacgcaagggcata

SEQ ID NO: 2209 - DNA, 15 bp, Artificial Sequence
  dgRNA
  Epn1
cgcagtcccgtgcgc

SEQ ID NO: 2210 - DNA, 15 bp, Artificial Sequence
  dgRNA
  Fhit
gttgatactgacatt

SEQ ID NO: 2211 - DNA, 15 bp, Artificial Sequence
  dgRNA
  Fhit
catttggttcccgat

SEQ ID NO: 2212 - DNA, 15 bp, Artificial Sequence
  dgRNA
  Fhit
gtgctcttcgcgtat

SEQ ID NO: 2213 - DNA, 15 bp, Artificial Sequence
  dgRNA
  Fhit
cccgccccttaccgc

SEQ ID NO: 2214 - DNA, 15 bp, Artificial Sequence
  dgRNA
  Ccdc80
tacgctcggaaacaa

SEQ ID NO: 2215 - DNA, 15 bp, Artificial Sequence
  dgRNA
  Ccdc80
acgctcggaaacaaa

SEQ ID NO: 2216 - DNA, 15 bp, Artificial Sequence
  dgRNA
  Ccdc80
actcggccagactgc

SEQ ID NO: 2217 - DNA, 15 bp, Artificial Sequence
  dgRNA
  Mpzl1
agatcacaccaaggg

SEQ ID NO: 2218 - DNA, 15 bp, Artificial Sequence
  dgRNA
  Mpzl1
atcacaccaagggcg

SEQ ID NO: 2219 - DNA, 15 bp, Artificial Sequence
  dgRNA
  Mpzl1
accaagggcggggcc

SEQ ID NO: 2220 - DNA, 15 bp, Artificial Sequence
  dgRNA
  Mpzl1
aagggcggggcccgg

SEQ ID NO: 2221 - DNA, 15 bp, Artificial Sequence
  dgRNA
  Znfx1
cagtgcagataaccg

SEQ ID NO: 2222 - DNA, 15 bp, Artificial Sequence
  dgRNA
  Znfx1
catccttagtcgccc

SEQ ID NO: 2223 - DNA, 15 bp, Artificial Sequence
  dgRNA
  Znfx1
gcttaggtctccgat

SEQ ID NO: 2224 - DNA, 15 bp, Artificial Sequence
  dgRNA
  Znfx1
ctcggttatctgcac

SEQ ID NO: 2225 - DNA, 15 bp, Artificial Sequence
  dgRNA
  Smn1
gagttggaagcgtgt

SEQ ID NO: 2226 - DNA, 15 bp, Artificial Sequence
  dgRNA
  Smn1
ttggaagcgtgtagg

SEQ ID NO: 2227 - DNA, 15 bp, Artificial Sequence
  dgRNA
  Smn1
cgtgtaggaggtctc

SEQ ID NO: 2228 - DNA, 15 bp, Artificial Sequence
  dgRNA
  Smn1
agtacggtggcccgg

SEQ ID NO: 2229 - DNA, 15 bp, Artificial Sequence
  dgRNA
  Hk1
attttggatcctcga

SEQ ID NO: 2230 - DNA, 15 bp, Artificial Sequence
  dgRNA
  Hk1
tggatcctcgatggc

SEQ ID NO: 2231 - DNA, 15 bp, Artificial Sequence
  dgRNA
  Hk1
tcctcgatggcaggc

SEQ ID NO: 2232 - DNA, 15 bp, Artificial Sequence
  dgRNA
  Hk1
gaagccgcctagttt

SEQ ID NO: 2233 - DNA, 15 bp, Artificial Sequence
  dgRNA
  Nos2
gactacgtgctgcct

SEQ ID NO: 2234 - DNA, 15 bp, Artificial Sequence
  dgRNA
  Nos2
actacgtgctgccta

SEQ ID NO: 2235 - DNA, 15 bp, Artificial Sequence
  dgRNA
  Nos2
ctacgtgctgcctag

SEQ ID NO: 2236 - DNA, 15 bp, Artificial Sequence
  dgRNA
  Nos2
taggggccactgcct

SEQ ID NO: 2237 - DNA, 15 bp, Artificial Sequence
  dgRNA
  Lrrc56
ggcgccgggagcgga

SEQ ID NO: 2238 - DNA, 15 bp, Artificial Sequence
  dgRNA
  Lrrc56
cgggagcggacggcg

SEQ ID NO: 2239 - DNA, 15 bp, Artificial Sequence
  dgRNA
  Lrrc56
cggacggcggggact

SEQ ID NO: 2240 - DNA, 15 bp, Artificial Sequence
  dgRNA
  Lrrc56
cggcggggacttggc

SEQ ID NO: 2241 - DNA, 15 bp, Artificial Sequence
  dgRNA
  Prss33
tagaggtatagagtc

SEQ ID NO: 2242 - DNA, 15 bp, Artificial Sequence
  dgRNA
  Prss33
agccgctgaggtaca

SEQ ID NO: 2243 - DNA, 15 bp, Artificial Sequence
  dgRNA
  Prss33
gagcagtctagtcta

SEQ ID NO: 2244 - DNA, 15 bp, Artificial Sequence
  dgRNA
  Prss33
ggagcagtctagtct

SEQ ID NO: 2245 - DNA, 15 bp, Artificial Sequence
  dgRNA
  Kif11
tgaacttcggactac

SEQ ID NO: 2246 - DNA, 15 bp, Artificial Sequence
  dgRNA
  Kif11
cgccatccatttctt

SEQ ID NO: 2247 - DNA, 15 bp, Artificial Sequence
  dgRNA
  Kif11
accacagtgacgaca

SEQ ID NO: 2248 - DNA, 15 bp, Artificial Sequence
  dgRNA
  Kif11
gtgccgctctgctat

SEQ ID NO: 2249 - DNA, 15 bp, Artificial Sequence
  dgRNA
  Lgals9
gtgtccactggtcct

SEQ ID NO: 2250 - DNA, 15 bp, Artificial Sequence
  dgRNA
  Lgals9
aggacctaggaccag

SEQ ID NO: 2251 - DNA, 15 bp, Artificial Sequence
  dgRNA
  Chek1
cgtcaataccaaatc

SEQ ID NO: 2252 - DNA, 15 bp, Artificial Sequence
  dgRNA
  Chek1
tcagccagtattaga

SEQ ID NO: 2253 - DNA, 15 bp, Artificial Sequence
  dgRNA
  Chek1
ggaagggtccttgcg

SEQ ID NO: 2254 - DNA, 15 bp, Artificial Sequence
  dgRNA
  Chek1
gggtccttgcgcggt

SEQ ID NO: 2255 - DNA, 15 bp, Artificial Sequence
  dgRNA
  Hhip
ccgccccgtcgcagc

SEQ ID NO: 2256 - DNA, 15 bp, Artificial Sequence
  dgRNA
  Hhip
ccccgtcgcagccgg

SEQ ID NO: 2257 - DNA, 15 bp, Artificial Sequence
  dgRNA
  Hhip
gccggaggccaccct

SEQ ID NO: 2258 - DNA, 15 bp, Artificial Sequence
  dgRNA
  Hhip
gcgagcgctagctcc

SEQ ID NO: 2259 - DNA, 15 bp, Artificial Sequence
  dgRNA
  Mib1
catccgagtcactcc

SEQ ID NO: 2260 - DNA, 15 bp, Artificial Sequence
  dgRNA
  Mib1
atccgagtcactcca

SEQ ID NO: 2261 - DNA, 15 bp, Artificial Sequence
  dgRNA
  Mib1
gactcctccagacgg

SEQ ID NO: 2262 - DNA, 15 bp, Artificial Sequence
  dgRNA
  Mib1
tcctccagacggagg

SEQ ID NO: 2263 - DNA, 15 bp, Artificial Sequence
  dgRNA
  Ttbk2
atagcggcaattctc

SEQ ID NO: 2264 - DNA, 15 bp, Artificial Sequence
  dgRNA
  Ttbk2
gcggcaattctccgg

SEQ ID NO: 2265 - DNA, 15 bp, Artificial Sequence
  dgRNA
  Ttbk2
cggcaattctccggt

SEQ ID NO: 2266 - DNA, 15 bp, Artificial Sequence
  dgRNA
  Ttbk2
ggcaattctccggtg

SEQ ID NO: 2267 - DNA, 15 bp, Artificial Sequence
  dgRNA
  Olfr350
gcaacccactttaaa

SEQ ID NO: 2268 - DNA, 15 bp, Artificial Sequence
  dgRNA
  Olfr350
atggatattatatgc

SEQ ID NO: 2269 - DNA, 15 bp, Artificial Sequence
  dgRNA
  Olfr350
attgatttgcagtag

SEQ ID NO: 2270 - DNA, 15 bp, Artificial Sequence
  dgRNA
  Olfr350
tattgatttgcagta

SEQ ID NO: 2271 - DNA, 15 bp, Artificial Sequence
  dgRNA
  Plekhb1
ttacctgcctcattc

SEQ ID NO: 2272 - DNA, 15 bp, Artificial Sequence
  dgRNA
  Plekhb1
gccttgccaaggttc

SEQ ID NO: 2273 - DNA, 15 bp, Artificial Sequence
  dgRNA
  Plekhb1
actccctgtcctatt

SEQ ID NO: 2274 - DNA, 15 bp, Artificial Sequence
  dgRNA
  Plekhb1
ccctgtcctattggg

SEQ ID NO: 2275 - DNA, 15 bp, Artificial Sequence
  dgRNA
  Oser1
agcgaaaagaataac

SEQ ID NO: 2276 - DNA, 15 bp, Artificial Sequence
  dgRNA
  Oser1
aagacgcacgtgctt

SEQ ID NO: 2277 - DNA, 15 bp, Artificial Sequence
  dgRNA
  Oser1
gcacgtgcttcggag

SEQ ID NO: 2278 - DNA, 15 bp, Artificial Sequence
  dgRNA
  Oser1
cacgtgcttcggaga

SEQ ID NO: 2279 - DNA, 15 bp, Artificial Sequence
  dgRNA
  Cabp1
cgagcacgcgcgctc

SEQ ID NO: 2280 - DNA, 15 bp, Artificial Sequence
  dgRNA
  Cabp1
agcagagagagtcgc

SEQ ID NO: 2281 - DNA, 15 bp, Artificial Sequence
  dgRNA
  Cabp1
gcagagagagtcgct

SEQ ID NO: 2282 - DNA, 15 bp, Artificial Sequence
  dgRNA
  Cabp1
agtcgctcttcctcc

SEQ ID NO: 2283 - DNA, 15 bp, Artificial Sequence
  dgRNA
  Rngtt
ggcaaaacaggggcg

SEQ ID NO: 2284 - DNA, 15 bp, Artificial Sequence
  dgRNA
  Rngtt
ggcgccctgagatac

SEQ ID NO: 2285 - DNA, 15 bp, Artificial Sequence
  dgRNA
  Rngtt
gcgccctgagataca

SEQ ID NO: 2286 - DNA, 15 bp, Artificial Sequence
  dgRNA
  Rngtt
cgccctgagatacag

SEQ ID NO: 2287 - DNA, 15 bp, Artificial Sequence
  dgRNA
  Lpar1
agtgctgccctccgt

SEQ ID NO: 2288 - DNA, 15 bp, Artificial Sequence
  dgRNA
  Lpar1
gccctccgtaggctc

SEQ ID NO: 2289 - DNA, 15 bp, Artificial Sequence
  dgRNA
  Lpar1
ccctccgtaggctcc

SEQ ID NO: 2290 - DNA, 15 bp, Artificial Sequence
  dgRNA
  Lpar1
ggctccgggttgtgc

SEQ ID NO: 2291 - DNA, 15 bp, Artificial Sequence
  dgRNA
  Med9
ttcctgccagtcccg

SEQ ID NO: 2292 - DNA, 15 bp, Artificial Sequence
  dgRNA
  Med9
tcctgccagtcccgg

SEQ ID NO: 2293 - DNA, 15 bp, Artificial Sequence
  dgRNA
  Med9
cccgggggtcctcgt

SEQ ID NO: 2294 - DNA, 15 bp, Artificial Sequence
  dgRNA
  Med9
cgcccgcctacgccc

SEQ ID NO: 2295 - DNA, 15 bp, Artificial Sequence
  dgRNA
  Cdh5
tgagacctagaattg

SEQ ID NO: 2296 - DNA, 15 bp, Artificial Sequence
  dgRNA
  Cdh5
tgagttgaatacccc

SEQ ID NO: 2297 - DNA, 15 bp, Artificial Sequence
  dgRNA
  Cdh5
gtccaaggcttccac

SEQ ID NO: 2298 - DNA, 15 bp, Artificial Sequence
  dgRNA
  Cdh5
gaggccgcccaccgt

SEQ ID NO: 2299 - DNA, 15 bp, Artificial Sequence
  dgRNA
  Mansc1
gactgcgacccagcg

SEQ ID NO: 2300 - DNA, 15 bp, Artificial Sequence
  dgRNA
  Mansc1
cgacccagcgtggag

SEQ ID NO: 2301 - DNA, 15 bp, Artificial Sequence
  dgRNA
  Mansc1
gacccagcgtggagc

SEQ ID NO: 2302 - DNA, 15 bp, Artificial Sequence
  dgRNA
  Mansc1
gagcgggagtacacc

SEQ ID NO: 2303 - DNA, 15 bp, Artificial Sequence
  dgRNA
  Clvs2
tctaccccgcactcc

SEQ ID NO: 2304 - DNA, 15 bp, Artificial Sequence
  dgRNA
  Clvs2
ctaccccgcactccc

SEQ ID NO: 2305 - DNA, 15 bp, Artificial Sequence
  dgRNA
  Clvs2
cttgcacacaaagcg

SEQ ID NO: 2306 - DNA, 15 bp, Artificial Sequence
  dgRNA
  Clvs2
gcacacaaagcgagg

SEQ ID NO: 2307 - DNA, 15 bp, Artificial Sequence
  dgRNA
  Btk
gtgtaaagaggtccc

SEQ ID NO: 2308 - DNA, 15 bp, Artificial Sequence
  dgRNA
  Btk
cccaggcaaatgtcg

SEQ ID NO: 2309 - DNA, 15 bp, Artificial Sequence
  dgRNA
  Btk
ccaggcaaatgtcgg

SEQ ID NO: 2310 - DNA, 15 bp, Artificial Sequence
  dgRNA
  Btk
caggcaaatgtcggg

SEQ ID NO: 2311 - DNA, 15 bp, Artificial Sequence
  dgRNA
  Gja8
taaaagctgtctggc

SEQ ID NO: 2312 - DNA, 15 bp, Artificial Sequence
  dgRNA
  Gja8
ggggaaagctgacgt

SEQ ID NO: 2313 - DNA, 15 bp, Artificial Sequence
  dgRNA
  Gja8
tggatctgtcctgat

SEQ ID NO: 2314 - DNA, 15 bp, Artificial Sequence
  dgRNA
  Lrrc56
ctgcgttcagccgtc

SEQ ID NO: 2315 - DNA, 15 bp, Artificial Sequence
  dgRNA
  Lrrc56
atctgccgcgtgtcc

SEQ ID NO: 2316 - DNA, 15 bp, Artificial Sequence
  dgRNA
  Lrrc56
ccggcaaccgttgct

SEQ ID NO: 2317 - DNA, 15 bp, Artificial Sequence
  dgRNA
  Lrrc56
cggcaaccgttgcta

SEQ ID NO: 2318 - DNA, 15 bp, Artificial Sequence
  dgRNA
  Zfp605
gtagtaaaatacttc

SEQ ID NO: 2319 - DNA, 15 bp, Artificial Sequence
  dgRNA
  Zfp605
gatgacatcgtctta

SEQ ID NO: 2320 - DNA, 15 bp, Artificial Sequence
  dgRNA
  Zfp605
cgatgtcatcagcaa

SEQ ID NO: 2321 - DNA, 15 bp, Artificial Sequence
  dgRNA
  Zfp605
acgatgtcatcagca

SEQ ID NO: 2322 - DNA, 15 bp, Artificial Sequence
  dgRNA
  Gm5868
tctttgttccgcccc

SEQ ID NO: 2323 - DNA, 15 bp, Artificial Sequence
  dgRNA
  Gm5868
cgcccctggctgcac

SEQ ID NO: 2324 - DNA, 15 bp, Artificial Sequence
  dgRNA
  Gm5868
aggggaccgagcggc

SEQ ID NO: 2325 - DNA, 15 bp, Artificial Sequence
  dgRNA
  Gm5868
ggggaccgagcggca

SEQ ID NO: 2326 - DNA, 15 bp, Artificial Sequence
  dgRNA
  Tceal8
ctggtaatctgagta

SEQ ID NO: 2327 - DNA, 15 bp, Artificial Sequence
  dgRNA
  Tceal8
tgaatagatactact

SEQ ID NO: 2328 - DNA, 15 bp, Artificial Sequence
  dgRNA
  Tceal8
ctcctattggcaaat

SEQ ID NO: 2329 - DNA, 15 bp, Artificial Sequence
  dgRNA
  Tceal8
gacagtatctagtga

SEQ ID NO: 2330 - DNA, 15 bp, Artificial Sequence
  dgRNA
  Pip5k1c
tcctgcaccggacgc

SEQ ID NO: 2331 - DNA, 15 bp, Artificial Sequence
  dgRNA
  Pip5k1c
tgcaccggacgccgg

SEQ ID NO: 2332 - DNA, 15 bp, Artificial Sequence
  dgRNA
  Pip5k1c
gcaccggacgccgga

SEQ ID NO: 2333 - DNA, 15 bp, Artificial Sequence
  dgRNA
  Pip5k1c
gtccttatatccaat

SEQ ID NO: 2334 - DNA, 15 bp, Artificial Sequence
  dgRNA
  Il12rb2
tcataattcagttac

SEQ ID NO: 2335 - DNA, 15 bp, Artificial Sequence
  dgRNA
  Il12rb2
ggatctcatacatga

SEQ ID NO: 2336 - DNA, 15 bp, Artificial Sequence
  dgRNA
  Ntng1
ggtttcacaccacgg

SEQ ID NO: 2337 - DNA, 15 bp, Artificial Sequence
  dgRNA
  Ntng1
ggaggtccgaagctc

SEQ ID NO: 2338 - DNA, 15 bp, Artificial Sequence
  dgRNA
  Ntng1
ccttgctcccagtta

SEQ ID NO: 2339 - DNA, 15 bp, Artificial Sequence
  dgRNA
  Ntng1
gcgctccgttgtgtg

SEQ ID NO: 2340 - DNA, 15 bp, Artificial Sequence
  dgRNA
  4921517D22Rik
agtaagggcggggtt

SEQ ID NO: 2341 - DNA, 15 bp, Artificial Sequence
  dgRNA
  4921517D22Rik
ttgacagtaagggcg

SEQ ID NO: 2342 - DNA, 15 bp, Artificial Sequence
  dgRNA
  4921517D22Rik
tttgacagtaagggc

SEQ ID NO: 2343 - DNA, 15 bp, Artificial Sequence
  dgRNA
  4921517D22Rik
gtttgacagtaaggg

SEQ ID NO: 2344 - DNA, 15 bp, Artificial Sequence
  dgRNA
  Atp5o
gttcacgagtccagc

SEQ ID NO: 2345 - DNA, 15 bp, Artificial Sequence
  dgRNA
  Atp5o
agtccagccggaccg

SEQ ID NO: 2346 - DNA, 15 bp, Artificial Sequence
  dgRNA
  Atp5o
cagccggaccgcggc

SEQ ID NO: 2347 - DNA, 15 bp, Artificial Sequence
  dgRNA
  Atp5o
ggaccgcggcaggta

SEQ ID NO: 2348 - DNA, 15 bp, Artificial Sequence
  dgRNA
  Olfr1338
gcagatacccggaac

SEQ ID NO: 2349 - DNA, 15 bp, Artificial Sequence
  dgRNA
  Olfr1338
caactttgagctctc

SEQ ID NO: 2350 - DNA, 15 bp, Artificial Sequence
  dgRNA
  Olfr1014
agtacatacctcttt

SEQ ID NO: 2351 - DNA, 15 bp, Artificial Sequence
  dgRNA
  Pgbd1
cgaccttcatcgtcg

SEQ ID NO: 2352 - DNA, 15 bp, Artificial Sequence
  dgRNA
  Pgbd1
gaccttcatcgtcgc

SEQ ID NO: 2353 - DNA, 15 bp, Artificial Sequence
  dgRNA
  Pgbd1
tcatcgtcgcgggct

SEQ ID NO: 2354 - DNA, 15 bp, Artificial Sequence
  dgRNA
  Pgbd1
acagcaagaaccgcc

SEQ ID NO: 2355 - DNA, 15 bp, Artificial Sequence
  dgRNA
  Tmem109
catttttagcgtgaa

SEQ ID NO: 2356 - DNA, 15 bp, Artificial Sequence
  dgRNA
  Tmem109
ccagcgccccgcctt

SEQ ID NO: 2357 - DNA, 15 bp, Artificial Sequence
  dgRNA
  Tmem109
ggaactgcacttccc

SEQ ID NO: 2358 - DNA, 15 bp, Artificial Sequence
  dgRNA
  Tmem109
actgcacttcccggg

SEQ ID NO: 2359 - DNA, 15 bp, Artificial Sequence
  dgRNA
  Dapp1
cttgacaatacgttg

SEQ ID NO: 2360 - DNA, 15 bp, Artificial Sequence
  dgRNA
  Dapp1
acgttgtggtgactg

SEQ ID NO: 2361 - DNA, 15 bp, Artificial Sequence
  dgRNA
  Dapp1
ggcccacggtggcag

SEQ ID NO: 2362 - DNA, 15 bp, Artificial Sequence
  dgRNA
  Dapp1
caggatggggcgatt

SEQ ID NO: 2363 - DNA, 15 bp, Artificial Sequence
  dgRNA
  Nras
ccggttttatgttaa

SEQ ID NO: 2364 - DNA, 15 bp, Artificial Sequence
  dgRNA
  Nras
ttaatggcgaaagaa

SEQ ID NO: 2365 - DNA, 15 bp, Artificial Sequence
  dgRNA
  Nras
caagactctagtcgt

SEQ ID NO: 2366 - DNA, 15 bp, Artificial Sequence
  dgRNA
  Nras
agtcgtcggcccacg

SEQ ID NO: 2367 - DNA, 15 bp, Artificial Sequence
  dgRNA
  Pnpla7
acggccgtccccacg

SEQ ID NO: 2368 - DNA, 15 bp, Artificial Sequence
  dgRNA
  Pnpla7
cggccgtctggggtt

SEQ ID NO: 2369 - DNA, 15 bp, Artificial Sequence
  dgRNA
  Pnpla7
acggccgtctggggt

SEQ ID NO: 2370 - DNA, 15 bp, Artificial Sequence
  dgRNA
  Pnpla7
ggggacggccgtctg

SEQ ID NO: 2371 - DNA, 15 bp, Artificial Sequence
  dgRNA
  Yy1
cgccccctaccccag

SEQ ID NO: 2372 - DNA, 15 bp, Artificial Sequence
  dgRNA
  Yy1
ccccctaccccagcg

SEQ ID NO: 2373 - DNA, 15 bp, Artificial Sequence
  dgRNA
  Yy1
cccctaccccagcgg

SEQ ID NO: 2374 - DNA, 15 bp, Artificial Sequence
  dgRNA
  Yy1
gggggcccccccaat

SEQ ID NO: 2375 - DNA, 15 bp, Artificial Sequence
  dgRNA
  Zfp40
aaaccctcacgtaac

SEQ ID NO: 2376 - DNA, 15 bp, Artificial Sequence
  dgRNA
  Zfp40
accggaaccagcgtg

SEQ ID NO: 2377 - DNA, 15 bp, Artificial Sequence
  dgRNA
  Zfp40
ggaaccagcgtgtgg

SEQ ID NO: 2378 - DNA, 15 bp, Artificial Sequence
  dgRNA
  Zfp40
gaaccagcgtgtggt

SEQ ID NO: 2379 - DNA, 15 bp, Artificial Sequence
  dgRNA
  Ankrd50
gcgagccaatagagt

SEQ ID NO: 2380 - DNA, 15 bp, Artificial Sequence
  dgRNA
  Ankrd50
cgagccaatagagtg

SEQ ID NO: 2381 - DNA, 15 bp, Artificial Sequence
  dgRNA
  Ankrd50
gagccaatagagtgg

SEQ ID NO: 2382 - DNA, 15 bp, Artificial Sequence
  dgRNA
  Ankrd50
agagtgggggttaac

SEQ ID NO: 2383 - DNA, 15 bp, Artificial Sequence
  dgRNA
  Map7d2
ggatgctgagccgtg

SEQ ID NO: 2384 - DNA, 15 bp, Artificial Sequence
  dgRNA
  Map7d2
agccgtgaggacttg

SEQ ID NO: 2385 - DNA, 15 bp, Artificial Sequence
  dgRNA
  Map7d2
gcacgttcggcgccc

SEQ ID NO: 2386 - DNA, 15 bp, Artificial Sequence
  dgRNA
  Map7d2
cacgttcggcgcccc

SEQ ID NO: 2387 - DNA, 15 bp, Artificial Sequence
  dgRNA
  Wee2
taatagaattgccat

SEQ ID NO: 2388 - DNA, 15 bp, Artificial Sequence
  dgRNA
  Wee2
aaaggcggcgcacag

SEQ ID NO: 2389 - DNA, 15 bp, Artificial Sequence
  dgRNA
  Wee2
atcatctgatttacc

SEQ ID NO: 2390 - DNA, 15 bp, Artificial Sequence
  dgRNA
  Wee2
atcttgtgttgccaa

SEQ ID NO: 2391 - DNA, 15 bp, Artificial Sequence
  dgRNA
  Sowaha
ggtaaatagtgctga

SEQ ID NO: 2392 - DNA, 15 bp, Artificial Sequence
  dgRNA
  Sowaha
cgctgcaacatcccc

SEQ ID NO: 2393 - DNA, 15 bp, Artificial Sequence
  dgRNA
  Sowaha
gtatgggcgaggcgt

SEQ ID NO: 2394 - DNA, 15 bp, Artificial Sequence
  dgRNA
  Sowaha
cgtatgggcgaggcg

SEQ ID NO: 2395 - DNA, 15 bp, Artificial Sequence
  dgRNA
  Ash2l
ctggccttaaagcgg

SEQ ID NO: 2396 - DNA, 15 bp, Artificial Sequence
  dgRNA
  Ash2l
tcccaagtaagtggc

SEQ ID NO: 2397 - DNA, 15 bp, Artificial Sequence
  dgRNA
  Ash2l
taagagcgccgtgcg

SEQ ID NO: 2398 - DNA, 15 bp, Artificial Sequence
  dgRNA
  Ash2l
gagcgccgtgcgtgg

SEQ ID NO: 2399 - DNA, 15 bp, Artificial Sequence
  dgRNA
  Esco2
cactgttacgggcgt

SEQ ID NO: 2400 - DNA, 15 bp, Artificial Sequence
  dgRNA
  Esco2
gcctgaagttattgc

SEQ ID NO: 2401 - DNA, 15 bp, Artificial Sequence
  dgRNA
  Esco2
agggcgggagaatct

SEQ ID NO: 2402 - DNA, 15 bp, Artificial Sequence
  dgRNA
  Esco2
cggagacctcctcgc

SEQ ID NO: 2403 - DNA, 15 bp, Artificial Sequence
  dgRNA
  Gipr
ctctacgtgacacaa

SEQ ID NO: 2404 - DNA, 15 bp, Artificial Sequence
  dgRNA
  Gipr
aacgtgcctgctcca

SEQ ID NO: 2405 - DNA, 15 bp, Artificial Sequence
  dgRNA
  Gipr
ttctctggtccgccc

SEQ ID NO: 2406 - DNA, 15 bp, Artificial Sequence
  dgRNA
  Gipr
attgtgtcacgtaga

SEQ ID NO: 2407 - DNA, 15 bp, Artificial Sequence
  dgRNA
  Cd8a
gttgacactctttgg

SEQ ID NO: 2408 - DNA, 15 bp, Artificial Sequence
  dgRNA
  Cd8a
ttgacactctttggt

SEQ ID NO: 2409 - DNA, 15 bp, Artificial Sequence
  dgRNA
  Cd8a
cctccgccctgttcc

SEQ ID NO: 2410 - DNA, 15 bp, Artificial Sequence
  dgRNA
  Cd8a
ctccgccctgttcct

SEQ ID NO: 2411 - DNA, 15 bp, Artificial Sequence
  dgRNA
  Anapc4
cgggcagcccagagt

SEQ ID NO: 2412 - DNA, 15 bp, Artificial Sequence
  dgRNA
  Anapc4
agccacgcccagcta

SEQ ID NO: 2413 - DNA, 15 bp, Artificial Sequence
  dgRNA
  Anapc4
cacccgctgtagcct

SEQ ID NO: 2414 - DNA, 15 bp, Artificial Sequence
  dgRNA
  Anapc4
ctcgccccgcccaca

SEQ ID NO: 2415 - DNA, 15 bp, Artificial Sequence
  dgRNA
  Tubg1
ctggacccggggccg

SEQ ID NO: 2416 - DNA, 15 bp, Artificial Sequence
  dgRNA
  Tubg1
caacatccggggcca

SEQ ID NO: 2417 - DNA, 15 bp, Artificial Sequence
  dgRNA
  Tubg1
ccggggccacggccc

SEQ ID NO: 2418 - DNA, 15 bp, Artificial Sequence
  dgRNA
  Tubg1
cgcagaagcacgatt

SEQ ID NO: 2419 - DNA, 15 bp, Artificial Sequence
  dgRNA
  Rbm12b2
gcgttcagagcgcca

SEQ ID NO: 2420 - DNA, 15 bp, Artificial Sequence
  dgRNA
  Rbm12b2
cgttcagagcgccaa

SEQ ID NO: 2421 - DNA, 15 bp, Artificial Sequence
  dgRNA
  Rbm12b2
gttcagagcgccaag

SEQ ID NO: 2422 - DNA, 15 bp, Artificial Sequence
  dgRNA
  Rbm12b2
cagagcgccaagggg

SEQ ID NO: 2423 - DNA, 15 bp, Artificial Sequence
  dgRNA
  Hipk1
cacttccgcctcagt

SEQ ID NO: 2424 - DNA, 15 bp, Artificial Sequence
  dgRNA
  Hipk1
cctcagtaggtgtca

SEQ ID NO: 2425 - DNA, 15 bp, Artificial Sequence
  dgRNA
  Hipk1
aggtgtcatggcgct

SEQ ID NO: 2426 - DNA, 15 bp, Artificial Sequence
  dgRNA
  Hipk1
tgtcatggcgctagg

SEQ ID NO: 2427 - DNA, 15 bp, Artificial Sequence
  dgRNA
  Ttc12
ggagcctttacatta

SEQ ID NO: 2428 - DNA, 15 bp, Artificial Sequence
  dgRNA
  Ttc12
gagcctttacattat

SEQ ID NO: 2429 - DNA, 15 bp, Artificial Sequence
  dgRNA
  Ttc12
ctgggagaaccctcg

SEQ ID NO: 2430 - DNA, 15 bp, Artificial Sequence
  dgRNA
  Ttc12
ctcgcggctccagag

SEQ ID NO: 2431 - DNA, 15 bp, Artificial Sequence
  dgRNA
  Bcor
caaacttgcgagagc

SEQ ID NO: 2432 - DNA, 15 bp, Artificial Sequence
  dgRNA
  Bcor
acttgcgagagctgg

SEQ ID NO: 2433 - DNA, 15 bp, Artificial Sequence
  dgRNA
  Bcor
cgagcgctgcgcctg

SEQ ID NO: 2434 - DNA, 15 bp, Artificial Sequence
  dgRNA
  Bcor
gagcgctgcgcctga

SEQ ID NO: 2435 - DNA, 15 bp, Artificial Sequence
  dgRNA
  Ces3a
gcctccaaccaatca

SEQ ID NO: 2436 - DNA, 15 bp, Artificial Sequence
  dgRNA
  Ces3a
gccctgattggttgg

SEQ ID NO: 2437 - DNA, 15 bp, Artificial Sequence
  dgRNA
  Ces3a
ttggtctgccctgat

SEQ ID NO: 2438 - DNA, 15 bp, Artificial Sequence
  dgRNA
  Dlgap4
gcgccgggccccgag

SEQ ID NO: 2439 - DNA, 15 bp, Artificial Sequence
  dgRNA
  Dlgap4
cccgagcggcccccg

SEQ ID NO: 2440 - DNA, 15 bp, Artificial Sequence
  dgRNA
  Dlgap4
ggtcccccgcagccc

SEQ ID NO: 2441 - DNA, 15 bp, Artificial Sequence
  dgRNA
  Dlgap4
ggcctgatccgcgcc

SEQ ID NO: 2442 - DNA, 15 bp, Artificial Sequence
  dgRNA
  Dgcr6
tacaagcagtctccc

SEQ ID NO: 2443 - DNA, 15 bp, Artificial Sequence
  dgRNA
  Dgcr6
gtgcctgacgcacca

SEQ ID NO: 2444 - DNA, 15 bp, Artificial Sequence
  dgRNA
  Dgcr6
acgcaccacggtgaa

SEQ ID NO: 2445 - DNA, 15 bp, Artificial Sequence
  dgRNA
  Dgcr6
accacggtgaacggc

SEQ ID NO: 2446 - DNA, 15 bp, Artificial Sequence
  dgRNA
  Gne
aaacaaccatctcgt

SEQ ID NO: 2447 - DNA, 15 bp, Artificial Sequence
  dgRNA
  Gne
actcgggcttaactg

SEQ ID NO: 2448 - DNA, 15 bp, Artificial Sequence
  dgRNA
  Gne
ctcgggcttaactgt

SEQ ID NO: 2449 - DNA, 15 bp, Artificial Sequence
  dgRNA
  Gne
cctcaggcgagaata

SEQ ID NO: 2450 - DNA, 15 bp, Artificial Sequence
  dgRNA
  Ppp1r15b
tcggatccataaaaa

SEQ ID NO: 2451 - DNA, 15 bp, Artificial Sequence
  dgRNA
  Ppp1r15b
cggatccataaaaaa

SEQ ID NO: 2452 - DNA, 15 bp, Artificial Sequence
  dgRNA
  Ppp1r15b
ccataaaaaagggct

SEQ ID NO: 2453 - DNA, 15 bp, Artificial Sequence
  dgRNA
  Ppp1r15b
gctcgggagaattct

SEQ ID NO: 2454 - DNA, 15 bp, Artificial Sequence
  dgRNA
  Olfr339
cattaagtgttccca

SEQ ID NO: 2455 - DNA, 15 bp, Artificial Sequence
  dgRNA
  Olfr339
ataacattagtttgg

SEQ ID NO: 2456 - DNA, 15 bp, Artificial Sequence
  dgRNA
  Olfr339
tgtctaatacacctt

SEQ ID NO: 2457 - DNA, 15 bp, Artificial Sequence
  dgRNA
  Olfr339
tctgctgtaagtgaa

SEQ ID NO: 2458 - DNA, 15 bp, Artificial Sequence
  dgRNA
  Mthfd2
cagttggcctagctg

SEQ ID NO: 2459 - DNA, 15 bp, Artificial Sequence
  dgRNA
  Mthfd2
agttggcctagctga

SEQ ID NO: 2460 - DNA, 15 bp, Artificial Sequence
  dgRNA
  Mthfd2
tattggctcctacgc

SEQ ID NO: 2461 - DNA, 15 bp, Artificial Sequence
  dgRNA
  Mthfd2
ctcctacgccggctc

SEQ ID NO: 2462 - DNA, 15 bp, Artificial Sequence
  dgRNA
  Olfr1406
tcaactctacagtac

SEQ ID NO: 2463 - DNA, 15 bp, Artificial Sequence
  dgRNA
  Olfr1406
ccatataccactacc

SEQ ID NO: 2464 - DNA, 15 bp, Artificial Sequence
  dgRNA
  Olfr1406
tttaagggcaatgcc

SEQ ID NO: 2465 - DNA, 15 bp, Artificial Sequence
  dgRNA
  Olfr1406
ttaagggcaatgcct

SEQ ID NO: 2466 - DNA, 15 bp, Artificial Sequence
  dgRNA
  Gba
tccgcccctttaagc

SEQ ID NO: 2467 - DNA, 15 bp, Artificial Sequence
  dgRNA
  Gba
ctaacaaggattgta

SEQ ID NO: 2468 - DNA, 15 bp, Artificial Sequence
  dgRNA
  Gba
tttggggaggcctaa

SEQ ID NO: 2469 - DNA, 15 bp, Artificial Sequence
  dgRNA
  Gba
ataccctgtgaattt

SEQ ID NO: 2470 - DNA, 15 bp, Artificial Sequence
  dgRNA
  Zfp57
gacatcagcgaagca

SEQ ID NO: 2471 - DNA, 15 bp, Artificial Sequence
  dgRNA
  Zfp57
tgagctagataaagg

SEQ ID NO: 2472 - DNA, 15 bp, Artificial Sequence
  dgRNA
  Zfp57
gggctagaatgtgcc

SEQ ID NO: 2473 - DNA, 15 bp, Artificial Sequence
  dgRNA
  Zfp57
ggctagaatgtgcct

SEQ ID NO: 2474 - DNA, 15 bp, Artificial Sequence
  dgRNA
  Creg1
gaaactgggttgcac

SEQ ID NO: 2475 - DNA, 15 bp, Artificial Sequence
  dgRNA
  Creg1
gattggctttctcgg

SEQ ID NO: 2476 - DNA, 15 bp, Artificial Sequence
  dgRNA
  Creg1
attggctttctcgga

SEQ ID NO: 2477 - DNA, 15 bp, Artificial Sequence
  dgRNA
  Creg1
ttggctttctcggag

SEQ ID NO: 2478 - DNA, 15 bp, Artificial Sequence
  dgRNA
  Ypel2
ccgtcctccagtgat

SEQ ID NO: 2479 - DNA, 15 bp, Artificial Sequence
  dgRNA
  Ypel2
ttggctcctggcgga

SEQ ID NO: 2480 - DNA, 15 bp, Artificial Sequence
  dgRNA
  Ypel2
tggctcctggcggat

SEQ ID NO: 2481 - DNA, 15 bp, Artificial Sequence
  dgRNA
  Ypel2
ctggcggatgggctg

SEQ ID NO: 2482 - DNA, 15 bp, Artificial Sequence
  dgRNA
  Vmn1r180
tataggagaattgtc

SEQ ID NO: 2483 - DNA, 15 bp, Artificial Sequence
  dgRNA
  Vmn1r180
tattctatacactat

SEQ ID NO: 2484 - DNA, 15 bp, Artificial Sequence
  dgRNA
  Aldoart2
ccccgtcctctgagt

SEQ ID NO: 2485 - DNA, 15 bp, Artificial Sequence
  dgRNA
  Aldoart2
taggttgcgttctct

SEQ ID NO: 2486 - DNA, 15 bp, Artificial Sequence
  dgRNA
  Aldoart2
acacgccacagaaac

SEQ ID NO: 2487 - DNA, 15 bp, Artificial Sequence
  dgRNA
  Aldoart2
cctactcagaggacg

SEQ ID NO: 2488 - DNA, 15 bp, Artificial Sequence
  dgRNA
  Abcb11
gttgataccctcaga

SEQ ID NO: 2489 - DNA, 15 bp, Artificial Sequence
  dgRNA
  Abcb11
ggtccccacgcactc

SEQ ID NO: 2490 - DNA, 15 bp, Artificial Sequence
  dgRNA
  Abcb11
gtccccacgcactct

SEQ ID NO: 2491 - DNA, 15 bp, Artificial Sequence
  dgRNA
  Abcb11
cacgcactctgggtt

SEQ ID NO: 2492 - DNA, 15 bp, Artificial Sequence
  dgRNA
  Rprd2
tgcgaggaggggccg

SEQ ID NO: 2493 - DNA, 15 bp, Artificial Sequence
  dgRNA
  Rprd2
acacgctgcgaggag

SEQ ID NO: 2494 - DNA, 15 bp, Artificial Sequence
  dgRNA
  Rprd2
cacacgctgcgagga

SEQ ID NO: 2495 - DNA, 15 bp, Artificial Sequence
  dgRNA
  Rprd2
ccacacgctgcgagg

SEQ ID NO: 2496 - DNA, 15 bp, Artificial Sequence
  dgRNA
  Zc3h10
gccactcctacgttt

SEQ ID NO: 2497 - DNA, 15 bp, Artificial Sequence
  dgRNA
  Zc3h10
ccactcctacgtttt

SEQ ID NO: 2498 - DNA, 15 bp, Artificial Sequence
  dgRNA
  Zc3h10
cactcctacgttttg

SEQ ID NO: 2499 - DNA, 15 bp, Artificial Sequence
  dgRNA
  Zc3h10
actcctacgttttgg

SEQ ID NO: 2500 - DNA, 15 bp, Artificial Sequence
  dgRNA
  Nfic
atggatagctctaga

SEQ ID NO: 2501 - DNA, 15 bp, Artificial Sequence
  dgRNA
  Nfic
gatagctctagaggg

SEQ ID NO: 2502 - DNA, 15 bp, Artificial Sequence
  dgRNA
  Nfic
aaagttggatgcggg

SEQ ID NO: 2503 - DNA, 15 bp, Artificial Sequence
  dgRNA
  Nfic
ttggatgcgggcggc

SEQ ID NO: 2504 - DNA, 15 bp, Artificial Sequence
  dgRNA
  Fads1
aaataaattccgaag

SEQ ID NO: 2505 - DNA, 15 bp, Artificial Sequence
  dgRNA
  Fads1
cgaagtggaatagcc

SEQ ID NO: 2506 - DNA, 15 bp, Artificial Sequence
  dgRNA
  Fads1
ctttcaggccccgcg

SEQ ID NO: 2507 - DNA, 15 bp, Artificial Sequence
  dgRNA
  Fads1
tttcaggccccgcga

SEQ ID NO: 2508 - DNA, 15 bp, Artificial Sequence
  dgRNA
  Nnmt
gaacaagcagactac

SEQ ID NO: 2509 - DNA, 15 bp, Artificial Sequence
  dgRNA
  Nnmt
gactactggattgtt

SEQ ID NO: 2510 - DNA, 15 bp, Artificial Sequence
  dgRNA
  Nnmt
gatgacccgtctctc

SEQ ID NO: 2511 - DNA, 15 bp, Artificial Sequence
  dgRNA
  Nnmt
tgcaccactggtcag

SEQ ID NO: 2512 - DNA, 15 bp, Artificial Sequence
  dgRNA
  Aire
tcgcctttccgccgc

SEQ ID NO: 2513 - DNA, 15 bp, Artificial Sequence
  dgRNA
  Aire
cgcctttccgccgct

SEQ ID NO: 2514 - DNA, 15 bp, Artificial Sequence
  dgRNA
  Aire
gcctttccgccgctg

SEQ ID NO: 2515 - DNA, 15 bp, Artificial Sequence
  dgRNA
  Aire
aatataaacgcttac

SEQ ID NO: 2516 - DNA, 15 bp, Artificial Sequence
  dgRNA
  Spata3
gtcttaattagacca

SEQ ID NO: 2517 - DNA, 15 bp, Artificial Sequence
  dgRNA
  Spata3
ttaattagaccatgg

SEQ ID NO: 2518 - DNA, 15 bp, Artificial Sequence
  dgRNA
  Spata3
cctgccggttcaagc

SEQ ID NO: 2519 - DNA, 15 bp, Artificial Sequence
  dgRNA
  Spata3
cctgcttgaaccggc

SEQ ID NO: 2520 - DNA, 15 bp, Artificial Sequence
  dgRNA
  Upf3a
agcgcacgggacgtc

SEQ ID NO: 2521 - DNA, 15 bp, Artificial Sequence
  dgRNA
  Upf3a
catctgctctccgcg

SEQ ID NO: 2522 - DNA, 15 bp, Artificial Sequence
  dgRNA
  Upf3a
tgctctccgcgtggc

SEQ ID NO: 2523 - DNA, 15 bp, Artificial Sequence
  dgRNA
  Upf3a
cgtcgccgccgttct

SEQ ID NO: 2524 - DNA, 15 bp, Artificial Sequence
  dgRNA
  Lrp2
gagcgagcgcgcttg

SEQ ID NO: 2525 - DNA, 15 bp, Artificial Sequence
  dgRNA
  Lrp2
gcgcgcaagtgtccg

SEQ ID NO: 2526 - DNA, 15 bp, Artificial Sequence
  dgRNA
  Lrp2
cgcgcaagtgtccga

SEQ ID NO: 2527 - DNA, 15 bp, Artificial Sequence
  dgRNA
  Lrp2
agagtcgcaaagtgc

SEQ ID NO: 2528 - DNA, 15 bp, Artificial Sequence
  dgRNA
  Dedd
gggcagtccgacccc

SEQ ID NO: 2529 - DNA, 15 bp, Artificial Sequence
  dgRNA
  Dedd
cgcccttacgtatca

SEQ ID NO: 2530 - DNA, 15 bp, Artificial Sequence
  dgRNA
  Dedd
gcccctctctcccga

SEQ ID NO: 2531 - DNA, 15 bp, Artificial Sequence
  dgRNA
  Dedd
cgataccagccagct

SEQ ID NO: 2532 - DNA, 15 bp, Artificial Sequence
  dgRNA
  Apob
cacaagttcgggggt

SEQ ID NO: 2533 - DNA, 15 bp, Artificial Sequence
  dgRNA
  Apob
agaaatgcgcttgta

SEQ ID NO: 2534 - DNA, 15 bp, Artificial Sequence
  dgRNA
  Apob
ccgggccgtgccctt

SEQ ID NO: 2535 - DNA, 15 bp, Artificial Sequence
  dgRNA
  Apob
tggagcacttttcaa

SEQ ID NO: 2536 - DNA, 15 bp, Artificial Sequence
  dgRNA
  Olfr1032
aattcccattcttga

SEQ ID NO: 2537 - DNA, 15 bp, Artificial Sequence
  dgRNA
  Trpm3
aaacccgatctctcc

SEQ ID NO: 2538 - DNA, 15 bp, Artificial Sequence
  dgRNA
  Trpm3
aacccgatctctcct

SEQ ID NO: 2539 - DNA, 15 bp, Artificial Sequence
  dgRNA
  Trpm3
acctaatctgaagcc

SEQ ID NO: 2540 - DNA, 15 bp, Artificial Sequence
  dgRNA
  Als2cr11
gtatttcccatcatg

SEQ ID NO: 2541 - DNA, 15 bp, Artificial Sequence
  dgRNA
  Als2cr11
cccaccagcgaactc

SEQ ID NO: 2542 - DNA, 15 bp, Artificial Sequence
  dgRNA
  Als2cr11
aggaaccacacccga

SEQ ID NO: 2543 - DNA, 15 bp, Artificial Sequence
  dgRNA
  Als2cr11
ccgatggtccagctt

SEQ ID NO: 2544 - DNA, 15 bp, Artificial Sequence
  dgRNA
  Gnas
gcccgagccggacgt

SEQ ID NO: 2545 - DNA, 15 bp, Artificial Sequence
  dgRNA
  Gnas
ccgccctcccagccg

SEQ ID NO: 2546 - DNA, 15 bp, Artificial Sequence
  dgRNA
  Gnas
ccgccgcggcgcttt

SEQ ID NO: 2547 - DNA, 15 bp, Artificial Sequence
  dgRNA
  Gnas
cgccgcggcgctttt

SEQ ID NO: 2548 - DNA, 15 bp, Artificial Sequence
  dgRNA
  Macrod2
gctccccaacgtcct

SEQ ID NO: 2549 - DNA, 15 bp, Artificial Sequence
  dgRNA
  Macrod2
agtaggggcgcgcct

SEQ ID NO: 2550 - DNA, 15 bp, Artificial Sequence
  dgRNA
  Macrod2
cgccttggctagagc

SEQ ID NO: 2551 - DNA, 15 bp, Artificial Sequence
  dgRNA
  Macrod2
ctagagccgggagag

SEQ ID NO: 2552 - DNA, 15 bp, Artificial Sequence
  dgRNA
  Phc2
agtgagccaccgggg

SEQ ID NO: 2553 - DNA, 15 bp, Artificial Sequence
  dgRNA
  Phc2
tgagccaccggggcg

SEQ ID NO: 2554 - DNA, 15 bp, Artificial Sequence
  dgRNA
  Phc2
gagccaccggggcgg

SEQ ID NO: 2555 - DNA, 15 bp, Artificial Sequence
  dgRNA
  Phc2
aggccacgggtcccc

SEQ ID NO: 2556 - DNA, 15 bp, Artificial Sequence
  dgRNA
  Pcdha7
attctacttactact

SEQ ID NO: 2557 - DNA, 15 bp, Artificial Sequence
  dgRNA
  Pcdha7
tctcgtgcttcttca

SEQ ID NO: 2558 - DNA, 15 bp, Artificial Sequence
  dgRNA
  Rhbdf1
atgttatgattaagg

SEQ ID NO: 2559 - DNA, 15 bp, Artificial Sequence
  dgRNA
  Rhbdf1
gattaaggtggtcgc

SEQ ID NO: 2560 - DNA, 15 bp, Artificial Sequence
  dgRNA
  Rhbdf1
ccgactcccagctac

SEQ ID NO: 2561 - DNA, 15 bp, Artificial Sequence
  dgRNA
  Rhbdf1
tctctgcgggacccc

SEQ ID NO: 2562 - DNA, 15 bp, Artificial Sequence
  dgRNA
  Tsc1
cggttttatttatct

SEQ ID NO: 2563 - DNA, 15 bp, Artificial Sequence
  dgRNA
  Tsc1
ttgtatcgtcataag

SEQ ID NO: 2564 - DNA, 15 bp, Artificial Sequence
  dgRNA
  Tsc1
atctggcattaggct

SEQ ID NO: 2565 - DNA, 15 bp, Artificial Sequence
  dgRNA
  Tsc1
agtagagacccgaat

SEQ ID NO: 2566 - DNA, 15 bp, Artificial Sequence
  dgRNA
  Ubtf
gatgatcagggaacg

SEQ ID NO: 2567 - DNA, 15 bp, Artificial Sequence
  dgRNA
  Ubtf
aagggcgccgtgagc

SEQ ID NO: 2568 - DNA, 15 bp, Artificial Sequence
  dgRNA
  Ubtf
agggcgccgtgagcc

SEQ ID NO: 2569 - DNA, 15 bp, Artificial Sequence
  dgRNA
  Ubtf
gggcgccgtgagccg

SEQ ID NO: 2570 - DNA, 15 bp, Artificial Sequence
  dgRNA
  Steap2
gggctgctcccacgg

SEQ ID NO: 2571 - DNA, 15 bp, Artificial Sequence
  dgRNA
  Steap2
ggctgctcccacggg

SEQ ID NO: 2572 - DNA, 15 bp, Artificial Sequence
  dgRNA
  Steap2
cgcaagatcgcgcgc

SEQ ID NO: 2573 - DNA, 15 bp, Artificial Sequence
  dgRNA
  Steap2
gatcgcgcgcaggcg

SEQ ID NO: 2574 - DNA, 15 bp, Artificial Sequence
  dgRNA
  Sun2
cccgcctcccacgcg

SEQ ID NO: 2575 - DNA, 15 bp, Artificial Sequence
  dgRNA
  Sun2
ccacgcgcggactac

SEQ ID NO: 2576 - DNA, 15 bp, Artificial Sequence
  dgRNA
  Sun2
cacgcgcggactaca

SEQ ID NO: 2577 - DNA, 15 bp, Artificial Sequence
  dgRNA
  Sun2
actacagggcccacg

SEQ ID NO: 2578 - DNA, 15 bp, Artificial Sequence
  dgRNA
  Dtwd2
cgcctaaccttaccc

SEQ ID NO: 2579 - DNA, 15 bp, Artificial Sequence
  dgRNA
  Dtwd2
ctccttccggcccgt

SEQ ID NO: 2580 - DNA, 15 bp, Artificial Sequence
  dgRNA
  Dtwd2
acccaacacaccaat

SEQ ID NO: 2581 - DNA, 15 bp, Artificial Sequence
  dgRNA
  Dtwd2
ttaggcgcaaagtgt

SEQ ID NO: 2582 - DNA, 15 bp, Artificial Sequence
  dgRNA
  Mtpap
tagcaacacttcacc

SEQ ID NO: 2583 - DNA, 15 bp, Artificial Sequence
  dgRNA
  Mtpap
ctagtttgacctaat

SEQ ID NO: 2584 - DNA, 15 bp, Artificial Sequence
  dgRNA
  Mtpap
ggcttcccgttgttg

SEQ ID NO: 2585 - DNA, 15 bp, Artificial Sequence
  dgRNA
  Mtpap
gttgttgcggtctct

SEQ ID NO: 2586 - DNA, 15 bp, Artificial Sequence
  dgRNA
  Ttpal
tcagctgcacagccg

SEQ ID NO: 2587 - DNA, 15 bp, Artificial Sequence
  dgRNA
  Ttpal
acagccggggccacc

SEQ ID NO: 2588 - DNA, 15 bp, Artificial Sequence
  dgRNA
  Ttpal
actcatgcgcattcc

SEQ ID NO: 2589 - DNA, 15 bp, Artificial Sequence
  dgRNA
  Ttpal
atgcgcattcccgga

SEQ ID NO: 2590 - DNA, 15 bp, Artificial Sequence
  dgRNA
  Olfr658
agtaccactagagtt

SEQ ID NO: 2591 - DNA, 15 bp, Artificial Sequence
  dgRNA
  Olfr658
tgttccagccgcacg

SEQ ID NO: 2592 - DNA, 15 bp, Artificial Sequence
  dgRNA
  Olfr658
gttccagccgcacga

SEQ ID NO: 2593 - DNA, 15 bp, Artificial Sequence
  dgRNA
  Olfr658
cgcacgagggcagca

SEQ ID NO: 2594 - DNA, 15 bp, Artificial Sequence
  dgRNA
  Dlg2
gtcaccaactggggc

SEQ ID NO: 2595 - DNA, 15 bp, Artificial Sequence
  dgRNA
  Hic2
gcatcgggaccctgt

SEQ ID NO: 2596 - DNA, 15 bp, Artificial Sequence
  dgRNA
  Hic2
actcagacccctcgg

SEQ ID NO: 2597 - DNA, 15 bp, Artificial Sequence
  dgRNA
  Hic2
ggttccgcccccaca

SEQ ID NO: 2598 - DNA, 15 bp, Artificial Sequence
  dgRNA
  Hic2
gttccgcccccacaa

SEQ ID NO: 2599 - DNA, 15 bp, Artificial Sequence
  dgRNA
  Tpbg
actaccctagacgtg

SEQ ID NO: 2600 - DNA, 15 bp, Artificial Sequence
  dgRNA
  Tpbg
ctaccctagacgtgc

SEQ ID NO: 2601 - DNA, 15 bp, Artificial Sequence
  dgRNA
  Tpbg
taccctagacgtgcg

SEQ ID NO: 2602 - DNA, 15 bp, Artificial Sequence
  dgRNA
  Tpbg
accctagacgtgcgg

SEQ ID NO: 2603 - DNA, 15 bp, Artificial Sequence
  dgRNA
  Serpina3m
tctacacaagcccat

SEQ ID NO: 2604 - DNA, 15 bp, Artificial Sequence
  dgRNA
  Serpina3m
tacaactcgtcagac

SEQ ID NO: 2605 - DNA, 15 bp, Artificial Sequence
  dgRNA
  Arl4a
ccagaggccgcccta

SEQ ID NO: 2606 - DNA, 15 bp, Artificial Sequence
  dgRNA
  Arl4a
ccgccctagggtgac

SEQ ID NO: 2607 - DNA, 15 bp, Artificial Sequence
  dgRNA
  Arl4a
tcccgcacccagcct

SEQ ID NO: 2608 - DNA, 15 bp, Artificial Sequence
  dgRNA
  Arl4a
cccgcacccagcctg

SEQ ID NO: 2609 - DNA, 15 bp, Artificial Sequence
  dgRNA
  Gm13177
accacacaaatcaac

SEQ ID NO: 2610 - DNA, 15 bp, Artificial Sequence
  dgRNA
  Myadm
cctcactggtagggc

SEQ ID NO: 2611 - DNA, 15 bp, Artificial Sequence
  dgRNA
  Myadm
tagggcgggagatcc

SEQ ID NO: 2612 - DNA, 15 bp, Artificial Sequence
  dgRNA
  Myadm
aggacgctagccttc

SEQ ID NO: 2613 - DNA, 15 bp, Artificial Sequence
  dgRNA
  Myadm
ggacgctagccttct

SEQ ID NO: 2614 - DNA, 15 bp, Artificial Sequence
  dgRNA
  Rassf1
ggcgaaggcgctccc

SEQ ID NO: 2615 - DNA, 15 bp, Artificial Sequence
  dgRNA
  Rassf1
aaggcgctccctggc

SEQ ID NO: 2616 - DNA, 15 bp, Artificial Sequence
  dgRNA
  Rassf1
ctcacaccccgcttc

SEQ ID NO: 2617 - DNA, 15 bp, Artificial Sequence
  dgRNA
  Rassf1
ccgcttccggcccta

SEQ ID NO: 2618 - DNA, 15 bp, Artificial Sequence
  dgRNA
  Tmem35
gaggcttgaaccacc

SEQ ID NO: 2619 - DNA, 15 bp, Artificial Sequence
  dgRNA
  Tmem35
ttgaaccaccaggta

SEQ ID NO: 2620 - DNA, 15 bp, Artificial Sequence
  dgRNA
  Tmem35
cttcgggaagactag

SEQ ID NO: 2621 - DNA, 15 bp, Artificial Sequence
  dgRNA
  Tmem35
tagtggattgattga

SEQ ID NO: 2622 - DNA, 15 bp, Artificial Sequence
  dgRNA
  Manea
tccaggacaagctag

SEQ ID NO: 2623 - DNA, 15 bp, Artificial Sequence
  dgRNA
  Manea
aagccccgcccgctt

SEQ ID NO: 2624 - DNA, 15 bp, Artificial Sequence
  dgRNA
  Manea
gaagccccgccttct

SEQ ID NO: 2625 - DNA, 15 bp, Artificial Sequence
  dgRNA
  Manea
cggagattcaacccc

SEQ ID NO: 2626 - DNA, 15 bp, Artificial Sequence
  dgRNA
  Arhgef37
ctgtcgccctggtat

SEQ ID NO: 2627 - DNA, 15 bp, Artificial Sequence
  dgRNA
  Arhgef37
tgtcgccctggtatt

SEQ ID NO: 2628 - DNA, 15 bp, Artificial Sequence
  dgRNA
  Arhgef37
gtcgccctggtattg

SEQ ID NO: 2629 - DNA, 15 bp, Artificial Sequence
  dgRNA
  Arhgef37
ggggtgaagtcccgc

SEQ ID NO: 2630 - DNA, 15 bp, Artificial Sequence
  dgRNA
  Gpt
tctcttgctccctcg

SEQ ID NO: 2631 - DNA, 15 bp, Artificial Sequence
  dgRNA
  Gpt
ctcttgctccctcgt

SEQ ID NO: 2632 - DNA, 15 bp, Artificial Sequence
  dgRNA
  Gpt
tcttgctccctcgtg

SEQ ID NO: 2633 - DNA, 15 bp, Artificial Sequence
  dgRNA
  Gpt
cctcgtggggacact

SEQ ID NO: 2634 - DNA, 15 bp, Artificial Sequence
  dgRNA
  Ptbp3
ggggcaaagaggcga

SEQ ID NO: 2635 - DNA, 15 bp, Artificial Sequence
  dgRNA
  Ptbp3
ggcgaaggcgggaag

SEQ ID NO: 2636 - DNA, 15 bp, Artificial Sequence
  dgRNA
  Ptbp3
gcgaaggcgggaaga

SEQ ID NO: 2637 - DNA, 15 bp, Artificial Sequence
  dgRNA
  Ptbp3
agtccagccgagccc

SEQ ID NO: 2638 - DNA, 15 bp, Artificial Sequence
  dgRNA
  Card6
agcactctcggtctg

SEQ ID NO: 2639 - DNA, 15 bp, Artificial Sequence
  dgRNA
  Stk32b
aactgtcaaacgctg

SEQ ID NO: 2640 - DNA, 15 bp, Artificial Sequence
  dgRNA
  Stk32b
actgtcaaacgctgc

SEQ ID NO: 2641 - DNA, 15 bp, Artificial Sequence
  dgRNA
  Stk32b
gtcaaacgctgcggg

SEQ ID NO: 2642 - DNA, 15 bp, Artificial Sequence
  dgRNA
  Stk32b
tcaaacgctgcgggt

SEQ ID NO: 2643 - DNA, 15 bp, Artificial Sequence
  dgRNA
  Irs4
cacgcacacctttac

SEQ ID NO: 2644 - DNA, 15 bp, Artificial Sequence
  dgRNA
  Irs4
gcacacctttactgg

SEQ ID NO: 2645 - DNA, 15 bp, Artificial Sequence
  dgRNA
  Irs4
gcgcccctccaccgc

SEQ ID NO: 2646 - DNA, 15 bp, Artificial Sequence
  dgRNA
  Irs4
cgcccctccaccgct

SEQ ID NO: 2647 - DNA, 15 bp, Artificial Sequence
  dgRNA
  Pifo
ctagtatcctgttgt

SEQ ID NO: 2648 - DNA, 15 bp, Artificial Sequence
  dgRNA
  Pifo
gtcataatgacttaa

SEQ ID NO: 2649 - DNA, 15 bp, Artificial Sequence
  dgRNA
  Pifo
cataatgacttaaag

SEQ ID NO: 2650 - DNA, 15 bp, Artificial Sequence
  dgRNA
  Pifo
gggagcttctaaggc

SEQ ID NO: 2651 - DNA, 15 bp, Artificial Sequence
  dgRNA
  Cdc42ep2
ccctcagccgcccgg

SEQ ID NO: 2652 - DNA, 15 bp, Artificial Sequence
  dgRNA
  Cdc42ep2
acctgggcggtgccg

SEQ ID NO: 2653 - DNA, 15 bp, Artificial Sequence
  dgRNA
  Cdc42ep2
tgggcggtgccgcgg

SEQ ID NO: 2654 - DNA, 15 bp, Artificial Sequence
  dgRNA
  Cdc42ep2
gggcggtgccgcggt

SEQ ID NO: 2655 - DNA, 15 bp, Artificial Sequence
  dgRNA
  Spata5
ccccgccccatctcg

SEQ ID NO: 2656 - DNA, 15 bp, Artificial Sequence
  dgRNA
  Spata5
gcggcgaacactctc

SEQ ID NO: 2657 - DNA, 15 bp, Artificial Sequence
  dgRNA
  Spata5
agaccaggctacgtc

SEQ ID NO: 2658 - DNA, 15 bp, Artificial Sequence
  dgRNA
  Spata5
gcggggcgtgcgccc

SEQ ID NO: 2659 - DNA, 15 bp, Artificial Sequence
  dgRNA
  Dynap
gttcagaagcctcgt

SEQ ID NO: 2660 - DNA, 15 bp, Artificial Sequence
  dgRNA
  Dynap
gcgtgaaacccacaa

SEQ ID NO: 2661 - DNA, 15 bp, Artificial Sequence
  dgRNA
  Dynap
ccttggtactttaaa

SEQ ID NO: 2662 - DNA, 15 bp, Artificial Sequence
  dgRNA
  Dynap
tttaggaatcccacg

SEQ ID NO: 2663 - DNA, 15 bp, Artificial Sequence
  dgRNA
  Arrdc1
tgctcgtgctcaggg

SEQ ID NO: 2664 - DNA, 15 bp, Artificial Sequence
  dgRNA
  Arrdc1
atgggcgtgtcctcg

SEQ ID NO: 2665 - DNA, 15 bp, Artificial Sequence
  dgRNA
  Arrdc1
ggcgtgtcctcgtgg

SEQ ID NO: 2666 - DNA, 15 bp, Artificial Sequence
  dgRNA
  Arrdc1
gcgtgtcctcatccg

SEQ ID NO: 2667 - DNA, 15 bp, Artificial Sequence
  dgRNA
  Fbxl19
agggggccgcagtac

SEQ ID NO: 2668 - DNA, 15 bp, Artificial Sequence
  dgRNA
  Fbxl19
gggggccgcagtaca

SEQ ID NO: 2669 - DNA, 15 bp, Artificial Sequence
  dgRNA
  Fbxl19
ggggccgcagtacag

SEQ ID NO: 2670 - DNA, 15 bp, Artificial Sequence
  dgRNA
  Fbxl19
tacaggggcggaccc

SEQ ID NO: 2671 - DNA, 15 bp, Artificial Sequence
  dgRNA
  Traf3ip1
gctagagaggccgga

SEQ ID NO: 2672 - DNA, 15 bp, Artificial Sequence
  dgRNA
  Traf3ip1
ctagagaggccggag

SEQ ID NO: 2673 - DNA, 15 bp, Artificial Sequence
  dgRNA
  Traf3ip1
gcgcgtccgttgcca

SEQ ID NO: 2674 - DNA, 15 bp, Artificial Sequence
  dgRNA
  Traf3ip1
gttgccaaggccgcg

SEQ ID NO: 2675 - DNA, 15 bp, Artificial Sequence
  dgRNA
  B4galnt4
cgcccaccccgaccg

SEQ ID NO: 2676 - DNA, 15 bp, Artificial Sequence
  dgRNA
  B4galnt4
cggcctgagcagccc

SEQ ID NO: 2677 - DNA, 15 bp, Artificial Sequence
  dgRNA
  B4galnt4
gcagcccgggagtag

SEQ ID NO: 2678 - DNA, 15 bp, Artificial Sequence
  dgRNA
  B4galnt4
ccgtagtccccgcag

SEQ ID NO: 2679 - DNA, 15 bp, Artificial Sequence
  dgRNA
  H2bfm
ggattccgcgaccat

SEQ ID NO: 2680 - DNA, 15 bp, Artificial Sequence
  dgRNA
  H2bfm
agcactcattttgat

SEQ ID NO: 2681 - DNA, 15 bp, Artificial Sequence
  dgRNA
  H2bfm
agttggttcattacg

SEQ ID NO: 2682 - DNA, 15 bp, Artificial Sequence
  dgRNA
  H2bfm
cattacgtggcctaa

SEQ ID NO: 2683 - DNA, 15 bp, Artificial Sequence
  dgRNA
  St6galnac6
ggtcaagagactccc

SEQ ID NO: 2684 - DNA, 15 bp, Artificial Sequence
  dgRNA
  St6galnac6
ggagtctcttgaccc

SEQ ID NO: 2685 - DNA, 15 bp, Artificial Sequence
  dgRNA
  St6galnac6
agtctagatcccacc

SEQ ID NO: 2686 - DNA, 15 bp, Artificial Sequence
  dgRNA
  St6galnac6
cttatggctgaaagc

SEQ ID NO: 2687 - DNA, 15 bp, Artificial Sequence
  dgRNA
  Tmem216
cccctagaccactgt

SEQ ID NO: 2688 - DNA, 15 bp, Artificial Sequence
  dgRNA
  Tmem216
actgtaggtggttga

SEQ ID NO: 2689 - DNA, 15 bp, Artificial Sequence
  dgRNA
  Tmem216
taggtggttgacggc

SEQ ID NO: 2690 - DNA, 15 bp, Artificial Sequence
  dgRNA
  Tmem216
gcgctgttctgtgca

SEQ ID NO: 2691 - DNA, 15 bp, Artificial Sequence
  dgRNA
  Tti2
ctagcagatgaaatc

SEQ ID NO: 2692 - DNA, 15 bp, Artificial Sequence
  dgRNA
  Tti2
gcgttgcggctccgc

SEQ ID NO: 2693 - DNA, 15 bp, Artificial Sequence
  dgRNA
  Tti2
ttgcggctccgctgg

SEQ ID NO: 2694 - DNA, 15 bp, Artificial Sequence
  dgRNA
  Tti2
acagtccgtcagaga

SEQ ID NO: 2695 - DNA, 15 bp, Artificial Sequence
  dgRNA
  Pex16
tcccgttcgagctct

SEQ ID NO: 2696 - DNA, 15 bp, Artificial Sequence
  dgRNA
  Pex16
aagttgtaactacgc

SEQ ID NO: 2697 - DNA, 15 bp, Artificial Sequence
  dgRNA
  Pex16
gaaattgtcgtaaat

SEQ ID NO: 2698 - DNA, 15 bp, Artificial Sequence
  dgRNA
  Pex16
tcgaacgggagggtc

SEQ ID NO: 2699 - DNA, 15 bp, Artificial Sequence
  dgRNA
  Osbpl3
ccgatgactcctgat

SEQ ID NO: 2700 - DNA, 15 bp, Artificial Sequence
  dgRNA
  Osbpl3
atgactcctgattgg

SEQ ID NO: 2701 - DNA, 15 bp, Artificial Sequence
  dgRNA
  Osbpl3
cgttattccgcccag

SEQ ID NO: 2702 - DNA, 15 bp, Artificial Sequence
  dgRNA
  Osbpl3
gggcgtgtggagcgg

SEQ ID NO: 2703 - DNA, 15 bp, Artificial Sequence
  dgRNA
  Ttc37
tctccagtcatgagc

SEQ ID NO: 2704 - DNA, 15 bp, Artificial Sequence
  dgRNA
  Ttc37
caggggccggactct

SEQ ID NO: 2705 - DNA, 15 bp, Artificial Sequence
  dgRNA
  Ttc37
aggggccggactcta

SEQ ID NO: 2706 - DNA, 15 bp, Artificial Sequence
  dgRNA
  Ttc37
acaagactagaagtt

SEQ ID NO: 2707 - DNA, 15 bp, Artificial Sequence
  dgRNA
  Rhpn1
catgcgtaccctgat

SEQ ID NO: 2708 - DNA, 15 bp, Artificial Sequence
  dgRNA
  Rhpn1
accctgatcggcgag

SEQ ID NO: 2709 - DNA, 15 bp, Artificial Sequence
  dgRNA
  Rhpn1
atcggcgagcggccc

SEQ ID NO: 2710 - DNA, 15 bp, Artificial Sequence
  dgRNA
  Rhpn1
accagatcccttacc

SEQ ID NO: 2711 - DNA, 15 bp, Artificial Sequence
  dgRNA
  Rcor3
cgcccgggaaccggc

SEQ ID NO: 2712 - DNA, 15 bp, Artificial Sequence
  dgRNA
  Rcor3
cgggaaccggccggc

SEQ ID NO: 2713 - DNA, 15 bp, Artificial Sequence
  dgRNA
  Rcor3
gggaaccggccggct

SEQ ID NO: 2714 - DNA, 15 bp, Artificial Sequence
  dgRNA
  Rcor3
ggaaccggccggctg

SEQ ID NO: 2715 - DNA, 15 bp, Artificial Sequence
  dgRNA
  Vps9d1
aagcgaggagcggtc

SEQ ID NO: 2716 - DNA, 15 bp, Artificial Sequence
  dgRNA
  Vps9d1
agcgaggagcggtct

SEQ ID NO: 2717 - DNA, 15 bp, Artificial Sequence
  dgRNA
  Vps9d1
gcgaggagcggtctg

SEQ ID NO: 2718 - DNA, 15 bp, Artificial Sequence
  dgRNA
  Vps9d1
gagccacagcggccg

SEQ ID NO: 2719 - DNA, 15 bp, Artificial Sequence
  dgRNA
  Fcna
ctgagctagttcttt

SEQ ID NO: 2720 - DNA, 15 bp, Artificial Sequence
  dgRNA
  Fcna
gggattcggggcatg

SEQ ID NO: 2721 - DNA, 15 bp, Artificial Sequence
  dgRNA
  Fcna
agcactggggattcg

SEQ ID NO: 2722 - DNA, 15 bp, Artificial Sequence
  dgRNA
  Hcrtr2
gcagcccgaagttgc

SEQ ID NO: 2723 - DNA, 15 bp, Artificial Sequence
  dgRNA
  Hcrtr2
cagcccgaagttgcc

SEQ ID NO: 2724 - DNA, 15 bp, Artificial Sequence
  dgRNA
  Hcrtr2
aagttgccgggcgca

SEQ ID NO: 2725 - DNA, 15 bp, Artificial Sequence
  dgRNA
  Hcrtr2
ttttcacgtcattcc

SEQ ID NO: 2726 - DNA, 15 bp, Artificial Sequence
  dgRNA
  Muc15
ggtttaaggtcacaa

SEQ ID NO: 2727 - DNA, 15 bp, Artificial Sequence
  dgRNA
  Muc15
cgaagaatttgttta

SEQ ID NO: 2728 - DNA, 15 bp, Artificial Sequence
  dgRNA
  Muc15
gggttgtaataactt

SEQ ID NO: 2729 - DNA, 15 bp, Artificial Sequence
  dgRNA
  Muc15
ggttgtaataacttt

SEQ ID NO: 2730 - DNA, 15 bp, Artificial Sequence
  dgRNA
  Zmat1
cgtactgcagagcca

SEQ ID NO: 2731 - DNA, 15 bp, Artificial Sequence
  dgRNA
  Zmat1
catcctgcgggtgca

SEQ ID NO: 2732 - DNA, 15 bp, Artificial Sequence
  dgRNA
  Zmat1
tggctctcctattgg

SEQ ID NO: 2733 - DNA, 15 bp, Artificial Sequence
  dgRNA
  Zmat1
cctattggaggatga

SEQ ID NO: 2734 - DNA, 15 bp, Artificial Sequence
  dgRNA
  Lefty2
ccctcctcagggcgc

SEQ ID NO: 2735 - DNA, 15 bp, Artificial Sequence
  dgRNA
  Lefty2
cctcctcagggcgca

SEQ ID NO: 2736 - DNA, 15 bp, Artificial Sequence
  dgRNA
  Lefty2
ggccaactataaaga

SEQ ID NO: 2737 - DNA, 15 bp, Artificial Sequence
  dgRNA
  Lefty2
agcccctgcgccctg

SEQ ID NO: 2738 - DNA, 15 bp, Artificial Sequence
  dgRNA
  Inhbe
gtgaaactcgagtcc

SEQ ID NO: 2739 - DNA, 15 bp, Artificial Sequence
  dgRNA
  Inhbe
gaaactcgagtcccg

SEQ ID NO: 2740 - DNA, 15 bp, Artificial Sequence
  dgRNA
  Inhbe
aaactcgagtcccgg

SEQ ID NO: 2741 - DNA, 15 bp, Artificial Sequence
  dgRNA
  Inhbe
ctgcaggggcctgat

SEQ ID NO: 2742 - DNA, 15 bp, Artificial Sequence
  dgRNA
  Gcsam
ctttggttaatagtc

SEQ ID NO: 2743 - DNA, 15 bp, Artificial Sequence
  dgRNA
  Gcsam
tagtctggtgcatca

SEQ ID NO: 2744 - DNA, 15 bp, Artificial Sequence
  dgRNA
  Gcsam
ggtgcatcaaggccc

SEQ ID NO: 2745 - DNA, 15 bp, Artificial Sequence
  dgRNA
  Gcsam
ggcttttcctaacgg

SEQ ID NO: 2746 - DNA, 15 bp, Artificial Sequence
  dgRNA
  Nr2f2
tgcaagtcgattgtc

SEQ ID NO: 2747 - DNA, 15 bp, Artificial Sequence
  dgRNA
  Nr2f2
ttccgtccagagggg

SEQ ID NO: 2748 - DNA, 15 bp, Artificial Sequence
  dgRNA
  Nr2f2
gctttccgtccagag

SEQ ID NO: 2749 - DNA, 15 bp, Artificial Sequence
  dgRNA
  Nr2f2
ggctttccgtccaga

SEQ ID NO: 2750 - DNA, 15 bp, Artificial Sequence
  dgRNA
  Gpx5
ccacactattgaatt

SEQ ID NO: 2751 - DNA, 15 bp, Artificial Sequence
  dgRNA
  Gpx5
attcggagtgctcgt

SEQ ID NO: 2752 - DNA, 15 bp, Artificial Sequence
  dgRNA
  Gpx5
ttcggagtgctcgtg

SEQ ID NO: 2753 - DNA, 15 bp, Artificial Sequence
  dgRNA
  Gpx5
tcggagtgctcgtgg

SEQ ID NO: 2754 - DNA, 15 bp, Artificial Sequence
  dgRNA
  Krt6b
tgacttcctttagtc

SEQ ID NO: 2755 - DNA, 15 bp, Artificial Sequence
  dgRNA
  Krt6b
tgagtgggtcgggca

SEQ ID NO: 2756 - DNA, 15 bp, Artificial Sequence
  dgRNA
  Krt6b
gttgctgagtgggtc

SEQ ID NO: 2757 - DNA, 15 bp, Artificial Sequence
  dgRNA
  Krt6b
tatggacatatgggc

SEQ ID NO: 2758 - DNA, 15 bp, Artificial Sequence
  dgRNA
  Lpin1
aggcggggatatgag

SEQ ID NO: 2759 - DNA, 15 bp, Artificial Sequence
  dgRNA
  Lpin1
ggcggggatatgaga

SEQ ID NO: 2760 - DNA, 15 bp, Artificial Sequence
  dgRNA
  Lpin1
cccctggcgtcgccc

SEQ ID NO: 2761 - DNA, 15 bp, Artificial Sequence
  dgRNA
  Lpin1
actccgcctcctttc

SEQ ID NO: 2762 - DNA, 15 bp, Artificial Sequence
  dgRNA
  Zbtb43
ccccgaaagcacgcc

SEQ ID NO: 2763 - DNA, 15 bp, Artificial Sequence
  dgRNA
  Zbtb43
tcgacgacacgcctc

SEQ ID NO: 2764 - DNA, 15 bp, Artificial Sequence
  dgRNA
  Zbtb43
cgcctccggaagcac

SEQ ID NO: 2765 - DNA, 15 bp, Artificial Sequence
  dgRNA
  Zbtb43
gcactggcaatttcg

SEQ ID NO: 2766 - DNA, 15 bp, Artificial Sequence
  dgRNA
  Psmd5
gcacgcgcaagactc

SEQ ID NO: 2767 - DNA, 15 bp, Artificial Sequence
  dgRNA
  Psmd5
cacgcgcaagactcc

SEQ ID NO: 2768 - DNA, 15 bp, Artificial Sequence
  dgRNA
  Psmd5
ccgggccccaaagaa

SEQ ID NO: 2769 - DNA, 15 bp, Artificial Sequence
  dgRNA
  Psmd5
cgggccccaaagaaa

SEQ ID NO: 2770 - DNA, 15 bp, Artificial Sequence
  dgRNA
  Ubtd2
tagacgcgggggcgc

SEQ ID NO: 2771 - DNA, 15 bp, Artificial Sequence
  dgRNA
  Ubtd2
agacgcgggggcgcg

SEQ ID NO: 2772 - DNA, 15 bp, Artificial Sequence
  dgRNA
  Ubtd2
ggcgcggggaagtga

SEQ ID NO: 2773 - DNA, 15 bp, Artificial Sequence
  dgRNA
  Ubtd2
gcgcggggaagtgag

SEQ ID NO: 2774 - DNA, 15 bp, Artificial Sequence
  dgRNA
  Tcte2
tagggatcgagagaa

SEQ ID NO: 2775 - DNA, 15 bp, Artificial Sequence
  dgRNA
  Tcte2
gaaagggctctaact

SEQ ID NO: 2776 - DNA, 15 bp, Artificial Sequence
  dgRNA
  Tcte2
ttcgcggctaagcgc

SEQ ID NO: 2777 - DNA, 15 bp, Artificial Sequence
  dgRNA
  Tcte2
ggccaatttgaacac

SEQ ID NO: 2778 - DNA, 15 bp, Artificial Sequence
  dgRNA
  Fcgr2b
ctgtaccagacgtcc

SEQ ID NO: 2779 - DNA, 15 bp, Artificial Sequence
  dgRNA
  Fcgr2b
cgtccaggtcagcta

SEQ ID NO: 2780 - DNA, 15 bp, Artificial Sequence
  dgRNA
  Fcgr2b
tagagaacggatgaa

SEQ ID NO: 2781 - DNA, 15 bp, Artificial Sequence
  dgRNA
  Fcgr2b
acgtctggtacagag

SEQ ID NO: 2782 - DNA, 15 bp, Artificial Sequence
  dgRNA
  Cul5
atagccattccgatc

SEQ ID NO: 2783 - DNA, 15 bp, Artificial Sequence
  dgRNA
  Cul5
tagccattccgatct

SEQ ID NO: 2784 - DNA, 15 bp, Artificial Sequence
  dgRNA
  Cul5
agccattccgatctg

SEQ ID NO: 2785 - DNA, 15 bp, Artificial Sequence
  dgRNA
  Cul5
tggggcgagcgcgtg

SEQ ID NO: 2786 - DNA, 15 bp, Artificial Sequence
  dgRNA
  Smpd4
attcccgccaaacta

SEQ ID NO: 2787 - DNA, 15 bp, Artificial Sequence
  dgRNA
  Smpd4
ttcccgccaaactaa

SEQ ID NO: 2788 - DNA, 15 bp, Artificial Sequence
  dgRNA
  Smpd4
tcccgccaaactaag

SEQ ID NO: 2789 - DNA, 15 bp, Artificial Sequence
  dgRNA
  Smpd4
cccgccaaactaagg

SEQ ID NO: 2790 - DNA, 15 bp, Artificial Sequence
  dgRNA
  Abtb1
tgtcctctagacggg

SEQ ID NO: 2791 - DNA, 15 bp, Artificial Sequence
  dgRNA
  Abtb1
gtcctctagacgggt

SEQ ID NO: 2792 - DNA, 15 bp, Artificial Sequence
  dgRNA
  Abtb1
ctctagacgggtggg

SEQ ID NO: 2793 - DNA, 15 bp, Artificial Sequence
  dgRNA
  Abtb1
tctagacgggtgggc

SEQ ID NO: 2794 - DNA, 15 bp, Artificial Sequence
  dgRNA
  Gp2
gaagagtttccatgc

SEQ ID NO: 2795 - DNA, 15 bp, Artificial Sequence
  dgRNA
  Gp2
gagtttccatgccgg

SEQ ID NO: 2796 - DNA, 15 bp, Artificial Sequence
  dgRNA
  Gp2
tttcactacccttga

SEQ ID NO: 2797 - DNA, 15 bp, Artificial Sequence
  dgRNA
  Gp2
acccttgatggtcaa

SEQ ID NO: 2798 - DNA, 15 bp, Artificial Sequence
  dgRNA
  Slc38a1
ggagcccctccgcgc

SEQ ID NO: 2799 - DNA, 15 bp, Artificial Sequence
  dgRNA
  Slc38a1
gagcccctccgcgcc

SEQ ID NO: 2800 - DNA, 15 bp, Artificial Sequence
  dgRNA
  Slc38a1
aatgtaagtgctggc

SEQ ID NO: 2801 - DNA, 15 bp, Artificial Sequence
  dgRNA
  Slc38a1
tggcgggcagagtgt

SEQ ID NO: 2802 - DNA, 15 bp, Artificial Sequence
  dgRNA
  Adamts1
acgagctgtggcgtg

SEQ ID NO: 2803 - DNA, 15 bp, Artificial Sequence
  dgRNA
  Adamts1
ctgtggcgtgaggcc

SEQ ID NO: 2804 - DNA, 15 bp, Artificial Sequence
  dgRNA
  Adamts1
ggcgtgaggccaggg

SEQ ID NO: 2805 - DNA, 15 bp, Artificial Sequence
  dgRNA
  Adamts1
ccccttcaggccccg

SEQ ID NO: 2806 - DNA, 15 bp, Artificial Sequence
  dgRNA
  Gm17727
aacctcatacagact

SEQ ID NO: 2807 - DNA, 15 bp, Artificial Sequence
  dgRNA
  Gm17727
gataagattgctttt

SEQ ID NO: 2808 - DNA, 15 bp, Artificial Sequence
  dgRNA
  Gm17727
agcaatcttatcata

SEQ ID NO: 2809 - DNA, 15 bp, Artificial Sequence
  dgRNA
  Gm17727
aagcaatcttatcat

SEQ ID NO: 2810 - DNA, 15 bp, Artificial Sequence
  dgRNA
  Lce1i
catctgggtatgagt

SEQ ID NO: 2811 - DNA, 15 bp, Artificial Sequence
  dgRNA
  Lce1i
cttagtatatgactt

SEQ ID NO: 2812 - DNA, 15 bp, Artificial Sequence
  dgRNA
  Lce1i
ctactcatacccaga

SEQ ID NO: 2813 - DNA, 15 bp, Artificial Sequence
  dgRNA
  Tma7
agctttcctcggttc

SEQ ID NO: 2814 - DNA, 15 bp, Artificial Sequence
  dgRNA
  Tma7
tcctcggttccggaa

SEQ ID NO: 2815 - DNA, 15 bp, Artificial Sequence
  dgRNA
  Tma7
ccactcccacggttt

SEQ ID NO: 2816 - DNA, 15 bp, Artificial Sequence
  dgRNA
  Tma7
gtttcggataaaccc

SEQ ID NO: 2817 - DNA, 15 bp, Artificial Sequence
  dgRNA
  Ppp1r14a
catctgaacccccgc

SEQ ID NO: 2818 - DNA, 15 bp, Artificial Sequence
  dgRNA
  Ppp1r14a
acccccgcaggaccc

SEQ ID NO: 2819 - DNA, 15 bp, Artificial Sequence
  dgRNA
  Ppp1r14a
cccccgcaggacccc

SEQ ID NO: 2820 - DNA, 15 bp, Artificial Sequence
  dgRNA
  Ppp1r14a
ggaccccgggcttga

SEQ ID NO: 2821 - DNA, 15 bp, Artificial Sequence
  dgRNA
  Scn3b
gacaagaagccaccg

SEQ ID NO: 2822 - DNA, 15 bp, Artificial Sequence
  dgRNA
  Scn3b
agaagccaccgcggt

SEQ ID NO: 2823 - DNA, 15 bp, Artificial Sequence
  dgRNA
  Scn3b
agccaccgcggtcgg

SEQ ID NO: 2824 - DNA, 15 bp, Artificial Sequence
  dgRNA
  Scn3b
gccaccgcggtcgga

SEQ ID NO: 2825 - DNA, 15 bp, Artificial Sequence
  dgRNA
  Ppp1cc
tttcccccgcccgtt

SEQ ID NO: 2826 - DNA, 15 bp, Artificial Sequence
  dgRNA
  Ppp1cc
cccccgcccgtttgg

SEQ ID NO: 2827 - DNA, 15 bp, Artificial Sequence
  dgRNA
  Ppp1cc
cgcccgtttggcgga

SEQ ID NO: 2828 - DNA, 15 bp, Artificial Sequence
  dgRNA
  Ppp1cc
gaaggatcccgcgcg

SEQ ID NO: 2829 - DNA, 15 bp, Artificial Sequence
  dgRNA
  Ift122
ttggattcggctcag

SEQ ID NO: 2830 - DNA, 15 bp, Artificial Sequence
  dgRNA
  Ift122
gtcggtgtttggatt

SEQ ID NO: 2831 - DNA, 15 bp, Artificial Sequence
  dgRNA
  Ift122
tttcacgtcggtgtt

SEQ ID NO: 2832 - DNA, 15 bp, Artificial Sequence
  dgRNA
  Ift122
gaagcggtggcggga

SEQ ID NO: 2833 - DNA, 15 bp, Artificial Sequence
  dgRNA
  Ube2q1
gtgacaggcgcgggc

SEQ ID NO: 2834 - DNA, 15 bp, Artificial Sequence
  dgRNA
  Ube2q1
tgacaggcgcgggcc

SEQ ID NO: 2835 - DNA, 15 bp, Artificial Sequence
  dgRNA
  Ube2q1
gacaggcgcgggccg

SEQ ID NO: 2836 - DNA, 15 bp, Artificial Sequence
  dgRNA
  Ube2q1
acaggcgcgggccgg

SEQ ID NO: 2837 - DNA, 15 bp, Artificial Sequence
  dgRNA
  Gp9
ggtacccctccctta

SEQ ID NO: 2838 - DNA, 15 bp, Artificial Sequence
  dgRNA
  Gp9
acccctcccttaagg

SEQ ID NO: 2839 - DNA, 15 bp, Artificial Sequence
  dgRNA
  Gp9
cccctcccttaaggt

SEQ ID NO: 2840 - DNA, 15 bp, Artificial Sequence
  dgRNA
  Gp9
cctgacaggccctcg

SEQ ID NO: 2841 - DNA, 15 bp, Artificial Sequence
  dgRNA
  Ifi47
cttgcataagccatg

SEQ ID NO: 2842 - DNA, 15 bp, Artificial Sequence
  dgRNA
  Ifi47
aagcactcagttagc

SEQ ID NO: 2843 - DNA, 15 bp, Artificial Sequence
  dgRNA
  Ifi47
tgtttcacggatgtt

SEQ ID NO: 2844 - DNA, 15 bp, Artificial Sequence
  dgRNA
  Riok1
tcaggctaaggattc

SEQ ID NO: 2845 - DNA, 15 bp, Artificial Sequence
  dgRNA
  Riok1
ttccgggtttcctcc

SEQ ID NO: 2846 - DNA, 15 bp, Artificial Sequence
  dgRNA
  Riok1
ttcctcccggcacac

SEQ ID NO: 2847 - DNA, 15 bp, Artificial Sequence
  dgRNA
  Riok1
ggcacaccggctccg

SEQ ID NO: 2848 - DNA, 15 bp, Artificial Sequence
  dgRNA
  Atp6v0a1
gttaagacttcccct

SEQ ID NO: 2849 - DNA, 15 bp, Artificial Sequence
  dgRNA
  Atp6v0a1
ttaagacttcccctt

SEQ ID NO: 2850 - DNA, 15 bp, Artificial Sequence
  dgRNA
  Atp6v0a1
tattcttggtcctat

SEQ ID NO: 2851 - DNA, 15 bp, Artificial Sequence
  dgRNA
  Atp6v0a1
tctcttgcctcggat

SEQ ID NO: 2852 - DNA, 15 bp, Artificial Sequence
  dgRNA
  Pkig
gcagttacagccctc

SEQ ID NO: 2853 - DNA, 15 bp, Artificial Sequence
  dgRNA
  Pkig
ttgacatcatcagac

SEQ ID NO: 2854 - DNA, 15 bp, Artificial Sequence
  dgRNA
  Pkig
catcagaccgggaat

SEQ ID NO: 2855 - DNA, 15 bp, Artificial Sequence
  dgRNA
  Pkig
cttcgaggttttagt

SEQ ID NO: 2856 - DNA, 15 bp, Artificial Sequence
  dgRNA
  Coro2b
taacatggaccacat

SEQ ID NO: 2857 - DNA, 15 bp, Artificial Sequence
  dgRNA
  Coro2b
atcactgagatgcga

SEQ ID NO: 2858 - DNA, 15 bp, Artificial Sequence
  dgRNA
  Coro2b
ttccacgagccctcc

SEQ ID NO: 2859 - DNA, 15 bp, Artificial Sequence
  dgRNA
  Coro2b
caccctgaactcgtg

SEQ ID NO: 2860 - DNA, 15 bp, Artificial Sequence
  dgRNA
  Smug1
caagaccagtagcta

SEQ ID NO: 2861 - DNA, 15 bp, Artificial Sequence
  dgRNA
  Smug1
accagtagctaaggt

SEQ ID NO: 2862 - DNA, 15 bp, Artificial Sequence
  dgRNA
  Smug1
agggctccggaggtg

SEQ ID NO: 2863 - DNA, 15 bp, Artificial Sequence
  dgRNA
  Smug1
aattccttcgttacc

SEQ ID NO: 2864 - DNA, 15 bp, Artificial Sequence
  dgRNA
  Sphkap
tggatgaacaacttc

SEQ ID NO: 2865 - DNA, 15 bp, Artificial Sequence
  dgRNA
  Sphkap
ggcgggactggacta

SEQ ID NO: 2866 - DNA, 15 bp, Artificial Sequence
  dgRNA
  Sphkap
cgggactggactaag

SEQ ID NO: 2867 - DNA, 15 bp, Artificial Sequence
  dgRNA
  Sphkap
gggagcaacagcgaa

SEQ ID NO: 2868 - DNA, 15 bp, Artificial Sequence
  dgRNA
  Dolpp1
gaactcgcacgggat

SEQ ID NO: 2869 - DNA, 15 bp, Artificial Sequence
  dgRNA
  Dolpp1
cacgggattggacac

SEQ ID NO: 2870 - DNA, 15 bp, Artificial Sequence
  dgRNA
  Dolpp1
ctctgattcgccgca

SEQ ID NO: 2871 - DNA, 15 bp, Artificial Sequence
  dgRNA
  Dolpp1
tctgattcgccgcac

SEQ ID NO: 2872 - DNA, 15 bp, Artificial Sequence
  dgRNA
  Arsb
gttgtgaaacagctt

SEQ ID NO: 2873 - DNA, 15 bp, Artificial Sequence
  dgRNA
  Arsb
tggctctcgagttca

SEQ ID NO: 2874 - DNA, 15 bp, Artificial Sequence
  dgRNA
  Arsb
taaagaacgggcctc

SEQ ID NO: 2875 - DNA, 15 bp, Artificial Sequence
  dgRNA
  Arsb
aaagaacgggcctct

SEQ ID NO: 2876 - DNA, 15 bp, Artificial Sequence
  dgRNA
  Bhlhe23
aggcaaagcgccctc

SEQ ID NO: 2877 - DNA, 15 bp, Artificial Sequence
  dgRNA
  Bhlhe23
cgccctcaggttccg

SEQ ID NO: 2878 - DNA, 15 bp, Artificial Sequence
  dgRNA
  Bhlhe23
gcggctcccatcttc

SEQ ID NO: 2879 - DNA, 15 bp, Artificial Sequence
  dgRNA
  Bhlhe23
ccatcttcaggcccg

SEQ ID NO: 2880 - DNA, 15 bp, Artificial Sequence
  dgRNA
  Mylpf
actgcagtccccctt

SEQ ID NO: 2881 - DNA, 15 bp, Artificial Sequence
  dgRNA
  Mylpf
ctgcagtcccccttt

SEQ ID NO: 2882 - DNA, 15 bp, Artificial Sequence
  dgRNA
  Mylpf
gagacttgcatccca

SEQ ID NO: 2883 - DNA, 15 bp, Artificial Sequence
  dgRNA
  Mylpf
cgttaggacctaggt

SEQ ID NO: 2884 - DNA, 15 bp, Artificial Sequence
  dgRNA
  Kcnrg
tgacgatagttacct

SEQ ID NO: 2885 - DNA, 15 bp, Artificial Sequence
  dgRNA
  Kcnrg
taatcctatataaca

SEQ ID NO: 2886 - DNA, 15 bp, Artificial Sequence
  dgRNA
  Kcnrg
cctatataacatgga

SEQ ID NO: 2887 - DNA, 15 bp, Artificial Sequence
  dgRNA
  Kcnrg
aacatggatggtagc

SEQ ID NO: 2888 - DNA, 15 bp, Artificial Sequence
  dgRNA
  Cd5
cactaccgcagttcc

SEQ ID NO: 2889 - DNA, 15 bp, Artificial Sequence
  dgRNA
  Cd5
ccaggcacctcgtgc

SEQ ID NO: 2890 - DNA, 15 bp, Artificial Sequence
  dgRNA
  Cd5
ggcctccattctaat

SEQ ID NO: 2891 - DNA, 15 bp, Artificial Sequence
  dgRNA
  Cd5
gcctccattctaatt

SEQ ID NO: 2892 - DNA, 15 bp, Artificial Sequence
  dgRNA
  Cpne8
gcaatcgccggcgcc

SEQ ID NO: 2893 - DNA, 15 bp, Artificial Sequence
  dgRNA
  Cpne8
caatcgccggcgcct

SEQ ID NO: 2894 - DNA, 15 bp, Artificial Sequence
  dgRNA
  Cpne8
aatcgccggcgcctg

SEQ ID NO: 2895 - DNA, 15 bp, Artificial Sequence
  dgRNA
  Cpne8
tcccactagacggcg

SEQ ID NO: 2896 - DNA, 15 bp, Artificial Sequence
  dgRNA
  Scimp
cacgaccagccttca

SEQ ID NO: 2897 - DNA, 15 bp, Artificial Sequence
  dgRNA
  Scimp
acgaccagccttcat

SEQ ID NO: 2898 - DNA, 15 bp, Artificial Sequence
  dgRNA
  Scimp
tgctggagccacgaa

SEQ ID NO: 2899 - DNA, 15 bp, Artificial Sequence
  dgRNA
  Scimp
gccacgaagggcagt

SEQ ID NO: 2900 - DNA, 15 bp, Artificial Sequence
  dgRNA
  Pnpla6
cggctgttaaataaa

SEQ ID NO: 2901 - DNA, 15 bp, Artificial Sequence
  dgRNA
  Pnpla6
ggaatgtaaatgcgg

SEQ ID NO: 2902 - DNA, 15 bp, Artificial Sequence
  dgRNA
  Pnpla6
ggtctaatttgtaac

SEQ ID NO: 2903 - DNA, 15 bp, Artificial Sequence
  dgRNA
  Pnpla6
gtcagctcctttaag

SEQ ID NO: 2904 - DNA, 15 bp, Artificial Sequence
  dgRNA
  Kng1
agctccatacctggt

SEQ ID NO: 2905 - DNA, 15 bp, Artificial Sequence
  dgRNA
  Kng1
aaggggcgtgacctc

SEQ ID NO: 2906 - DNA, 15 bp, Artificial Sequence
  dgRNA
  Kng1
ctcaggaatctaaat

SEQ ID NO: 2907 - DNA, 15 bp, Artificial Sequence
  dgRNA
  Kng1
ggagaattgcaacat

SEQ ID NO: 2908 - DNA, 15 bp, Artificial Sequence
  dgRNA
  Magee1
gccattgcgcagttt

SEQ ID NO: 2909 - DNA, 15 bp, Artificial Sequence
  dgRNA
  Magee1
ctttcgcaaacccac

SEQ ID NO: 2910 - DNA, 15 bp, Artificial Sequence
  dgRNA
  Magee1
gcaaacccacgggag

SEQ ID NO: 2911 - DNA, 15 bp, Artificial Sequence
  dgRNA
  Magee1
acccacgggagaggc

SEQ ID NO: 2912 - DNA, 15 bp, Artificial Sequence
  dgRNA
  Dlk1
tgctcgagccgcttc

SEQ ID NO: 2913 - DNA, 15 bp, Artificial Sequence
  dgRNA
  Dlk1
gctcgagccgcttcc

SEQ ID NO: 2914 - DNA, 15 bp, Artificial Sequence
  dgRNA
  Dlk1
cgcttccgggcgccg

SEQ ID NO: 2915 - DNA, 15 bp, Artificial Sequence
  dgRNA
  Dlk1
cgccgcggcgctggg

SEQ ID NO: 2916 - DNA, 15 bp, Artificial Sequence
  dgRNA
  Fn3k
agggatagcatgcac

SEQ ID NO: 2917 - DNA, 15 bp, Artificial Sequence
  dgRNA
  Fn3k
gatagcatgcaccgg

SEQ ID NO: 2918 - DNA, 15 bp, Artificial Sequence
  dgRNA
  Fn3k
gcaccggaggtagct

SEQ ID NO: 2919 - DNA, 15 bp, Artificial Sequence
  dgRNA
  Fn3k
gcgcgtgttcccttc

SEQ ID NO: 2920 - DNA, 15 bp, Artificial Sequence
  dgRNA
  Mpz
caacggtcgcgggcg

SEQ ID NO: 2921 - DNA, 15 bp, Artificial Sequence
  dgRNA
  Mpz
tggactcctagcccc

SEQ ID NO: 2922 - DNA, 15 bp, Artificial Sequence
  dgRNA
  Mpz
tcttgagttccggcc

SEQ ID NO: 2923 - DNA, 15 bp, Artificial Sequence
  dgRNA
  Mpz
gagttccggcctgga

SEQ ID NO: 2924 - DNA, 15 bp, Artificial Sequence
  dgRNA
  Mroh8
acaggcgtaggccgc

SEQ ID NO: 2925 - DNA, 15 bp, Artificial Sequence
  dgRNA
  Mroh8
tactactcgaatgaa

SEQ ID NO: 2926 - DNA, 15 bp, Artificial Sequence
  dgRNA
  Mroh8
tactcgaatgaatgg

SEQ ID NO: 2927 - DNA, 15 bp, Artificial Sequence
  dgRNA
  Mroh8
tcgaatgaatggagg

SEQ ID NO: 2928 - DNA, 15 bp, Artificial Sequence
  dgRNA
  Gnas
gactcacttcagcca

SEQ ID NO: 2929 - DNA, 15 bp, Artificial Sequence
  dgRNA
  Gnas
tatccttacaaagtt

SEQ ID NO: 2930 - DNA, 15 bp, Artificial Sequence
  dgRNA
  Gnas
tttttcaccctagtt

SEQ ID NO: 2931 - DNA, 15 bp, Artificial Sequence
  dgRNA
  Gnas
tcaccctagtttggc

SEQ ID NO: 2932 - DNA, 15 bp, Artificial Sequence
  dgRNA
  Erlin1
cgagtgacccacccc

SEQ ID NO: 2933 - DNA, 15 bp, Artificial Sequence
  dgRNA
  Erlin1
gacttggtcctcgtc

SEQ ID NO: 2934 - DNA, 15 bp, Artificial Sequence
  dgRNA
  Erlin1
acttggtcctcgtct

SEQ ID NO: 2935 - DNA, 15 bp, Artificial Sequence
  dgRNA
  Erlin1
cactgtgcgcgcacc

SEQ ID NO: 2936 - DNA, 15 bp, Artificial Sequence
  dgRNA
  Twf1
agggggggtgattgc

SEQ ID NO: 2937 - DNA, 15 bp, Artificial Sequence
  dgRNA
  Twf1
gggggggtgattgcc

SEQ ID NO: 2938 - DNA, 15 bp, Artificial Sequence
  dgRNA
  Twf1
ggtgattgccgggaa

SEQ ID NO: 2939 - DNA, 15 bp, Artificial Sequence
  dgRNA
  Twf1
gtgattgccgggaaa

SEQ ID NO: 2940 - DNA, 15 bp, Artificial Sequence
  dgRNA
  Krt39
atgaggagttcctgt

SEQ ID NO: 2941 - DNA, 15 bp, Artificial Sequence
  dgRNA
  Krt39
atataagcacttcaa

SEQ ID NO: 2942 - DNA, 15 bp, Artificial Sequence
  dgRNA
  Krt39
ggttgagggtgcttc

SEQ ID NO: 2943 - DNA, 15 bp, Artificial Sequence
  dgRNA
  Krt39
tgagggtgcttcggg

SEQ ID NO: 2944 - DNA, 15 bp, Artificial Sequence
  dgRNA
  Clec9a
gtggtaaaatgcaac

SEQ ID NO: 2945 - DNA, 15 bp, Artificial Sequence
  dgRNA
  Clec9a
ggttggtacaagaaa

SEQ ID NO: 2946 - DNA, 15 bp, Artificial Sequence
  dgRNA
  Clec9a
tagttaggagtaggt

SEQ ID NO: 2947 - DNA, 15 bp, Artificial Sequence
  dgRNA
  Clec9a
acttcggttgtagtt

SEQ ID NO: 2948 - DNA, 15 bp, Artificial Sequence
  dgRNA
  Map3k7
gcgaaacctgttcct

SEQ ID NO: 2949 - DNA, 15 bp, Artificial Sequence
  dgRNA
  Map3k7
cgaaacctgttcctc

SEQ ID NO: 2950 - DNA, 15 bp, Artificial Sequence
  dgRNA
  Map3k7
tgttcctcgggccca

SEQ ID NO: 2951 - DNA, 15 bp, Artificial Sequence
  dgRNA
  Map3k7
actccgcccctaccc

SEQ ID NO: 2952 - DNA, 15 bp, Artificial Sequence
  dgRNA
  Smarcal1
gagctacaactccca

SEQ ID NO: 2953 - DNA, 15 bp, Artificial Sequence
  dgRNA
  Smarcal1
tcaccaacctccaat

SEQ ID NO: 2954 - DNA, 15 bp, Artificial Sequence
  dgRNA
  Smarcal1
cccacaatttatgac

SEQ ID NO: 2955 - DNA, 15 bp, Artificial Sequence
  dgRNA
  Smarcal1
ccacaatttatgacc

SEQ ID NO: 2956 - DNA, 15 bp, Artificial Sequence
  dgRNA
  Cdc34
ggcgcattctagacc

SEQ ID NO: 2957 - DNA, 15 bp, Artificial Sequence
  dgRNA
  Cdc34
ttctagacccggcag

SEQ ID NO: 2958 - DNA, 15 bp, Artificial Sequence
  dgRNA
  Cdc34
ccggcagtggcgcgc

SEQ ID NO: 2959 - DNA, 15 bp, Artificial Sequence
  dgRNA
  Cdc34
gcgcaggtgcatttc

SEQ ID NO: 2960 - DNA, 15 bp, Artificial Sequence
  dgRNA
  Sh3glb1
gtcgctgttcccgcg

SEQ ID NO: 2961 - DNA, 15 bp, Artificial Sequence
  dgRNA
  Sh3glb1
cccacgccatcggtg

SEQ ID NO: 2962 - DNA, 15 bp, Artificial Sequence
  dgRNA
  Sh3glb1
ggctgttttccgccg

SEQ ID NO: 2963 - DNA, 15 bp, Artificial Sequence
  dgRNA
  Sh3glb1
cggttgcacagtcgc

SEQ ID NO: 2964 - DNA, 15 bp, Artificial Sequence
  dgRNA
  Sdha
cgaccctctctgttt

SEQ ID NO: 2965 - DNA, 15 bp, Artificial Sequence
  dgRNA
  Sdha
caccgccgcgtttac

SEQ ID NO: 2966 - DNA, 15 bp, Artificial Sequence
  dgRNA
  Sdha
accgccgcgtttaca

SEQ ID NO: 2967 - DNA, 15 bp, Artificial Sequence
  dgRNA
  Sdha
gcgtttacagggcgc

SEQ ID NO: 2968 - DNA, 15 bp, Artificial Sequence
  dgRNA
  Nuggc
actatcaattatgta

SEQ ID NO: 2969 - DNA, 15 bp, Artificial Sequence
  dgRNA
  Nuggc
cctaccgtaaaaata

SEQ ID NO: 2970 - DNA, 15 bp, Artificial Sequence
  dgRNA
  Nuggc
ccgacaacagtagcc

SEQ ID NO: 2971 - DNA, 15 bp, Artificial Sequence
  dgRNA
  Nuggc
aattgatagttgaat

SEQ ID NO: 2972 - DNA, 15 bp, Artificial Sequence
  dgRNA
  Wnt10b
ccgaccacttgcccc

SEQ ID NO: 2973 - DNA, 15 bp, Artificial Sequence
  dgRNA
  Wnt10b
ggctaatcgtgatcc

SEQ ID NO: 2974 - DNA, 15 bp, Artificial Sequence
  dgRNA
  Wnt10b
tgtgtacacgcttgg

SEQ ID NO: 2975 - DNA, 15 bp, Artificial Sequence
  dgRNA
  Wnt10b
gtgtacacgcttggg

SEQ ID NO: 2976 - DNA, 15 bp, Artificial Sequence
  dgRNA
  Sun1
ccccccgcagggccg

SEQ ID NO: 2977 - DNA, 15 bp, Artificial Sequence
  dgRNA
  Sun1
cccgcagggccgtgg

SEQ ID NO: 2978 - DNA, 15 bp, Artificial Sequence
  dgRNA
  Sun1
ccgcagggccgtggc

SEQ ID NO: 2979 - DNA, 15 bp, Artificial Sequence
  dgRNA
  Sun1
gccgtggcgggtcag

SEQ ID NO: 2980 - DNA, 15 bp, Artificial Sequence
  dgRNA
  Ppie
cggaccatagtgtgt

SEQ ID NO: 2981 - DNA, 15 bp, Artificial Sequence
  dgRNA
  Ppie
atagtgtgttggtaa

SEQ ID NO: 2982 - DNA, 15 bp, Artificial Sequence
  dgRNA
  Ppie
ttgccgttaatatct

SEQ ID NO: 2983 - DNA, 15 bp, Artificial Sequence
  dgRNA
  Ppie
aggttgatcagacca

SEQ ID NO: 2984 - DNA, 15 bp, Artificial Sequence
  dgRNA
  Magea2
tccctatcatacatt

SEQ ID NO: 2985 - DNA, 15 bp, Artificial Sequence
  dgRNA
  Magea2
ccctatcatacattt

SEQ ID NO: 2986 - DNA, 15 bp, Artificial Sequence
  dgRNA
  Magea2
cctatcatacatttg

SEQ ID NO: 2987 - DNA, 15 bp, Artificial Sequence
  dgRNA
  Magea2
cccaaatgtatgata

SEQ ID NO: 2988 - DNA, 15 bp, Artificial Sequence
  dgRNA
  Gpr35
gagattctgctagaa

SEQ ID NO: 2989 - DNA, 15 bp, Artificial Sequence
  dgRNA
  Gpr35
cttgaaacccccttg

SEQ ID NO: 2990 - DNA, 15 bp, Artificial Sequence
  dgRNA
  Gpr35
aaacccccttgaggc

SEQ ID NO: 2991 - DNA, 15 bp, Artificial Sequence
  dgRNA
  Gpr35
aacccccttgaggct

SEQ ID NO: 2992 - DNA, 15 bp, Artificial Sequence
  dgRNA
  Camk2b
gcgcgcgtaggtgtg

SEQ ID NO: 2993 - DNA, 15 bp, Artificial Sequence
  dgRNA
  Camk2b
tgtgcggcgcgctcc

SEQ ID NO: 2994 - DNA, 15 bp, Artificial Sequence
  dgRNA
  Camk2b
gcggcgcgctcctgg

SEQ ID NO: 2995 - DNA, 15 bp, Artificial Sequence
  dgRNA
  Camk2b
cggcgcgctcctggc

SEQ ID NO: 2996 - DNA, 15 bp, Artificial Sequence
  dgRNA
  Cfap57
ggcgaggcggggtca

SEQ ID NO: 2997 - DNA, 15 bp, Artificial Sequence
  dgRNA
  Cfap57
gcgggccggggccat

SEQ ID NO: 2998 - DNA, 15 bp, Artificial Sequence
  dgRNA
  Cfap57
gccggggccatgggc

SEQ ID NO: 2999 - DNA, 15 bp, Artificial Sequence
  dgRNA
  Cfap57
ccggggccatgggcg

SEQ ID NO: 3000 - DNA, 15 bp, Artificial Sequence
  dgRNA
  Lrrk1
cccaagcgtctaccg

SEQ ID NO: 3001 - DNA, 15 bp, Artificial Sequence
  dgRNA
  Lrrk1
gacatcttgcagcta

SEQ ID NO: 3002 - DNA, 15 bp, Artificial Sequence
  dgRNA
  Lrrk1
atccaggggaggtcg

SEQ ID NO: 3003 - DNA, 15 bp, Artificial Sequence
  dgRNA
  Lrrk1
gggcggccgaccctc

SEQ ID NO: 3004 - DNA, 15 bp, Artificial Sequence
  dgRNA
  Mlf2
tcccacccgccccag

SEQ ID NO: 3005 - DNA, 15 bp, Artificial Sequence
  dgRNA
  Mlf2
agaggacccgccctc

SEQ ID NO: 3006 - DNA, 15 bp, Artificial Sequence
  dgRNA
  Mlf2
gaggacccgccctcc

SEQ ID NO: 3007 - DNA, 15 bp, Artificial Sequence
  dgRNA
  Mlf2
aggacccgccctccg

SEQ ID NO: 3008 - DNA, 15 bp, Artificial Sequence
  dgRNA
  Cpq
tacttgccttaagtc

SEQ ID NO: 3009 - DNA, 15 bp, Artificial Sequence
  dgRNA
  Cpq
ctccgcccaccggcc

SEQ ID NO: 3010 - DNA, 15 bp, Artificial Sequence
  dgRNA
  Cpq
tccgcccaccggcca

SEQ ID NO: 3011 - DNA, 15 bp, Artificial Sequence
  dgRNA
  Cpq
gcccaccggccaggg

SEQ ID NO: 3012 - DNA, 15 bp, Artificial Sequence
  dgRNA
  Col25a1
gctaatagagacctc

SEQ ID NO: 3013 - DNA, 15 bp, Artificial Sequence
  dgRNA
  Col25a1
gctcccgccccttcg

SEQ ID NO: 3014 - DNA, 15 bp, Artificial Sequence
  dgRNA
  Col25a1
ctcccgccccttcgt

SEQ ID NO: 3015 - DNA, 15 bp, Artificial Sequence
  dgRNA
  Col25a1
ccccttcgtgggtcc

SEQ ID NO: 3016 - DNA, 15 bp, Artificial Sequence
  dgRNA
  C330027C09Rik
ccagccgaaacctcg

SEQ ID NO: 3017 - DNA, 15 bp, Artificial Sequence
  dgRNA
  C330027C09Rik
cggcctctccgccaa

SEQ ID NO: 3018 - DNA, 15 bp, Artificial Sequence
  dgRNA
  C330027C09Rik
ggcctctccgccaaa

SEQ ID NO: 3019 - DNA, 15 bp, Artificial Sequence
  dgRNA
  C330027C09Rik
gcctctccgccaaag

SEQ ID NO: 3020 - DNA, 15 bp, Artificial Sequence
  dgRNA
  Ttll13
gaacccgccccaata

SEQ ID NO: 3021 - DNA, 15 bp, Artificial Sequence
  dgRNA
  Ttll13
aacccgccccaatat

SEQ ID NO: 3022 - DNA, 15 bp, Artificial Sequence
  dgRNA
  Ttll13
ccgccccaatatggg

SEQ ID NO: 3023 - DNA, 15 bp, Artificial Sequence
  dgRNA
  Ttll13
aatcccataatgcgt

SEQ ID NO: 3024 - DNA, 15 bp, Artificial Sequence
  dgRNA
  Cog5
gcccaatacttgcgt

SEQ ID NO: 3025 - DNA, 15 bp, Artificial Sequence
  dgRNA
  Cog5
acttgcgttggagat

SEQ ID NO: 3026 - DNA, 15 bp, Artificial Sequence
  dgRNA
  Cog5
cgttggagatcggcg

SEQ ID NO: 3027 - DNA, 15 bp, Artificial Sequence
  dgRNA
  Cog5
tggagatcggcgcgg

SEQ ID NO: 3028 - DNA, 15 bp, Artificial Sequence
  dgRNA
  Gm3604
cgccaacagaagtag

SEQ ID NO: 3029 - DNA, 15 bp, Artificial Sequence
  dgRNA
  Gm3604
cgcctctacttctgt

SEQ ID NO: 3030 - DNA, 15 bp, Artificial Sequence
  dgRNA
  Rlbp1
atcggcagagatcgg

SEQ ID NO: 3031 - DNA, 15 bp, Artificial Sequence
  dgRNA
  Rlbp1
tcggcagagatcgga

SEQ ID NO: 3032 - DNA, 15 bp, Artificial Sequence
  dgRNA
  Rlbp1
agagatcggagggtc

SEQ ID NO: 3033 - DNA, 15 bp, Artificial Sequence
  dgRNA
  Rlbp1
gagatcggagggtca

SEQ ID NO: 3034 - DNA, 15 bp, Artificial Sequence
  dgRNA
  Klk12
ggcatcatgtgtgac

SEQ ID NO: 3035 - DNA, 15 bp, Artificial Sequence
  dgRNA
  Klk12
gaaggtaggtgaacc

SEQ ID NO: 3036 - DNA, 15 bp, Artificial Sequence
  dgRNA
  Klk12
cgagacaggctgaac

SEQ ID NO: 3037 - DNA, 15 bp, Artificial Sequence
  dgRNA
  Plec
gctgccgtatggcac

SEQ ID NO: 3038 - DNA, 15 bp, Artificial Sequence
  dgRNA
  Plec
tatggcactggcgta

SEQ ID NO: 3039 - DNA, 15 bp, Artificial Sequence
  dgRNA
  Plec
atggcactggcgtaa

SEQ ID NO: 3040 - DNA, 15 bp, Artificial Sequence
  dgRNA
  Plec
tggcactggcgtaag

SEQ ID NO: 3041 - DNA, 15 bp, Artificial Sequence
  dgRNA
  Armcx2
gggaaacggtgagta

SEQ ID NO: 3042 - DNA, 15 bp, Artificial Sequence
  dgRNA
  Armcx2
acggtgagtagggac

SEQ ID NO: 3043 - DNA, 15 bp, Artificial Sequence
  dgRNA
  Armcx2
gtagggactggacga

SEQ ID NO: 3044 - DNA, 15 bp, Artificial Sequence
  dgRNA
  Armcx2
acgatggagaattga

SEQ ID NO: 3045 - DNA, 15 bp, Artificial Sequence
  dgRNA
  Klf13
gttcgcgtctaccac

SEQ ID NO: 3046 - DNA, 15 bp, Artificial Sequence
  dgRNA
  Klf13
ctcctgaggcgctcc

SEQ ID NO: 3047 - DNA, 15 bp, Artificial Sequence
  dgRNA
  Klf13
gcgcgctgctccctg

SEQ ID NO: 3048 - DNA, 15 bp, Artificial Sequence
  dgRNA
  Klf13
gtaacctgcgccgcc

SEQ ID NO: 3049 - DNA, 15 bp, Artificial Sequence
  dgRNA
  Mau2
gttacgatgatgcag

SEQ ID NO: 3050 - DNA, 15 bp, Artificial Sequence
  dgRNA
  Mau2
ttctcgcgagaattg

SEQ ID NO: 3051 - DNA, 15 bp, Artificial Sequence
  dgRNA
  Mau2
tctcgcgagaattgc

SEQ ID NO: 3052 - DNA, 15 bp, Artificial Sequence
  dgRNA
  Mau2
gaattgcgggtcgcc

SEQ ID NO: 3053 - DNA, 15 bp, Artificial Sequence
  dgRNA
  Csn2
agtcaagatctactc

SEQ ID NO: 3054 - DNA, 15 bp, Artificial Sequence
  dgRNA
  Celf3
gcgtggctcttgccc

SEQ ID NO: 3055 - DNA, 15 bp, Artificial Sequence
  dgRNA
  Celf3
tgtgcgtctctctcc

SEQ ID NO: 3056 - DNA, 15 bp, Artificial Sequence
  dgRNA
  Celf3
agagacgcacaaccc

SEQ ID NO: 3057 - DNA, 15 bp, Artificial Sequence
  dgRNA
  Celf3
gagagacgcacaacc

SEQ ID NO: 3058 - DNA, 15 bp, Artificial Sequence
  dgRNA
  Cpa6
gtccctatgctatca

SEQ ID NO: 3059 - DNA, 15 bp, Artificial Sequence
  dgRNA
  Cpa6
agaagggttacccac

SEQ ID NO: 3060 - DNA, 15 bp, Artificial Sequence
  dgRNA
  Cpa6
tgggtaacccttctc

SEQ ID NO: 3061 - DNA, 15 bp, Artificial Sequence
  dgRNA
  Cpa6
gggtgctatagcctg

SEQ ID NO: 3062 - DNA, 15 bp, Artificial Sequence
  dgRNA
  Olfr391-ps
acattataactatcc

SEQ ID NO: 3063 - DNA, 15 bp, Artificial Sequence
  dgRNA
  Olfr391-ps
tgtcctgcatcccaa

SEQ ID NO: 3064 - DNA, 15 bp, Artificial Sequence
  dgRNA
  Lrrc1
ctgtgcgactccccg

SEQ ID NO: 3065 - DNA, 15 bp, Artificial Sequence
  dgRNA
  Lrrc1
tgcgactccccgcgg

SEQ ID NO: 3066 - DNA, 15 bp, Artificial Sequence
  dgRNA
  Lrrc1
ctccccgcggaggag

SEQ ID NO: 3067 - DNA, 15 bp, Artificial Sequence
  dgRNA
  Lrrc1
accctcccgggagcc

SEQ ID NO: 3068 - DNA, 15 bp, Artificial Sequence
  dgRNA
  Map2k3
gcacaatcccccgag

SEQ ID NO: 3069 - DNA, 15 bp, Artificial Sequence
  dgRNA
  Map2k3
cacaatcccccgagt

SEQ ID NO: 3070 - DNA, 15 bp, Artificial Sequence
  dgRNA
  Map2k3
atcccccgagtgggt

SEQ ID NO: 3071 - DNA, 15 bp, Artificial Sequence
  dgRNA
  Map2k3
tcccccgagtgggta

SEQ ID NO: 3072 - DNA, 15 bp, Artificial Sequence
  dgRNA
  Sec14l1
cacgcgcgcctcttc

SEQ ID NO: 3073 - DNA, 15 bp, Artificial Sequence
  dgRNA
  Sec14l1
tcggccctcccgccc

SEQ ID NO: 3074 - DNA, 15 bp, Artificial Sequence
  dgRNA
  Sec14l1
agggccgtactgcgc

SEQ ID NO: 3075 - DNA, 15 bp, Artificial Sequence
  dgRNA
  Sec14l1
cgccgggctggctaa

SEQ ID NO: 3076 - DNA, 15 bp, Artificial Sequence
  dgRNA
  Zfp318
gcggccccctccccg

SEQ ID NO: 3077 - DNA, 15 bp, Artificial Sequence
  dgRNA
  Ripply3
ctccgtcccttcccg

SEQ ID NO: 3078 - DNA, 15 bp, Artificial Sequence
  dgRNA
  Ripply3
tcgggacggcgggga

SEQ ID NO: 3079 - DNA, 15 bp, Artificial Sequence
  dgRNA
  Ripply3
agggtcgggacggcg

SEQ ID NO: 3080 - DNA, 15 bp, Artificial Sequence
  dgRNA
  Ripply3
cagggtcgggacggc

SEQ ID NO: 3081 - DNA, 15 bp, Artificial Sequence
  dgRNA
  Plcg2
ttggctaagcgatcg

SEQ ID NO: 3082 - DNA, 15 bp, Artificial Sequence
  dgRNA
  Plcg2
taagcgatcgcggcc

SEQ ID NO: 3083 - DNA, 15 bp, Artificial Sequence
  dgRNA
  Plcg2
cgatcgcggccaggc

SEQ ID NO: 3084 - DNA, 15 bp, Artificial Sequence
  dgRNA
  Plcg2
agtttccccctggtc

SEQ ID NO: 3085 - DNA, 15 bp, Artificial Sequence
  dgRNA
  Cfap157
gcctaggccggacac

SEQ ID NO: 3086 - DNA, 15 bp, Artificial Sequence
  dgRNA
  Cfap157
aggaccttagccttt

SEQ ID NO: 3087 - DNA, 15 bp, Artificial Sequence
  dgRNA
  Cfap157
aaggaccttagcctt

SEQ ID NO: 3088 - DNA, 15 bp, Artificial Sequence
  dgRNA
  Cfap157
cttgagtacaagttt

SEQ ID NO: 3089 - DNA, 15 bp, Artificial Sequence
  dgRNA
  Rcn1
gcaacccccatcatc

SEQ ID NO: 3090 - DNA, 15 bp, Artificial Sequence
  dgRNA
  Rcn1
ctcgcaacgagatag

SEQ ID NO: 3091 - DNA, 15 bp, Artificial Sequence
  dgRNA
  Rcn1
tcgcaacgagatagc

SEQ ID NO: 3092 - DNA, 15 bp, Artificial Sequence
  dgRNA
  Rcn1
cgcaacgagatagcg

SEQ ID NO: 3093 - DNA, 15 bp, Artificial Sequence
  dgRNA
  C330007P06Rik
gggcgcgcgctccgg

SEQ ID NO: 3094 - DNA, 15 bp, Artificial Sequence
  dgRNA
  C330007P06Rik
ttcaaataacacgga

SEQ ID NO: 3095 - DNA, 15 bp, Artificial Sequence
  dgRNA
  C330007P06Rik
ctccctgcaatttag

SEQ ID NO: 3096 - DNA, 15 bp, Artificial Sequence
  dgRNA
  C330007P06Rik
tccctgcaatttagc

SEQ ID NO: 3097 - DNA, 15 bp, Artificial Sequence
  dgRNA
  Csn1s2b
ctaaatcatcctaag

SEQ ID NO: 3098 - DNA, 15 bp, Artificial Sequence
  dgRNA
  Csn1s2b
agtggaagaactccc

SEQ ID NO: 3099 - DNA, 15 bp, Artificial Sequence
  dgRNA
  Csn1s2b
aagggggtttaaata

SEQ ID NO: 3100 - DNA, 15 bp, Artificial Sequence
  dgRNA
  Csn1s2b
tggataactcatccc

SEQ ID NO: 3101 - DNA, 15 bp, Artificial Sequence
  dgRNA
  Cdyl2
tcgccgcgattgccg

SEQ ID NO: 3102 - DNA, 15 bp, Artificial Sequence
  dgRNA
  Cdyl2
tccgattctgcgcac

SEQ ID NO: 3103 - DNA, 15 bp, Artificial Sequence
  dgRNA
  Cdyl2
gattctgcgcacagg

SEQ ID NO: 3104 - DNA, 15 bp, Artificial Sequence
  dgRNA
  Cdyl2
ggcaggggcgaccga

SEQ ID NO: 3105 - DNA, 15 bp, Artificial Sequence
  dgRNA
  Fstl3
gacctgaccccattg

SEQ ID NO: 3106 - DNA, 15 bp, Artificial Sequence
  dgRNA
  Fstl3
tcctagacaactgtc

SEQ ID NO: 3107 - DNA, 15 bp, Artificial Sequence
  dgRNA
  Fstl3
gtctggttcccagat

SEQ ID NO: 3108 - DNA, 15 bp, Artificial Sequence
  dgRNA
  Fstl3
acggcctgcccccgg

SEQ ID NO: 3109 - DNA, 15 bp, Artificial Sequence
  dgRNA
  Olfr695
tgttagagtcatgct

SEQ ID NO: 3110 - DNA, 15 bp, Artificial Sequence
  dgRNA
  Olfr695
gctgggtagcataag

SEQ ID NO: 3111 - DNA, 15 bp, Artificial Sequence
  dgRNA
  Olfr695
tgactctaacaacat

SEQ ID NO: 3112 - DNA, 15 bp, Artificial Sequence
  dgRNA
  Olfr695
tgtctaaaaaacacg

SEQ ID NO: 3113 - DNA, 15 bp, Artificial Sequence
  dgRNA
  Ckmt2
ggtggaggtctcatg

SEQ ID NO: 3114 - DNA, 15 bp, Artificial Sequence
  dgRNA
  Ckmt2
ggtctcatgagggat

SEQ ID NO: 3115 - DNA, 15 bp, Artificial Sequence
  dgRNA
  Ckmt2
taagctgagccccac

SEQ ID NO: 3116 - DNA, 15 bp, Artificial Sequence
  dgRNA
  Ckmt2
gactcttctgctatt

SEQ ID NO: 3117 - DNA, 15 bp, Artificial Sequence
  dgRNA
  Apobec4
atcacccttttatcc

SEQ ID NO: 3118 - DNA, 15 bp, Artificial Sequence
  dgRNA
  Apobec4
ttccaaacgttgcca

SEQ ID NO: 3119 - DNA, 15 bp, Artificial Sequence
  dgRNA
  Apobec4
taaaagggtgatatc

SEQ ID NO: 3120 - DNA, 15 bp, Artificial Sequence
  dgRNA
  Apobec4
gctactgctaggata

SEQ ID NO: 3121 - DNA, 15 bp, Artificial Sequence
  dgRNA
  Piezo1
gtttggggggcgcgc

SEQ ID NO: 3122 - DNA, 15 bp, Artificial Sequence
  dgRNA
  Piezo1
gcgggtcgaggtctc

SEQ ID NO: 3123 - DNA, 15 bp, Artificial Sequence
  dgRNA
  Piezo1
cgggtcgaggtctcc

SEQ ID NO: 3124 - DNA, 15 bp, Artificial Sequence
  dgRNA
  Piezo1
aggtctccgggtcac

SEQ ID NO: 3125 - DNA, 15 bp, Artificial Sequence
  dgRNA
  Rrp1b
ccctaaaaagctgca

SEQ ID NO: 3126 - DNA, 15 bp, Artificial Sequence
  dgRNA
  Rrp1b
cctaaaaagctgcaa

SEQ ID NO: 3127 - DNA, 15 bp, Artificial Sequence
  dgRNA
  Rrp1b
cttgtcccaggacat

SEQ ID NO: 3128 - DNA, 15 bp, Artificial Sequence
  dgRNA
  Rrp1b
ttgtcccaggacatt

SEQ ID NO: 3129 - DNA, 15 bp, Artificial Sequence
  dgRNA
  Nepro
tcccagcgggtctaa

SEQ ID NO: 3130 - DNA, 15 bp, Artificial Sequence
  dgRNA
  Nepro
cccagcgggtctaac

SEQ ID NO: 3131 - DNA, 15 bp, Artificial Sequence
  dgRNA
  Nepro
gccgtgactccgccc

SEQ ID NO: 3132 - DNA, 15 bp, Artificial Sequence
  dgRNA
  Nepro
ccgtgactccgcccc

SEQ ID NO: 3133 - DNA, 15 bp, Artificial Sequence
  dgRNA
  Pkib
ggtgtgtaatttcaa

SEQ ID NO: 3134 - DNA, 15 bp, Artificial Sequence
  dgRNA
  Pkib
agaggctgtcccctt

SEQ ID NO: 3135 - DNA, 15 bp, Artificial Sequence
  dgRNA
  Pkib
tccccttaggacacc

SEQ ID NO: 3136 - DNA, 15 bp, Artificial Sequence
  dgRNA
  Pkib
gttgcgtttgtcccc

SEQ ID NO: 3137 - DNA, 15 bp, Artificial Sequence
  dgRNA
  Zfp423
ctctcccccactagc

SEQ ID NO: 3138 - DNA, 15 bp, Artificial Sequence
  dgRNA
  Zfp423
tggagatgcatcccg

SEQ ID NO: 3139 - DNA, 15 bp, Artificial Sequence
  dgRNA
  Zfp423
tgcatcccgtggctg

SEQ ID NO: 3140 - DNA, 15 bp, Artificial Sequence
  dgRNA
  Zfp423
ggctgaggtcacccg

SEQ ID NO: 3141 - DNA, 15 bp, Artificial Sequence
  dgRNA
  Cdc123
agtctccgtagaatc

SEQ ID NO: 3142 - DNA, 15 bp, Artificial Sequence
  dgRNA
  Cdc123
caccgctagagacac

SEQ ID NO: 3143 - DNA, 15 bp, Artificial Sequence
  dgRNA
  Cdc123
caccggcgcctctcg

SEQ ID NO: 3144 - DNA, 15 bp, Artificial Sequence
  dgRNA
  Cdc123
gcctctcgtggtgca

SEQ ID NO: 3145 - DNA, 15 bp, Artificial Sequence
  dgRNA
  Spata4
gactgttaacgttca

SEQ ID NO: 3146 - DNA, 15 bp, Artificial Sequence
  dgRNA
  Spata4
aacgttaacagtctg

SEQ ID NO: 3147 - DNA, 15 bp, Artificial Sequence
  dgRNA
  Spata4
cgaagggcggggctt

SEQ ID NO: 3148 - DNA, 15 bp, Artificial Sequence
  dgRNA
  Spata4
tagcgtcgaagggcg

SEQ ID NO: 3149 - DNA, 15 bp, Artificial Sequence
  dgRNA
  Pdzd9
tctactgaagccgtg

SEQ ID NO: 3150 - DNA, 15 bp, Artificial Sequence
  dgRNA
  Pdzd9
gccgtgtggcaacta

SEQ ID NO: 3151 - DNA, 15 bp, Artificial Sequence
  dgRNA
  Pdzd9
ccgtgtggcaactac

SEQ ID NO: 3152 - DNA, 15 bp, Artificial Sequence
  dgRNA
  Pdzd9
cgtgtggcaactacg

SEQ ID NO: 3153 - DNA, 15 bp, Artificial Sequence
  dgRNA
  Ak6
tgacacctcgcacca

SEQ ID NO: 3154 - DNA, 15 bp, Artificial Sequence
  dgRNA
  Ak6
tacaccagtccagac

SEQ ID NO: 3155 - DNA, 15 bp, Artificial Sequence
  dgRNA
  Ak6
accagtccagactgg

SEQ ID NO: 3156 - DNA, 15 bp, Artificial Sequence
  dgRNA
  Ak6
actggagggcgggcc

SEQ ID NO: 3157 - DNA, 15 bp, Artificial Sequence
  dgRNA
  Klhl5
aatgctctgcgttaa

SEQ ID NO: 3158 - DNA, 15 bp, Artificial Sequence
  dgRNA
  Klhl5
tgcaccgagcaataa

SEQ ID NO: 3159 - DNA, 15 bp, Artificial Sequence
  dgRNA
  Klhl5
gcattaactctttta

SEQ ID NO: 3160 - DNA, 15 bp, Artificial Sequence
  dgRNA
  Klhl5
gcagcctttattgct

SEQ ID NO: 3161 - DNA, 15 bp, Artificial Sequence
  dgRNA
  Figf
tgggtttcatgttac

SEQ ID NO: 3162 - DNA, 15 bp, Artificial Sequence
  dgRNA
  Figf
gttcctagcaagagc

SEQ ID NO: 3163 - DNA, 15 bp, Artificial Sequence
  dgRNA
  Figf
aacgctgggaagtct

SEQ ID NO: 3164 - DNA, 15 bp, Artificial Sequence
  dgRNA
  Figf
ttggcagaaaacgct

SEQ ID NO: 3165 - DNA, 15 bp, Artificial Sequence
  dgRNA
  Scara5
cttctagagggagtt

SEQ ID NO: 3166 - DNA, 15 bp, Artificial Sequence
  dgRNA
  Scara5
ctgctaggtactgac

SEQ ID NO: 3167 - DNA, 15 bp, Artificial Sequence
  dgRNA
  1700067K01Rik
aagccggtcggcccc

SEQ ID NO: 3168 - DNA, 15 bp, Artificial Sequence
  dgRNA
  1700067K01Rik
aggtgtgtgcgctcc

SEQ ID NO: 3169 - DNA, 15 bp, Artificial Sequence
  dgRNA
  1700067K01Rik
ctcccgggacgccgc

SEQ ID NO: 3170 - DNA, 15 bp, Artificial Sequence
  dgRNA
  1700067K01Rik
ggacgccgcaggagc

SEQ ID NO: 3171 - DNA, 15 bp, Artificial Sequence
  dgRNA
  Ptpn5
ggttttaactaccat

SEQ ID NO: 3172 - DNA, 15 bp, Artificial Sequence
  dgRNA
  Ptpn5
ccataggaaaacacg

SEQ ID NO: 3173 - DNA, 15 bp, Artificial Sequence
  dgRNA
  Ptpn5
agccatatggctttc

SEQ ID NO: 3174 - DNA, 15 bp, Artificial Sequence
  dgRNA
  Ptpn5
cctcgtgttttccta

SEQ ID NO: 3175 - DNA, 15 bp, Artificial Sequence
  dgRNA
  Mid1ip1
cgccagtccgccctc

SEQ ID NO: 3176 - DNA, 15 bp, Artificial Sequence
  dgRNA
  Mid1ip1
gtccgccctctggtt

SEQ ID NO: 3177 - DNA, 15 bp, Artificial Sequence
  dgRNA
  Mid1ip1
tggacggcggctcct

SEQ ID NO: 3178 - DNA, 15 bp, Artificial Sequence
  dgRNA
  Mid1ip1
ggacggcggctcctt

SEQ ID NO: 3179 - DNA, 15 bp, Artificial Sequence
  dgRNA
  Gas2l1
cagacccggagttaa

SEQ ID NO: 3180 - DNA, 15 bp, Artificial Sequence
  dgRNA
  Gas2l1
agacccggagttaaa

SEQ ID NO: 3181 - DNA, 15 bp, Artificial Sequence
  dgRNA
  Gas2l1
gacccggagttaaag

SEQ ID NO: 3182 - DNA, 15 bp, Artificial Sequence
  dgRNA
  Gas2l1
acccggagttaaagg

SEQ ID NO: 3183 - DNA, 15 bp, Artificial Sequence
  dgRNA
  Cep72
gcaatggggttgtcc

SEQ ID NO: 3184 - DNA, 15 bp, Artificial Sequence
  dgRNA
  Cep72
caatggggttgtcct

SEQ ID NO: 3185 - DNA, 15 bp, Artificial Sequence
  dgRNA
  Cep72
ggggttgtcctgggg

SEQ ID NO: 3186 - DNA, 15 bp, Artificial Sequence
  dgRNA
  Cep72
agagctcagcggatt

SEQ ID NO: 3187 - DNA, 15 bp, Artificial Sequence
  dgRNA
  Stat1
cctgcccggtacttt

SEQ ID NO: 3188 - DNA, 15 bp, Artificial Sequence
  dgRNA
  Stat1
atcagcggcagagat

SEQ ID NO: 3189 - DNA, 15 bp, Artificial Sequence
  dgRNA
  Stat1
ccgaaagtaccgggc

SEQ ID NO: 3190 - DNA, 15 bp, Artificial Sequence
  dgRNA
  Stat1
aaaaccgaaagtacc

SEQ ID NO: 3191 - DNA, 15 bp, Artificial Sequence
  dgRNA
  Zfp451
atgagcgccgagctc

SEQ ID NO: 3192 - DNA, 15 bp, Artificial Sequence
  dgRNA
  Zfp451
cctttccccgccacg

SEQ ID NO: 3193 - DNA, 15 bp, Artificial Sequence
  dgRNA
  Zfp451
cgtcagcctcgagac

SEQ ID NO: 3194 - DNA, 15 bp, Artificial Sequence
  dgRNA
  Zfp451
cagcctcgagaccgg

SEQ ID NO: 3195 - DNA, 15 bp, Artificial Sequence
  dgRNA
  Cldn34c4
gtcatgagttcacaa

SEQ ID NO: 3196 - DNA, 15 bp, Artificial Sequence
  dgRNA
  A330070K13Rik
gtgctccaaaatcca

SEQ ID NO: 3197 - DNA, 15 bp, Artificial Sequence
  dgRNA
  A330070K13Rik
cgctaagccatctga

SEQ ID NO: 3198 - DNA, 15 bp, Artificial Sequence
  dgRNA
  A330070K13Rik
gctcctcagcctgat

SEQ ID NO: 3199 - DNA, 15 bp, Artificial Sequence
  dgRNA
  A330070K13Rik
cgagctttaattaac

SEQ ID NO: 3200 - DNA, 15 bp, Artificial Sequence
  dgRNA
  Rap1gap
aacactgccctgcgg

SEQ ID NO: 3201 - DNA, 15 bp, Artificial Sequence
  dgRNA
  Rap1gap
agcggagcctgcagc

SEQ ID NO: 3202 - DNA, 15 bp, Artificial Sequence
  dgRNA
  Rap1gap
gctagggctggctag

SEQ ID NO: 3203 - DNA, 15 bp, Artificial Sequence
  dgRNA
  Rap1gap
gagacctccaccgca

SEQ ID NO: 3204 - DNA, 15 bp, Artificial Sequence
  dgRNA
  Piwil2
aaaagttcgggctcc

SEQ ID NO: 3205 - DNA, 15 bp, Artificial Sequence
  dgRNA
  Piwil2
gctcctggtgtcgag

SEQ ID NO: 3206 - DNA, 15 bp, Artificial Sequence
  dgRNA
  Piwil2
ctcctggtgtcgagc

SEQ ID NO: 3207 - DNA, 15 bp, Artificial Sequence
  dgRNA
  Piwil2
tcctggtgtcgagcg

SEQ ID NO: 3208 - DNA, 15 bp, Artificial Sequence
  dgRNA
  Ddx39
cgcgcaattaacgtg

SEQ ID NO: 3209 - DNA, 15 bp, Artificial Sequence
  dgRNA
  Ddx39
ctcatctcacgtgac

SEQ ID NO: 3210 - DNA, 15 bp, Artificial Sequence
  dgRNA
  Ddx39
tcatctcacgtgact

SEQ ID NO: 3211 - DNA, 15 bp, Artificial Sequence
  dgRNA
  Ddx39
tctcacgtgactggg

SEQ ID NO: 3212 - DNA, 15 bp, Artificial Sequence
  dgRNA
  Ssr1
gcgatgctaagcatc

SEQ ID NO: 3213 - DNA, 15 bp, Artificial Sequence
  dgRNA
  Ssr1
taagcctgctcagct

SEQ ID NO: 3214 - DNA, 15 bp, Artificial Sequence
  dgRNA
  Ssr1
tcagctaggctctcg

SEQ ID NO: 3215 - DNA, 15 bp, Artificial Sequence
  dgRNA
  Ssr1
cagctaggctctcgc

SEQ ID NO: 3216 - DNA, 15 bp, Artificial Sequence
  dgRNA
  Tfpi2
ctgcaagcaaaacgt

SEQ ID NO: 3217 - DNA, 15 bp, Artificial Sequence
  dgRNA
  Tfpi2
tgcaagcaaaacgtt

SEQ ID NO: 3218 - DNA, 15 bp, Artificial Sequence
  dgRNA
  Tfpi2
aaaacgttgggaatc

SEQ ID NO: 3219 - DNA, 15 bp, Artificial Sequence
  dgRNA
  Tfpi2
ggaacacactgaacg

SEQ ID NO: 3220 - DNA, 15 bp, Artificial Sequence
  dgRNA
  Grem1
gtagacaaagaggcg

SEQ ID NO: 3221 - DNA, 15 bp, Artificial Sequence
  dgRNA
  Grem1
cgaggcgggcggaga

SEQ ID NO: 3222 - DNA, 15 bp, Artificial Sequence
  dgRNA
  Grem1
gagaggggaccccgc

SEQ ID NO: 3223 - DNA, 15 bp, Artificial Sequence
  dgRNA
  Grem1
agaggggaccccgca

SEQ ID NO: 3224 - DNA, 15 bp, Artificial Sequence
  dgRNA
  Olfr487
aatttggatcaacca

SEQ ID NO: 3225 - DNA, 15 bp, Artificial Sequence
  dgRNA
  Arpp21
gaagtgagtaatctt

SEQ ID NO: 3226 - DNA, 15 bp, Artificial Sequence
  dgRNA
  Arpp21
ttttagctccttgcg

SEQ ID NO: 3227 - DNA, 15 bp, Artificial Sequence
  dgRNA
  Arpp21
agcggcacccacgca

SEQ ID NO: 3228 - DNA, 15 bp, Artificial Sequence
  dgRNA
  Rph3a
cctccgcttgcgtcc

SEQ ID NO: 3229 - DNA, 15 bp, Artificial Sequence
  dgRNA
  Rph3a
caatccggatcgttc

SEQ ID NO: 3230 - DNA, 15 bp, Artificial Sequence
  dgRNA
  Rph3a
aatccggatcgttct

SEQ ID NO: 3231 - DNA, 15 bp, Artificial Sequence
  dgRNA
  Rph3a
atccggatcgttctg

SEQ ID NO: 3232 - DNA, 15 bp, Artificial Sequence
  dgRNA
  Med15
cctgtacttccggcg

SEQ ID NO: 3233 - DNA, 15 bp, Artificial Sequence
  dgRNA
  Med15
ccacgccggaagtac

SEQ ID NO: 3234 - DNA, 15 bp, Artificial Sequence
  dgRNA
  Cpa2
caactgatttgccct

SEQ ID NO: 3235 - DNA, 15 bp, Artificial Sequence
  dgRNA
  Cpa2
ggccatagcgtgctc

SEQ ID NO: 3236 - DNA, 15 bp, Artificial Sequence
  dgRNA
  Cpa2
gcgtgctctggtatc

SEQ ID NO: 3237 - DNA, 15 bp, Artificial Sequence
  dgRNA
  Cpa2
cgtgctctggtatct

SEQ ID NO: 3238 - DNA, 15 bp, Artificial Sequence
  dgRNA
  Mbnl2
tgctttcctcggaga

SEQ ID NO: 3239 - DNA, 15 bp, Artificial Sequence
  dgRNA
  Mbnl2
gtcagtcatcctatg

SEQ ID NO: 3240 - DNA, 15 bp, Artificial Sequence
  dgRNA
  Mbnl2
cagtttcagacgagg

SEQ ID NO: 3241 - DNA, 15 bp, Artificial Sequence
  dgRNA
  Mbnl2
agtttcagacgagga

SEQ ID NO: 3242 - DNA, 15 bp, Artificial Sequence
  dgRNA
  Msh5
acggctgcttagcaa

SEQ ID NO: 3243 - DNA, 15 bp, Artificial Sequence
  dgRNA
  Msh5
gcttagcaacggcag

SEQ ID NO: 3244 - DNA, 15 bp, Artificial Sequence
  dgRNA
  Msh5
cttagcaacggcaga

SEQ ID NO: 3245 - DNA, 15 bp, Artificial Sequence
  dgRNA
  Msh5
cgcccccaatgcaaa

SEQ ID NO: 3246 - DNA, 15 bp, Artificial Sequence
  dgRNA
  Dpys
ccgacttattgtaac

SEQ ID NO: 3247 - DNA, 15 bp, Artificial Sequence
  dgRNA
  Dpys
tgtaactggatgcta

SEQ ID NO: 3248 - DNA, 15 bp, Artificial Sequence
  dgRNA
  Dpys
cttaagggtttgtcc

SEQ ID NO: 3249 - DNA, 15 bp, Artificial Sequence
  dgRNA
  Dpys
gtccaggtctgcggc

SEQ ID NO: 3250 - DNA, 15 bp, Artificial Sequence
  dgRNA
  Gpd1
tcaataccaatacgt

SEQ ID NO: 3251 - DNA, 15 bp, Artificial Sequence
  dgRNA
  Gpd1
ataccaatacgtagg

SEQ ID NO: 3252 - DNA, 15 bp, Artificial Sequence
  dgRNA
  Gpd1
tggagaactaagccg

SEQ ID NO: 3253 - DNA, 15 bp, Artificial Sequence
  dgRNA
  Gpd1
agccgaggccaaacg

SEQ ID NO: 3254 - DNA, 15 bp, Artificial Sequence
  dgRNA
  Tlr2
ttaacgtttcctagc

SEQ ID NO: 3255 - DNA, 15 bp, Artificial Sequence
  dgRNA
  Tlr2
agccaaaaggcgagc

SEQ ID NO: 3256 - DNA, 15 bp, Artificial Sequence
  dgRNA
  Tlr2
gccaaaaggcgagct

SEQ ID NO: 3257 - DNA, 15 bp, Artificial Sequence
  dgRNA
  Tlr2
aaaaggcgagctggg

SEQ ID NO: 3258 - DNA, 15 bp, Artificial Sequence
  dgRNA
  Myo1g
ggccaaacctagctt

SEQ ID NO: 3259 - DNA, 15 bp, Artificial Sequence
  dgRNA
  Myo1g
ggagtagcaatgggc

SEQ ID NO: 3260 - DNA, 15 bp, Artificial Sequence
  dgRNA
  Myo1g
agggccaaactcccc

SEQ ID NO: 3261 - DNA, 15 bp, Artificial Sequence
  dgRNA
  Myo1g
agattacgggcaggc

SEQ ID NO: 3262 - DNA, 15 bp, Artificial Sequence
  dgRNA
  Map2
tcccctacactgcga

SEQ ID NO: 3263 - DNA, 15 bp, Artificial Sequence
  dgRNA
  Map2
cctacactgcgacgg

SEQ ID NO: 3264 - DNA, 15 bp, Artificial Sequence
  dgRNA
  Map2
ggtggcagcttagcg

SEQ ID NO: 3265 - DNA, 15 bp, Artificial Sequence
  dgRNA
  Map2
gcttagcgcggaccg

SEQ ID NO: 3266 - DNA, 15 bp, Artificial Sequence
  dgRNA
  Abhd2
aaagtaaccaattat

SEQ ID NO: 3267 - DNA, 15 bp, Artificial Sequence
  dgRNA
  Abhd2
tccgcctccaccttg

SEQ ID NO: 3268 - DNA, 15 bp, Artificial Sequence
  dgRNA
  Abhd2
agtcctactgaccaa

SEQ ID NO: 3269 - DNA, 15 bp, Artificial Sequence
  dgRNA
  Abhd2
gtcctactgaccaat

SEQ ID NO: 3270 - DNA, 15 bp, Artificial Sequence
  dgRNA
  Adal
gagccgagacacgtc

SEQ ID NO: 3271 - DNA, 15 bp, Artificial Sequence
  dgRNA
  Adal
agccgagacacgtcc

SEQ ID NO: 3272 - DNA, 15 bp, Artificial Sequence
  dgRNA
  Adal
tcccagacggcagct

SEQ ID NO: 3273 - DNA, 15 bp, Artificial Sequence
  dgRNA
  Adal
acggcagctcgggcc

SEQ ID NO: 3274 - DNA, 15 bp, Artificial Sequence
  dgRNA
  Cul4a
gccctcgacgtgacg

SEQ ID NO: 3275 - DNA, 15 bp, Artificial Sequence
  dgRNA
  Cul4a
ccctcgacgtgacgt

SEQ ID NO: 3276 - DNA, 15 bp, Artificial Sequence
  dgRNA
  Cul4a
cctcgacgtgacgtg

SEQ ID NO: 3277 - DNA, 15 bp, Artificial Sequence
  dgRNA
  Cul4a
cgacgtgacgtgggg

SEQ ID NO: 3278 - DNA, 15 bp, Artificial Sequence
  dgRNA
  Mfsd6
agttagctttgaggg

SEQ ID NO: 3279 - DNA, 15 bp, Artificial Sequence
  dgRNA
  Mfsd6
gcacctattaagttc

SEQ ID NO: 3280 - DNA, 15 bp, Artificial Sequence
  dgRNA
  Mfsd6
caccacccctagacc

SEQ ID NO: 3281 - DNA, 15 bp, Artificial Sequence
  dgRNA
  Mfsd6
accccatcagagatt

SEQ ID NO: 3282 - DNA, 15 bp, Artificial Sequence
  dgRNA
  Ptpn11
ttagaagaatcgtcc

SEQ ID NO: 3283 - DNA, 15 bp, Artificial Sequence
  dgRNA
  Ptpn11
tcgtccaggcgttca

SEQ ID NO: 3284 - DNA, 15 bp, Artificial Sequence
  dgRNA
  Ptpn11
cgtccaggcgttcac

SEQ ID NO: 3285 - DNA, 15 bp, Artificial Sequence
  dgRNA
  Ptpn11
gccgcaccgattcag

SEQ ID NO: 3286 - DNA, 15 bp, Artificial Sequence
  dgRNA
  Mrap2
tcctttgctcgttgc

SEQ ID NO: 3287 - DNA, 15 bp, Artificial Sequence
  dgRNA
  Mrap2
gtctccaccgcaccg

SEQ ID NO: 3288 - DNA, 15 bp, Artificial Sequence
  dgRNA
  Mrap2
accgcaccgcggcgc

SEQ ID NO: 3289 - DNA, 15 bp, Artificial Sequence
  dgRNA
  Mrap2
ccgcaccgcggcgca

SEQ ID NO: 3290 - DNA, 15 bp, Artificial Sequence
  dgRNA
  Eid2
taggtagcaatctca

SEQ ID NO: 3291 - DNA, 15 bp, Artificial Sequence
  dgRNA
  Eid2
tcgccagcaaatgcc

SEQ ID NO: 3292 - DNA, 15 bp, Artificial Sequence
  dgRNA
  Eid2
ccagcaaatgcccgg

SEQ ID NO: 3293 - DNA, 15 bp, Artificial Sequence
  dgRNA
  Eid2
gtgcgcactgctcct

SEQ ID NO: 3294 - DNA, 15 bp, Artificial Sequence
  dgRNA
  Zfp760
taaagcccgcatgga

SEQ ID NO: 3295 - DNA, 15 bp, Artificial Sequence
  dgRNA
  Zfp760
cctggaaaactcaat

SEQ ID NO: 3296 - DNA, 15 bp, Artificial Sequence
  dgRNA
  Zfp760
aactcaattggacaa

SEQ ID NO: 3297 - DNA, 15 bp, Artificial Sequence
  dgRNA
  Zfp760
tttgaaccagtgggc

SEQ ID NO: 3298 - DNA, 15 bp, Artificial Sequence
  dgRNA
  Tspan11
ccaaggaacctgtca

SEQ ID NO: 3299 - DNA, 15 bp, Artificial Sequence
  dgRNA
  Tspan11
ggattcaattcttcc

SEQ ID NO: 3300 - DNA, 15 bp, Artificial Sequence
  dgRNA
  Tspan11
attcttccgggatcc

SEQ ID NO: 3301 - DNA, 15 bp, Artificial Sequence
  dgRNA
  Tspan11
tccccccacttcatg

SEQ ID NO: 3302 - DNA, 15 bp, Artificial Sequence
  dgRNA
  Entpd1
cttccgtctgcgcat

SEQ ID NO: 3303 - DNA, 15 bp, Artificial Sequence
  dgRNA
  Entpd1
tctgcgcattggctc

SEQ ID NO: 3304 - DNA, 15 bp, Artificial Sequence
  dgRNA
  Entpd1
gcgcattggctcagg

SEQ ID NO: 3305 - DNA, 15 bp, Artificial Sequence
  dgRNA
  Entpd1
cgcattggctcaggc

SEQ ID NO: 3306 - DNA, 15 bp, Artificial Sequence
  dgRNA
  Sema3g
gccagttagctgcac

SEQ ID NO: 3307 - DNA, 15 bp, Artificial Sequence
  dgRNA
  Sema3g
tgcacgggcattgag

SEQ ID NO: 3308 - DNA, 15 bp, Artificial Sequence
  dgRNA
  Sema3g
gcacgggcattgagc

SEQ ID NO: 3309 - DNA, 15 bp, Artificial Sequence
  dgRNA
  Sema3g
gggcattgagcgggc

SEQ ID NO: 3310 - DNA, 15 bp, Artificial Sequence
  dgRNA
  Cyp26b1
ataccccatcgccat

SEQ ID NO: 3311 - DNA, 15 bp, Artificial Sequence
  dgRNA
  Cyp26b1
taccccatcgccatc

SEQ ID NO: 3312 - DNA, 15 bp, Artificial Sequence
  dgRNA
  Cyp26b1
cccatcgccatcggg

SEQ ID NO: 3313 - DNA, 15 bp, Artificial Sequence
  dgRNA
  Cyp26b1
ccatcgccatcgggc

SEQ ID NO: 3314 - DNA, 15 bp, Artificial Sequence
  dgRNA
  Krtap13-1
taatctttcgtttaa

SEQ ID NO: 3315 - DNA, 15 bp, Artificial Sequence
  dgRNA
  Krtap13-1
ttaatctttcgttta

SEQ ID NO: 3316 - DNA, 15 bp, Artificial Sequence
  dgRNA
  Krtap13-1
aatcactccttacct

SEQ ID NO: 3317 - DNA, 15 bp, Artificial Sequence
  dgRNA
  Krtap13-1
aaatcactccttacc

SEQ ID NO: 3318 - DNA, 15 bp, Artificial Sequence
  dgRNA
  Fam188a
caactatccccaaac

SEQ ID NO: 3319 - DNA, 15 bp, Artificial Sequence
  dgRNA
  Fam188a
tcccagccctccgcg

SEQ ID NO: 3320 - DNA, 15 bp, Artificial Sequence
  dgRNA
  Fam188a
cccagccctccgcgg

SEQ ID NO: 3321 - DNA, 15 bp, Artificial Sequence
  dgRNA
  Fam188a
agccctccgcggggg

SEQ ID NO: 3322 - DNA, 15 bp, Artificial Sequence
  dgRNA
  Tbc1d24
actttgccttacacc

SEQ ID NO: 3323 - DNA, 15 bp, Artificial Sequence
  dgRNA
  Tbc1d24
cttacaccaggcgct

SEQ ID NO: 3324 - DNA, 15 bp, Artificial Sequence
  dgRNA
  Tbc1d24
ccccgccccttagcg

SEQ ID NO: 3325 - DNA, 15 bp, Artificial Sequence
  dgRNA
  Tbc1d24
cccgccccttagcgc

SEQ ID NO: 3326 - DNA, 15 bp, Artificial Sequence
  dgRNA
  Slc8a3
cgctgagaagcgctg

SEQ ID NO: 3327 - DNA, 15 bp, Artificial Sequence
  dgRNA
  Slc8a3
tcccctccgctcccg

SEQ ID NO: 3328 - DNA, 15 bp, Artificial Sequence
  dgRNA
  Slc8a3
gaggctaaatatgcg

SEQ ID NO: 3329 - DNA, 15 bp, Artificial Sequence
  dgRNA
  Slc8a3
gcgcggcttgtcatt

SEQ ID NO: 3330 - DNA, 15 bp, Artificial Sequence
  dgRNA
  Npnt
ccccggcgcgcgccc

SEQ ID NO: 3331 - DNA, 15 bp, Artificial Sequence
  dgRNA
  Npnt
cccggcgcgcgccca

SEQ ID NO: 3332 - DNA, 15 bp, Artificial Sequence
  dgRNA
  Npnt
cgcgcccagggcacc

SEQ ID NO: 3333 - DNA, 15 bp, Artificial Sequence
  dgRNA
  Npnt
gcgcccagggcacca

SEQ ID NO: 3334 - DNA, 15 bp, Artificial Sequence
  dgRNA
  Tspo2
taattcctcgtatct

SEQ ID NO: 3335 - DNA, 15 bp, Artificial Sequence
  dgRNA
  Tspo2
aattcctcgtatctc

SEQ ID NO: 3336 - DNA, 15 bp, Artificial Sequence
  dgRNA
  Tspo2
catttctaacagacc

SEQ ID NO: 3337 - DNA, 15 bp, Artificial Sequence
  dgRNA
  Tspo2
atttctaacagacca

SEQ ID NO: 3338 - DNA, 15 bp, Artificial Sequence
  dgRNA
  Ebf3
ggcgctcggaggcgg

SEQ ID NO: 3339 - DNA, 15 bp, Artificial Sequence
  dgRNA
  Ebf3
gcgctcggaggcggc

SEQ ID NO: 3340 - DNA, 15 bp, Artificial Sequence
  dgRNA
  Ebf3
gcggcggggctcgct

SEQ ID NO: 3341 - DNA, 15 bp, Artificial Sequence
  dgRNA
  Ebf3
ggctcgctgggctcg

SEQ ID NO: 3342 - DNA, 15 bp, Artificial Sequence
  dgRNA
  Nubp2
ctttcgcatgaccat

SEQ ID NO: 3343 - DNA, 15 bp, Artificial Sequence
  dgRNA
  Nubp2
gtgtgtccgtgcccg

SEQ ID NO: 3344 - DNA, 15 bp, Artificial Sequence
  dgRNA
  Nubp2
tcatcatcagttgcc

SEQ ID NO: 3345 - DNA, 15 bp, Artificial Sequence
  dgRNA
  Nubp2
atcagttgccaggat

SEQ ID NO: 3346 - DNA, 15 bp, Artificial Sequence
  dgRNA
  2010111I01Rik
atcgcttaaaacaag

SEQ ID NO: 3347 - DNA, 15 bp, Artificial Sequence
  dgRNA
  2010111I01Rik
cttctaagcggctaa

SEQ ID NO: 3348 - DNA, 15 bp, Artificial Sequence
  dgRNA
  2010111I01Rik
acttctaagcggcta

SEQ ID NO: 3349 - DNA, 15 bp, Artificial Sequence
  dgRNA
  Zfp874a
aaggtgccgcttttc

SEQ ID NO: 3350 - DNA, 15 bp, Artificial Sequence
  dgRNA
  Zfp874a
ccgaatgtttatgta

SEQ ID NO: 3351 - DNA, 15 bp, Artificial Sequence
  dgRNA
  Zfp874a
tagtgtcacctactt

SEQ ID NO: 3352 - DNA, 15 bp, Artificial Sequence
  dgRNA
  Zfp874a
cgttgcaggagtcct

SEQ ID NO: 3353 - DNA, 15 bp, Artificial Sequence
  dgRNA
  Il1f10
ccctatctaaagacc

SEQ ID NO: 3354 - DNA, 15 bp, Artificial Sequence
  dgRNA
  Il1f10
taatacttaggggta

SEQ ID NO: 3355 - DNA, 15 bp, Artificial Sequence
  dgRNA
  Il1f10
gtacggaacagcttg

SEQ ID NO: 3356 - DNA, 15 bp, Artificial Sequence
  dgRNA
  Il1f10
cctggtctttagata

SEQ ID NO: 3357 - DNA, 15 bp, Artificial Sequence
  dgRNA
  Olfr273
aatgtgcatctgata

SEQ ID NO: 3358 - DNA, 15 bp, Artificial Sequence
  dgRNA
  Olfr273
tagatagtcacatgg

SEQ ID NO: 3359 - DNA, 15 bp, Artificial Sequence
  dgRNA
  Olfr273
taacatacattactg

SEQ ID NO: 3360 - DNA, 15 bp, Artificial Sequence
  dgRNA
  Olfr273
aacatacattactgt

SEQ ID NO: 3361 - DNA, 15 bp, Artificial Sequence
  dgRNA
  Treml4
aggtcaaccacgaga

SEQ ID NO: 3362 - DNA, 15 bp, Artificial Sequence
  dgRNA
  Treml4
cccgccttcccagac

SEQ ID NO: 3363 - DNA, 15 bp, Artificial Sequence
  dgRNA
  Treml4
acttgcctagttcag

SEQ ID NO: 3364 - DNA, 15 bp, Artificial Sequence
  dgRNA
  Treml4
ggtagataggttctg

SEQ ID NO: 3365 - DNA, 15 bp, Artificial Sequence
  dgRNA
  Akr1cl
tactcccaacctgat

SEQ ID NO: 3366 - DNA, 15 bp, Artificial Sequence
  dgRNA
  Akr1cl
ttgggagtaggtttc

SEQ ID NO: 3367 - DNA, 15 bp, Artificial Sequence
  dgRNA
  Akr1cl
tttcaccaatcaggt

SEQ ID NO: 3368 - DNA, 15 bp, Artificial Sequence
  dgRNA
  Treh
atctcccccctcagg

SEQ ID NO: 3369 - DNA, 15 bp, Artificial Sequence
  dgRNA
  Treh
ccacacctcatagcc

SEQ ID NO: 3370 - DNA, 15 bp, Artificial Sequence
  dgRNA
  Treh
tcatagcctggactt

SEQ ID NO: 3371 - DNA, 15 bp, Artificial Sequence
  dgRNA
  Treh
ggtcagccaaagtcc

SEQ ID NO: 3372 - DNA, 15 bp, Artificial Sequence
  dgRNA
  F13b
attgtcagctaatac

SEQ ID NO: 3373 - DNA, 15 bp, Artificial Sequence
  dgRNA
  F13b
gttacctcgttccaa

SEQ ID NO: 3374 - DNA, 15 bp, Artificial Sequence
  dgRNA
  F13b
catatgaggcaacat

SEQ ID NO: 3375 - DNA, 15 bp, Artificial Sequence
  dgRNA
  F13b
agtacctttggaacg

SEQ ID NO: 3376 - DNA, 15 bp, Artificial Sequence
  dgRNA
  Vwc2l
gacaacactacagcc

SEQ ID NO: 3377 - DNA, 15 bp, Artificial Sequence
  dgRNA
  Vwc2l
taatgcattcttgca

SEQ ID NO: 3378 - DNA, 15 bp, Artificial Sequence
  dgRNA
  Vwc2l
gatgagagcgagcat

SEQ ID NO: 3379 - DNA, 15 bp, Artificial Sequence
  dgRNA
  Vwc2l
tgatgagagcgagca

SEQ ID NO: 3380 - DNA, 15 bp, Artificial Sequence
  dgRNA
  Prss30
ggctcctatcgcctc

SEQ ID NO: 3381 - DNA, 15 bp, Artificial Sequence
  dgRNA
  Prss30
aactgcatgcagaat

SEQ ID NO: 3382 - DNA, 15 bp, Artificial Sequence
  dgRNA
  Prss30
aataggagtctgatt

SEQ ID NO: 3383 - DNA, 15 bp, Artificial Sequence
  dgRNA
  Prss30
aggagtctgattggg

SEQ ID NO: 3384 - DNA, 15 bp, Artificial Sequence
  dgRNA
  Acpt
gcctgggggttaggc

SEQ ID NO: 3385 - DNA, 15 bp, Artificial Sequence
  dgRNA
  Acpt
gcacagtatagatgc

SEQ ID NO: 3386 - DNA, 15 bp, Artificial Sequence
  dgRNA
  Acpt
cggagaggtagttac

SEQ ID NO: 3387 - DNA, 15 bp, Artificial Sequence
  dgRNA
  Acpt
aatggcaaagcggag

SEQ ID NO: 3388 - DNA, 15 bp, Artificial Sequence
  dgRNA
  Cntn1
tcaatagcccattac

SEQ ID NO: 3389 - DNA, 15 bp, Artificial Sequence
  dgRNA
  Cntn1
caatagcccattact

SEQ ID NO: 3390 - DNA, 15 bp, Artificial Sequence
  dgRNA
  Cntn1
cctgaacagaatgac

SEQ ID NO: 3391 - DNA, 15 bp, Artificial Sequence
  dgRNA
  Cntn1
gctctacccagtaat

SEQ ID NO: 3392 - DNA, 15 bp, Artificial Sequence
  dgRNA
  Krtap5-3
gggagatcaacacat

SEQ ID NO: 3393 - DNA, 15 bp, Artificial Sequence
  dgRNA
  Krtap5-3
ggagatcaacacatg

SEQ ID NO: 3394 - DNA, 15 bp, Artificial Sequence
  dgRNA
  Krtap5-3
tttaggagcgatcct

SEQ ID NO: 3395 - DNA, 15 bp, Artificial Sequence
  dgRNA
  Krtap5-3
gtttaggagcgatcc

SEQ ID NO: 3396 - DNA, 15 bp, Artificial Sequence
  dgRNA
  Stau1
cagcgcagccgtgcc

SEQ ID NO: 3397 - DNA, 15 bp, Artificial Sequence
  dgRNA
  Stau1
cgtgcccggcccttg

SEQ ID NO: 3398 - DNA, 15 bp, Artificial Sequence
  dgRNA
  Stau1
gtgcccggcccttgt

SEQ ID NO: 3399 - DNA, 15 bp, Artificial Sequence
  dgRNA
  Stau1
cctagagagcgcatg

SEQ ID NO: 3400 - DNA, 15 bp, Artificial Sequence
  dgRNA
  Aebp2
aatccccaccgactt

SEQ ID NO: 3401 - DNA, 15 bp, Artificial Sequence
  dgRNA
  Aebp2
atccccaccgacttc

SEQ ID NO: 3402 - DNA, 15 bp, Artificial Sequence
  dgRNA
  Aebp2
cgacttcgggtttcg

SEQ ID NO: 3403 - DNA, 15 bp, Artificial Sequence
  dgRNA
  Aebp2
gacttcgggtttcga

SEQ ID NO: 3404 - DNA, 15 bp, Artificial Sequence
  dgRNA
  Ywhab
ggaacagacgatcct

SEQ ID NO: 3405 - DNA, 15 bp, Artificial Sequence
  dgRNA
  Ywhab
cgaaccctgccctcc

SEQ ID NO: 3406 - DNA, 15 bp, Artificial Sequence
  dgRNA
  Ywhab
taattctcacggggt

SEQ ID NO: 3407 - DNA, 15 bp, Artificial Sequence
  dgRNA
  Ywhab
agcttggagcggtct

SEQ ID NO: 3408 - DNA, 15 bp, Artificial Sequence
  dgRNA
  Rtn3
cacgccccttacgtc

SEQ ID NO: 3409 - DNA, 15 bp, Artificial Sequence
  dgRNA
  Rtn3
tgcgtcctttcctgc

SEQ ID NO: 3410 - DNA, 15 bp, Artificial Sequence
  dgRNA
  Rtn3
cctgcgggagcgcag

SEQ ID NO: 3411 - DNA, 15 bp, Artificial Sequence
  dgRNA
  Rtn3
ctgcgggagcgcaga

SEQ ID NO: 3412 - DNA, 15 bp, Artificial Sequence
  dgRNA
  Plin5
ccgctatggcaacca

SEQ ID NO: 3413 - DNA, 15 bp, Artificial Sequence
  dgRNA
  Plin5
caaccatggcgcctg

SEQ ID NO: 3414 - DNA, 15 bp, Artificial Sequence
  dgRNA
  Plin5
aaccatggcgcctgt

SEQ ID NO: 3415 - DNA, 15 bp, Artificial Sequence
  dgRNA
  Plin5
accatggcgcctgtg

SEQ ID NO: 3416 - DNA, 15 bp, Artificial Sequence
  dgRNA
  P2ry1
cttgccaggcgtgca

SEQ ID NO: 3417 - DNA, 15 bp, Artificial Sequence
  dgRNA
  P2ry1
ttgccaggcgtgcag

SEQ ID NO: 3418 - DNA, 15 bp, Artificial Sequence
  dgRNA
  P2ry1
ggccacctcccgccc

SEQ ID NO: 3419 - DNA, 15 bp, Artificial Sequence
  dgRNA
  P2ry1
gccacctcccgccct

SEQ ID NO: 3420 - DNA, 15 bp, Artificial Sequence
  dgRNA
  Nr2f1
ttttgggcgatctcc

SEQ ID NO: 3421 - DNA, 15 bp, Artificial Sequence
  dgRNA
  Nr2f1
tttgggcgatctcca

SEQ ID NO: 3422 - DNA, 15 bp, Artificial Sequence
  dgRNA
  Nr2f1
ttattcgacctactt

SEQ ID NO: 3423 - DNA, 15 bp, Artificial Sequence
  dgRNA
  Nr2f1
ctagttaaaaaaccc

SEQ ID NO: 3424 - DNA, 15 bp, Artificial Sequence
  dgRNA
  Pitx2
cccggaagacgttgc

SEQ ID NO: 3425 - DNA, 15 bp, Artificial Sequence
  dgRNA
  Pitx2
cgttgctggactccg

SEQ ID NO: 3426 - DNA, 15 bp, Artificial Sequence
  dgRNA
  Pitx2
gttgctggactccgt

SEQ ID NO: 3427 - DNA, 15 bp, Artificial Sequence
  dgRNA
  Pitx2
ttgctggactccgtg

SEQ ID NO: 3428 - DNA, 15 bp, Artificial Sequence
  dgRNA
  Ogdh
tgcaggccgctcctc

SEQ ID NO: 3429 - DNA, 15 bp, Artificial Sequence
  dgRNA
  Ogdh
gcaggccgctcctct

SEQ ID NO: 3430 - DNA, 15 bp, Artificial Sequence
  dgRNA
  Ogdh
cgctcctctggggcc

SEQ ID NO: 3431 - DNA, 15 bp, Artificial Sequence
  dgRNA
  Ogdh
gttgacgccacacgc

SEQ ID NO: 3432 - DNA, 15 bp, Artificial Sequence
  dgRNA
  Uap1
agccgcgcgcgtagc

SEQ ID NO: 3433 - DNA, 15 bp, Artificial Sequence
  dgRNA
  Uap1
gcccctgctagtgcg

SEQ ID NO: 3434 - DNA, 15 bp, Artificial Sequence
  dgRNA
  Uap1
cccctgctagtgcgt

SEQ ID NO: 3435 - DNA, 15 bp, Artificial Sequence
  dgRNA
  Uap1
cctgctagtgcgtgg

SEQ ID NO: 3436 - DNA, 15 bp, Artificial Sequence
  dgRNA
  Ccne1
ccgcccccggcgcgc

SEQ ID NO: 3437 - DNA, 15 bp, Artificial Sequence
  dgRNA
  Ccne1
aaagaacacgccccc

SEQ ID NO: 3438 - DNA, 15 bp, Artificial Sequence
  dgRNA
  Ccne1
aagaacacgcccccc

SEQ ID NO: 3439 - DNA, 15 bp, Artificial Sequence
  dgRNA
  Ccne1
aacacgccccccggg

SEQ ID NO: 3440 - DNA, 15 bp, Artificial Sequence
  dgRNA
  Ncan
cctgtaaatcggagc

SEQ ID NO: 3441 - DNA, 15 bp, Artificial Sequence
  dgRNA
  Ncan
gtaaatcggagcagg

SEQ ID NO: 3442 - DNA, 15 bp, Artificial Sequence
  dgRNA
  Ncan
cctcatgaggcatac

SEQ ID NO: 3443 - DNA, 15 bp, Artificial Sequence
  dgRNA
  Ncan
ctggagtcatttaat

SEQ ID NO: 3444 - DNA, 15 bp, Artificial Sequence
  dgRNA
  Olfr1414
cctgaaggcttggac

SEQ ID NO: 3445 - DNA, 15 bp, Artificial Sequence
  dgRNA
  Olfr1414
gagaccagggctaat

SEQ ID NO: 3446 - DNA, 15 bp, Artificial Sequence
  dgRNA
  Olfr1414
accagggctaattgg

SEQ ID NO: 3447 - DNA, 15 bp, Artificial Sequence
  dgRNA
  Olfr1414
ggctaattggcggtg

SEQ ID NO: 3448 - DNA, 15 bp, Artificial Sequence
  dgRNA
  Olfr180
atgcatataaggtga

SEQ ID NO: 3449 - DNA, 15 bp, Artificial Sequence
  dgRNA
  Olfr180
agtcttaaaccattg

SEQ ID NO: 3450 - DNA, 15 bp, Artificial Sequence
  dgRNA
  Olfr180
cagtcttaaaccatt

SEQ ID NO: 3451 - DNA, 15 bp, Artificial Sequence
  dgRNA
  Olfr180
gcagtcttaaaccat

SEQ ID NO: 3452 - DNA, 15 bp, Artificial Sequence
  dgRNA
  Exoc7
acccacgtatgcctc

SEQ ID NO: 3453 - DNA, 15 bp, Artificial Sequence
  dgRNA
  Exoc7
cccgctcgcgagctc

SEQ ID NO: 3454 - DNA, 15 bp, Artificial Sequence
  dgRNA
  Exoc7
gcccccgaaagcgtc

SEQ ID NO: 3455 - DNA, 15 bp, Artificial Sequence
  dgRNA
  Exoc7
cccccgaaagcgtcc

SEQ ID NO: 3456 - DNA, 15 bp, Artificial Sequence
  dgRNA
  Plin1
cccccatagaagtta

SEQ ID NO: 3457 - DNA, 15 bp, Artificial Sequence
  dgRNA
  Plin1
agttagggtgagccc

SEQ ID NO: 3458 - DNA, 15 bp, Artificial Sequence
  dgRNA
  Plin1
gttagggtgagccca

SEQ ID NO: 3459 - DNA, 15 bp, Artificial Sequence
  dgRNA
  Plin1
gacagctaaggcaat

SEQ ID NO: 3460 - DNA, 15 bp, Artificial Sequence
  dgRNA
  Sstr5
cccccattctcgacc

SEQ ID NO: 3461 - DNA, 15 bp, Artificial Sequence
  dgRNA
  Sstr5
ttctcgacctggcca

SEQ ID NO: 3462 - DNA, 15 bp, Artificial Sequence
  dgRNA
  Sstr5
tctcgacctggccat

SEQ ID NO: 3463 - DNA, 15 bp, Artificial Sequence
  dgRNA
  Sstr5
gtcaggttgcctggg

SEQ ID NO: 3464 - DNA, 15 bp, Artificial Sequence
  dgRNA
  Gimap5
ctcaacaccccctga

SEQ ID NO: 3465 - DNA, 15 bp, Artificial Sequence
  dgRNA
  Gimap5
tcaacaccccctgaa

SEQ ID NO: 3466 - DNA, 15 bp, Artificial Sequence
  dgRNA
  Gimap5
atgagtagggccggg

SEQ ID NO: 3467 - DNA, 15 bp, Artificial Sequence
  dgRNA
  Gimap5
cgggaggctttccac

SEQ ID NO: 3468 - DNA, 15 bp, Artificial Sequence
  dgRNA
  Zfp81
caccaaatatactcc

SEQ ID NO: 3469 - DNA, 15 bp, Artificial Sequence
  dgRNA
  Zfp81
ctccgggtttactcc

SEQ ID NO: 3470 - DNA, 15 bp, Artificial Sequence
  dgRNA
  Zfp81
tccgggtttactcca

SEQ ID NO: 3471 - DNA, 15 bp, Artificial Sequence
  dgRNA
  Zfp81
ccgggtttactccag

SEQ ID NO: 3472 - DNA, 15 bp, Artificial Sequence
  dgRNA
  Arhgap27
agtgggagtctaatc

SEQ ID NO: 3473 - DNA, 15 bp, Artificial Sequence
  dgRNA
  Arhgap27
cgcagatctccatcc

SEQ ID NO: 3474 - DNA, 15 bp, Artificial Sequence
  dgRNA
  Arhgap27
tccccggagacagtc

SEQ ID NO: 3475 - DNA, 15 bp, Artificial Sequence
  dgRNA
  Arhgap27
ctgctcctagagcgc

SEQ ID NO: 3476 - DNA, 15 bp, Artificial Sequence
  dgRNA
  Olfr314
ggcgagatgtttgac

SEQ ID NO: 3477 - DNA, 15 bp, Artificial Sequence
  dgRNA
  Olfr314
aatactttgcaagca

SEQ ID NO: 3478 - DNA, 15 bp, Artificial Sequence
  dgRNA
  Zfp638
gaccgctgcaggtgt

SEQ ID NO: 3479 - DNA, 15 bp, Artificial Sequence
  dgRNA
  Zfp638
gcgatcgcccccttc

SEQ ID NO: 3480 - DNA, 15 bp, Artificial Sequence
  dgRNA
  Zfp638
ccccgacagcgtctc

SEQ ID NO: 3481 - DNA, 15 bp, Artificial Sequence
  dgRNA
  Zfp638
cgtctctggagaacg

SEQ ID NO: 3482 - DNA, 15 bp, Artificial Sequence
  dgRNA
  Ldb1
cttcctcctcgctcg

SEQ ID NO: 3483 - DNA, 15 bp, Artificial Sequence
  dgRNA
  Ldb1
ttcctcctcgctcgc

SEQ ID NO: 3484 - DNA, 15 bp, Artificial Sequence
  dgRNA
  Ldb1
tcctcctcgctcgcg

SEQ ID NO: 3485 - DNA, 15 bp, Artificial Sequence
  dgRNA
  Ldb1
tcctcgctcgcgggg

SEQ ID NO: 3486 - DNA, 15 bp, Artificial Sequence
  dgRNA
  Naa60
gcacgcaagggcagc

SEQ ID NO: 3487 - DNA, 15 bp, Artificial Sequence
  dgRNA
  Naa60
cacgcaagggcagct

SEQ ID NO: 3488 - DNA, 15 bp, Artificial Sequence
  dgRNA
  Naa60
cttccgccgccagtg

SEQ ID NO: 3489 - DNA, 15 bp, Artificial Sequence
  dgRNA
  Naa60
ttccgccgccagtgc

SEQ ID NO: 3490 - DNA, 15 bp, Artificial Sequence
  dgRNA
  Dtx3
ggctcccgggtagga

SEQ ID NO: 3491 - DNA, 15 bp, Artificial Sequence
  dgRNA
  Dtx3
gctcccgggtaggag

SEQ ID NO: 3492 - DNA, 15 bp, Artificial Sequence
  dgRNA
  Dtx3
ctcccgggtaggagg

SEQ ID NO: 3493 - DNA, 15 bp, Artificial Sequence
  dgRNA
  Dtx3
gattatcacccacca

SEQ ID NO: 3494 - DNA, 15 bp, Artificial Sequence
  dgRNA
  S100a14
tcctcctcatgatag

SEQ ID NO: 3495 - DNA, 15 bp, Artificial Sequence
  dgRNA
  S100a14
tcctcatgatagggg

SEQ ID NO: 3496 - DNA, 15 bp, Artificial Sequence
  dgRNA
  S100a14
cctcatgataggggt

SEQ ID NO: 3497 - DNA, 15 bp, Artificial Sequence
  dgRNA
  S100a14
ggaggctgcaatagc

SEQ ID NO: 3498 - DNA, 15 bp, Artificial Sequence
  dgRNA
  Soga1
cccgcctgaccctcg

SEQ ID NO: 3499 - DNA, 15 bp, Artificial Sequence
  dgRNA
  Soga1
ccgcctgaccctcga

SEQ ID NO: 3500 - DNA, 15 bp, Artificial Sequence
  dgRNA
  Soga1
cgcctgaccctcgag

SEQ ID NO: 3501 - DNA, 15 bp, Artificial Sequence
  dgRNA
  Soga1
gtcgctgttgcctcg

SEQ ID NO: 3502 - DNA, 15 bp, Artificial Sequence
  dgRNA
  Pxdc1
gcctcgcctagcagt

SEQ ID NO: 3503 - DNA, 15 bp, Artificial Sequence
  dgRNA
  Pxdc1
agcagttggcagacc

SEQ ID NO: 3504 - DNA, 15 bp, Artificial Sequence
  dgRNA
  Pxdc1
atttgcgtgcagctc

SEQ ID NO: 3505 - DNA, 15 bp, Artificial Sequence
  dgRNA
  Pxdc1
tttgcgtgcagctct

SEQ ID NO: 3506 - DNA, 15 bp, Artificial Sequence
  dgRNA
  Pcdhgb8
gactccatgctctac

SEQ ID NO: 3507 - DNA, 15 bp, Artificial Sequence
  dgRNA
  Pcdhgb8
ctgtacattcactgg

SEQ ID NO: 3508 - DNA, 15 bp, Artificial Sequence
  dgRNA
  Pcdhgb8
aggcttaaagagtag

SEQ ID NO: 3509 - DNA, 15 bp, Artificial Sequence
  dgRNA
  Pcdhgb8
tgatatcctcaaacg

SEQ ID NO: 3510 - DNA, 15 bp, Artificial Sequence
  dgRNA
  Ifitm7
gctgttgtgcaacac

SEQ ID NO: 3511 - DNA, 15 bp, Artificial Sequence
  dgRNA
  Ifitm7
tgccagcctgcgttc

SEQ ID NO: 3512 - DNA, 15 bp, Artificial Sequence
  dgRNA
  Ifitm7
gttccggtctgctct

SEQ ID NO: 3513 - DNA, 15 bp, Artificial Sequence
  dgRNA
  Ifitm7
ttccggtctgctcta

SEQ ID NO: 3514 - DNA, 15 bp, Artificial Sequence
  dgRNA
  Kctd16
atcttacctcactcg

SEQ ID NO: 3515 - DNA, 15 bp, Artificial Sequence
  dgRNA
  Kctd16
cagttgaaataatgc

SEQ ID NO: 3516 - DNA, 15 bp, Artificial Sequence
  dgRNA
  Kctd16
ttgcatccacgagtg

SEQ ID NO: 3517 - DNA, 15 bp, Artificial Sequence
  dgRNA
  Ikzf1
aagtttgcacggtgc

SEQ ID NO: 3518 - DNA, 15 bp, Artificial Sequence
  dgRNA
  Ikzf1
agtttgcacggtgcg

SEQ ID NO: 3519 - DNA, 15 bp, Artificial Sequence
  dgRNA
  Ikzf1
gcacggtgcggggcg

SEQ ID NO: 3520 - DNA, 15 bp, Artificial Sequence
  dgRNA
  Ikzf1
cacggtgcggggcga

SEQ ID NO: 3521 - DNA, 15 bp, Artificial Sequence
  dgRNA
  Nme6
gtgtaaacaagctgc

SEQ ID NO: 3522 - DNA, 15 bp, Artificial Sequence
  dgRNA
  Nme6
gcagcgccagactgc

SEQ ID NO: 3523 - DNA, 15 bp, Artificial Sequence
  dgRNA
  Nme6
actgcaggatccgga

SEQ ID NO: 3524 - DNA, 15 bp, Artificial Sequence
  dgRNA
  Nme6
ctgccgcgtgcctga

SEQ ID NO: 3525 - DNA, 15 bp, Artificial Sequence
  dgRNA
  Siglecg
agtcactatatttct

SEQ ID NO: 3526 - DNA, 15 bp, Artificial Sequence
  dgRNA
  Siglecg
gagagcgagacctcc

SEQ ID NO: 3527 - DNA, 15 bp, Artificial Sequence
  dgRNA
  Slu7
atcacttcgcctttc

SEQ ID NO: 3528 - DNA, 15 bp, Artificial Sequence
  dgRNA
  Slu7
catgtgccgatctcc

SEQ ID NO: 3529 - DNA, 15 bp, Artificial Sequence
  dgRNA
  Slu7
ttatctctgcgcagc

SEQ ID NO: 3530 - DNA, 15 bp, Artificial Sequence
  dgRNA
  Slu7
tgcgcagccggaaga

SEQ ID NO: 3531 - DNA, 15 bp, Artificial Sequence
  dgRNA
  Cd36
ccattctaggacact

SEQ ID NO: 3532 - DNA, 15 bp, Artificial Sequence
  dgRNA
  Cd36
aatgaactgctcctt

SEQ ID NO: 3533 - DNA, 15 bp, Artificial Sequence
  dgRNA
  Ireb2
agttactaacctccc

SEQ ID NO: 3534 - DNA, 15 bp, Artificial Sequence
  dgRNA
  Ireb2
gttactaacctccca

SEQ ID NO: 3535 - DNA, 15 bp, Artificial Sequence
  dgRNA
  Ireb2
gacccgcctacccgc

SEQ ID NO: 3536 - DNA, 15 bp, Artificial Sequence
  dgRNA
  Ireb2
tgtttcgccggtccg

SEQ ID NO: 3537 - DNA, 15 bp, Artificial Sequence
  dgRNA
  Hapln4
ctcaattccccgtgc

SEQ ID NO: 3538 - DNA, 15 bp, Artificial Sequence
  dgRNA
  Hapln4
tcaattccccgtgct

SEQ ID NO: 3539 - DNA, 15 bp, Artificial Sequence
  dgRNA
  Hapln4
aattccccgtgctgg

SEQ ID NO: 3540 - DNA, 15 bp, Artificial Sequence
  dgRNA
  Hapln4
ttgcaggcagacgcc

SEQ ID NO: 3541 - DNA, 15 bp, Artificial Sequence
  dgRNA
  Olfr633
gctgcattttatgtc

SEQ ID NO: 3542 - DNA, 15 bp, Artificial Sequence
  dgRNA
  Olfr633
gactttggtttgaca

SEQ ID NO: 3543 - DNA, 15 bp, Artificial Sequence
  dgRNA
  Olfr633
ggactttggtttgac

SEQ ID NO: 3544 - DNA, 15 bp, Artificial Sequence
  dgRNA
  Chst1
gctgcctcggcccgc

SEQ ID NO: 3545 - DNA, 15 bp, Artificial Sequence
  dgRNA
  Chst1
gcctcggcccgccgg

SEQ ID NO: 3546 - DNA, 15 bp, Artificial Sequence
  dgRNA
  Chst1
cctcggcccgccggt

SEQ ID NO: 3547 - DNA, 15 bp, Artificial Sequence
  dgRNA
  Chst1
ggcccgccggtgggt

SEQ ID NO: 3548 - DNA, 15 bp, Artificial Sequence
  dgRNA
  Ccna1
ggcgcacgcccgccg

SEQ ID NO: 3549 - DNA, 15 bp, Artificial Sequence
  dgRNA
  Ccna1
cacgcccgccgcggt

SEQ ID NO: 3550 - DNA, 15 bp, Artificial Sequence
  dgRNA
  Ccna1
ccgccgcggttggca

SEQ ID NO: 3551 - DNA, 15 bp, Artificial Sequence
  dgRNA
  Ccna1
tggaagcggctctgc

SEQ ID NO: 3552 - DNA, 15 bp, Artificial Sequence
  dgRNA
  Ppat
aacaagggcgaccac

SEQ ID NO: 3553 - DNA, 15 bp, Artificial Sequence
  dgRNA
  Ppat
cgaccacaggatcag

SEQ ID NO: 3554 - DNA, 15 bp, Artificial Sequence
  dgRNA
  Ppat
atcagagggcgggaa

SEQ ID NO: 3555 - DNA, 15 bp, Artificial Sequence
  dgRNA
  Ppat
tcagagggcgggaaa

SEQ ID NO: 3556 - DNA, 15 bp, Artificial Sequence
  dgRNA
  Whamm
cgccggtgttgtaaa

SEQ ID NO: 3557 - DNA, 15 bp, Artificial Sequence
  dgRNA
  Whamm
gccggtgttgtaaaa

SEQ ID NO: 3558 - DNA, 15 bp, Artificial Sequence
  dgRNA
  Whamm
agcctatcagaatga

SEQ ID NO: 3559 - DNA, 15 bp, Artificial Sequence
  dgRNA
  Whamm
gcctatcagaatgag

SEQ ID NO: 3560 - DNA, 15 bp, Artificial Sequence
  dgRNA
  Adam21
taactaattctggga

SEQ ID NO: 3561 - DNA, 15 bp, Artificial Sequence
  dgRNA
  Adam21
tttagtaactaattc

SEQ ID NO: 3562 - DNA, 15 bp, Artificial Sequence
  dgRNA
  Lrit3
gccatattcaaaggc

SEQ ID NO: 3563 - DNA, 15 bp, Artificial Sequence
  dgRNA
  Lrit3
aggttaagtaacttc

SEQ ID NO: 3564 - DNA, 15 bp, Artificial Sequence
  dgRNA
  Lrit3
ggtctcgggctaatc

SEQ ID NO: 3565 - DNA, 15 bp, Artificial Sequence
  dgRNA
  Lrit3
ggcggcgggcattcg

SEQ ID NO: 3566 - DNA, 15 bp, Artificial Sequence
  dgRNA
  Itih4
aagtttactggacat

SEQ ID NO: 3567 - DNA, 15 bp, Artificial Sequence
  dgRNA
  Itih4
agaacttgcaccagc

SEQ ID NO: 3568 - DNA, 15 bp, Artificial Sequence
  dgRNA
  Itih4
gaacttgcaccagca

SEQ ID NO: 3569 - DNA, 15 bp, Artificial Sequence
  dgRNA
  Itih4
aacttgcaccagcag

SEQ ID NO: 3570 - DNA, 15 bp, Artificial Sequence
  dgRNA
  Cyp4a30b
tcccctcccacggga

SEQ ID NO: 3571 - DNA, 15 bp, Artificial Sequence
  dgRNA
  Cyp4a30b
ctcccacgggaaggt

SEQ ID NO: 3572 - DNA, 15 bp, Artificial Sequence
  dgRNA
  Cyp4a30b
tgccatacttaaatg

SEQ ID NO: 3573 - DNA, 15 bp, Artificial Sequence
  dgRNA
  Cyp4a30b
gccatacttaaatgt

SEQ ID NO: 3574 - DNA, 15 bp, Artificial Sequence
  dgRNA
  Mob3b
acctacattgggcag

SEQ ID NO: 3575 - DNA, 15 bp, Artificial Sequence
  dgRNA
  Mob3b
gattagaggatccta

SEQ ID NO: 3576 - DNA, 15 bp, Artificial Sequence
  dgRNA
  Mob3b
attagaggatcctaa

SEQ ID NO: 3577 - DNA, 15 bp, Artificial Sequence
  dgRNA
  Mob3b
gatcctaagggcaac

SEQ ID NO: 3578 - DNA, 15 bp, Artificial Sequence
  dgRNA
  Mif4gd
gcactccgctttaac

SEQ ID NO: 3579 - DNA, 15 bp, Artificial Sequence
  dgRNA
  Mif4gd
cccacgctgcccggc

SEQ ID NO: 3580 - DNA, 15 bp, Artificial Sequence
  dgRNA
  Mif4gd
ccacgctgcccggcc

SEQ ID NO: 3581 - DNA, 15 bp, Artificial Sequence
  dgRNA
  Mif4gd
cacgctgcccggccg

SEQ ID NO: 3582 - DNA, 15 bp, Artificial Sequence
  dgRNA
  Eno3
gggggtacacgcccc

SEQ ID NO: 3583 - DNA, 15 bp, Artificial Sequence
  dgRNA
  Eno3
ggggtacacgcccca

SEQ ID NO: 3584 - DNA, 15 bp, Artificial Sequence
  dgRNA
  Eno3
aggagcttttgcttc

SEQ ID NO: 3585 - DNA, 15 bp, Artificial Sequence
  dgRNA
  Eno3
gcttcgggctgcagt

SEQ ID NO: 3586 - DNA, 15 bp, Artificial Sequence
  dgRNA
  Olfr1341
ttgagagggttataa

SEQ ID NO: 3587 - DNA, 15 bp, Artificial Sequence
  dgRNA
  Olfr1341
acctaaccccaactt

SEQ ID NO: 3588 - DNA, 15 bp, Artificial Sequence
  dgRNA
  Olfr1341
gccccctgtgtgaat

SEQ ID NO: 3589 - DNA, 15 bp, Artificial Sequence
  dgRNA
  Olfr1341
tctggaaccactccc

SEQ ID NO: 3590 - DNA, 15 bp, Artificial Sequence
  dgRNA
  Tas2r124
gattaaatgccaaat

SEQ ID NO: 3591 - DNA, 15 bp, Artificial Sequence
  dgRNA
  Tas2r124
cgttcaatcagtata

SEQ ID NO: 3592 - DNA, 15 bp, Artificial Sequence
  dgRNA
  Tas2r124
gttcaatcagtataa

SEQ ID NO: 3593 - DNA, 15 bp, Artificial Sequence
  dgRNA
  Tas2r124
ttcaatcagtataag

SEQ ID NO: 3594 - DNA, 15 bp, Artificial Sequence
  dgRNA
  Tex36
aattctgcacgtgct

SEQ ID NO: 3595 - DNA, 15 bp, Artificial Sequence
  dgRNA
  Tex36
attctgcacgtgctt

SEQ ID NO: 3596 - DNA, 15 bp, Artificial Sequence
  dgRNA
  Tex36
ttctgcacgtgcttg

SEQ ID NO: 3597 - DNA, 15 bp, Artificial Sequence
  dgRNA
  Tex36
ggggaacccaatgta

SEQ ID NO: 3598 - DNA, 15 bp, Artificial Sequence
  dgRNA
  Cmtm4
gtgggggcgtgacta

SEQ ID NO: 3599 - DNA, 15 bp, Artificial Sequence
  dgRNA
  Cmtm4
actaaggctcctcac

SEQ ID NO: 3600 - DNA, 15 bp, Artificial Sequence
  dgRNA
  Cmtm4
agtctccgccccctc

SEQ ID NO: 3601 - DNA, 15 bp, Artificial Sequence
  dgRNA
  Cmtm4
ctccgggccggcgcg

SEQ ID NO: 3602 - DNA, 15 bp, Artificial Sequence
  dgRNA
  Kcna1
caacccacgcccggg

SEQ ID NO: 3603 - DNA, 15 bp, Artificial Sequence
  dgRNA
  Kcna1
aacccacgcccgggt

SEQ ID NO: 3604 - DNA, 15 bp, Artificial Sequence
  dgRNA
  Kcna1
gctgctccgcattcc

SEQ ID NO: 3605 - DNA, 15 bp, Artificial Sequence
  dgRNA
  Kcna1
tccaggcgctttctc

SEQ ID NO: 3606 - DNA, 15 bp, Artificial Sequence
  dgRNA
  Fen1
ggagtaacgggaact

SEQ ID NO: 3607 - DNA, 15 bp, Artificial Sequence
  dgRNA
  Fen1
ggaactaggactatg

SEQ ID NO: 3608 - DNA, 15 bp, Artificial Sequence
  dgRNA
  Fen1
gtcggactgtgggaa

SEQ ID NO: 3609 - DNA, 15 bp, Artificial Sequence
  dgRNA
  Fen1
tcggactgtgggaaa

SEQ ID NO: 3610 - DNA, 15 bp, Artificial Sequence
  dgRNA
  Plin3
cctccatctaggatc

SEQ ID NO: 3611 - DNA, 15 bp, Artificial Sequence
  dgRNA
  Plin3
ctaatgcaagcaacc

SEQ ID NO: 3612 - DNA, 15 bp, Artificial Sequence
  dgRNA
  Plin3
taatgcaagcaacct

SEQ ID NO: 3613 - DNA, 15 bp, Artificial Sequence
  dgRNA
  Plin3
ctgggtcgccttaga

SEQ ID NO: 3614 - DNA, 15 bp, Artificial Sequence
  dgRNA
  Fam214a
ttgggacacgtgacc

SEQ ID NO: 3615 - DNA, 15 bp, Artificial Sequence
  dgRNA
  Fam214a
tgggacacgtgacca

SEQ ID NO: 3616 - DNA, 15 bp, Artificial Sequence
  dgRNA
  Fam214a
gggtagtgttttgac

SEQ ID NO: 3617 - DNA, 15 bp, Artificial Sequence
  dgRNA
  Fam214a
ggtagtgttttgaca

SEQ ID NO: 3618 - DNA, 15 bp, Artificial Sequence
  dgRNA
  Prdx4
tacaccttcaaggac

SEQ ID NO: 3619 - DNA, 15 bp, Artificial Sequence
  dgRNA
  Prdx4
ctctccttttgacgc

SEQ ID NO: 3620 - DNA, 15 bp, Artificial Sequence
  dgRNA
  Prdx4
ggcgcagaagcccac

SEQ ID NO: 3621 - DNA, 15 bp, Artificial Sequence
  dgRNA
  Prdx4
gcgcagaagcccact

SEQ ID NO: 3622 - DNA, 15 bp, Artificial Sequence
  dgRNA
  Pusl1
ggacacactccgcga

SEQ ID NO: 3623 - DNA, 15 bp, Artificial Sequence
  dgRNA
  Pusl1
cacactccgcgacgg

SEQ ID NO: 3624 - DNA, 15 bp, Artificial Sequence
  dgRNA
  Pusl1
actccgcgacggcgg

SEQ ID NO: 3625 - DNA, 15 bp, Artificial Sequence
  dgRNA
  Pusl1
ctccgcgacggcggc

SEQ ID NO: 3626 - DNA, 15 bp, Artificial Sequence
  dgRNA
  Col2a1
gtgccccgcccgatc

SEQ ID NO: 3627 - DNA, 15 bp, Artificial Sequence
  dgRNA
  Col2a1
gcccgatcaggccac

SEQ ID NO: 3628 - DNA, 15 bp, Artificial Sequence
  dgRNA
  Col2a1
cccgatcaggccact

SEQ ID NO: 3629 - DNA, 15 bp, Artificial Sequence
  dgRNA
  Col2a1
ccactgggcacattg

SEQ ID NO: 3630 - DNA, 15 bp, Artificial Sequence
  dgRNA
  Luc7l
actcaagcctgatcc

SEQ ID NO: 3631 - DNA, 15 bp, Artificial Sequence
  dgRNA
  Luc7l
caggcataccacgac

SEQ ID NO: 3632 - DNA, 15 bp, Artificial Sequence
  dgRNA
  Luc7l
tgtacacttcccgac

SEQ ID NO: 3633 - DNA, 15 bp, Artificial Sequence
  dgRNA
  Luc7l
agcattccccgcggc

SEQ ID NO: 3634 - DNA, 15 bp, Artificial Sequence
  dgRNA
  Acp2
cgaaggctgcacttc

SEQ ID NO: 3635 - DNA, 15 bp, Artificial Sequence
  dgRNA
  Acp2
ccttacgaatgcatc

SEQ ID NO: 3636 - DNA, 15 bp, Artificial Sequence
  dgRNA
  Acp2
cttacgaatgcatcc

SEQ ID NO: 3637 - DNA, 15 bp, Artificial Sequence
  dgRNA
  Acp2
acgaatgcatccggg

SEQ ID NO: 3638 - DNA, 15 bp, Artificial Sequence
  dgRNA
  Fxyd6
acagccaatgaacgc

SEQ ID NO: 3639 - DNA, 15 bp, Artificial Sequence
  dgRNA
  Fxyd6
atgaacgcaggttgc

SEQ ID NO: 3640 - DNA, 15 bp, Artificial Sequence
  dgRNA
  Fxyd6
aacgcaggttgcagg

SEQ ID NO: 3641 - DNA, 15 bp, Artificial Sequence
  dgRNA
  Fxyd6
gccctgtcacggtgt

SEQ ID NO: 3642 - DNA, 15 bp, Artificial Sequence
  dgRNA
  Gli2
gcagggtgcacgcgg

SEQ ID NO: 3643 - DNA, 15 bp, Artificial Sequence
  dgRNA
  Gli2
cagggtgcacgcggc

SEQ ID NO: 3644 - DNA, 15 bp, Artificial Sequence
  dgRNA
  Gli2
agggtgcacgcggcg

SEQ ID NO: 3645 - DNA, 15 bp, Artificial Sequence
  dgRNA
  Gli2
gtgcacgcggcgggg

SEQ ID NO: 3646 - DNA, 15 bp, Artificial Sequence
  dgRNA
  Nfib
tacctttaacaaatg

SEQ ID NO: 3647 - DNA, 15 bp, Artificial Sequence
  dgRNA
  Nfib
agggggagagacgcg

SEQ ID NO: 3648 - DNA, 15 bp, Artificial Sequence
  dgRNA
  Nfib
gggggagagacgcga

SEQ ID NO: 3649 - DNA, 15 bp, Artificial Sequence
  dgRNA
  Nfib
gagagacgcgagggc

SEQ ID NO: 3650 - DNA, 15 bp, Artificial Sequence
  dgRNA
  Kif18b
ctagagactcgattc

SEQ ID NO: 3651 - DNA, 15 bp, Artificial Sequence
  dgRNA
  Kif18b
gagactcgattctgg

SEQ ID NO: 3652 - DNA, 15 bp, Artificial Sequence
  dgRNA
  Kif18b
caattccgctccgtc

SEQ ID NO: 3653 - DNA, 15 bp, Artificial Sequence
  dgRNA
  Kif18b
ccgtccggtttgatt

SEQ ID NO: 3654 - DNA, 15 bp, Artificial Sequence
  dgRNA
  Arl6ip1
agagactaggtacgg

SEQ ID NO: 3655 - DNA, 15 bp, Artificial Sequence
  dgRNA
  Arl6ip1
ccgctccgcctctcg

SEQ ID NO: 3656 - DNA, 15 bp, Artificial Sequence
  dgRNA
  Arl6ip1
cgctccgcctctcga

SEQ ID NO: 3657 - DNA, 15 bp, Artificial Sequence
  dgRNA
  Arl6ip1
cgctctcctttgacc

SEQ ID NO: 3658 - DNA, 15 bp, Artificial Sequence
  dgRNA
  Clip4
gtgtgcacttacctc

SEQ ID NO: 3659 - DNA, 15 bp, Artificial Sequence
  dgRNA
  Clip4
ggacatccattcata

SEQ ID NO: 3660 - DNA, 15 bp, Artificial Sequence
  dgRNA
  Clip4
tagttaccacacgat

SEQ ID NO: 3661 - DNA, 15 bp, Artificial Sequence
  dgRNA
  Clip4
agttaccacacgata

SEQ ID NO: 3662 - DNA, 15 bp, Artificial Sequence
  dgRNA
  Tle3
gcgcacgcccgactc

SEQ ID NO: 3663 - DNA, 15 bp, Artificial Sequence
  dgRNA
  Tle3
cgcacgcccgactct

SEQ ID NO: 3664 - DNA, 15 bp, Artificial Sequence
  dgRNA
  Tle3
atttcgctgcgagag

SEQ ID NO: 3665 - DNA, 15 bp, Artificial Sequence
  dgRNA
  Tle3
tttcgctgcgagagc

SEQ ID NO: 3666 - DNA, 15 bp, Artificial Sequence
  dgRNA
  Rhbdf2
agccccgcctcaatg

SEQ ID NO: 3667 - DNA, 15 bp, Artificial Sequence
  dgRNA
  Rhbdf2
cctgcgccctcgcgc

SEQ ID NO: 3668 - DNA, 15 bp, Artificial Sequence
  dgRNA
  Rhbdf2
cgccctcgcgcaggt

SEQ ID NO: 3669 - DNA, 15 bp, Artificial Sequence
  dgRNA
  Rhbdf2
gccctcgcgcaggta

SEQ ID NO: 3670 - DNA, 15 bp, Artificial Sequence
  dgRNA
  Ccdc174
gacgacgtagcgact

SEQ ID NO: 3671 - DNA, 15 bp, Artificial Sequence
  dgRNA
  Ccdc174
acgacgtagcgacta

SEQ ID NO: 3672 - DNA, 15 bp, Artificial Sequence
  dgRNA
  Ccdc174
ctgacgctttcaaga

SEQ ID NO: 3673 - DNA, 15 bp, Artificial Sequence
  dgRNA
  Ccdc174
ttcaagatggcgccg

SEQ ID NO: 3674 - DNA, 15 bp, Artificial Sequence
  dgRNA
  Pcnp
gaccaccgctgagcg

SEQ ID NO: 3675 - DNA, 15 bp, Artificial Sequence
  dgRNA
  Pcnp
agcgtggaagcacct

SEQ ID NO: 3676 - DNA, 15 bp, Artificial Sequence
  dgRNA
  Pcnp
ccaccgttccacgat

SEQ ID NO: 3677 - DNA, 15 bp, Artificial Sequence
  dgRNA
  Pcnp
gagtccgtactaacc

SEQ ID NO: 3678 - DNA, 15 bp, Artificial Sequence
  dgRNA
  Vmn1r8
tatgatgcacagtcc

SEQ ID NO: 3679 - DNA, 15 bp, Artificial Sequence
  dgRNA
  Tmem169
agcaacccggccgct

SEQ ID NO: 3680 - DNA, 15 bp, Artificial Sequence
  dgRNA
  Tmem169
attagtagcagtcct

SEQ ID NO: 3681 - DNA, 15 bp, Artificial Sequence
  dgRNA
  Tmem169
gcccctaagtccgcg

SEQ ID NO: 3682 - DNA, 15 bp, Artificial Sequence
  dgRNA
  Tmem169
gcgtggtcccgcctc

SEQ ID NO: 3683 - DNA, 15 bp, Artificial Sequence
  dgRNA
  Cdc7
cgagagagaacgcta

SEQ ID NO: 3684 - DNA, 15 bp, Artificial Sequence
  dgRNA
  Cdc7
gagaacgctaaggac

SEQ ID NO: 3685 - DNA, 15 bp, Artificial Sequence
  dgRNA
  Cdc7
agaacgctaaggacc

SEQ ID NO: 3686 - DNA, 15 bp, Artificial Sequence
  dgRNA
  Cdc7
ctaaggaccgggcga

SEQ ID NO: 3687 - DNA, 15 bp, Artificial Sequence
  dgRNA
  Yipf6
gggctccattgggct

SEQ ID NO: 3688 - DNA, 15 bp, Artificial Sequence
  dgRNA
  Yipf6
gggctcggcttcatt

SEQ ID NO: 3689 - DNA, 15 bp, Artificial Sequence
  dgRNA
  Yipf6
cggcttcattcggct

SEQ ID NO: 3690 - DNA, 15 bp, Artificial Sequence
  dgRNA
  Yipf6
tcattcggctaggtt

SEQ ID NO: 3691 - DNA, 15 bp, Artificial Sequence
  dgRNA
  Gimap6
ccgagacaagctttc

SEQ ID NO: 3692 - DNA, 15 bp, Artificial Sequence
  dgRNA
  Gimap6
gtaagcggaagtgac

SEQ ID NO: 3693 - DNA, 15 bp, Artificial Sequence
  dgRNA
  Gimap6
gcttgtctcgggaac

SEQ ID NO: 3694 - DNA, 15 bp, Artificial Sequence
  dgRNA
  Gimap6
ttccgcttacagcct

SEQ ID NO: 3695 - DNA, 15 bp, Artificial Sequence
  dgRNA
  Olr1
gtcatgaagcatgac

SEQ ID NO: 3696 - DNA, 15 bp, Artificial Sequence
  dgRNA
  Olr1
cctttcctcccgcga

SEQ ID NO: 3697 - DNA, 15 bp, Artificial Sequence
  dgRNA
  Olr1
ggttgtgtctcttgt

SEQ ID NO: 3698 - DNA, 15 bp, Artificial Sequence
  dgRNA
  Olr1
ccgtcgcgggaggaa

SEQ ID NO: 3699 - DNA, 15 bp, Artificial Sequence
  dgRNA
  Ribc2
acgagcagcagctca

SEQ ID NO: 3700 - DNA, 15 bp, Artificial Sequence
  dgRNA
  Ribc2
gctcaaggtgcccca

SEQ ID NO: 3701 - DNA, 15 bp, Artificial Sequence
  dgRNA
  Ribc2
cctcgtgctcccgtg

SEQ ID NO: 3702 - DNA, 15 bp, Artificial Sequence
  dgRNA
  Ribc2
gaagtctcgcgagac

SEQ ID NO: 3703 - DNA, 15 bp, Artificial Sequence
  dgRNA
  Rnf139
agatggtggctccgc

SEQ ID NO: 3704 - DNA, 15 bp, Artificial Sequence
  dgRNA
  Rnf139
tggtggctccgctgg

SEQ ID NO: 3705 - DNA, 15 bp, Artificial Sequence
  dgRNA
  Rnf139
ggtggctccgctggc

SEQ ID NO: 3706 - DNA, 15 bp, Artificial Sequence
  dgRNA
  Rnf139
gtggctccgctggcg

SEQ ID NO: 3707 - DNA, 15 bp, Artificial Sequence
  dgRNA
  D930020B18Rik
gtgaggacgaagttt

SEQ ID NO: 3708 - DNA, 15 bp, Artificial Sequence
  dgRNA
  D930020B18Rik
gaggacgaagtttag

SEQ ID NO: 3709 - DNA, 15 bp, Artificial Sequence
  dgRNA
  D930020B18Rik
gacgaagtttagggg

SEQ ID NO: 3710 - DNA, 15 bp, Artificial Sequence
  dgRNA
  D930020B18Rik
acgaagtttaggggc

SEQ ID NO: 3711 - DNA, 15 bp, Artificial Sequence
  dgRNA
  Exph5
actttgcatctcggt

SEQ ID NO: 3712 - DNA, 15 bp, Artificial Sequence
  dgRNA
  Exph5
gcatctcggttggac

SEQ ID NO: 3713 - DNA, 15 bp, Artificial Sequence
  dgRNA
  Exph5
ggagccctgtatgtg

SEQ ID NO: 3714 - DNA, 15 bp, Artificial Sequence
  dgRNA
  Exph5
tgtgggctggtcccg

SEQ ID NO: 3715 - DNA, 15 bp, Artificial Sequence
  dgRNA
  Robo2
ctgggttcattcgga

SEQ ID NO: 3716 - DNA, 15 bp, Artificial Sequence
  dgRNA
  Robo2
ccttaattaatctct

SEQ ID NO: 3717 - DNA, 15 bp, Artificial Sequence
  dgRNA
  Robo2
ggaaagtctaaactt

SEQ ID NO: 3718 - DNA, 15 bp, Artificial Sequence
  dgRNA
  Robo2
acgttgcacttccac

SEQ ID NO: 3719 - DNA, 15 bp, Artificial Sequence
  dgRNA
  Ints3
cgcctccagatgcag

SEQ ID NO: 3720 - DNA, 15 bp, Artificial Sequence
  dgRNA
  Ints3
ctacaattggcagcc

SEQ ID NO: 3721 - DNA, 15 bp, Artificial Sequence
  dgRNA
  Ints3
ccagtccgccgtcgt

SEQ ID NO: 3722 - DNA, 15 bp, Artificial Sequence
  dgRNA
  Ints3
tactccttagagacc

SEQ ID NO: 3723 - DNA, 15 bp, Artificial Sequence
  dgRNA
  Rab11fip2
gcgtccctccgacac

SEQ ID NO: 3724 - DNA, 15 bp, Artificial Sequence
  dgRNA
  Rab11fip2
ctccgacaccggtcc

SEQ ID NO: 3725 - DNA, 15 bp, Artificial Sequence
  dgRNA
  Rab11fip2
gacaccggtccaggt

SEQ ID NO: 3726 - DNA, 15 bp, Artificial Sequence
  dgRNA
  Rab11fip2
ccgccccgctcgccc

SEQ ID NO: 3727 - DNA, 15 bp, Artificial Sequence
  dgRNA
  Rnpc3
taaagcacgactcct

SEQ ID NO: 3728 - DNA, 15 bp, Artificial Sequence
  dgRNA
  Rnpc3
gagcgactctcccgg

SEQ ID NO: 3729 - DNA, 15 bp, Artificial Sequence
  dgRNA
  Rnpc3
gaggccattctcgcg

SEQ ID NO: 3730 - DNA, 15 bp, Artificial Sequence
  dgRNA
  Rnpc3
ggagttctcctctcg

SEQ ID NO: 3731 - DNA, 15 bp, Artificial Sequence
  dgRNA
  A630001G21Rik
agctaaatatgatta

SEQ ID NO: 3732 - DNA, 15 bp, Artificial Sequence
  dgRNA
  A630001G21Rik
tgattatggtccaag

SEQ ID NO: 3733 - DNA, 15 bp, Artificial Sequence
  dgRNA
  A630001G21Rik
ggtccaagtggtttc

SEQ ID NO: 3734 - DNA, 15 bp, Artificial Sequence
  dgRNA
  A630001G21Rik
aagtgctaccaccag

SEQ ID NO: 3735 - DNA, 15 bp, Artificial Sequence
  dgRNA
  Fga
tttgcaacaacttat

SEQ ID NO: 3736 - DNA, 15 bp, Artificial Sequence
  dgRNA
  Fga
ataccttggttatta

SEQ ID NO: 3737 - DNA, 15 bp, Artificial Sequence
  dgRNA
  Fga
gggaatctacattcc

SEQ ID NO: 3738 - DNA, 15 bp, Artificial Sequence
  dgRNA
  Fga
ataagttgttgcaaa

SEQ ID NO: 3739 - DNA, 15 bp, Artificial Sequence
  dgRNA
  Emp1
gagggagctacaaca

SEQ ID NO: 3740 - DNA, 15 bp, Artificial Sequence
  dgRNA
  Emp1
ggctgccaacttagc

SEQ ID NO: 3741 - DNA, 15 bp, Artificial Sequence
  dgRNA
  Emp1
cggtcagatgtggct

SEQ ID NO: 3742 - DNA, 15 bp, Artificial Sequence
  dgRNA
  Emp1
ccggtcagatgtggc

SEQ ID NO: 3743 - DNA, 15 bp, Artificial Sequence
  dgRNA
  Sppl2b
agaccctcgatcccg

SEQ ID NO: 3744 - DNA, 15 bp, Artificial Sequence
  dgRNA
  Sppl2b
cacgtcgctctgcgc

SEQ ID NO: 3745 - DNA, 15 bp, Artificial Sequence
  dgRNA
  Sppl2b
cgcccttttctaacg

SEQ ID NO: 3746 - DNA, 15 bp, Artificial Sequence
  dgRNA
  Sppl2b
ccttttctaacgcgg

SEQ ID NO: 3747 - DNA, 15 bp, Artificial Sequence
  dgRNA
  Ip6k2
tgtgatggccaggtt

SEQ ID NO: 3748 - DNA, 15 bp, Artificial Sequence
  dgRNA
  Ip6k2
agtttaggggccccc

SEQ ID NO: 3749 - DNA, 15 bp, Artificial Sequence
  dgRNA
  Ip6k2
ctaaactgccaaacc

SEQ ID NO: 3750 - DNA, 15 bp, Artificial Sequence
  dgRNA
  Ip6k2
ggggcaaatactgat

SEQ ID NO: 3751 - DNA, 15 bp, Artificial Sequence
  dgRNA
  Mmp27
tcaagtttatctaag

SEQ ID NO: 3752 - DNA, 15 bp, Artificial Sequence
  dgRNA
  Mmp27
gcgctgacaatagca

SEQ ID NO: 3753 - DNA, 15 bp, Artificial Sequence
  dgRNA
  Mmp27
gttgacagtgagacg

SEQ ID NO: 3754 - DNA, 15 bp, Artificial Sequence
  dgRNA
  Nfatc4
caataggtaccatta

SEQ ID NO: 3755 - DNA, 15 bp, Artificial Sequence
  dgRNA
  Nfatc4
ttctataacgtttga

SEQ ID NO: 3756 - DNA, 15 bp, Artificial Sequence
  dgRNA
  Nfatc4
tggagagatgaccgg

SEQ ID NO: 3757 - DNA, 15 bp, Artificial Sequence
  dgRNA
  Nfatc4
gagatgaccgggggc

SEQ ID NO: 3758 - DNA, 15 bp, Artificial Sequence
  dgRNA
  Prtg
gggggttgtcgccat

SEQ ID NO: 3759 - DNA, 15 bp, Artificial Sequence
  dgRNA
  Prtg
gccataggatgcctc

SEQ ID NO: 3760 - DNA, 15 bp, Artificial Sequence
  dgRNA
  Prtg
cataggatgcctccg

SEQ ID NO: 3761 - DNA, 15 bp, Artificial Sequence
  dgRNA
  Prtg
ataggatgcctccgg

SEQ ID NO: 3762 - DNA, 15 bp, Artificial Sequence
  dgRNA
  Psmg1
cttcacccgcagctc

SEQ ID NO: 3763 - DNA, 15 bp, Artificial Sequence
  dgRNA
  Psmg1
ttcacccgcagctct

SEQ ID NO: 3764 - DNA, 15 bp, Artificial Sequence
  dgRNA
  Psmg1
ggtttcctccacggg

SEQ ID NO: 3765 - DNA, 15 bp, Artificial Sequence
  dgRNA
  Psmg1
gtttcctccacgggt

SEQ ID NO: 3766 - DNA, 15 bp, Artificial Sequence
  dgRNA
  Wnt2b
tgccatcaaacgcag

SEQ ID NO: 3767 - DNA, 15 bp, Artificial Sequence
  dgRNA
  Wnt2b
cgcgttgctgagtga

SEQ ID NO: 3768 - DNA, 15 bp, Artificial Sequence
  dgRNA
  Wnt2b
gcgttgctgagtgaa

SEQ ID NO: 3769 - DNA, 15 bp, Artificial Sequence
  dgRNA
  Wnt2b
tgagtgaagggcgct

SEQ ID NO: 3770 - DNA, 15 bp, Artificial Sequence
  dgRNA
  Timd2
gcaattataggagct

SEQ ID NO: 3771 - DNA, 15 bp, Artificial Sequence
  dgRNA
  Timd2
gtttcgtccggacag

SEQ ID NO: 3772 - DNA, 15 bp, Artificial Sequence
  dgRNA
  Timd2
gagaatggtttcgtc

SEQ ID NO: 3773 - DNA, 15 bp, Artificial Sequence
  dgRNA
  Timd2
actggaagggaaccg

SEQ ID NO: 3774 - DNA, 15 bp, Artificial Sequence
  dgRNA
  Grem2
aatacagagagcgac

SEQ ID NO: 3775 - DNA, 15 bp, Artificial Sequence
  dgRNA
  Grem2
atacagagagcgact

SEQ ID NO: 3776 - DNA, 15 bp, Artificial Sequence
  dgRNA
  Grem2
gttagatgagaagcg

SEQ ID NO: 3777 - DNA, 15 bp, Artificial Sequence
  dgRNA
  Grem2
ttagatgagaagcga

SEQ ID NO: 3778 - DNA, 15 bp, Artificial Sequence
  dgRNA
  Gskip
gacaagactccgacg

SEQ ID NO: 3779 - DNA, 15 bp, Artificial Sequence
  dgRNA
  Gskip
cctgagacacgctcc

SEQ ID NO: 3780 - DNA, 15 bp, Artificial Sequence
  dgRNA
  Gskip
cacgtactcgagcaa

SEQ ID NO: 3781 - DNA, 15 bp, Artificial Sequence
  dgRNA
  Gskip
acgtactcgagcaac

SEQ ID NO: 3782 - DNA, 15 bp, Artificial Sequence
  dgRNA
  4933425L06Rik
gccttaggcacagtc

SEQ ID NO: 3783 - DNA, 15 bp, Artificial Sequence
  dgRNA
  4933425L06Rik
cctgcgcatgcgaac

SEQ ID NO: 3784 - DNA, 15 bp, Artificial Sequence
  dgRNA
  4933425L06Rik
ctgcgcatgcgaaca

SEQ ID NO: 3785 - DNA, 15 bp, Artificial Sequence
  dgRNA
  4933425L06Rik
tgcgcagcacttgca

SEQ ID NO: 3786 - DNA, 15 bp, Artificial Sequence
  dgRNA
  Wdr41
ccactagattcgtcc

SEQ ID NO: 3787 - DNA, 15 bp, Artificial Sequence
  dgRNA
  Wdr41
gctagtgtgtttaag

SEQ ID NO: 3788 - DNA, 15 bp, Artificial Sequence
  dgRNA
  Wdr41
gcgccgtagctacac

SEQ ID NO: 3789 - DNA, 15 bp, Artificial Sequence
  dgRNA
  Wdr41
gatttagacaagcgc

SEQ ID NO: 3790 - DNA, 15 bp, Artificial Sequence
  dgRNA
  Tex264
ggagttccccttcat

SEQ ID NO: 3791 - DNA, 15 bp, Artificial Sequence
  dgRNA
  Tex264
tgggcccaacccagc

SEQ ID NO: 3792 - DNA, 15 bp, Artificial Sequence
  dgRNA
  Tex264
gggcccaacccagct

SEQ ID NO: 3793 - DNA, 15 bp, Artificial Sequence
  dgRNA
  Tex264
gcccaacccagctgg

SEQ ID NO: 3794 - DNA, 15 bp, Artificial Sequence
  dgRNA
  Trmt10a
gacccgagcttacac

SEQ ID NO: 3795 - DNA, 15 bp, Artificial Sequence
  dgRNA
  Trmt10a
cttacacaggcctgt

SEQ ID NO: 3796 - DNA, 15 bp, Artificial Sequence
  dgRNA
  Trmt10a
aatgcaacgcttgac

SEQ ID NO: 3797 - DNA, 15 bp, Artificial Sequence
  dgRNA
  Trmt10a
atgcaacgcttgacc

SEQ ID NO: 3798 - DNA, 15 bp, Artificial Sequence
  dgRNA
  Dpep3
gattagttagatttc

SEQ ID NO: 3799 - DNA, 15 bp, Artificial Sequence
  dgRNA
  Dpep3
aagcagagacccgcc

SEQ ID NO: 3800 - DNA, 15 bp, Artificial Sequence
  dgRNA
  Dpep3
gacccgccaggccca

SEQ ID NO: 3801 - DNA, 15 bp, Artificial Sequence
  dgRNA
  Dpep3
acccgccaggcccaa

SEQ ID NO: 3802 - DNA, 15 bp, Artificial Sequence
  dgRNA
  Tead3
cagcacctcccgctc

SEQ ID NO: 3803 - DNA, 15 bp, Artificial Sequence
  dgRNA
  Tead3
acctcccgctccggc

SEQ ID NO: 3804 - DNA, 15 bp, Artificial Sequence
  dgRNA
  Tead3
cctcccgctccggcc

SEQ ID NO: 3805 - DNA, 15 bp, Artificial Sequence
  dgRNA
  Tead3
tcattccgtacattc

SEQ ID NO: 3806 - DNA, 15 bp, Artificial Sequence
  dgRNA
  Rfx6
agcaatcctcttgac

SEQ ID NO: 3807 - DNA, 15 bp, Artificial Sequence
  dgRNA
  Rfx6
tcaattagtcccaga

SEQ ID NO: 3808 - DNA, 15 bp, Artificial Sequence
  dgRNA
  Rfx6
cctaaaggctccttc

SEQ ID NO: 3809 - DNA, 15 bp, Artificial Sequence
  dgRNA
  Rfx6
catcactaatcctaa

SEQ ID NO: 3810 - DNA, 15 bp, Artificial Sequence
  dgRNA
  Fam71f1
gaccggctgcccctt

SEQ ID NO: 3811 - DNA, 15 bp, Artificial Sequence
  dgRNA
  Fam71f1
tggccaaggcctaag

SEQ ID NO: 3812 - DNA, 15 bp, Artificial Sequence
  dgRNA
  Fam71f1
gctggccaaggccta

SEQ ID NO: 3813 - DNA, 15 bp, Artificial Sequence
  dgRNA
  Fam71f1
ctgatcatgggcagc

SEQ ID NO: 3814 - DNA, 15 bp, Artificial Sequence
  dgRNA
  Phyhipl
gtgcgcgtgtgcgca

SEQ ID NO: 3815 - DNA, 15 bp, Artificial Sequence
  dgRNA
  Phyhipl
tgcgcgtgtgcgcaa

SEQ ID NO: 3816 - DNA, 15 bp, Artificial Sequence
  dgRNA
  Phyhipl
gcgtgtgcgcaaggg

SEQ ID NO: 3817 - DNA, 15 bp, Artificial Sequence
  dgRNA
  Phyhipl
cgtgtgcgcaagggc

SEQ ID NO: 3818 - DNA, 15 bp, Artificial Sequence
  dgRNA
  Ccdc151
aacgtgcctccatct

SEQ ID NO: 3819 - DNA, 15 bp, Artificial Sequence
  dgRNA
  Ccdc151
acgtgcctccatctt

SEQ ID NO: 3820 - DNA, 15 bp, Artificial Sequence
  dgRNA
  Ccdc151
ggagtggcgggttac

SEQ ID NO: 3821 - DNA, 15 bp, Artificial Sequence
  dgRNA
  Ccdc151
tgccagcgaacacgc

SEQ ID NO: 3822 - DNA, 15 bp, Artificial Sequence
  dgRNA
  Lmo1
aaccttggtacccat

SEQ ID NO: 3823 - DNA, 15 bp, Artificial Sequence
  dgRNA
  Lmo1
agtcattcgccgaac

SEQ ID NO: 3824 - DNA, 15 bp, Artificial Sequence
  dgRNA
  Lmo1
ttcgccgaactggag

SEQ ID NO: 3825 - DNA, 15 bp, Artificial Sequence
  dgRNA
  Lmo1
agcggagaggcctcc

SEQ ID NO: 3826 - DNA, 15 bp, Artificial Sequence
  dgRNA
  Ret
catcagtaccgcaac

SEQ ID NO: 3827 - DNA, 15 bp, Artificial Sequence
  dgRNA
  Ret
ctccgagtccgcagc

SEQ ID NO: 3828 - DNA, 15 bp, Artificial Sequence
  dgRNA
  Ret
tccgagtccgcagct

SEQ ID NO: 3829 - DNA, 15 bp, Artificial Sequence
  dgRNA
  Ret
agtgcccgctgcgcc

SEQ ID NO: 3830 - DNA, 15 bp, Artificial Sequence
  dgRNA
  Olfr1295
tcatgaactttacct

SEQ ID NO: 3831 - DNA, 15 bp, Artificial Sequence
  dgRNA
  Olfr1295
catgaactttacctg

SEQ ID NO: 3832 - DNA, 15 bp, Artificial Sequence
  dgRNA
  Olfr1295
tgtcgacttctacaa

SEQ ID NO: 3833 - DNA, 15 bp, Artificial Sequence
  dgRNA
  Olfr1295
tataggcgaaaaatg

SEQ ID NO: 3834 - DNA, 15 bp, Artificial Sequence
  dgRNA
  Gtf2a2
ttcccgagcgccagc

SEQ ID NO: 3835 - DNA, 15 bp, Artificial Sequence
  dgRNA
  Gtf2a2
ccttctcggaaacgg

SEQ ID NO: 3836 - DNA, 15 bp, Artificial Sequence
  dgRNA
  Gtf2a2
tctcggaaacggcgg

SEQ ID NO: 3837 - DNA, 15 bp, Artificial Sequence
  dgRNA
  Gtf2a2
ctcggaaacggcggt

SEQ ID NO: 3838 - DNA, 15 bp, Artificial Sequence
  dgRNA
  Cyp2b10
ctacagtgagggtaa

SEQ ID NO: 3839 - DNA, 15 bp, Artificial Sequence
  dgRNA
  Cyp2b10
tggctcctcacgctc

SEQ ID NO: 3840 - DNA, 15 bp, Artificial Sequence
  dgRNA
  Cyp2b10
attgtccagagcgtg

SEQ ID NO: 3841 - DNA, 15 bp, Artificial Sequence
  dgRNA
  Lactbl1
ggaagctaatcctct

SEQ ID NO: 3842 - DNA, 15 bp, Artificial Sequence
  dgRNA
  Lactbl1
taatcctctaggcag

SEQ ID NO: 3843 - DNA, 15 bp, Artificial Sequence
  dgRNA
  Lactbl1
gcgagggattagagc

SEQ ID NO: 3844 - DNA, 15 bp, Artificial Sequence
  dgRNA
  Lactbl1
agaagctatagtccg

SEQ ID NO: 3845 - DNA, 15 bp, Artificial Sequence
  dgRNA
  Smco3
ttagctgaacaaatc

SEQ ID NO: 3846 - DNA, 15 bp, Artificial Sequence
  dgRNA
  1600014C23Rik
cgacagcctcccgcg

SEQ ID NO: 3847 - DNA, 15 bp, Artificial Sequence
  dgRNA
  1600014C23Rik
gcctcccgcgcggtc

SEQ ID NO: 3848 - DNA, 15 bp, Artificial Sequence
  dgRNA
  1600014C23Rik
tgacccgctggcgat

SEQ ID NO: 3849 - DNA, 15 bp, Artificial Sequence
  dgRNA
  1600014C23Rik
cgatcggccaagttg

SEQ ID NO: 3850 - DNA, 15 bp, Artificial Sequence
  dgRNA
  Cacnb1
tcatcccagtctaat

SEQ ID NO: 3851 - DNA, 15 bp, Artificial Sequence
  dgRNA
  Cacnb1
tcccagtctaatcgg

SEQ ID NO: 3852 - DNA, 15 bp, Artificial Sequence
  dgRNA
  Cacnb1
agcccctccacgttc

SEQ ID NO: 3853 - DNA, 15 bp, Artificial Sequence
  dgRNA
  Cacnb1
ccctccacgttctgg

SEQ ID NO: 3854 - DNA, 15 bp, Artificial Sequence
  dgRNA
  Cd68
tgcctcattctcacg

SEQ ID NO: 3855 - DNA, 15 bp, Artificial Sequence
  dgRNA
  Cd68
ctcacgaggtaacca

SEQ ID NO: 3856 - DNA, 15 bp, Artificial Sequence
  dgRNA
  Cd68
gggttgctaaagctg

SEQ ID NO: 3857 - DNA, 15 bp, Artificial Sequence
  dgRNA
  Cd68
tacctcgtgagaatg

SEQ ID NO: 3858 - DNA, 15 bp, Artificial Sequence
  dgRNA
  Gng5
ctcccgagtccgccc

SEQ ID NO: 3859 - DNA, 15 bp, Artificial Sequence
  dgRNA
  Gng5
tcccgagtccgcccc

SEQ ID NO: 3860 - DNA, 15 bp, Artificial Sequence
  dgRNA
  Gng5
cccgagtccgccccg

SEQ ID NO: 3861 - DNA, 15 bp, Artificial Sequence
  dgRNA
  Gng5
agaggcggaaggcgc

SEQ ID NO: 3862 - DNA, 15 bp, Artificial Sequence
  dgRNA
  Lsm5
acttgggggtaccat

SEQ ID NO: 3863 - DNA, 15 bp, Artificial Sequence
  dgRNA
  Lsm5
accataggtgcctgt

SEQ ID NO: 3864 - DNA, 15 bp, Artificial Sequence
  dgRNA
  Lsm5
ccataggtgcctgtt

SEQ ID NO: 3865 - DNA, 15 bp, Artificial Sequence
  dgRNA
  Lsm5
ctgtctgcgatccat

SEQ ID NO: 3866 - DNA, 15 bp, Artificial Sequence
  dgRNA
  Lrrc3
ccaaggtcccttact

SEQ ID NO: 3867 - DNA, 15 bp, Artificial Sequence
  dgRNA
  Lrrc3
aggaccccttttcac

SEQ ID NO: 3868 - DNA, 15 bp, Artificial Sequence
  dgRNA
  Lrrc3
gccgtccttatcgca

SEQ ID NO: 3869 - DNA, 15 bp, Artificial Sequence
  dgRNA
  Lrrc3
gtgctttgggggacg

SEQ ID NO: 3870 - DNA, 15 bp, Artificial Sequence
  dgRNA
  Eif3j1
ctttctcttctcgcg

SEQ ID NO: 3871 - DNA, 15 bp, Artificial Sequence
  dgRNA
  Eif3j1
tttctcttctcgcgg

SEQ ID NO: 3872 - DNA, 15 bp, Artificial Sequence
  dgRNA
  Eif3j1
ttctcttctcgcggg

SEQ ID NO: 3873 - DNA, 15 bp, Artificial Sequence
  dgRNA
  Eif3j1
cttctcgcggggggt

SEQ ID NO: 3874 - DNA, 15 bp, Artificial Sequence
  dgRNA
  Flad1
ccctatttttacttc

SEQ ID NO: 3875 - DNA, 15 bp, Artificial Sequence
  dgRNA
  Flad1
tctagctccgcgatg

SEQ ID NO: 3876 - DNA, 15 bp, Artificial Sequence
  dgRNA
  Flad1
cgcgtgagcgattgc

SEQ ID NO: 3877 - DNA, 15 bp, Artificial Sequence
  dgRNA
  Flad1
gaccaatagaaccac

SEQ ID NO: 3878 - DNA, 15 bp, Artificial Sequence
  dgRNA
  Serpinb10
tggccaagataagcc

SEQ ID NO: 3879 - DNA, 15 bp, Artificial Sequence
  dgRNA
  Ctcfl
ctcgagcgccccctc

SEQ ID NO: 3880 - DNA, 15 bp, Artificial Sequence
  dgRNA
  Ctcfl
gctcgagttttccgg

SEQ ID NO: 3881 - DNA, 15 bp, Artificial Sequence
  dgRNA
  Ctcfl
ggcgctcgagttttc

SEQ ID NO: 3882 - DNA, 15 bp, Artificial Sequence
  dgRNA
  Ctcfl
cgctggagtcatgga

SEQ ID NO: 3883 - DNA, 15 bp, Artificial Sequence
  dgRNA
  Evx1
ctccccattcgagcg

SEQ ID NO: 3884 - DNA, 15 bp, Artificial Sequence
  dgRNA
  Evx1
ccgagccattagctg

SEQ ID NO: 3885 - DNA, 15 bp, Artificial Sequence
  dgRNA
  Evx1
cagcgagttccacag

SEQ ID NO: 3886 - DNA, 15 bp, Artificial Sequence
  dgRNA
  Evx1
gcagcgagttccaca

SEQ ID NO: 3887 - DNA, 15 bp, Artificial Sequence
  dgRNA
  Lacc1
tcgcccgcggctctc

SEQ ID NO: 3888 - DNA, 15 bp, Artificial Sequence
  dgRNA
  Lacc1
cgcccgcggctctcc

SEQ ID NO: 3889 - DNA, 15 bp, Artificial Sequence
  dgRNA
  Lacc1
ccgcgcctcagcgcc

SEQ ID NO: 3890 - DNA, 15 bp, Artificial Sequence
  dgRNA
  Lacc1
cgcgcctcagcgccc

SEQ ID NO: 3891 - DNA, 15 bp, Artificial Sequence
  dgRNA
  Phykpl
tccacctggcggtct

SEQ ID NO: 3892 - DNA, 15 bp, Artificial Sequence
  dgRNA
  Phykpl
ccacctggcggtctg

SEQ ID NO: 3893 - DNA, 15 bp, Artificial Sequence
  dgRNA
  Phykpl
ggaaacctcgggcgt

SEQ ID NO: 3894 - DNA, 15 bp, Artificial Sequence
  dgRNA
  Phykpl
cgggcgtaggagaga

SEQ ID NO: 3895 - DNA, 15 bp, Artificial Sequence
  dgRNA
  Myh14
ctaggaacgtgcctc

SEQ ID NO: 3896 - DNA, 15 bp, Artificial Sequence
  dgRNA
  Myh14
taggaacgtgcctca

SEQ ID NO: 3897 - DNA, 15 bp, Artificial Sequence
  dgRNA
  Myh14
aggaacgtgcctcag

SEQ ID NO: 3898 - DNA, 15 bp, Artificial Sequence
  dgRNA
  Filip1l
gtagaagggtgctgc

SEQ ID NO: 3899 - DNA, 15 bp, Artificial Sequence
  dgRNA
  Filip1l
gcgggtcagacccgc

SEQ ID NO: 3900 - DNA, 15 bp, Artificial Sequence
  dgRNA
  Filip1l
cccgctggaccctca

SEQ ID NO: 3901 - DNA, 15 bp, Artificial Sequence
  dgRNA
  Filip1l
ccgctggaccctcac

SEQ ID NO: 3902 - DNA, 15 bp, Artificial Sequence
  dgRNA
  Grk1
gatacttgtcagccc

SEQ ID NO: 3903 - DNA, 15 bp, Artificial Sequence
  dgRNA
  Grk1
tcccttgtcctacaa

SEQ ID NO: 3904 - DNA, 15 bp, Artificial Sequence
  dgRNA
  Grk1
ttgtcctacaagggc

SEQ ID NO: 3905 - DNA, 15 bp, Artificial Sequence
  dgRNA
  Grk1
ataggccaagggcgt

SEQ ID NO: 3906 - DNA, 15 bp, Artificial Sequence
  dgRNA
  Klhl21
ccaaaggggtgatta

SEQ ID NO: 3907 - DNA, 15 bp, Artificial Sequence
  dgRNA
  Klhl21
gggtgattacggatt

SEQ ID NO: 3908 - DNA, 15 bp, Artificial Sequence
  dgRNA
  Klhl21
ggtgattacggattc

SEQ ID NO: 3909 - DNA, 15 bp, Artificial Sequence
  dgRNA
  Klhl21
ctttctgcaaaccgc

SEQ ID NO: 3910 - DNA, 15 bp, Artificial Sequence
  dgRNA
  Mkrn2
ggatccggactacta

SEQ ID NO: 3911 - DNA, 15 bp, Artificial Sequence
  dgRNA
  Mkrn2
ggactactaaggagt

SEQ ID NO: 3912 - DNA, 15 bp, Artificial Sequence
  dgRNA
  Mkrn2
gactactaaggagta

SEQ ID NO: 3913 - DNA, 15 bp, Artificial Sequence
  dgRNA
  Mkrn2
ggaccttccggctcc

SEQ ID NO: 3914 - DNA, 15 bp, Artificial Sequence
  dgRNA
  Msl3
ggcggggacaagccc

SEQ ID NO: 3915 - DNA, 15 bp, Artificial Sequence
  dgRNA
  Msl3
ggacaagccctggcg

SEQ ID NO: 3916 - DNA, 15 bp, Artificial Sequence
  dgRNA
  Msl3
ccaaggtcctcgcag

SEQ ID NO: 3917 - DNA, 15 bp, Artificial Sequence
  dgRNA
  Msl3
gtcctcgcagtggcg

SEQ ID NO: 3918 - DNA, 15 bp, Artificial Sequence
  dgRNA
  Fbxo17
gctgagcctttcgct

SEQ ID NO: 3919 - DNA, 15 bp, Artificial Sequence
  dgRNA
  Fbxo17
ctgagcctttcgcta

SEQ ID NO: 3920 - DNA, 15 bp, Artificial Sequence
  dgRNA
  Fbxo17
aatttaccctgacga

SEQ ID NO: 3921 - DNA, 15 bp, Artificial Sequence
  dgRNA
  Fbxo17
cctgacgacggtgtt

SEQ ID NO: 3922 - DNA, 15 bp, Artificial Sequence
  dgRNA
  Sim1
tggaaaacaaacgtc

SEQ ID NO: 3923 - DNA, 15 bp, Artificial Sequence
  dgRNA
  Sim1
tatgtcgatttccca

SEQ ID NO: 3924 - DNA, 15 bp, Artificial Sequence
  dgRNA
  Sim1
cccgggttcttaccg

SEQ ID NO: 3925 - DNA, 15 bp, Artificial Sequence
  dgRNA
  Sim1
gcggatcagatgaaa

SEQ ID NO: 3926 - DNA, 15 bp, Artificial Sequence
  dgRNA
  E4f1
ttccgccctgatgtc

SEQ ID NO: 3927 - DNA, 15 bp, Artificial Sequence
  dgRNA
  E4f1
gatgtctggcgctga

SEQ ID NO: 3928 - DNA, 15 bp, Artificial Sequence
  dgRNA
  E4f1
ccgccccctgcctgt

SEQ ID NO: 3929 - DNA, 15 bp, Artificial Sequence
  dgRNA
  E4f1
acgcagccctcggtg

SEQ ID NO: 3930 - DNA, 15 bp, Artificial Sequence
  dgRNA
  Slc23a1
aacaggccttgtgcc

SEQ ID NO: 3931 - DNA, 15 bp, Artificial Sequence
  dgRNA
  Slc23a1
aacgtgccccttgct

SEQ ID NO: 3932 - DNA, 15 bp, Artificial Sequence
  dgRNA
  Slc23a1
acgtgccccttgctt

SEQ ID NO: 3933 - DNA, 15 bp, Artificial Sequence
  dgRNA
  Slc23a1
tgccccttgcttggg

SEQ ID NO: 3934 - DNA, 15 bp, Artificial Sequence
  dgRNA
  Casp8ap2
gagtttggcgccaac

SEQ ID NO: 3935 - DNA, 15 bp, Artificial Sequence
  dgRNA
  Casp8ap2
tttttccgccttcaa

SEQ ID NO: 3936 - DNA, 15 bp, Artificial Sequence
  dgRNA
  Casp8ap2
ttccgccttcaatgg

SEQ ID NO: 3937 - DNA, 15 bp, Artificial Sequence
  dgRNA
  Casp8ap2
tccgccttcaatggc

SEQ ID NO: 3938 - DNA, 15 bp, Artificial Sequence
  dgRNA
  Stx5a
cgttcggctcagctc

SEQ ID NO: 3939 - DNA, 15 bp, Artificial Sequence
  dgRNA
  Stx5a
gttcggctcagctcc

SEQ ID NO: 3940 - DNA, 15 bp, Artificial Sequence
  dgRNA
  Stx5a
cgggcagcggcttga

SEQ ID NO: 3941 - DNA, 15 bp, Artificial Sequence
  dgRNA
  Stx5a
ggcagcggcttgacg

SEQ ID NO: 3942 - DNA, 15 bp, Artificial Sequence
  dgRNA
  Trpv6
ggtatcccaaagtcc

SEQ ID NO: 3943 - DNA, 15 bp, Artificial Sequence
  dgRNA
  Trpv6
gttgcagctgacgca

SEQ ID NO: 3944 - DNA, 15 bp, Artificial Sequence
  dgRNA
  Trpv6
acgcatggtctcagt

SEQ ID NO: 3945 - DNA, 15 bp, Artificial Sequence
  dgRNA
  Trpv6
aggctcattgcagga

SEQ ID NO: 3946 - DNA, 15 bp, Artificial Sequence
  dgRNA
  Zcchc8
gctttaaacgcctaa

SEQ ID NO: 3947 - DNA, 15 bp, Artificial Sequence
  dgRNA
  Zcchc8
ctttaaacgcctaac

SEQ ID NO: 3948 - DNA, 15 bp, Artificial Sequence
  dgRNA
  Zcchc8
tttaaacgcctaacg

SEQ ID NO: 3949 - DNA, 15 bp, Artificial Sequence
  dgRNA
  Zcchc8
gaatgccacgctctg

SEQ ID NO: 3950 - DNA, 15 bp, Artificial Sequence
  dgRNA
  Prr15l
tcccgtcctccagct

SEQ ID NO: 3951 - DNA, 15 bp, Artificial Sequence
  dgRNA
  Prr15l
cttggtgatcccagg

SEQ ID NO: 3952 - DNA, 15 bp, Artificial Sequence
  dgRNA
  Prr15l
gaggggccgggtttc

SEQ ID NO: 3953 - DNA, 15 bp, Artificial Sequence
  dgRNA
  Prr15l
gttcaccttgactcc

SEQ ID NO: 3954 - DNA, 15 bp, Artificial Sequence
  dgRNA
  Rims2
ggggggctgtcgcct

SEQ ID NO: 3955 - DNA, 15 bp, Artificial Sequence
  dgRNA
  Rims2
gtcgcctcggattga

SEQ ID NO: 3956 - DNA, 15 bp, Artificial Sequence
  dgRNA
  Rims2
ttgtcccagccccgg

SEQ ID NO: 3957 - DNA, 15 bp, Artificial Sequence
  dgRNA
  Rims2
agccgcggctgccag

SEQ ID NO: 3958 - DNA, 15 bp, Artificial Sequence
  dgRNA
  Pdzd4
tagacacctcgccct

SEQ ID NO: 3959 - DNA, 15 bp, Artificial Sequence
  dgRNA
  Pdzd4
ctcgccctcggacat

SEQ ID NO: 3960 - DNA, 15 bp, Artificial Sequence
  dgRNA
  Pdzd4
gacattggcattatc

SEQ ID NO: 3961 - DNA, 15 bp, Artificial Sequence
  dgRNA
  Pdzd4
ctgcgccgactcctg

SEQ ID NO: 3962 - DNA, 15 bp, Artificial Sequence
  dgRNA
  Fzd10
ggcggaggctgcccg

SEQ ID NO: 3963 - DNA, 15 bp, Artificial Sequence
  dgRNA
  Fzd10
tgcaaagcagcagcg

SEQ ID NO: 3964 - DNA, 15 bp, Artificial Sequence
  dgRNA
  Fzd10
gggcctgtcaccaat

SEQ ID NO: 3965 - DNA, 15 bp, Artificial Sequence
  dgRNA
  Fzd10
aaagccttgcgcccc

SEQ ID NO: 3966 - DNA, 15 bp, Artificial Sequence
  dgRNA
  Pdlim5
ccaccgaaactccac

SEQ ID NO: 3967 - DNA, 15 bp, Artificial Sequence
  dgRNA
  Pdlim5
caccgaaactccaca

SEQ ID NO: 3968 - DNA, 15 bp, Artificial Sequence
  dgRNA
  Pdlim5
accgaaactccacag

SEQ ID NO: 3969 - DNA, 15 bp, Artificial Sequence
  dgRNA
  Pdlim5
ggcaattgttttttg

SEQ ID NO: 3970 - DNA, 15 bp, Artificial Sequence
  dgRNA
  Cryzl1
tgtctcgtcccttga

SEQ ID NO: 3971 - DNA, 15 bp, Artificial Sequence
  dgRNA
  Cryzl1
tgaaggcgtaactag

SEQ ID NO: 3972 - DNA, 15 bp, Artificial Sequence
  dgRNA
  Cryzl1
tctgctctatgcgtg

SEQ ID NO: 3973 - DNA, 15 bp, Artificial Sequence
  dgRNA
  Cryzl1
ttttgtttcacgatt

SEQ ID NO: 3974 - DNA, 15 bp, Artificial Sequence
  dgRNA
  Cgrrf1
ccccagatgtcagtt

SEQ ID NO: 3975 - DNA, 15 bp, Artificial Sequence
  dgRNA
  Cgrrf1
tggcggaattctctc

SEQ ID NO: 3976 - DNA, 15 bp, Artificial Sequence
  dgRNA
  Cgrrf1
tcaggccaccaatcc

SEQ ID NO: 3977 - DNA, 15 bp, Artificial Sequence
  dgRNA
  Cgrrf1
accaatcctgggcgc

SEQ ID NO: 3978 - DNA, 15 bp, Artificial Sequence
  dgRNA
  Glrx2
ctgaatgcgggcgtg

SEQ ID NO: 3979 - DNA, 15 bp, Artificial Sequence
  dgRNA
  Glrx2
cgggcgtgaggagct

SEQ ID NO: 3980 - DNA, 15 bp, Artificial Sequence
  dgRNA
  Glrx2
gagctcgggagaact

SEQ ID NO: 3981 - DNA, 15 bp, Artificial Sequence
  dgRNA
  Glrx2
gaactcggtagagat

SEQ ID NO: 3982 - DNA, 15 bp, Artificial Sequence
  dgRNA
  Tas2r116
gcttaatggcttgtt

SEQ ID NO: 3983 - DNA, 15 bp, Artificial Sequence
  dgRNA
  Tas2r116
cctgtacattgttta

SEQ ID NO: 3984 - DNA, 15 bp, Artificial Sequence
  dgRNA
  Tas2r116
ttatggaacatgata

SEQ ID NO: 3985 - DNA, 15 bp, Artificial Sequence
  dgRNA
  Tas2r116
attaagccttgctaa

SEQ ID NO: 3986 - DNA, 15 bp, Artificial Sequence
  dgRNA
  Foxa2
gctacttcccgccgc

SEQ ID NO: 3987 - DNA, 15 bp, Artificial Sequence
  dgRNA
  Foxa2
tcccgccgcaggccg

SEQ ID NO: 3988 - DNA, 15 bp, Artificial Sequence
  dgRNA
  Foxa2
cccgccgcaggccgc

SEQ ID NO: 3989 - DNA, 15 bp, Artificial Sequence
  dgRNA
  Foxa2
ccgcgggagagagag

SEQ ID NO: 3990 - DNA, 15 bp, Artificial Sequence
  dgRNA
  Tbx19
cgattagacctcttc

SEQ ID NO: 3991 - DNA, 15 bp, Artificial Sequence
  dgRNA
  Tbx19
gcctgataatttgga

SEQ ID NO: 3992 - DNA, 15 bp, Artificial Sequence
  dgRNA
  Tbx19
ttaaacgtctactgt

SEQ ID NO: 3993 - DNA, 15 bp, Artificial Sequence
  dgRNA
  Tbx19
acgtctactgtaggc

SEQ ID NO: 3994 - DNA, 15 bp, Artificial Sequence
  dgRNA
  Mkrn2os
ctttagaggataagt

SEQ ID NO: 3995 - DNA, 15 bp, Artificial Sequence
  dgRNA
  Mkrn2os
ctttaagagtccagc

SEQ ID NO: 3996 - DNA, 15 bp, Artificial Sequence
  dgRNA
  Mkrn2os
ttaatctacctagct

SEQ ID NO: 3997 - DNA, 15 bp, Artificial Sequence
  dgRNA
  Mkrn2os
gctgccgtttgcagc

SEQ ID NO: 3998 - DNA, 15 bp, Artificial Sequence
  dgRNA
  Fggy
tcactcttataggag

SEQ ID NO: 3999 - DNA, 15 bp, Artificial Sequence
  dgRNA
  Fggy
tgaagtgcgcagtac

SEQ ID NO: 4000 - DNA, 15 bp, Artificial Sequence
  dgRNA
  Fggy
cctgcttacctaaac

SEQ ID NO: 4001 - DNA, 15 bp, Artificial Sequence
  dgRNA
  Fggy
ggtttaggtaagcag

SEQ ID NO: 4002 - DNA, 15 bp, Artificial Sequence
  dgRNA
  Adam11
gaggggtcgcaggat

SEQ ID NO: 4003 - DNA, 15 bp, Artificial Sequence
  dgRNA
  Adam11
gggtgcacctgccaa

SEQ ID NO: 4004 - DNA, 15 bp, Artificial Sequence
  dgRNA
  Adam11
tttgtcctaccgcag

SEQ ID NO: 4005 - DNA, 15 bp, Artificial Sequence
  dgRNA
  Adam11
gtcctaccgcagtgg

SEQ ID NO: 4006 - DNA, 15 bp, Artificial Sequence
  dgRNA
  Rtn4rl1
gcagcgaaaacacct

SEQ ID NO: 4007 - DNA, 15 bp, Artificial Sequence
  dgRNA
  Rtn4rl1
cgaaaacaccttgga

SEQ ID NO: 4008 - DNA, 15 bp, Artificial Sequence
  dgRNA
  Rtn4rl1
gaaggcggcgccgca

SEQ ID NO: 4009 - DNA, 15 bp, Artificial Sequence
  dgRNA
  Rtn4rl1
tgagcgccgctgccc

SEQ ID NO: 4010 - DNA, 15 bp, Artificial Sequence
  dgRNA
  Dcaf17
ttaccgcgtgcagcc

SEQ ID NO: 4011 - DNA, 15 bp, Artificial Sequence
  dgRNA
  Dcaf17
cgcgtgcagcccgga

SEQ ID NO: 4012 - DNA, 15 bp, Artificial Sequence
  dgRNA
  Dcaf17
cactgcgcagcccta

SEQ ID NO: 4013 - DNA, 15 bp, Artificial Sequence
  dgRNA
  Dcaf17
acggcgcagcctatt

SEQ ID NO: 4014 - DNA, 15 bp, Artificial Sequence
  dgRNA
  Col18a1
tctgaaggtaccgtt

SEQ ID NO: 4015 - DNA, 15 bp, Artificial Sequence
  dgRNA
  Col18a1
gaaggtaccgtttgg

SEQ ID NO: 4016 - DNA, 15 bp, Artificial Sequence
  dgRNA
  Col18a1
atcaccttgattctc

SEQ ID NO: 4017 - DNA, 15 bp, Artificial Sequence
  dgRNA
  Col18a1
tccaccgcttccctc

SEQ ID NO: 4018 - DNA, 15 bp, Artificial Sequence
  dgRNA
  Csnk1g1
acgctgttgctaagg

SEQ ID NO: 4019 - DNA, 15 bp, Artificial Sequence
  dgRNA
  Csnk1g1
cgctgttgctaagga

SEQ ID NO: 4020 - DNA, 15 bp, Artificial Sequence
  dgRNA
  Csnk1g1
gcagcattaacgacc

SEQ ID NO: 4021 - DNA, 15 bp, Artificial Sequence
  dgRNA
  Csnk1g1
ttaacgacccggaag

SEQ ID NO: 4022 - DNA, 15 bp, Artificial Sequence
  dgRNA
  Wnk4
cagcagtcgagatga

SEQ ID NO: 4023 - DNA, 15 bp, Artificial Sequence
  dgRNA
  Wnk4
agcagtcgagatgag

SEQ ID NO: 4024 - DNA, 15 bp, Artificial Sequence
  dgRNA
  Wnk4
acactgcaactcgcc

SEQ ID NO: 4025 - DNA, 15 bp, Artificial Sequence
  dgRNA
  Wnk4
ctcgccaggctcaca

SEQ ID NO: 4026 - DNA, 15 bp, Artificial Sequence
  dgRNA
  Ppard
cgctgcagacgcgcc

SEQ ID NO: 4027 - DNA, 15 bp, Artificial Sequence
  dgRNA
  Ppard
gctgcagacgcgcca

SEQ ID NO: 4028 - DNA, 15 bp, Artificial Sequence
  dgRNA
  Ppard
cagtgggcggagcga

SEQ ID NO: 4029 - DNA, 15 bp, Artificial Sequence
  dgRNA
  Ppard
agcgatggctgtcaa

SEQ ID NO: 4030 - DNA, 15 bp, Artificial Sequence
  dgRNA
  Zfp462
ctccggcgttttgtg

SEQ ID NO: 4031 - DNA, 15 bp, Artificial Sequence
  dgRNA
  Zfp462
ggcgttttgtgtggc

SEQ ID NO: 4032 - DNA, 15 bp, Artificial Sequence
  dgRNA
  Zfp462
cgccggagcaccagg

SEQ ID NO: 4033 - DNA, 15 bp, Artificial Sequence
  dgRNA
  Zfp462
acgccggagcaccag

SEQ ID NO: 4034 - DNA, 15 bp, Artificial Sequence
  dgRNA
  Dppa1
tggaataaacattac

SEQ ID NO: 4035 - DNA, 15 bp, Artificial Sequence
  dgRNA
  Olfr1308
tagtgatacctgagg

SEQ ID NO: 4036 - DNA, 15 bp, Artificial Sequence
  dgRNA
  Olfr1308
atagtgatacctgag

SEQ ID NO: 4037 - DNA, 15 bp, Artificial Sequence
  dgRNA
  Olfr1308
gatagtgatacctga

SEQ ID NO: 4038 - DNA, 15 bp, Artificial Sequence
  dgRNA
  Sirpa
tgcgcggccagcctc

SEQ ID NO: 4039 - DNA, 15 bp, Artificial Sequence
  dgRNA
  Sirpa
ggtgcttccaccgcc

SEQ ID NO: 4040 - DNA, 15 bp, Artificial Sequence
  dgRNA
  Sirpa
tggcagccctgcgcg

SEQ ID NO: 4041 - DNA, 15 bp, Artificial Sequence
  dgRNA
  Sirpa
cagccctgcgcgcgg

SEQ ID NO: 4042 - DNA, 15 bp, Artificial Sequence
  dgRNA
  Dctn6
ccttattatgccacc

SEQ ID NO: 4043 - DNA, 15 bp, Artificial Sequence
  dgRNA
  Dctn6
cttattatgccacct

SEQ ID NO: 4044 - DNA, 15 bp, Artificial Sequence
  dgRNA
  Dctn6
ctacgtagcagtagt

SEQ ID NO: 4045 - DNA, 15 bp, Artificial Sequence
  dgRNA
  Dctn6
tacgtagcagtagtt

SEQ ID NO: 4046 - DNA, 15 bp, Artificial Sequence
  dgRNA
  Rpa2
tgaatactgtcctat

SEQ ID NO: 4047 - DNA, 15 bp, Artificial Sequence
  dgRNA
  Rpa2
gataccgaaaaaaaa

SEQ ID NO: 4048 - DNA, 15 bp, Artificial Sequence
  dgRNA
  Rpa2
ctcatgagttctgat

SEQ ID NO: 4049 - DNA, 15 bp, Artificial Sequence
  dgRNA
  Rpa2
gtccagggcgctgat

SEQ ID NO: 4050 - DNA, 15 bp, Artificial Sequence
  dgRNA
  Fbxw10
agttgctgtatattc

SEQ ID NO: 4051 - DNA, 15 bp, Artificial Sequence
  dgRNA
  Fbxw10
taaatctcctaaccc

SEQ ID NO: 4052 - DNA, 15 bp, Artificial Sequence
  dgRNA
  Foxn2
tgcaggacgacagct

SEQ ID NO: 4053 - DNA, 15 bp, Artificial Sequence
  dgRNA
  Foxn2
aggacgacagctcgg

SEQ ID NO: 4054 - DNA, 15 bp, Artificial Sequence
  dgRNA
  Foxn2
ggacgacagctcgga

SEQ ID NO: 4055 - DNA, 15 bp, Artificial Sequence
  dgRNA
  Foxn2
gacgacagctcggag

SEQ ID NO: 4056 - DNA, 15 bp, Artificial Sequence
  dgRNA
  Mycbpap
cttcacgagaaccaa

SEQ ID NO: 4057 - DNA, 15 bp, Artificial Sequence
  dgRNA
  Mycbpap
tggcctaggaagtga

SEQ ID NO: 4058 - DNA, 15 bp, Artificial Sequence
  dgRNA
  Mycbpap
gctgattagtgggca

SEQ ID NO: 4059 - DNA, 15 bp, Artificial Sequence
  dgRNA
  Mycbpap
cagatgacaggccgg

SEQ ID NO: 4060 - DNA, 15 bp, Artificial Sequence
  dgRNA
  Rai1
cccctcctccgcgtc

SEQ ID NO: 4061 - DNA, 15 bp, Artificial Sequence
  dgRNA
  Rai1
ccctcctccgcgtct

SEQ ID NO: 4062 - DNA, 15 bp, Artificial Sequence
  dgRNA
  Rai1
cctcctccgcgtctg

SEQ ID NO: 4063 - DNA, 15 bp, Artificial Sequence
  dgRNA
  Rai1
tccgcgtctggggcg

SEQ ID NO: 4064 - DNA, 15 bp, Artificial Sequence
  dgRNA
  Itgb7
ggcaccgccactatc

SEQ ID NO: 4065 - DNA, 15 bp, Artificial Sequence
  dgRNA
  Itgb7
tatccggcgctgttc

SEQ ID NO: 4066 - DNA, 15 bp, Artificial Sequence
  dgRNA
  Itgb7
gtacttctttagcac

SEQ ID NO: 4067 - DNA, 15 bp, Artificial Sequence
  dgRNA
  Itgb7
gcagtgcttagtaga

SEQ ID NO: 4068 - DNA, 15 bp, Artificial Sequence
  dgRNA
  Magea8
tccctatcttatatc

SEQ ID NO: 4069 - DNA, 15 bp, Artificial Sequence
  dgRNA
  Magea8
agatataagataggg

SEQ ID NO: 4070 - DNA, 15 bp, Artificial Sequence
  dgRNA
  Magea8
ccccagatataagat

SEQ ID NO: 4071 - DNA, 15 bp, Artificial Sequence
  dgRNA
  Magea8
gctcacaaaaggttc

SEQ ID NO: 4072 - DNA, 15 bp, Artificial Sequence
  dgRNA
  Rhoq
tcgtgattccccgaa

SEQ ID NO: 4073 - DNA, 15 bp, Artificial Sequence
  dgRNA
  Rhoq
cttcacgtctcctcc

SEQ ID NO: 4074 - DNA, 15 bp, Artificial Sequence
  dgRNA
  Rhoq
tctcctccgggcacc

SEQ ID NO: 4075 - DNA, 15 bp, Artificial Sequence
  dgRNA
  Rhoq
ctcctccgggcaccg

SEQ ID NO: 4076 - DNA, 15 bp, Artificial Sequence
  dgRNA
  1700003F12Rik
atacagttaccctga

SEQ ID NO: 4077 - DNA, 15 bp, Artificial Sequence
  dgRNA
  1700003F12Rik
agttaccctgatggg

SEQ ID NO: 4078 - DNA, 15 bp, Artificial Sequence
  dgRNA
  1700003F12Rik
gttaccctgatgggc

SEQ ID NO: 4079 - DNA, 15 bp, Artificial Sequence
  dgRNA
  1700003F12Rik
ttaccctgatgggcg

SEQ ID NO: 4080 - DNA, 15 bp, Artificial Sequence
  dgRNA
  Adrbk1
tgtctcggacccgag

SEQ ID NO: 4081 - DNA, 15 bp, Artificial Sequence
  dgRNA
  Adrbk1
agcggtgcagcctct

SEQ ID NO: 4082 - DNA, 15 bp, Artificial Sequence
  dgRNA
  Adrbk1
gcggtgcagcctcta

SEQ ID NO: 4083 - DNA, 15 bp, Artificial Sequence
  dgRNA
  Adrbk1
cggtgcagcctctag

SEQ ID NO: 4084 - DNA, 15 bp, Artificial Sequence
  dgRNA
  Atm
cgtcatttccgtctg

SEQ ID NO: 4085 - DNA, 15 bp, Artificial Sequence
  dgRNA
  Atm
catttccgtctgcgg

SEQ ID NO: 4086 - DNA, 15 bp, Artificial Sequence
  dgRNA
  Atm
atttccgtctgcgga

SEQ ID NO: 4087 - DNA, 15 bp, Artificial Sequence
  dgRNA
  Atm
ctggtggccggctgt

SEQ ID NO: 4088 - DNA, 15 bp, Artificial Sequence
  dgRNA
  Osbpl5
ccccagcctgcaccg

SEQ ID NO: 4089 - DNA, 15 bp, Artificial Sequence
  dgRNA
  Osbpl5
ctcaggctccgggca

SEQ ID NO: 4090 - DNA, 15 bp, Artificial Sequence
  dgRNA
  Osbpl5
gctccgggcaaggac

SEQ ID NO: 4091 - DNA, 15 bp, Artificial Sequence
  dgRNA
  Osbpl5
ctccgggcaaggact

SEQ ID NO: 4092 - DNA, 15 bp, Artificial Sequence
  dgRNA
  Tctex1d1
tattccaaaaacgaa

SEQ ID NO: 4093 - DNA, 15 bp, Artificial Sequence
  dgRNA
  Tctex1d1
cattaacgaggggtg

SEQ ID NO: 4094 - DNA, 15 bp, Artificial Sequence
  dgRNA
  Tctex1d1
gacgtcattaacgag

SEQ ID NO: 4095 - DNA, 15 bp, Artificial Sequence
  dgRNA
  Tctex1d1
tgacgtcattaacga

SEQ ID NO: 4096 - DNA, 15 bp, Artificial Sequence
  dgRNA
  Pnpla2
gggaatcccctctcc

SEQ ID NO: 4097 - DNA, 15 bp, Artificial Sequence
  dgRNA
  Pnpla2
cagcaggtgtcacga

SEQ ID NO: 4098 - DNA, 15 bp, Artificial Sequence
  dgRNA
  Pnpla2
agcaggtgtcacgaa

SEQ ID NO: 4099 - DNA, 15 bp, Artificial Sequence
  dgRNA
  Pnpla2
gcaggtgtcacgaag

SEQ ID NO: 4100 - DNA, 15 bp, Artificial Sequence
  dgRNA
  Irf8
ccgcacttgcctagc

SEQ ID NO: 4101 - DNA, 15 bp, Artificial Sequence
  dgRNA
  Irf8
ccagtcctcagcacg

SEQ ID NO: 4102 - DNA, 15 bp, Artificial Sequence
  dgRNA
  Irf8
gcacgggggaaacgg

SEQ ID NO: 4103 - DNA, 15 bp, Artificial Sequence
  dgRNA
  Irf8
atcaaactagggagt

SEQ ID NO: 4104 - DNA, 15 bp, Artificial Sequence
  dgRNA
  Zfp202
atgggtttgccgcaa

SEQ ID NO: 4105 - DNA, 15 bp, Artificial Sequence
  dgRNA
  Zfp202
tgggtttgccgcaaa

SEQ ID NO: 4106 - DNA, 15 bp, Artificial Sequence
  dgRNA
  Zfp202
gggtttgccgcaaag

SEQ ID NO: 4107 - DNA, 15 bp, Artificial Sequence
  dgRNA
  Zfp202
tgccgcaaaggggac

SEQ ID NO: 4108 - DNA, 15 bp, Artificial Sequence
  dgRNA
  Carkd
gattgggtgcctcgc

SEQ ID NO: 4109 - DNA, 15 bp, Artificial Sequence
  dgRNA
  Carkd
gcctcgctggtcaag

SEQ ID NO: 4110 - DNA, 15 bp, Artificial Sequence
  dgRNA
  Carkd
gtcaagcggagtaag

SEQ ID NO: 4111 - DNA, 15 bp, Artificial Sequence
  dgRNA
  Carkd
aagcggagtaagcgg

SEQ ID NO: 4112 - DNA, 15 bp, Artificial Sequence
  dgRNA
  Rab42
cagaggtagtgattt

SEQ ID NO: 4113 - DNA, 15 bp, Artificial Sequence
  dgRNA
  Rab42
ccgaccaactacatc

SEQ ID NO: 4114 - DNA, 15 bp, Artificial Sequence
  dgRNA
  Rab42
cgaccaactacatcc

SEQ ID NO: 4115 - DNA, 15 bp, Artificial Sequence
  dgRNA
  Rab42
ccgggattgccttcc

SEQ ID NO: 4116 - DNA, 15 bp, Artificial Sequence
  dgRNA
  Retnlb
attacctcctggtga

SEQ ID NO: 4117 - DNA, 15 bp, Artificial Sequence
  dgRNA
  Retnlb
aagaggatttcccta

SEQ ID NO: 4118 - DNA, 15 bp, Artificial Sequence
  dgRNA
  Retnlb
agaggatttccctat

SEQ ID NO: 4119 - DNA, 15 bp, Artificial Sequence
  dgRNA
  Retnlb
atttccctatgggac

SEQ ID NO: 4120 - DNA, 15 bp, Artificial Sequence
  dgRNA
  Usf3
gccgagcggcggccg

SEQ ID NO: 4121 - DNA, 15 bp, Artificial Sequence
  dgRNA
  Usf3
ccgagcggcggccgc

SEQ ID NO: 4122 - DNA, 15 bp, Artificial Sequence
  dgRNA
  Usf3
aggccgtgctgccgc

SEQ ID NO: 4123 - DNA, 15 bp, Artificial Sequence
  dgRNA
  Usf3
ggccgtgctgccgcc

SEQ ID NO: 4124 - DNA, 15 bp, Artificial Sequence
  dgRNA
  Rexo4
tcatttgcggccttc

SEQ ID NO: 4125 - DNA, 15 bp, Artificial Sequence
  dgRNA
  Rexo4
catttgcggccttcc

SEQ ID NO: 4126 - DNA, 15 bp, Artificial Sequence
  dgRNA
  Rexo4
accagatctttgtga

SEQ ID NO: 4127 - DNA, 15 bp, Artificial Sequence
  dgRNA
  Rexo4
ccttccgtcaaactc

SEQ ID NO: 4128 - DNA, 15 bp, Artificial Sequence
  dgRNA
  Olfr340
aacaagtgtactaag

SEQ ID NO: 4129 - DNA, 15 bp, Artificial Sequence
  dgRNA
  Olfr340
gcaatggatataaca

SEQ ID NO: 4130 - DNA, 15 bp, Artificial Sequence
  dgRNA
  Olfr340
gtttttaccttaata

SEQ ID NO: 4131 - DNA, 15 bp, Artificial Sequence
  dgRNA
  Lyl1
ccggagccctattcc

SEQ ID NO: 4132 - DNA, 15 bp, Artificial Sequence
  dgRNA
  Lyl1
cggagccctattcct

SEQ ID NO: 4133 - DNA, 15 bp, Artificial Sequence
  dgRNA
  Lyl1
ggggtgcagtccaca

SEQ ID NO: 4134 - DNA, 15 bp, Artificial Sequence
  dgRNA
  Lyl1
ctcagaggaccggaa

SEQ ID NO: 4135 - DNA, 15 bp, Artificial Sequence
  dgRNA
  Zfp780b
ggcgcagctcccagg

SEQ ID NO: 4136 - DNA, 15 bp, Artificial Sequence
  dgRNA
  Zfp780b
gcgcagctcccaggt

SEQ ID NO: 4137 - DNA, 15 bp, Artificial Sequence
  dgRNA
  Zfp780b
cggagttccgccgca

SEQ ID NO: 4138 - DNA, 15 bp, Artificial Sequence
  dgRNA
  Zfp780b
cagggtccaccgcac

SEQ ID NO: 4139 - DNA, 15 bp, Artificial Sequence
  dgRNA
  4933427G17Rik
gagacgattcaaacc

SEQ ID NO: 4140 - DNA, 15 bp, Artificial Sequence
  dgRNA
  4933427G17Rik
agacgattcaaaccc

SEQ ID NO: 4141 - DNA, 15 bp, Artificial Sequence
  dgRNA
  4933427G17Rik
cgattcaaacccggg

SEQ ID NO: 4142 - DNA, 15 bp, Artificial Sequence
  dgRNA
  4933427G17Rik
tatcaaaaaaggtcg

SEQ ID NO: 4143 - DNA, 15 bp, Artificial Sequence
  dgRNA
  1110004E09Rik
agctacttccgggag

SEQ ID NO: 4144 - DNA, 15 bp, Artificial Sequence
  dgRNA
  1110004E09Rik
ggagcggcgactgtg

SEQ ID NO: 4145 - DNA, 15 bp, Artificial Sequence
  dgRNA
  1110004E09Rik
gttcttcagcgcctc

SEQ ID NO: 4146 - DNA, 15 bp, Artificial Sequence
  dgRNA
  1110004E09Rik
cgcctccggccttcc

SEQ ID NO: 4147 - DNA, 15 bp, Artificial Sequence
  dgRNA
  L3mbtl2
ccttttcgtgcaccc

SEQ ID NO: 4148 - DNA, 15 bp, Artificial Sequence
  dgRNA
  L3mbtl2
gcccctccttaatgg

SEQ ID NO: 4149 - DNA, 15 bp, Artificial Sequence
  dgRNA
  L3mbtl2
tccttaatggaggcg

SEQ ID NO: 4150 - DNA, 15 bp, Artificial Sequence
  dgRNA
  L3mbtl2
gggcgagcgcggaac

SEQ ID NO: 4151 - DNA, 15 bp, Artificial Sequence
  dgRNA
  Khdrbs3
ctcatcggggagccc

SEQ ID NO: 4152 - DNA, 15 bp, Artificial Sequence
  dgRNA
  Khdrbs3
tcggggagccctgga

SEQ ID NO: 4153 - DNA, 15 bp, Artificial Sequence
  dgRNA
  Khdrbs3
ggagacccctgatct

SEQ ID NO: 4154 - DNA, 15 bp, Artificial Sequence
  dgRNA
  Khdrbs3
gagacccctgatcta

SEQ ID NO: 4155 - DNA, 15 bp, Artificial Sequence
  dgRNA
  Osbpl1a
gagatgcgattgagc

SEQ ID NO: 4156 - DNA, 15 bp, Artificial Sequence
  dgRNA
  Osbpl1a
agatgcgattgagca

SEQ ID NO: 4157 - DNA, 15 bp, Artificial Sequence
  dgRNA
  Osbpl1a
accgctcaaaagctg

SEQ ID NO: 4158 - DNA, 15 bp, Artificial Sequence
  dgRNA
  Osbpl1a
gaccgctcaaaagct

SEQ ID NO: 4159 - DNA, 15 bp, Artificial Sequence
  dgRNA
  Haus3
actccaactcccgag

SEQ ID NO: 4160 - DNA, 15 bp, Artificial Sequence
  dgRNA
  Haus3
ctccaactcccgagc

SEQ ID NO: 4161 - DNA, 15 bp, Artificial Sequence
  dgRNA
  Haus3
tccaactcccgagcg

SEQ ID NO: 4162 - DNA, 15 bp, Artificial Sequence
  dgRNA
  Haus3
ccaactcccgagcgg

SEQ ID NO: 4163 - DNA, 15 bp, Artificial Sequence
  dgRNA
  Gpr156
agtggacgtctttgg

SEQ ID NO: 4164 - DNA, 15 bp, Artificial Sequence
  dgRNA
  Gpr156
aggatgcgggagtaa

SEQ ID NO: 4165 - DNA, 15 bp, Artificial Sequence
  dgRNA
  Gpr156
ggatgcgggagtaaa

SEQ ID NO: 4166 - DNA, 15 bp, Artificial Sequence
  dgRNA
  Gpr156
gactccggagtagag

SEQ ID NO: 4167 - DNA, 15 bp, Artificial Sequence
  dgRNA
  Mcm10
gtgaatcttaattat

SEQ ID NO: 4168 - DNA, 15 bp, Artificial Sequence
  dgRNA
  Mcm10
ggttgctctactgag

SEQ ID NO: 4169 - DNA, 15 bp, Artificial Sequence
  dgRNA
  Mcm10
gtggtccaagagttc

SEQ ID NO: 4170 - DNA, 15 bp, Artificial Sequence
  dgRNA
  Mcm10
gtccaagagttccgg

SEQ ID NO: 4171 - DNA, 15 bp, Artificial Sequence
  dgRNA
  Tmed8
gcggactgtaaaaac

SEQ ID NO: 4172 - DNA, 15 bp, Artificial Sequence
  dgRNA
  Tmed8
cccctctcacgtgtc

SEQ ID NO: 4173 - DNA, 15 bp, Artificial Sequence
  dgRNA
  Tmed8
gctccttccggcccg

SEQ ID NO: 4174 - DNA, 15 bp, Artificial Sequence
  dgRNA
  Tmed8
gcccgtggctcgctt

SEQ ID NO: 4175 - DNA, 15 bp, Artificial Sequence
  dgRNA
  Rabep2
cagacccgaagccct

SEQ ID NO: 4176 - DNA, 15 bp, Artificial Sequence
  dgRNA
  Rabep2
gcttccagggagcgc

SEQ ID NO: 4177 - DNA, 15 bp, Artificial Sequence
  dgRNA
  Rabep2
ggagcgcgggagcgc

SEQ ID NO: 4178 - DNA, 15 bp, Artificial Sequence
  dgRNA
  Rabep2
agcgcgggagcgcgg

SEQ ID NO: 4179 - DNA, 15 bp, Artificial Sequence
  dgRNA
  Ergic2
cgtcctgtgctgtga

SEQ ID NO: 4180 - DNA, 15 bp, Artificial Sequence
  dgRNA
  Ergic2
gcgtagcttactttt

SEQ ID NO: 4181 - DNA, 15 bp, Artificial Sequence
  dgRNA
  Ergic2
cgtagcttactttta

SEQ ID NO: 4182 - DNA, 15 bp, Artificial Sequence
  dgRNA
  Ergic2
tctccacgcccgaca

SEQ ID NO: 4183 - DNA, 15 bp, Artificial Sequence
  dgRNA
  Ptprj
agggctaggcggaca

SEQ ID NO: 4184 - DNA, 15 bp, Artificial Sequence
  dgRNA
  Ptprj
gctaggcggacaggg

SEQ ID NO: 4185 - DNA, 15 bp, Artificial Sequence
  dgRNA
  Ptprj
ctaggcggacaggga

SEQ ID NO: 4186 - DNA, 15 bp, Artificial Sequence
  dgRNA
  Ptprj
agggggcgcttcctc

SEQ ID NO: 4187 - DNA, 15 bp, Artificial Sequence
  dgRNA
  Vps16
cgaggttggccgctg

SEQ ID NO: 4188 - DNA, 15 bp, Artificial Sequence
  dgRNA
  Vps16
ggttggccgctgtgg

SEQ ID NO: 4189 - DNA, 15 bp, Artificial Sequence
  dgRNA
  Vps16
agggctaggtccact

SEQ ID NO: 4190 - DNA, 15 bp, Artificial Sequence
  dgRNA
  Vps16
gggctaggtccactc

SEQ ID NO: 4191 - DNA, 15 bp, Artificial Sequence
  dgRNA
  Afap1
aaccaattctagctt

SEQ ID NO: 4192 - DNA, 15 bp, Artificial Sequence
  dgRNA
  Afap1
accaattctagcttt

SEQ ID NO: 4193 - DNA, 15 bp, Artificial Sequence
  dgRNA
  Afap1
tgagcttagtccacg

SEQ ID NO: 4194 - DNA, 15 bp, Artificial Sequence
  dgRNA
  Afap1
gagcttagtccacgt

SEQ ID NO: 4195 - DNA, 15 bp, Artificial Sequence
  dgRNA
  Gatad2b
attgctgaagttgac

SEQ ID NO: 4196 - DNA, 15 bp, Artificial Sequence
  dgRNA
  Gatad2b
taatatagatgtcgt

SEQ ID NO: 4197 - DNA, 15 bp, Artificial Sequence
  dgRNA
  Gatad2b
ggacagtaatagcat

SEQ ID NO: 4198 - DNA, 15 bp, Artificial Sequence
  dgRNA
  Gatad2b
tcacattcctacatg

SEQ ID NO: 4199 - DNA, 15 bp, Artificial Sequence
  dgRNA
  Rtel1
tgtagcatttaggcg

SEQ ID NO: 4200 - DNA, 15 bp, Artificial Sequence
  dgRNA
  Rtel1
ttaggcgtggctaca

SEQ ID NO: 4201 - DNA, 15 bp, Artificial Sequence
  dgRNA
  Rtel1
cgaagttccaatcag

SEQ ID NO: 4202 - DNA, 15 bp, Artificial Sequence
  dgRNA
  Rtel1
tgattggaacttcgc

SEQ ID NO: 4203 - DNA, 15 bp, Artificial Sequence
  dgRNA
  Inha
gtatgcttgcctgaa

SEQ ID NO: 4204 - DNA, 15 bp, Artificial Sequence
  dgRNA
  Inha
gggtcaggtcacttg

SEQ ID NO: 4205 - DNA, 15 bp, Artificial Sequence
  dgRNA
  Inha
ccccacattcttggc

SEQ ID NO: 4206 - DNA, 15 bp, Artificial Sequence
  dgRNA
  Inha
cattcttggcgggag

SEQ ID NO: 4207 - DNA, 15 bp, Artificial Sequence
  dgRNA
  Gata4
agagttccgcgcgca

SEQ ID NO: 4208 - DNA, 15 bp, Artificial Sequence
  dgRNA
  Gata4
ggactttgcctgttg

SEQ ID NO: 4209 - DNA, 15 bp, Artificial Sequence
  dgRNA
  Gata4
gaagagtcctgcggg

SEQ ID NO: 4210 - DNA, 15 bp, Artificial Sequence
  dgRNA
  Gata4
aagagtcctgcgggc

SEQ ID NO: 4211 - DNA, 15 bp, Artificial Sequence
  dgRNA
  Hmgb2
ctagaccggttccaa

SEQ ID NO: 4212 - DNA, 15 bp, Artificial Sequence
  dgRNA
  Hmgb2
tagaccggttccaac

SEQ ID NO: 4213 - DNA, 15 bp, Artificial Sequence
  dgRNA
  Hmgb2
cggttccaacgggtc

SEQ ID NO: 4214 - DNA, 15 bp, Artificial Sequence
  dgRNA
  Hmgb2
ggttccaacgggtct

SEQ ID NO: 4215 - DNA, 15 bp, Artificial Sequence
  dgRNA
  Prnd
atcgagatcttcacg

SEQ ID NO: 4216 - DNA, 15 bp, Artificial Sequence
  dgRNA
  Prnd
tccaaccttccaggg

SEQ ID NO: 4217 - DNA, 15 bp, Artificial Sequence
  dgRNA
  Prnd
aagggctaccctatt

SEQ ID NO: 4218 - DNA, 15 bp, Artificial Sequence
  dgRNA
  Prnd
ggctaccctatttgg

SEQ ID NO: 4219 - DNA, 15 bp, Artificial Sequence
  dgRNA
  AI597479
gcgttgcttagcctc

SEQ ID NO: 4220 - DNA, 15 bp, Artificial Sequence
  dgRNA
  AI597479
gctttcggcgcagcc

SEQ ID NO: 4221 - DNA, 15 bp, Artificial Sequence
  dgRNA
  AI597479
ctttcggcgcagccc

SEQ ID NO: 4222 - DNA, 15 bp, Artificial Sequence
  dgRNA
  AI597479
cccagttcgtcctct

SEQ ID NO: 4223 - DNA, 15 bp, Artificial Sequence
  dgRNA
  Ptprt
gcttgagtgcgcgag

SEQ ID NO: 4224 - DNA, 15 bp, Artificial Sequence
  dgRNA
  Ptprt
cgagcggccccgagc

SEQ ID NO: 4225 - DNA, 15 bp, Artificial Sequence
  dgRNA
  Ptprt
ccgagccggccagcc

SEQ ID NO: 4226 - DNA, 15 bp, Artificial Sequence
  dgRNA
  Ptprt
cgagccggccagccc

SEQ ID NO: 4227 - DNA, 15 bp, Artificial Sequence
  dgRNA
  Rae1
tctcaactagttgcc

SEQ ID NO: 4228 - DNA, 15 bp, Artificial Sequence
  dgRNA
  Rae1
gcctggcaactgcgc

SEQ ID NO: 4229 - DNA, 15 bp, Artificial Sequence
  dgRNA
  Rae1
caaacgcacaactgc

SEQ ID NO: 4230 - DNA, 15 bp, Artificial Sequence
  dgRNA
  Rae1
cctctcgccctcagc

SEQ ID NO: 4231 - DNA, 15 bp, Artificial Sequence
  dgRNA
  Esr1
gaatgctgattctag

SEQ ID NO: 4232 - DNA, 15 bp, Artificial Sequence
  dgRNA
  Esr1
aatgctgattctagc

SEQ ID NO: 4233 - DNA, 15 bp, Artificial Sequence
  dgRNA
  Esr1
atgctgattctagcg

SEQ ID NO: 4234 - DNA, 15 bp, Artificial Sequence
  dgRNA
  Esr1
gccttgtctgccggg

SEQ ID NO: 4235 - DNA, 15 bp, Artificial Sequence
  dgRNA
  Coq7
accctaagagccgac

SEQ ID NO: 4236 - DNA, 15 bp, Artificial Sequence
  dgRNA
  Coq7
ccctaagagccgacc

SEQ ID NO: 4237 - DNA, 15 bp, Artificial Sequence
  dgRNA
  Coq7
gttacaatgatcgac

SEQ ID NO: 4238 - DNA, 15 bp, Artificial Sequence
  dgRNA
  Coq7
ttacaatgatcgaca

SEQ ID NO: 4239 - DNA, 15 bp, Artificial Sequence
  dgRNA
  5730507C01Rik
ccaccgagcgtcccg

SEQ ID NO: 4240 - DNA, 15 bp, Artificial Sequence
  dgRNA
  5730507C01Rik
ccgagcgtcccgcgg

SEQ ID NO: 4241 - DNA, 15 bp, Artificial Sequence
  dgRNA
  5730507C01Rik
gtcccgcggtggctc

SEQ ID NO: 4242 - DNA, 15 bp, Artificial Sequence
  dgRNA
  5730507C01Rik
gccgcagtccgcgcc

SEQ ID NO: 4243 - DNA, 15 bp, Artificial Sequence
  dgRNA
  Tysnd1
caaggattcctaggc

SEQ ID NO: 4244 - DNA, 15 bp, Artificial Sequence
  dgRNA
  Tysnd1
gctggctaaattaag

SEQ ID NO: 4245 - DNA, 15 bp, Artificial Sequence
  dgRNA
  Tysnd1
gctaaattaagaggg

SEQ ID NO: 4246 - DNA, 15 bp, Artificial Sequence
  dgRNA
  Tysnd1
ctaaattaagagggc

SEQ ID NO: 4247 - DNA, 15 bp, Artificial Sequence
  dgRNA
  Gm1123
gagtttccggaggga

SEQ ID NO: 4248 - DNA, 15 bp, Artificial Sequence
  dgRNA
  Gm1123
ttccggagggaaggc

SEQ ID NO: 4249 - DNA, 15 bp, Artificial Sequence
  dgRNA
  Gm1123
ggcaggggccaatag

SEQ ID NO: 4250 - DNA, 15 bp, Artificial Sequence
  dgRNA
  Gm1123
tagctcaagcagcac

SEQ ID NO: 4251 - DNA, 15 bp, Artificial Sequence
  dgRNA
  Cox6b1
ccataattgaacgtc

SEQ ID NO: 4252 - DNA, 15 bp, Artificial Sequence
  dgRNA
  Cox6b1
aagtaaaatctcgat

SEQ ID NO: 4253 - DNA, 15 bp, Artificial Sequence
  dgRNA
  Cox6b1
agctcaataggaggt

SEQ ID NO: 4254 - DNA, 15 bp, Artificial Sequence
  dgRNA
  Cox6b1
gctcaataggaggtc

SEQ ID NO: 4255 - DNA, 15 bp, Artificial Sequence
  dgRNA
  Myb
gctccgcggcgcgag

SEQ ID NO: 4256 - DNA, 15 bp, Artificial Sequence
  dgRNA
  Myb
ggcgcgagaggcgaa

SEQ ID NO: 4257 - DNA, 15 bp, Artificial Sequence
  dgRNA
  Myb
gcgcgagaggcgaat

SEQ ID NO: 4258 - DNA, 15 bp, Artificial Sequence
  dgRNA
  Myb
atgggagcggcggcc

SEQ ID NO: 4259 - DNA, 15 bp, Artificial Sequence
  dgRNA
  E230025N22Rik
ggctcagccggctca

SEQ ID NO: 4260 - DNA, 15 bp, Artificial Sequence
  dgRNA
  E230025N22Rik
gccggctcagggtgg

SEQ ID NO: 4261 - DNA, 15 bp, Artificial Sequence
  dgRNA
  E230025N22Rik
ttgagggcgaaggca

SEQ ID NO: 4262 - DNA, 15 bp, Artificial Sequence
  dgRNA
  E230025N22Rik
tcgcctacttcagcc

SEQ ID NO: 4263 - DNA, 15 bp, Artificial Sequence
  dgRNA
  Boll
gcgcgctgccctgtc

SEQ ID NO: 4264 - DNA, 15 bp, Artificial Sequence
  dgRNA
  Boll
cccggctggggccta

SEQ ID NO: 4265 - DNA, 15 bp, Artificial Sequence
  dgRNA
  Boll
ccggctggggcctag

SEQ ID NO: 4266 - DNA, 15 bp, Artificial Sequence
  dgRNA
  Boll
gcatgcgcccacgca

SEQ ID NO: 4267 - DNA, 15 bp, Artificial Sequence
  dgRNA
  Tcf4
aaatattgttcgtct

SEQ ID NO: 4268 - DNA, 15 bp, Artificial Sequence
  dgRNA
  Tcf4
atagttttgcgtttg

SEQ ID NO: 4269 - DNA, 15 bp, Artificial Sequence
  dgRNA
  Tcf4
gatagttttgcgttt

SEQ ID NO: 4270 - DNA, 15 bp, Artificial Sequence
  dgRNA
  Tcf4
ggatagttttgcgtt

SEQ ID NO: 4271 - DNA, 15 bp, Artificial Sequence
  dgRNA
  Mst1r
ctaacctcaaccaga

SEQ ID NO: 4272 - DNA, 15 bp, Artificial Sequence
  dgRNA
  Mst1r
taacctcaaccagat

SEQ ID NO: 4273 - DNA, 15 bp, Artificial Sequence
  dgRNA
  Mst1r
caaccagatgggttg

SEQ ID NO: 4274 - DNA, 15 bp, Artificial Sequence
  dgRNA
  Mst1r
aaccagatgggttgt

SEQ ID NO: 4275 - DNA, 15 bp, Artificial Sequence
  dgRNA
  Crhr1
gtggaccgaggagac

SEQ ID NO: 4276 - DNA, 15 bp, Artificial Sequence
  dgRNA
  Crhr1
aggggacacgaggcg

SEQ ID NO: 4277 - DNA, 15 bp, Artificial Sequence
  dgRNA
  Crhr1
ggggacacgaggcga

SEQ ID NO: 4278 - DNA, 15 bp, Artificial Sequence
  dgRNA
  Crhr1
gggacacgaggcgag

SEQ ID NO: 4279 - DNA, 15 bp, Artificial Sequence
  dgRNA
  Tas2r122
atccaaatcttaaat

SEQ ID NO: 4280 - DNA, 15 bp, Artificial Sequence
  dgRNA
  Col8a2
ctcctgcagccgtct

SEQ ID NO: 4281 - DNA, 15 bp, Artificial Sequence
  dgRNA
  Col8a2
tcctgcagccgtcta

SEQ ID NO: 4282 - DNA, 15 bp, Artificial Sequence
  dgRNA
  Col8a2
gcagccgtctagggc

SEQ ID NO: 4283 - DNA, 15 bp, Artificial Sequence
  dgRNA
  Col8a2
cagccgtctagggca

SEQ ID NO: 4284 - DNA, 15 bp, Artificial Sequence
  dgRNA
  Psmc5
cgtatcctaaacgct

SEQ ID NO: 4285 - DNA, 15 bp, Artificial Sequence
  dgRNA
  Psmc5
ccccgcccattgacc

SEQ ID NO: 4286 - DNA, 15 bp, Artificial Sequence
  dgRNA
  Psmc5
acccggaactgttct

SEQ ID NO: 4287 - DNA, 15 bp, Artificial Sequence
  dgRNA
  Psmc5
cggaactgttctcgg

SEQ ID NO: 4288 - DNA, 15 bp, Artificial Sequence
  dgRNA
  Ppm1d
gcgcgctcccccggt

SEQ ID NO: 4289 - DNA, 15 bp, Artificial Sequence
  dgRNA
  Ppm1d
cgctcccccggtcgg

SEQ ID NO: 4290 - DNA, 15 bp, Artificial Sequence
  dgRNA
  Ppm1d
gctcccccggtcggc

SEQ ID NO: 4291 - DNA, 15 bp, Artificial Sequence
  dgRNA
  Ppm1d
gccgagcgagatcag

SEQ ID NO: 4292 - DNA, 15 bp, Artificial Sequence
  dgRNA
  Ppih
cgcgcgccacacttc

SEQ ID NO: 4293 - DNA, 15 bp, Artificial Sequence
  dgRNA
  Ppih
gcgcgccacacttcc

SEQ ID NO: 4294 - DNA, 15 bp, Artificial Sequence
  dgRNA
  Ppih
cgcgccacacttccg

SEQ ID NO: 4295 - DNA, 15 bp, Artificial Sequence
  dgRNA
  Ppih
gccacacttccgggg

SEQ ID NO: 4296 - DNA, 15 bp, Artificial Sequence
  dgRNA
  Acacb
gttagcaacgtgccc

SEQ ID NO: 4297 - DNA, 15 bp, Artificial Sequence
  dgRNA
  Acacb
ttagcaacgtgccct

SEQ ID NO: 4298 - DNA, 15 bp, Artificial Sequence
  dgRNA
  Acacb
cttcgtccagtacaa

SEQ ID NO: 4299 - DNA, 15 bp, Artificial Sequence
  dgRNA
  Acacb
cccacgcgccgtgtt

SEQ ID NO: 4300 - DNA, 15 bp, Artificial Sequence
  dgRNA
  Tcta
agctggcgccagtcg

SEQ ID NO: 4301 - DNA, 15 bp, Artificial Sequence
  dgRNA
  Tcta
acgcttaaccaatca

SEQ ID NO: 4302 - DNA, 15 bp, Artificial Sequence
  dgRNA
  Tcta
atcatggcagacgcg

SEQ ID NO: 4303 - DNA, 15 bp, Artificial Sequence
  dgRNA
  Tcta
acgcgtggagcatga

SEQ ID NO: 4304 - DNA, 15 bp, Artificial Sequence
  dgRNA
  Hs6st2
gattcataaggggac

SEQ ID NO: 4305 - DNA, 15 bp, Artificial Sequence
  dgRNA
  Hs6st2
aaaatcccccgtgta

SEQ ID NO: 4306 - DNA, 15 bp, Artificial Sequence
  dgRNA
  Hs6st2
cgttgattgaatgga

SEQ ID NO: 4307 - DNA, 15 bp, Artificial Sequence
  dgRNA
  Hs6st2
ctaccgttgattgaa

SEQ ID NO: 4308 - DNA, 15 bp, Artificial Sequence
  dgRNA
  Rab24
cacccgtgcagcatc

SEQ ID NO: 4309 - DNA, 15 bp, Artificial Sequence
  dgRNA
  Rab24
acccgtgcagcatca

SEQ ID NO: 4310 - DNA, 15 bp, Artificial Sequence
  dgRNA
  Rab24
gggggggacgtggct

SEQ ID NO: 4311 - DNA, 15 bp, Artificial Sequence
  dgRNA
  Rab24
aggcgcacgcccgcc

SEQ ID NO: 4312 - DNA, 15 bp, Artificial Sequence
  dgRNA
  Uxt
cgacgatccgcctgc

SEQ ID NO: 4313 - DNA, 15 bp, Artificial Sequence
  dgRNA
  Uxt
cctgctggcagaccg

SEQ ID NO: 4314 - DNA, 15 bp, Artificial Sequence
  dgRNA
  Uxt
agaccgcggcgtgcc

SEQ ID NO: 4315 - DNA, 15 bp, Artificial Sequence
  dgRNA
  Uxt
cccatctagatccat

SEQ ID NO: 4316 - DNA, 15 bp, Artificial Sequence
  dgRNA
  Msc
cgccccgctaaccgc

SEQ ID NO: 4317 - DNA, 15 bp, Artificial Sequence
  dgRNA
  Msc
gccccgctaaccgca

SEQ ID NO: 4318 - DNA, 15 bp, Artificial Sequence
  dgRNA
  Msc
ctaaccgcagggttc

SEQ ID NO: 4319 - DNA, 15 bp, Artificial Sequence
  dgRNA
  Msc
taaccgcagggttca

SEQ ID NO: 4320 - DNA, 15 bp, Artificial Sequence
  dgRNA
  Dedd2
gagcaagacacagcg

SEQ ID NO: 4321 - DNA, 15 bp, Artificial Sequence
  dgRNA
  Dedd2
tgcgcaagcgcagca

SEQ ID NO: 4322 - DNA, 15 bp, Artificial Sequence
  dgRNA
  Dedd2
gcgcaagcgcagcaa

SEQ ID NO: 4323 - DNA, 15 bp, Artificial Sequence
  dgRNA
  Dedd2
gagagtccggacgct

SEQ ID NO: 4324 - DNA, 15 bp, Artificial Sequence
  dgRNA
  Abce1
aacgccgccgagact

SEQ ID NO: 4325 - DNA, 15 bp, Artificial Sequence
  dgRNA
  Abce1
acgccgccgagacta

SEQ ID NO: 4326 - DNA, 15 bp, Artificial Sequence
  dgRNA
  Abce1
agttctctaaaccga

SEQ ID NO: 4327 - DNA, 15 bp, Artificial Sequence
  dgRNA
  Abce1
gattcgccacaattc

SEQ ID NO: 4328 - DNA, 15 bp, Artificial Sequence
  dgRNA
  Chil4
ctatcttgaccgaac

SEQ ID NO: 4329 - DNA, 15 bp, Artificial Sequence
  dgRNA
  Chil4
cgaaccggtgataaa

SEQ ID NO: 4330 - DNA, 15 bp, Artificial Sequence
  dgRNA
  Chil4
cttttatcaccggtt

SEQ ID NO: 4331 - DNA, 15 bp, Artificial Sequence
  dgRNA
  Chil4
atcaccttttatcac

SEQ ID NO: 4332 - DNA, 15 bp, Artificial Sequence
  dgRNA
  Aven
ggaatgattagtgtt

SEQ ID NO: 4333 - DNA, 15 bp, Artificial Sequence
  dgRNA
  Aven
atgattagtgttagg

SEQ ID NO: 4334 - DNA, 15 bp, Artificial Sequence
  dgRNA
  Aven
agacagatgcagcgc

SEQ ID NO: 4335 - DNA, 15 bp, Artificial Sequence
  dgRNA
  Aven
atgcagcgctggtgt

SEQ ID NO: 4336 - DNA, 15 bp, Artificial Sequence
  dgRNA
  C3
gggttactcacccca

SEQ ID NO: 4337 - DNA, 15 bp, Artificial Sequence
  dgRNA
  C3
tatgttgcgaaattt

SEQ ID NO: 4338 - DNA, 15 bp, Artificial Sequence
  dgRNA
  C3
atgttgcgaaatttt

SEQ ID NO: 4339 - DNA, 15 bp, Artificial Sequence
  dgRNA
  C3
ggtccctgttgtact

SEQ ID NO: 4340 - DNA, 15 bp, Artificial Sequence
  dgRNA
  Smr3a
aacacgctgccaaat

SEQ ID NO: 4341 - DNA, 15 bp, Artificial Sequence
  dgRNA
  Cd209f
atatagcttggagca

SEQ ID NO: 4342 - DNA, 15 bp, Artificial Sequence
  dgRNA
  Cd209f
gctatatctagtaat

SEQ ID NO: 4343 - DNA, 15 bp, Artificial Sequence
  dgRNA
  Trnt1
gcctgtcatgcgcgc

SEQ ID NO: 4344 - DNA, 15 bp, Artificial Sequence
  dgRNA
  Trnt1
catgcgcgcaggcgc

SEQ ID NO: 4345 - DNA, 15 bp, Artificial Sequence
  dgRNA
  Trnt1
gcgcgcaggcgcagg

SEQ ID NO: 4346 - DNA, 15 bp, Artificial Sequence
  dgRNA
  Trnt1
cctagccccgcccag

SEQ ID NO: 4347 - DNA, 15 bp, Artificial Sequence
  dgRNA
  Plekhf1
aaccggactccaacc

SEQ ID NO: 4348 - DNA, 15 bp, Artificial Sequence
  dgRNA
  Plekhf1
ctgctgacccgttta

SEQ ID NO: 4349 - DNA, 15 bp, Artificial Sequence
  dgRNA
  Plekhf1
ccgtttacggtccag

SEQ ID NO: 4350 - DNA, 15 bp, Artificial Sequence
  dgRNA
  Plekhf1
gcccgcgcacatttc

SEQ ID NO: 4351 - DNA, 15 bp, Artificial Sequence
  dgRNA
  Rbks
tctcgccgtggcggc

SEQ ID NO: 4352 - DNA, 15 bp, Artificial Sequence
  dgRNA
  Rbks
tgtgcttgtgaggcg

SEQ ID NO: 4353 - DNA, 15 bp, Artificial Sequence
  dgRNA
  Rbks
gcggggcaggaacac

SEQ ID NO: 4354 - DNA, 15 bp, Artificial Sequence
  dgRNA
  Rbks
gaacaccggtcccag

SEQ ID NO: 4355 - DNA, 15 bp, Artificial Sequence
  dgRNA
  Epha10
ccgtgaaaagccaca

SEQ ID NO: 4356 - DNA, 15 bp, Artificial Sequence
  dgRNA
  Epha10
caagttcagctcaaa

SEQ ID NO: 4357 - DNA, 15 bp, Artificial Sequence
  dgRNA
  Epha10
cttccttcgtcctag

SEQ ID NO: 4358 - DNA, 15 bp, Artificial Sequence
  dgRNA
  Epha10
ttccttcgtcctaga

SEQ ID NO: 4359 - DNA, 15 bp, Artificial Sequence
  dgRNA
  Il18r1
aagcttgagcgctcc

SEQ ID NO: 4360 - DNA, 15 bp, Artificial Sequence
  dgRNA
  Il18r1
agcttgagcgctcct

SEQ ID NO: 4361 - DNA, 15 bp, Artificial Sequence
  dgRNA
  Il18r1
ttgagcgctcctggg

SEQ ID NO: 4362 - DNA, 15 bp, Artificial Sequence
  dgRNA
  Il18r1
agcctgtagcgccct

SEQ ID NO: 4363 - DNA, 15 bp, Artificial Sequence
  dgRNA
  Stradb
ccgagctaacccccc

SEQ ID NO: 4364 - DNA, 15 bp, Artificial Sequence
  dgRNA
  Stradb
cgagctaaccccccc

SEQ ID NO: 4365 - DNA, 15 bp, Artificial Sequence
  dgRNA
  Stradb
taacccccccgggcg

SEQ ID NO: 4366 - DNA, 15 bp, Artificial Sequence
  dgRNA
  Stradb
ccccccgggcgtggc

SEQ ID NO: 4367 - DNA, 15 bp, Artificial Sequence
  dgRNA
  9130409I23Rik
gctgcagccgtgcta

SEQ ID NO: 4368 - DNA, 15 bp, Artificial Sequence
  dgRNA
  9130409I23Rik
ctggcctttacgtgc

SEQ ID NO: 4369 - DNA, 15 bp, Artificial Sequence
  dgRNA
  9130409I23Rik
atacccatagactgc

SEQ ID NO: 4370 - DNA, 15 bp, Artificial Sequence
  dgRNA
  9130409I23Rik
ggccgggctggtgac

SEQ ID NO: 4371 - DNA, 15 bp, Artificial Sequence
  dgRNA
  Gsc2
ctccagctctagacg

SEQ ID NO: 4372 - DNA, 15 bp, Artificial Sequence
  dgRNA
  Gsc2
gacgtggcagagtgc

SEQ ID NO: 4373 - DNA, 15 bp, Artificial Sequence
  dgRNA
  Gsc2
tcccagcgcagtccc

SEQ ID NO: 4374 - DNA, 15 bp, Artificial Sequence
  dgRNA
  Gsc2
ccggtacccagacga

SEQ ID NO: 4375 - DNA, 15 bp, Artificial Sequence
  dgRNA
  Tubgcp4
cctgaggactcccgc

SEQ ID NO: 4376 - DNA, 15 bp, Artificial Sequence
  dgRNA
  Tubgcp4
ccgccggcccacccc

SEQ ID NO: 4377 - DNA, 15 bp, Artificial Sequence
  dgRNA
  Tubgcp4
gtcccgctctcaagc

SEQ ID NO: 4378 - DNA, 15 bp, Artificial Sequence
  dgRNA
  Tubgcp4
agccggaagtccgag

SEQ ID NO: 4379 - DNA, 15 bp, Artificial Sequence
  dgRNA
  Alkbh3
ttcagcgtctccacc

SEQ ID NO: 4380 - DNA, 15 bp, Artificial Sequence
  dgRNA
  Alkbh3
gccctttagttgcca

SEQ ID NO: 4381 - DNA, 15 bp, Artificial Sequence
  dgRNA
  Alkbh3
gttgccagggatgcg

SEQ ID NO: 4382 - DNA, 15 bp, Artificial Sequence
  dgRNA
  Alkbh3
ggatgcggggcaacc

SEQ ID NO: 4383 - DNA, 15 bp, Artificial Sequence
  dgRNA
  Cntnap5c
gagctcgcatctccg

SEQ ID NO: 4384 - DNA, 15 bp, Artificial Sequence
  dgRNA
  Cntnap5c
agcagaacggagtga

SEQ ID NO: 4385 - DNA, 15 bp, Artificial Sequence
  dgRNA
  Cntnap5c
tggtgcccgtgaatt

SEQ ID NO: 4386 - DNA, 15 bp, Artificial Sequence
  dgRNA
  Cntnap5c
agcgatcgctcactg

SEQ ID NO: 4387 - DNA, 15 bp, Artificial Sequence
  dgRNA
  Picalm
gcgcgtcacgtgacg

SEQ ID NO: 4388 - DNA, 15 bp, Artificial Sequence
  dgRNA
  Picalm
cgcgccgtcccccgc

SEQ ID NO: 4389 - DNA, 15 bp, Artificial Sequence
  dgRNA
  Picalm
gccgtcccccgcggg

SEQ ID NO: 4390 - DNA, 15 bp, Artificial Sequence
  dgRNA
  Picalm
ccgtcccccgcgggc

SEQ ID NO: 4391 - DNA, 15 bp, Artificial Sequence
  dgRNA
  Ttc39b
cctgccaatcctcta

SEQ ID NO: 4392 - DNA, 15 bp, Artificial Sequence
  dgRNA
  Ttc39b
gccaatcctctaggg

SEQ ID NO: 4393 - DNA, 15 bp, Artificial Sequence
  dgRNA
  Ttc39b
cacccgctgactctg

SEQ ID NO: 4394 - DNA, 15 bp, Artificial Sequence
  dgRNA
  Ttc39b
acccgctgactctgt

SEQ ID NO: 4395 - DNA, 15 bp, Artificial Sequence
  dgRNA
  Capzb
cgcccactcgaccac

SEQ ID NO: 4396 - DNA, 15 bp, Artificial Sequence
  dgRNA
  Capzb
gcccactcgaccaca

SEQ ID NO: 4397 - DNA, 15 bp, Artificial Sequence
  dgRNA
  Capzb
gcggcgctccatact

SEQ ID NO: 4398 - DNA, 15 bp, Artificial Sequence
  dgRNA
  Capzb
acttggcgatcgctg

SEQ ID NO: 4399 - DNA, 15 bp, Artificial Sequence
  dgRNA
  Cox14
aagggccgctccagg

SEQ ID NO: 4400 - DNA, 15 bp, Artificial Sequence
  dgRNA
  Cox14
gccgctccaggcggt

SEQ ID NO: 4401 - DNA, 15 bp, Artificial Sequence
  dgRNA
  Cox14
ccgctccaggcggta

SEQ ID NO: 4402 - DNA, 15 bp, Artificial Sequence
  dgRNA
  Cox14
cgctccaggcggtag

SEQ ID NO: 4403 - DNA, 15 bp, Artificial Sequence
  dgRNA
  Npcd
ccctagcaaccgccc

SEQ ID NO: 4404 - DNA, 15 bp, Artificial Sequence
  dgRNA
  Npcd
cctagcaaccgcccc

SEQ ID NO: 4405 - DNA, 15 bp, Artificial Sequence
  dgRNA
  Npcd
ctagcaaccgccccg

SEQ ID NO: 4406 - DNA, 15 bp, Artificial Sequence
  dgRNA
  Npcd
tagcaaccgccccgg

SEQ ID NO: 4407 - DNA, 15 bp, Artificial Sequence
  dgRNA
  Anxa8
gcccaaacattctca

SEQ ID NO: 4408 - DNA, 15 bp, Artificial Sequence
  dgRNA
  Anxa8
ggcccgggcagtgtc

SEQ ID NO: 4409 - DNA, 15 bp, Artificial Sequence
  dgRNA
  Anxa8
gcccgggcagtgtct

SEQ ID NO: 4410 - DNA, 15 bp, Artificial Sequence
  dgRNA
  Anxa8
gccaagcggagcctg

SEQ ID NO: 4411 - DNA, 15 bp, Artificial Sequence
  dgRNA
  Olfr905
aagggattagttcta

SEQ ID NO: 4412 - DNA, 15 bp, Artificial Sequence
  dgRNA
  Olfr905
tgtatgaaagacggt

SEQ ID NO: 4413 - DNA, 15 bp, Artificial Sequence
  dgRNA
  Olfr905
gtatgaaagacggtt

SEQ ID NO: 4414 - DNA, 15 bp, Artificial Sequence
  dgRNA
  Olfr905
tatgaaagacggttg

SEQ ID NO: 4415 - DNA, 15 bp, Artificial Sequence
  dgRNA
  Scarb1
gatgcagacggtgcc

SEQ ID NO: 4416 - DNA, 15 bp, Artificial Sequence
  dgRNA
  Scarb1
atgcagacggtgcca

SEQ ID NO: 4417 - DNA, 15 bp, Artificial Sequence
  dgRNA
  Scarb1
gcccagcagctcgga

SEQ ID NO: 4418 - DNA, 15 bp, Artificial Sequence
  dgRNA
  Scarb1
aggggcggcgcccaa

SEQ ID NO: 4419 - DNA, 15 bp, Artificial Sequence
  dgRNA
  Ablim2
cagtctgcgcctgag

SEQ ID NO: 4420 - DNA, 15 bp, Artificial Sequence
  dgRNA
  Ablim2
ccgcacgtccaactg

SEQ ID NO: 4421 - DNA, 15 bp, Artificial Sequence
  dgRNA
  Ablim2
cacgtccaactgcgg

SEQ ID NO: 4422 - DNA, 15 bp, Artificial Sequence
  dgRNA
  Ablim2
actgcggtggcgcgc

SEQ ID NO: 4423 - DNA, 15 bp, Artificial Sequence
  dgRNA
  Gnl3l
tatttctttacccgc

SEQ ID NO: 4424 - DNA, 15 bp, Artificial Sequence
  dgRNA
  Gnl3l
tacccgccggcagcc

SEQ ID NO: 4425 - DNA, 15 bp, Artificial Sequence
  dgRNA
  Gnl3l
ccgccggcagccagg

SEQ ID NO: 4426 - DNA, 15 bp, Artificial Sequence
  dgRNA
  Gnl3l
aggcggggccagcgt

SEQ ID NO: 4427 - DNA, 15 bp, Artificial Sequence
  dgRNA
  Atp6v1h
gcaccagtggcctgc

SEQ ID NO: 4428 - DNA, 15 bp, Artificial Sequence
  dgRNA
  Atp6v1h
agtgaccaagttaag

SEQ ID NO: 4429 - DNA, 15 bp, Artificial Sequence
  dgRNA
  Atp6v1h
ccaagttaagtggcc

SEQ ID NO: 4430 - DNA, 15 bp, Artificial Sequence
  dgRNA
  Atp6v1h
caagttaagtggcct

SEQ ID NO: 4431 - DNA, 15 bp, Artificial Sequence
  dgRNA
  Usp20
tgctcaccgctcaac

SEQ ID NO: 4432 - DNA, 15 bp, Artificial Sequence
  dgRNA
  Usp20
caccgctcaacagga

SEQ ID NO: 4433 - DNA, 15 bp, Artificial Sequence
  dgRNA
  Usp20
cactcccccgactcc

SEQ ID NO: 4434 - DNA, 15 bp, Artificial Sequence
  dgRNA
  Usp20
gactcccggcatgct

SEQ ID NO: 4435 - DNA, 15 bp, Artificial Sequence
  dgRNA
  Mmp14
ctcctagttagttgc

SEQ ID NO: 4436 - DNA, 15 bp, Artificial Sequence
  dgRNA
  Mmp14
gttagttgccggctg

SEQ ID NO: 4437 - DNA, 15 bp, Artificial Sequence
  dgRNA
  Mmp14
cgtccccaccgaaaa

SEQ ID NO: 4438 - DNA, 15 bp, Artificial Sequence
  dgRNA
  Mmp14
ccccaccgaaaaagg

SEQ ID NO: 4439 - DNA, 15 bp, Artificial Sequence
  dgRNA
  Fam170a
ttagaggggttccat

SEQ ID NO: 4440 - DNA, 15 bp, Artificial Sequence
  dgRNA
  Fam170a
gttccattgggagaa

SEQ ID NO: 4441 - DNA, 15 bp, Artificial Sequence
  dgRNA
  Fam170a
ctctgtgtccgactg

SEQ ID NO: 4442 - DNA, 15 bp, Artificial Sequence
  dgRNA
  Fam170a
ctcatctctcgattg

SEQ ID NO: 4443 - DNA, 15 bp, Artificial Sequence
  dgRNA
  Adam1a
cgaggtataacactt

SEQ ID NO: 4444 - DNA, 15 bp, Artificial Sequence
  dgRNA
  Adam1a
acgaggtataacact

SEQ ID NO: 4445 - DNA, 15 bp, Artificial Sequence
  dgRNA
  Adam1a
aacctaaatcatacg

SEQ ID NO: 4446 - DNA, 15 bp, Artificial Sequence
  dgRNA
  6430548M08Rik
aactcgtacgtcacg

SEQ ID NO: 4447 - DNA, 15 bp, Artificial Sequence
  dgRNA
  6430548M08Rik
actcgtacgtcacgc

SEQ ID NO: 4448 - DNA, 15 bp, Artificial Sequence
  dgRNA
  6430548M08Rik
ctcgtacgtcacgcg

SEQ ID NO: 4449 - DNA, 15 bp, Artificial Sequence
  dgRNA
  6430548M08Rik
tcgtacgtcacgcgg

SEQ ID NO: 4450 - DNA, 15 bp, Artificial Sequence
  dgRNA
  Hfe2
tgccaccaacgttcc

SEQ ID NO: 4451 - DNA, 15 bp, Artificial Sequence
  dgRNA
  Hfe2
acgttcctggaattt

SEQ ID NO: 4452 - DNA, 15 bp, Artificial Sequence
  dgRNA
  Hfe2
aactgtcaactcagt

SEQ ID NO: 4453 - DNA, 15 bp, Artificial Sequence
  dgRNA
  Hfe2
attggataccaaggg

SEQ ID NO: 4454 - DNA, 15 bp, Artificial Sequence
  dgRNA
  Depdc7
caataagactccggt

SEQ ID NO: 4455 - DNA, 15 bp, Artificial Sequence
  dgRNA
  Depdc7
actccggttggagcg

SEQ ID NO: 4456 - DNA, 15 bp, Artificial Sequence
  dgRNA
  Depdc7
ctccggttggagcga

SEQ ID NO: 4457 - DNA, 15 bp, Artificial Sequence
  dgRNA
  Depdc7
cagcgggtctagccc

SEQ ID NO: 4458 - DNA, 15 bp, Artificial Sequence
  dgRNA
  Akr1c14
ctgtagcaattttcc

SEQ ID NO: 4459 - DNA, 15 bp, Artificial Sequence
  dgRNA
  Akr1c14
cacaggataaacgcc

SEQ ID NO: 4460 - DNA, 15 bp, Artificial Sequence
  dgRNA
  Prok2
tgcggcgccccgcgg

SEQ ID NO: 4461 - DNA, 15 bp, Artificial Sequence
  dgRNA
  Prok2
ggggctctgcccgcg

SEQ ID NO: 4462 - DNA, 15 bp, Artificial Sequence
  dgRNA
  Prok2
gtggcgctttgcgcg

SEQ ID NO: 4463 - DNA, 15 bp, Artificial Sequence
  dgRNA
  Prok2
tggcgctttgcgcgt

SEQ ID NO: 4464 - DNA, 15 bp, Artificial Sequence
  dgRNA
  Arid3c
cctcacccgcccagc

SEQ ID NO: 4465 - DNA, 15 bp, Artificial Sequence
  dgRNA
  Arid3c
ctcacccgcccagca

SEQ ID NO: 4466 - DNA, 15 bp, Artificial Sequence
  dgRNA
  Arid3c
cgcccagcagggctc

SEQ ID NO: 4467 - DNA, 15 bp, Artificial Sequence
  dgRNA
  Arid3c
ctcgggtcccgcccc

SEQ ID NO: 4468 - DNA, 15 bp, Artificial Sequence
  dgRNA
  Ccdc122
ctgcgggcgctgacc

SEQ ID NO: 4469 - DNA, 15 bp, Artificial Sequence
  dgRNA
  Cd300lb
ccaccactggtctac

SEQ ID NO: 4470 - DNA, 15 bp, Artificial Sequence
  dgRNA
  Cd300lb
tgagtaactgacggc

SEQ ID NO: 4471 - DNA, 15 bp, Artificial Sequence
  dgRNA
  Cd300lb
cacccacgctataaa

SEQ ID NO: 4472 - DNA, 15 bp, Artificial Sequence
  dgRNA
  Cd300lb
gagcactctggatat

SEQ ID NO: 4473 - DNA, 15 bp, Artificial Sequence
  dgRNA
  Dcakd
ctccaaacctcggcc

SEQ ID NO: 4474 - DNA, 15 bp, Artificial Sequence
  dgRNA
  Dcakd
tctcctgcacgcggc

SEQ ID NO: 4475 - DNA, 15 bp, Artificial Sequence
  dgRNA
  Dcakd
ggccgggccgaggtt

SEQ ID NO: 4476 - DNA, 15 bp, Artificial Sequence
  dgRNA
  Dcakd
cgcgtgcaggagatg

SEQ ID NO: 4477 - DNA, 15 bp, Artificial Sequence
  dgRNA
  Pdlim5
ctgcacgttgaaccc

SEQ ID NO: 4478 - DNA, 15 bp, Artificial Sequence
  dgRNA
  Pdlim5
tgcacgttgaaccct

SEQ ID NO: 4479 - DNA, 15 bp, Artificial Sequence
  dgRNA
  Pdlim5
ggtgaaaagatatac

SEQ ID NO: 4480 - DNA, 15 bp, Artificial Sequence
  dgRNA
  Bcl2l2
cccggtgtgtttctc

SEQ ID NO: 4481 - DNA, 15 bp, Artificial Sequence
  dgRNA
  Bcl2l2
ccggtgtgtttctct

SEQ ID NO: 4482 - DNA, 15 bp, Artificial Sequence
  dgRNA
  Bcl2l2
cactgcgggcttcgc

SEQ ID NO: 4483 - DNA, 15 bp, Artificial Sequence
  dgRNA
  Bcl2l2
cggcacaggtcacta

SEQ ID NO: 4484 - DNA, 15 bp, Artificial Sequence
  dgRNA
  Usp10
gcgcagtaaccactc

SEQ ID NO: 4485 - DNA, 15 bp, Artificial Sequence
  dgRNA
  Usp10
tggagcagccgccct

SEQ ID NO: 4486 - DNA, 15 bp, Artificial Sequence
  dgRNA
  Usp10
cgccctcggcgcgct

SEQ ID NO: 4487 - DNA, 15 bp, Artificial Sequence
  dgRNA
  Usp10
gccctcggcgcgctg

SEQ ID NO: 4488 - DNA, 15 bp, Artificial Sequence
  dgRNA
  Cst6
ggcaactcaaacgtc

SEQ ID NO: 4489 - DNA, 15 bp, Artificial Sequence
  dgRNA
  Cst6
gcaactcaaacgtca

SEQ ID NO: 4490 - DNA, 15 bp, Artificial Sequence
  dgRNA
  Smarca5
gctcgcgtcactcgg

SEQ ID NO: 4491 - DNA, 15 bp, Artificial Sequence
  dgRNA
  Smarca5
cgtcactcggaggag

SEQ ID NO: 4492 - DNA, 15 bp, Artificial Sequence
  dgRNA
  Smarca5
cactcggaggagcgg

SEQ ID NO: 4493 - DNA, 15 bp, Artificial Sequence
  dgRNA
  Smarca5
cgacgcgcttcctcg

SEQ ID NO: 4494 - DNA, 15 bp, Artificial Sequence
  dgRNA
  Srpx2
cacgtgtatgataca

SEQ ID NO: 4495 - DNA, 15 bp, Artificial Sequence
  dgRNA
  Srpx2
tcacgtgtatgatac

SEQ ID NO: 4496 - DNA, 15 bp, Artificial Sequence
  dgRNA
  Srpx2
cgggattgaaagaaa

SEQ ID NO: 4497 - DNA, 15 bp, Artificial Sequence
  dgRNA
  Srpx2
tcgggattgaaagaa

SEQ ID NO: 4498 - DNA, 15 bp, Artificial Sequence
  dgRNA
  Olfr1333
gggctatcatatatc

SEQ ID NO: 4499 - DNA, 15 bp, Artificial Sequence
  dgRNA
  Olfr1333
caggtgttacataga

SEQ ID NO: 4500 - DNA, 15 bp, Artificial Sequence
  dgRNA
  Olfr1333
ggaatctacagatgc

SEQ ID NO: 4501 - DNA, 15 bp, Artificial Sequence
  dgRNA
  Atoh7
gcaggacccaagcta

SEQ ID NO: 4502 - DNA, 15 bp, Artificial Sequence
  dgRNA
  Atoh7
acgtaaagttgaacg

SEQ ID NO: 4503 - DNA, 15 bp, Artificial Sequence
  dgRNA
  Atoh7
gtggaagtgatgctc

SEQ ID NO: 4504 - DNA, 15 bp, Artificial Sequence
  dgRNA
  Atoh7
tagcttgggtcctgc

SEQ ID NO: 4505 - DNA, 15 bp, Artificial Sequence
  dgRNA
  Usp11
gttaacccctggtat

SEQ ID NO: 4506 - DNA, 15 bp, Artificial Sequence
  dgRNA
  Usp11
ccaatttccgccaaa

SEQ ID NO: 4507 - DNA, 15 bp, Artificial Sequence
  dgRNA
  Usp11
gtgacgtttccaaga

SEQ ID NO: 4508 - DNA, 15 bp, Artificial Sequence
  dgRNA
  Usp11
tagccccctgattgt

SEQ ID NO: 4509 - DNA, 15 bp, Artificial Sequence
  dgRNA
  Bpifa6
ttccaacagccgttc

SEQ ID NO: 4510 - DNA, 15 bp, Artificial Sequence
  dgRNA
  Bpifa6
agccgttcaggtctc

SEQ ID NO: 4511 - DNA, 15 bp, Artificial Sequence
  dgRNA
  Bpifa6
tctgaccacacggac

SEQ ID NO: 4512 - DNA, 15 bp, Artificial Sequence
  dgRNA
  Bpifa6
ctgaccacacggact

SEQ ID NO: 4513 - DNA, 15 bp, Artificial Sequence
  dgRNA
  Rsph3a
cgtttggaaagggct

SEQ ID NO: 4514 - DNA, 15 bp, Artificial Sequence
  dgRNA
  Rsph3a
acgtttggaaagggc

SEQ ID NO: 4515 - DNA, 15 bp, Artificial Sequence
  dgRNA
  Rsph3a
ttgtaacgtttggaa

SEQ ID NO: 4516 - DNA, 15 bp, Artificial Sequence
  dgRNA
  Rsph3a
tggacttgtaacgtt

SEQ ID NO: 4517 - DNA, 15 bp, Artificial Sequence
  dgRNA
  Lrp6
cccgcgggggctctc

SEQ ID NO: 4518 - DNA, 15 bp, Artificial Sequence
  dgRNA
  Lrp6
ccgcgggggctctcc

SEQ ID NO: 4519 - DNA, 15 bp, Artificial Sequence
  dgRNA
  Lrp6
cgcgggggctctccg

SEQ ID NO: 4520 - DNA, 15 bp, Artificial Sequence
  dgRNA
  Lrp6
ggctctccggggagt

SEQ ID NO: 4521 - DNA, 15 bp, Artificial Sequence
  dgRNA
  Xirp1
tcctccgggcagact

SEQ ID NO: 4522 - DNA, 15 bp, Artificial Sequence
  dgRNA
  Xirp1
cctccgggcagactt

SEQ ID NO: 4523 - DNA, 15 bp, Artificial Sequence
  dgRNA
  Xirp1
agccctaaaaataac

SEQ ID NO: 4524 - DNA, 15 bp, Artificial Sequence
  dgRNA
  Xirp1
tcacccacccctagc

SEQ ID NO: 4525 - DNA, 15 bp, Artificial Sequence
  dgRNA
  Tchhl1
ttaatgaatctgata

SEQ ID NO: 4526 - DNA, 15 bp, Artificial Sequence
  dgRNA
  Tchhl1
ggtcattacacccag

SEQ ID NO: 4527 - DNA, 15 bp, Artificial Sequence
  dgRNA
  Tchhl1
gtcattacacccaga

SEQ ID NO: 4528 - DNA, 15 bp, Artificial Sequence
  dgRNA
  Tchhl1
gatgattcctccttt

SEQ ID NO: 4529 - DNA, 15 bp, Artificial Sequence
  dgRNA
  Ergic3
ccagcccgcccctct

SEQ ID NO: 4530 - DNA, 15 bp, Artificial Sequence
  dgRNA
  Ergic3
tgcccaatccgcgcg

SEQ ID NO: 4531 - DNA, 15 bp, Artificial Sequence
  dgRNA
  Ergic3
ccaatccgcgcgagg

SEQ ID NO: 4532 - DNA, 15 bp, Artificial Sequence
  dgRNA
  Ergic3
gctagactgcctttg

SEQ ID NO: 4533 - DNA, 15 bp, Artificial Sequence
  dgRNA
  Tmem18
gaaccctccgctttc

SEQ ID NO: 4534 - DNA, 15 bp, Artificial Sequence
  dgRNA
  Tmem18
aaccctccgctttct

SEQ ID NO: 4535 - DNA, 15 bp, Artificial Sequence
  dgRNA
  Tmem18
tgcaataacgaaagt

SEQ ID NO: 4536 - DNA, 15 bp, Artificial Sequence
  dgRNA
  Tmem18
gaagagccaagcgcc

SEQ ID NO: 4537 - DNA, 15 bp, Artificial Sequence
  dgRNA
  Lsr
tgcacaggtcgccta

SEQ ID NO: 4538 - DNA, 15 bp, Artificial Sequence
  dgRNA
  Lsr
gtgcagacgccctcc

SEQ ID NO: 4539 - DNA, 15 bp, Artificial Sequence
  dgRNA
  Lsr
ggcaaagcggtcact

SEQ ID NO: 4540 - DNA, 15 bp, Artificial Sequence
  dgRNA
  Lsr
gcggtcacttggttc

SEQ ID NO: 4541 - DNA, 15 bp, Artificial Sequence
  dgRNA
  Mrpl47
tcacacgagagcccc

SEQ ID NO: 4542 - DNA, 15 bp, Artificial Sequence
  dgRNA
  Mrpl47
cgctctctccctcgg

SEQ ID NO: 4543 - DNA, 15 bp, Artificial Sequence
  dgRNA
  Mrpl47
tcacccgcgtctccg

SEQ ID NO: 4544 - DNA, 15 bp, Artificial Sequence
  dgRNA
  Mrpl47
cccaccgacagtctt

SEQ ID NO: 4545 - DNA, 15 bp, Artificial Sequence
  dgRNA
  Gpr176
cttcgaagctactag

SEQ ID NO: 4546 - DNA, 15 bp, Artificial Sequence
  dgRNA
  Gpr176
ggatcagagcgtgcg

SEQ ID NO: 4547 - DNA, 15 bp, Artificial Sequence
  dgRNA
  Gpr176
gatcagagcgtgcgc

SEQ ID NO: 4548 - DNA, 15 bp, Artificial Sequence
  dgRNA
  Gpr176
atcagagcgtgcgcg

SEQ ID NO: 4549 - DNA, 15 bp, Artificial Sequence
  dgRNA
  Cntn3
gtatgtgcaactgat

SEQ ID NO: 4550 - DNA, 15 bp, Artificial Sequence
  dgRNA
  Cntn3
agtatgtgcaactga

SEQ ID NO: 4551 - DNA, 15 bp, Artificial Sequence
  dgRNA
  Stom
cggtcacgcactctg

SEQ ID NO: 4552 - DNA, 15 bp, Artificial Sequence
  dgRNA
  Stom
ggtcacgcactctga

SEQ ID NO: 4553 - DNA, 15 bp, Artificial Sequence
  dgRNA
  Stom
cacgcactctgaggg

SEQ ID NO: 4554 - DNA, 15 bp, Artificial Sequence
  dgRNA
  Stom
acgcactctgagggc

SEQ ID NO: 4555 - DNA, 15 bp, Artificial Sequence
  dgRNA
  Cep290
cgtatagcctgtgtc

SEQ ID NO: 4556 - DNA, 15 bp, Artificial Sequence
  dgRNA
  Cep290
gtatagcctgtgtca

SEQ ID NO: 4557 - DNA, 15 bp, Artificial Sequence
  dgRNA
  Cep290
tatagcctgtgtcag

SEQ ID NO: 4558 - DNA, 15 bp, Artificial Sequence
  dgRNA
  Cep290
aactaattttcgtcg

SEQ ID NO: 4559 - DNA, 15 bp, Artificial Sequence
  dgRNA
  Zeb2
gtgcattccctcata

SEQ ID NO: 4560 - DNA, 15 bp, Artificial Sequence
  dgRNA
  Zeb2
ttccctcatacggtc

SEQ ID NO: 4561 - DNA, 15 bp, Artificial Sequence
  dgRNA
  Zeb2
caacacaaagcgcct

SEQ ID NO: 4562 - DNA, 15 bp, Artificial Sequence
  dgRNA
  Zeb2
aacacaaagcgcctc

SEQ ID NO: 4563 - DNA, 15 bp, Artificial Sequence
  dgRNA
  Ccnjl
ctttctgcccgggcg

SEQ ID NO: 4564 - DNA, 15 bp, Artificial Sequence
  dgRNA
  Ccnjl
tttctgcccgggcga

SEQ ID NO: 4565 - DNA, 15 bp, Artificial Sequence
  dgRNA
  Ccnjl
ctgcccgggcgaggg

SEQ ID NO: 4566 - DNA, 15 bp, Artificial Sequence
  dgRNA
  Ccnjl
agcgcagctcagcgc

SEQ ID NO: 4567 - DNA, 15 bp, Artificial Sequence
  dgRNA
  Atl2
gtgtggccccgagag

SEQ ID NO: 4568 - DNA, 15 bp, Artificial Sequence
  dgRNA
  Atl2
tgtggccccgagagc

SEQ ID NO: 4569 - DNA, 15 bp, Artificial Sequence
  dgRNA
  Atl2
gccccgagagcggga

SEQ ID NO: 4570 - DNA, 15 bp, Artificial Sequence
  dgRNA
  Atl2
cgagagcgggaaggt

SEQ ID NO: 4571 - DNA, 15 bp, Artificial Sequence
  dgRNA
  Nup50
ccggcgactgtttct

SEQ ID NO: 4572 - DNA, 15 bp, Artificial Sequence
  dgRNA
  Nup50
cggcgactgtttcta

SEQ ID NO: 4573 - DNA, 15 bp, Artificial Sequence
  dgRNA
  Nup50
cgactgtttctaggg

SEQ ID NO: 4574 - DNA, 15 bp, Artificial Sequence
  dgRNA
  Nup50
gactgtttctagggc

SEQ ID NO: 4575 - DNA, 15 bp, Artificial Sequence
  dgRNA
  Usp40
catactccacttaaa

SEQ ID NO: 4576 - DNA, 15 bp, Artificial Sequence
  dgRNA
  Usp40
agctctaacagaatg

SEQ ID NO: 4577 - DNA, 15 bp, Artificial Sequence
  dgRNA
  Usp40
tccaacgctttttgc

SEQ ID NO: 4578 - DNA, 15 bp, Artificial Sequence
  dgRNA
  Usp40
aacttgtaagccgtc

SEQ ID NO: 4579 - DNA, 15 bp, Artificial Sequence
  dgRNA
  Galp
gacctacgtggctga

SEQ ID NO: 4580 - DNA, 15 bp, Artificial Sequence
  dgRNA
  Galp
ctacgtggctgaagg

SEQ ID NO: 4581 - DNA, 15 bp, Artificial Sequence
  dgRNA
  Galp
agccacgtaggtccc

SEQ ID NO: 4582 - DNA, 15 bp, Artificial Sequence
  dgRNA
  Galp
ataacttgtgagtat

SEQ ID NO: 4583 - DNA, 15 bp, Artificial Sequence
  dgRNA
  Pmp22
cctggcgcatctatt

SEQ ID NO: 4584 - DNA, 15 bp, Artificial Sequence
  dgRNA
  Pmp22
ctggcgcatctattc

SEQ ID NO: 4585 - DNA, 15 bp, Artificial Sequence
  dgRNA
  Pmp22
cgcatctattcggga

SEQ ID NO: 4586 - DNA, 15 bp, Artificial Sequence
  dgRNA
  Pmp22
gcatctattcgggat

SEQ ID NO: 4587 - DNA, 15 bp, Artificial Sequence
  dgRNA
  Limk1
gcggatctgtctccg

SEQ ID NO: 4588 - DNA, 15 bp, Artificial Sequence
  dgRNA
  Limk1
cggatctgtctccga

SEQ ID NO: 4589 - DNA, 15 bp, Artificial Sequence
  dgRNA
  Limk1
ggatctgtctccgag

SEQ ID NO: 4590 - DNA, 15 bp, Artificial Sequence
  dgRNA
  Limk1
tgtctccgaggggcg

SEQ ID NO: 4591 - DNA, 15 bp, Artificial Sequence
  dgRNA
  Fcrl1
gtaaactcgtgctga

SEQ ID NO: 4592 - DNA, 15 bp, Artificial Sequence
  dgRNA
  Fcrl1
tgaggaagtcgtggt

SEQ ID NO: 4593 - DNA, 15 bp, Artificial Sequence
  dgRNA
  Fcrl1
ggtttgaggaagtcg

SEQ ID NO: 4594 - DNA, 15 bp, Artificial Sequence
  dgRNA
  Fcrl1
ccagactactcacag

SEQ ID NO: 4595 - DNA, 15 bp, Artificial Sequence
  dgRNA
  5730455P16Rik
tccaagtccaggatt

SEQ ID NO: 4596 - DNA, 15 bp, Artificial Sequence
  dgRNA
  5730455P16Rik
ccaagtccaggattc

SEQ ID NO: 4597 - DNA, 15 bp, Artificial Sequence
  dgRNA
  5730455P16Rik
agtccaggattcggg

SEQ ID NO: 4598 - DNA, 15 bp, Artificial Sequence
  dgRNA
  5730455P16Rik
gaactcagatgtgcg

SEQ ID NO: 4599 - DNA, 15 bp, Artificial Sequence
  dgRNA
  Tmem95
caggggtggctctac

SEQ ID NO: 4600 - DNA, 15 bp, Artificial Sequence
  dgRNA
  Tmem95
gctctaccggagccg

SEQ ID NO: 4601 - DNA, 15 bp, Artificial Sequence
  dgRNA
  Tmem95
ctctaccggagccga

SEQ ID NO: 4602 - DNA, 15 bp, Artificial Sequence
  dgRNA
  Tmem95
tctaccggagccgag

SEQ ID NO: 4603 - DNA, 15 bp, Artificial Sequence
  dgRNA
  Cdh23
tcaggacgatcccca

SEQ ID NO: 4604 - DNA, 15 bp, Artificial Sequence
  dgRNA
  Cdh23
agtggcgggctctta

SEQ ID NO: 4605 - DNA, 15 bp, Artificial Sequence
  dgRNA
  Cdh23
tatggcatgtctgcc

SEQ ID NO: 4606 - DNA, 15 bp, Artificial Sequence
  dgRNA
  Cdh23
gtttcctcataatgg

SEQ ID NO: 4607 - DNA, 15 bp, Artificial Sequence
  dgRNA
  Cyth4
agtgcgctctgtgtc

SEQ ID NO: 4608 - DNA, 15 bp, Artificial Sequence
  dgRNA
  Cyth4
gagcgcacttcctaa

SEQ ID NO: 4609 - DNA, 15 bp, Artificial Sequence
  dgRNA
  Eftud2
ccacgcttcgttttg

SEQ ID NO: 4610 - DNA, 15 bp, Artificial Sequence
  dgRNA
  Eftud2
tgaggaccaacaagt

SEQ ID NO: 4611 - DNA, 15 bp, Artificial Sequence
  dgRNA
  Eftud2
tcgaagctgttcctt

SEQ ID NO: 4612 - DNA, 15 bp, Artificial Sequence
  dgRNA
  Eftud2
ctgtcctccgaggcg

SEQ ID NO: 4613 - DNA, 15 bp, Artificial Sequence
  dgRNA
  Sema7a
gctgggttctcccgg

SEQ ID NO: 4614 - DNA, 15 bp, Artificial Sequence
  dgRNA
  Sema7a
ggagttgcccgcgtg

SEQ ID NO: 4615 - DNA, 15 bp, Artificial Sequence
  dgRNA
  Sema7a
gagttgcccgcgtgc

SEQ ID NO: 4616 - DNA, 15 bp, Artificial Sequence
  dgRNA
  Sema7a
gcgtgcgggtagcga

SEQ ID NO: 4617 - DNA, 15 bp, Artificial Sequence
  dgRNA
  Tmem196
aagaggacaacaacg

SEQ ID NO: 4618 - DNA, 15 bp, Artificial Sequence
  dgRNA
  Tmem196
agaggacaacaacgg

SEQ ID NO: 4619 - DNA, 15 bp, Artificial Sequence
  dgRNA
  Tmem196
caaggtcgctttttc

SEQ ID NO: 4620 - DNA, 15 bp, Artificial Sequence
  dgRNA
  Tmem196
ttaggaggctaacgg

SEQ ID NO: 4621 - DNA, 15 bp, Artificial Sequence
  dgRNA
  Gabarap
tgtgttcctccgctc

SEQ ID NO: 4622 - DNA, 15 bp, Artificial Sequence
  dgRNA
  Gabarap
tgtagtccttatctt

SEQ ID NO: 4623 - DNA, 15 bp, Artificial Sequence
  dgRNA
  Gabarap
gtagtccttatcttt

SEQ ID NO: 4624 - DNA, 15 bp, Artificial Sequence
  dgRNA
  Gabarap
gtgccaacacctcgt

SEQ ID NO: 4625 - DNA, 15 bp, Artificial Sequence
  dgRNA
  Ap1m1
caggccccgctcttc

SEQ ID NO: 4626 - DNA, 15 bp, Artificial Sequence
  dgRNA
  Ap1m1
acgccccctgacttc

SEQ ID NO: 4627 - DNA, 15 bp, Artificial Sequence
  dgRNA
  Ap1m1
ggcccgtttgagcta

SEQ ID NO: 4628 - DNA, 15 bp, Artificial Sequence
  dgRNA
  Ap1m1
gcccgtttgagctat

SEQ ID NO: 4629 - DNA, 15 bp, Artificial Sequence
  dgRNA
  Mfsd1
accaccacttcctac

SEQ ID NO: 4630 - DNA, 15 bp, Artificial Sequence
  dgRNA
  Mfsd1
actcccactcccgac

SEQ ID NO: 4631 - DNA, 15 bp, Artificial Sequence
  dgRNA
  Mfsd1
ggatctataccccat

SEQ ID NO: 4632 - DNA, 15 bp, Artificial Sequence
  dgRNA
  Mfsd1
atcggcagaacagaa

SEQ ID NO: 4633 - DNA, 15 bp, Artificial Sequence
  dgRNA
  Olfr25
acatgcattattagg

SEQ ID NO: 4634 - DNA, 15 bp, Artificial Sequence
  dgRNA
  Olfr25
attaggaggatagca

SEQ ID NO: 4635 - DNA, 15 bp, Artificial Sequence
  dgRNA
  Olfr25
gatagcaaggtacta

SEQ ID NO: 4636 - DNA, 15 bp, Artificial Sequence
  dgRNA
  Olfr25
atagcaaggtactaa

SEQ ID NO: 4637 - DNA, 15 bp, Artificial Sequence
  dgRNA
  Ildr1
gcgcgcagacggaga

SEQ ID NO: 4638 - DNA, 15 bp, Artificial Sequence
  dgRNA
  Ildr1
gacggagacggctag

SEQ ID NO: 4639 - DNA, 15 bp, Artificial Sequence
  dgRNA
  Ildr1
gtttcctgcggagat

SEQ ID NO: 4640 - DNA, 15 bp, Artificial Sequence
  dgRNA
  Ildr1
cggagatgggtcacc

SEQ ID NO: 4641 - DNA, 15 bp, Artificial Sequence
  dgRNA
  Efs
gctcacccccgcagc

SEQ ID NO: 4642 - DNA, 15 bp, Artificial Sequence
  dgRNA
  Efs
gcgtgctcaaaccgc

SEQ ID NO: 4643 - DNA, 15 bp, Artificial Sequence
  dgRNA
  Efs
cgtgctcaaaccgcc

SEQ ID NO: 4644 - DNA, 15 bp, Artificial Sequence
  dgRNA
  Efs
cgggaccctagcgcg

SEQ ID NO: 4645 - DNA, 15 bp, Artificial Sequence
  dgRNA
  Akt1s1
tgtcgctcttgccca

SEQ ID NO: 4646 - DNA, 15 bp, Artificial Sequence
  dgRNA
  Akt1s1
cccacggcttgccga

SEQ ID NO: 4647 - DNA, 15 bp, Artificial Sequence
  dgRNA
  Akt1s1
catgcaggataaggg

SEQ ID NO: 4648 - DNA, 15 bp, Artificial Sequence
  dgRNA
  Akt1s1
gagtgtacacaatgg

SEQ ID NO: 4649 - DNA, 15 bp, Artificial Sequence
  dgRNA
  Ptgr2
gttaatttgctctct

SEQ ID NO: 4650 - DNA, 15 bp, Artificial Sequence
  dgRNA
  Ptgr2
ttggtcctggaggcg

SEQ ID NO: 4651 - DNA, 15 bp, Artificial Sequence
  dgRNA
  Ptgr2
aggcggggtcggcca

SEQ ID NO: 4652 - DNA, 15 bp, Artificial Sequence
  dgRNA
  Ptgr2
cacggagccctaatg

SEQ ID NO: 4653 - DNA, 15 bp, Artificial Sequence
  dgRNA
  Wfdc5
ccaagtcagcaatac

SEQ ID NO: 4654 - DNA, 15 bp, Artificial Sequence
  dgRNA
  Wfdc5
gcaccccttgcccta

SEQ ID NO: 4655 - DNA, 15 bp, Artificial Sequence
  dgRNA
  Wfdc5
tgccctaaggacatc

SEQ ID NO: 4656 - DNA, 15 bp, Artificial Sequence
  dgRNA
  Wfdc5
agtcttgcccgtctc

SEQ ID NO: 4657 - DNA, 15 bp, Artificial Sequence
  dgRNA
  Oaz1
ccaactaatcatcaa

SEQ ID NO: 4658 - DNA, 15 bp, Artificial Sequence
  dgRNA
  Oaz1
tcgccaatcagaagc

SEQ ID NO: 4659 - DNA, 15 bp, Artificial Sequence
  dgRNA
  Oaz1
atcagaagccggagt

SEQ ID NO: 4660 - DNA, 15 bp, Artificial Sequence
  dgRNA
  Oaz1
taggtgggacgcatt

SEQ ID NO: 4661 - DNA, 15 bp, Artificial Sequence
  dgRNA
  Gnas
tttccccccgccgca

SEQ ID NO: 4662 - DNA, 15 bp, Artificial Sequence
  dgRNA
  Gnas
ccccgccgcacggcc

SEQ ID NO: 4663 - DNA, 15 bp, Artificial Sequence
  dgRNA
  Gnas
cgcacggccaggccc

SEQ ID NO: 4664 - DNA, 15 bp, Artificial Sequence
  dgRNA
  Gnas
aagggggcggccccg

SEQ ID NO: 4665 - DNA, 15 bp, Artificial Sequence
  dgRNA
  Rbfox3
tggccgcgcgaccgc

SEQ ID NO: 4666 - DNA, 15 bp, Artificial Sequence
  dgRNA
  Rbfox3
gccagaggaacgagg

SEQ ID NO: 4667 - DNA, 15 bp, Artificial Sequence
  dgRNA
  Rbfox3
gagggcggcgaggca

SEQ ID NO: 4668 - DNA, 15 bp, Artificial Sequence
  dgRNA
  Rbfox3
tcgcgcggccaggga

SEQ ID NO: 4669 - DNA, 15 bp, Artificial Sequence
  dgRNA
  Dclk3
caactccaccgcccc

SEQ ID NO: 4670 - DNA, 15 bp, Artificial Sequence
  dgRNA
  Dclk3
aactccaccgccccc

SEQ ID NO: 4671 - DNA, 15 bp, Artificial Sequence
  dgRNA
  Dclk3
tccaccgcccccggg

SEQ ID NO: 4672 - DNA, 15 bp, Artificial Sequence
  dgRNA
  Dclk3
gcccccgggtggcct

SEQ ID NO: 4673 - DNA, 15 bp, Artificial Sequence
  dgRNA
  Tekt1
tgacgttttctcagc

SEQ ID NO: 4674 - DNA, 15 bp, Artificial Sequence
  dgRNA
  Tekt1
cgcagtcttctaact

SEQ ID NO: 4675 - DNA, 15 bp, Artificial Sequence
  dgRNA
  Tekt1
gcagtcttctaacta

SEQ ID NO: 4676 - DNA, 15 bp, Artificial Sequence
  dgRNA
  Tekt1
aacgttgcgtccgtc

SEQ ID NO: 4677 - DNA, 15 bp, Artificial Sequence
  dgRNA
  Cipc
gtgccaaccatcgag

SEQ ID NO: 4678 - DNA, 15 bp, Artificial Sequence
  dgRNA
  Cipc
gaggagcatcgctgt

SEQ ID NO: 4679 - DNA, 15 bp, Artificial Sequence
  dgRNA
  Cipc
gcgtcgccctctcct

SEQ ID NO: 4680 - DNA, 15 bp, Artificial Sequence
  dgRNA
  Cipc
ctcctcggtgctccg

SEQ ID NO: 4681 - DNA, 15 bp, Artificial Sequence
  dgRNA
  Lrba
tccccggtcccgtcc

SEQ ID NO: 4682 - DNA, 15 bp, Artificial Sequence
  dgRNA
  Lrba
tgtccccgtccccgc

SEQ ID NO: 4683 - DNA, 15 bp, Artificial Sequence
  dgRNA
  Lrba
tccccgcaggcgcgt

SEQ ID NO: 4684 - DNA, 15 bp, Artificial Sequence
  dgRNA
  Lrba
ccccgcaggcgcgtc

SEQ ID NO: 4685 - DNA, 15 bp, Artificial Sequence
  dgRNA
  Ralgapa2
agtgcgtgaacagtc

SEQ ID NO: 4686 - DNA, 15 bp, Artificial Sequence
  dgRNA
  Ralgapa2
gtgcgtgaacagtcc

SEQ ID NO: 4687 - DNA, 15 bp, Artificial Sequence
  dgRNA
  Ralgapa2
gcgcgtgcgtcgcgc

SEQ ID NO: 4688 - DNA, 15 bp, Artificial Sequence
  dgRNA
  Ralgapa2
cgtgcgtcgcgccgg

SEQ ID NO: 4689 - DNA, 15 bp, Artificial Sequence
  dgRNA
  Mn1
tgcttctcccggcgc

SEQ ID NO: 4690 - DNA, 15 bp, Artificial Sequence
  dgRNA
  Mn1
cccggcgccggcgag

SEQ ID NO: 4691 - DNA, 15 bp, Artificial Sequence
  dgRNA
  Mn1
ggcgagaggcagacg

SEQ ID NO: 4692 - DNA, 15 bp, Artificial Sequence
  dgRNA
  Mn1
cgcggagcggaatcc

SEQ ID NO: 4693 - DNA, 15 bp, Artificial Sequence
  dgRNA
  Ffar4
ccacccacggtgttc

SEQ ID NO: 4694 - DNA, 15 bp, Artificial Sequence
  dgRNA
  Ffar4
ggcacttcctcgttc

SEQ ID NO: 4695 - DNA, 15 bp, Artificial Sequence
  dgRNA
  Ffar4
cgttccggtgcgccc

SEQ ID NO: 4696 - DNA, 15 bp, Artificial Sequence
  dgRNA
  Ffar4
cctacgcccagagcc

SEQ ID NO: 4697 - DNA, 15 bp, Artificial Sequence
  dgRNA
  Sdhaf3
caacagccgcgcctt

SEQ ID NO: 4698 - DNA, 15 bp, Artificial Sequence
  dgRNA
  Sdhaf3
cgcccgccccaaatc

SEQ ID NO: 4699 - DNA, 15 bp, Artificial Sequence
  dgRNA
  Sdhaf3
gcccgccccaaatcc

SEQ ID NO: 4700 - DNA, 15 bp, Artificial Sequence
  dgRNA
  Sdhaf3
ccaaatccgggtttc

SEQ ID NO: 4701 - DNA, 15 bp, Artificial Sequence
  dgRNA
  Lgals7
cttgcgcagcctttc

SEQ ID NO: 4702 - DNA, 15 bp, Artificial Sequence
  dgRNA
  Lgals7
atccactagatctcc

SEQ ID NO: 4703 - DNA, 15 bp, Artificial Sequence
  dgRNA
  Lgals7
tccactagatctcca

SEQ ID NO: 4704 - DNA, 15 bp, Artificial Sequence
  dgRNA
  Lgals7
ccactagatctccag

SEQ ID NO: 4705 - DNA, 15 bp, Artificial Sequence
  dgRNA
  Pin1
cgagccaatcggcag

SEQ ID NO: 4706 - DNA, 15 bp, Artificial Sequence
  dgRNA
  Pin1
aatcggcagtggtgt

SEQ ID NO: 4707 - DNA, 15 bp, Artificial Sequence
  dgRNA
  Pin1
atcggcagtggtgtt

SEQ ID NO: 4708 - DNA, 15 bp, Artificial Sequence
  dgRNA
  Pin1
ggggcggtccgaccg

SEQ ID NO: 4709 - DNA, 15 bp, Artificial Sequence
  dgRNA
  Zscan26
aacagtcaaacgaaa

SEQ ID NO: 4710 - DNA, 15 bp, Artificial Sequence
  dgRNA
  Zscan26
aacttagacccagtc

SEQ ID NO: 4711 - DNA, 15 bp, Artificial Sequence
  dgRNA
  Zscan26
caccgagttgagtcc

SEQ ID NO: 4712 - DNA, 15 bp, Artificial Sequence
  dgRNA
  Zscan26
cccatcgtcctagag

SEQ ID NO: 4713 - DNA, 15 bp, Artificial Sequence
  dgRNA
  Tmem248
cgagtgataaatttc

SEQ ID NO: 4714 - DNA, 15 bp, Artificial Sequence
  dgRNA
  Tmem248
acccgccgctcgccc

SEQ ID NO: 4715 - DNA, 15 bp, Artificial Sequence
  dgRNA
  Tmem248
cgccgccgtcgcgcg

SEQ ID NO: 4716 - DNA, 15 bp, Artificial Sequence
  dgRNA
  Tmem248
gccgccgtcgcgcgc

SEQ ID NO: 4717 - DNA, 15 bp, Artificial Sequence
  dgRNA
  Otud3
gcactacccaccacg

SEQ ID NO: 4718 - DNA, 15 bp, Artificial Sequence
  dgRNA
  Otud3
cactacccaccacga

SEQ ID NO: 4719 - DNA, 15 bp, Artificial Sequence
  dgRNA
  Otud3
actacccaccacgag

SEQ ID NO: 4720 - DNA, 15 bp, Artificial Sequence
  dgRNA
  Otud3
ctacccaccacgagg

SEQ ID NO: 4721 - DNA, 15 bp, Artificial Sequence
  dgRNA
  Pik3cd
agcacctcggcctat

SEQ ID NO: 4722 - DNA, 15 bp, Artificial Sequence
  dgRNA
  Pik3cd
gcacctcggcctata

SEQ ID NO: 4723 - DNA, 15 bp, Artificial Sequence
  dgRNA
  Pik3cd
cctcggcctataggg

SEQ ID NO: 4724 - DNA, 15 bp, Artificial Sequence
  dgRNA
  Pik3cd
tagggtggcttaaat

SEQ ID NO: 4725 - DNA, 15 bp, Artificial Sequence
  dgRNA
  Mettl21c
gacattatggatctt

SEQ ID NO: 4726 - DNA, 15 bp, Artificial Sequence
  dgRNA
  Mettl21c
acattatggatcttt

SEQ ID NO: 4727 - DNA, 15 bp, Artificial Sequence
  dgRNA
  Mettl21c
tgccccaacctgaaa

SEQ ID NO: 4728 - DNA, 15 bp, Artificial Sequence
  dgRNA
  Ctnnd2
tgctgtctgttcccg

SEQ ID NO: 4729 - DNA, 15 bp, Artificial Sequence
  dgRNA
  Ctnnd2
gttcccggggatgcg

SEQ ID NO: 4730 - DNA, 15 bp, Artificial Sequence
  dgRNA
  Ctnnd2
cgcgaaaaccagaag

SEQ ID NO: 4731 - DNA, 15 bp, Artificial Sequence
  dgRNA
  Ctnnd2
gaagtggaattcgcg

SEQ ID NO: 4732 - DNA, 15 bp, Artificial Sequence
  dgRNA
  Zbtb9
ttactgcggagcccg

SEQ ID NO: 4733 - DNA, 15 bp, Artificial Sequence
  dgRNA
  Zbtb9
tccgcacagccaatg

SEQ ID NO: 4734 - DNA, 15 bp, Artificial Sequence
  dgRNA
  Zbtb9
gaggagacggcttgt

SEQ ID NO: 4735 - DNA, 15 bp, Artificial Sequence
  dgRNA
  Zbtb9
cccgccgcgcgaggt

SEQ ID NO: 4736 - DNA, 15 bp, Artificial Sequence
  dgRNA
  Rplp0
aaagcgcgcctcctg

SEQ ID NO: 4737 - DNA, 15 bp, Artificial Sequence
  dgRNA
  Rplp0
cgcgcctcctgcggc

SEQ ID NO: 4738 - DNA, 15 bp, Artificial Sequence
  dgRNA
  Rplp0
gcgcctcctgcggcc

SEQ ID NO: 4739 - DNA, 15 bp, Artificial Sequence
  dgRNA
  Rplp0
actttcccgacttgc

SEQ ID NO: 4740 - DNA, 15 bp, Artificial Sequence
  dgRNA
  Plxdc2
gctcagccaatggac

SEQ ID NO: 4741 - DNA, 15 bp, Artificial Sequence
  dgRNA
  Plxdc2
gctggctgcgggttt

SEQ ID NO: 4742 - DNA, 15 bp, Artificial Sequence
  dgRNA
  Plxdc2
gctgcgggttttggg

SEQ ID NO: 4743 - DNA, 15 bp, Artificial Sequence
  dgRNA
  Plxdc2
ggtagatctagcaaa

SEQ ID NO: 4744 - DNA, 15 bp, Artificial Sequence
  dgRNA
  Il5
ggactcgcctttatt

SEQ ID NO: 4745 - DNA, 15 bp, Artificial Sequence
  dgRNA
  Il5
cgagtcctgaaactc

SEQ ID NO: 4746 - DNA, 15 bp, Artificial Sequence
  dgRNA
  Il5
ctaacaatcagatag

SEQ ID NO: 4747 - DNA, 15 bp, Artificial Sequence
  dgRNA
  Sh3bgrl3
agccggtccccagca

SEQ ID NO: 4748 - DNA, 15 bp, Artificial Sequence
  dgRNA
  Sh3bgrl3
gccggtccccagcat

SEQ ID NO: 4749 - DNA, 15 bp, Artificial Sequence
  dgRNA
  Sh3bgrl3
ccggtccccagcatg

SEQ ID NO: 4750 - DNA, 15 bp, Artificial Sequence
  dgRNA
  Sh3bgrl3
ggtcctcccggctcc

SEQ ID NO: 4751 - DNA, 15 bp, Artificial Sequence
  dgRNA
  Grik2
tacctagtccttgca

SEQ ID NO: 4752 - DNA, 15 bp, Artificial Sequence
  dgRNA
  Grik2
tagtccttgcagggc

SEQ ID NO: 4753 - DNA, 15 bp, Artificial Sequence
  dgRNA
  Grik2
tctcccaggctcgcg

SEQ ID NO: 4754 - DNA, 15 bp, Artificial Sequence
  dgRNA
  Grik2
ccaggctcgcgcggc

SEQ ID NO: 4755 - DNA, 15 bp, Artificial Sequence
  dgRNA
  Grid2
aaaaaccgtcaaggc

SEQ ID NO: 4756 - DNA, 15 bp, Artificial Sequence
  dgRNA
  Grid2
aaccgtcaaggcagg

SEQ ID NO: 4757 - DNA, 15 bp, Artificial Sequence
  dgRNA
  Grid2
accgtcaaggcaggt

SEQ ID NO: 4758 - DNA, 15 bp, Artificial Sequence
  dgRNA
  Grid2
ccgtcaaggcaggtg

SEQ ID NO: 4759 - DNA, 15 bp, Artificial Sequence
  dgRNA
  Tia1
gaaatcctaaactac

SEQ ID NO: 4760 - DNA, 15 bp, Artificial Sequence
  dgRNA
  Tia1
tgcctggtggcagcg

SEQ ID NO: 4761 - DNA, 15 bp, Artificial Sequence
  dgRNA
  Tia1
caatgccagtagttt

SEQ ID NO: 4762 - DNA, 15 bp, Artificial Sequence
  dgRNA
  Tia1
cgctgccaccaggca

SEQ ID NO: 4763 - DNA, 15 bp, Artificial Sequence
  dgRNA
  BC026585
ccagcgaagagatca

SEQ ID NO: 4764 - DNA, 15 bp, Artificial Sequence
  dgRNA
  BC026585
cagcgaagagatcaa

SEQ ID NO: 4765 - DNA, 15 bp, Artificial Sequence
  dgRNA
  BC026585
gttgcacacactgtt

SEQ ID NO: 4766 - DNA, 15 bp, Artificial Sequence
  dgRNA
  BC026585
gtctaaccctagaag

SEQ ID NO: 4767 - DNA, 15 bp, Artificial Sequence
  dgRNA
  Gm614
ctctaaactgacccc

SEQ ID NO: 4768 - DNA, 15 bp, Artificial Sequence
  dgRNA
  Gm614
ggaattgggccaaca

SEQ ID NO: 4769 - DNA, 15 bp, Artificial Sequence
  dgRNA
  Gm614
gagcttcgaggaatt

SEQ ID NO: 4770 - DNA, 15 bp, Artificial Sequence
  dgRNA
  Gm614
ggagcttcgaggaat

SEQ ID NO: 4771 - DNA, 15 bp, Artificial Sequence
  dgRNA
  Haus7
ccctgaggtgcgcgc

SEQ ID NO: 4772 - DNA, 15 bp, Artificial Sequence
  dgRNA
  Haus7
gagcggcagcccaat

SEQ ID NO: 4773 - DNA, 15 bp, Artificial Sequence
  dgRNA
  Haus7
tgacgcccgtcccga

SEQ ID NO: 4774 - DNA, 15 bp, Artificial Sequence
  dgRNA
  Haus7
gcccgtcccgatggt

SEQ ID NO: 4775 - DNA, 15 bp, Artificial Sequence
  dgRNA
  Cep95
ctgagaacccgtaag

SEQ ID NO: 4776 - DNA, 15 bp, Artificial Sequence
  dgRNA
  Cep95
tgagaacccgtaagc

SEQ ID NO: 4777 - DNA, 15 bp, Artificial Sequence
  dgRNA
  Cep95
gcgggatcttgaccg

SEQ ID NO: 4778 - DNA, 15 bp, Artificial Sequence
  dgRNA
  Cep95
cgggatcttgaccgc

SEQ ID NO: 4779 - DNA, 15 bp, Artificial Sequence
  dgRNA
  Siah1b
gctgcggtcgaaagc

SEQ ID NO: 4780 - DNA, 15 bp, Artificial Sequence
  dgRNA
  Siah1b
gtcgaaagccggagc

SEQ ID NO: 4781 - DNA, 15 bp, Artificial Sequence
  dgRNA
  Siah1b
agagccggattgagc

SEQ ID NO: 4782 - DNA, 15 bp, Artificial Sequence
  dgRNA
  Siah1b
ggattgagccggaac

SEQ ID NO: 4783 - DNA, 15 bp, Artificial Sequence
  dgRNA
  St18
acaacagacccttgt

SEQ ID NO: 4784 - DNA, 15 bp, Artificial Sequence
  dgRNA
  St18
ttgtaggatgcctga

SEQ ID NO: 4785 - DNA, 15 bp, Artificial Sequence
  dgRNA
  St18
ttcaggcatcctaca

SEQ ID NO: 4786 - DNA, 15 bp, Artificial Sequence
  dgRNA
  St18
agtaagcgaacaagc

SEQ ID NO: 4787 - DNA, 15 bp, Artificial Sequence
  dgRNA
  Carhsp1
ccgctgccgagtccc

SEQ ID NO: 4788 - DNA, 15 bp, Artificial Sequence
  dgRNA
  Carhsp1
cggctcccgcccgcg

SEQ ID NO: 4789 - DNA, 15 bp, Artificial Sequence
  dgRNA
  Carhsp1
ggggcatcaacacaa

SEQ ID NO: 4790 - DNA, 15 bp, Artificial Sequence
  dgRNA
  Carhsp1
tccccgaccagtcca

SEQ ID NO: 4791 - DNA, 15 bp, Artificial Sequence
  dgRNA
  Prox2
aattcttagcggaga

SEQ ID NO: 4792 - DNA, 15 bp, Artificial Sequence
  dgRNA
  Prox2
gaaactgtctgagcg

SEQ ID NO: 4793 - DNA, 15 bp, Artificial Sequence
  dgRNA
  Prox2
aggtgggaaatcacg

SEQ ID NO: 4794 - DNA, 15 bp, Artificial Sequence
  dgRNA
  Prox2
ggtgggaaatcacgg

SEQ ID NO: 4795 - DNA, 15 bp, Artificial Sequence
  dgRNA
  Atg9b
tgggagtgcaattgt

SEQ ID NO: 4796 - DNA, 15 bp, Artificial Sequence
  dgRNA
  Atg9b
ccacttgtgcccttg

SEQ ID NO: 4797 - DNA, 15 bp, Artificial Sequence
  dgRNA
  Atg9b
gcaaaatcctatcag

SEQ ID NO: 4798 - DNA, 15 bp, Artificial Sequence
  dgRNA
  Atg9b
ggctcaagagctatt

SEQ ID NO: 4799 - DNA, 15 bp, Artificial Sequence
  dgRNA
  Fgf15
cagggtcgcaaaggg

SEQ ID NO: 4800 - DNA, 15 bp, Artificial Sequence
  dgRNA
  Fgf15
agggtcgcaaagggg

SEQ ID NO: 4801 - DNA, 15 bp, Artificial Sequence
  dgRNA
  Fgf15
cagatctggccggcc

SEQ ID NO: 4802 - DNA, 15 bp, Artificial Sequence
  dgRNA
  Fgf15
agatctggccggcct

SEQ ID NO: 4803 - DNA, 15 bp, Artificial Sequence
  dgRNA
  Elane
tggtattcagcagca

SEQ ID NO: 4804 - DNA, 15 bp, Artificial Sequence
  dgRNA
  Elane
ccactgtcgtgtccc

SEQ ID NO: 4805 - DNA, 15 bp, Artificial Sequence
  dgRNA
  Elane
cactgtcgtgtccca

SEQ ID NO: 4806 - DNA, 15 bp, Artificial Sequence
  dgRNA
  Elane
tgtcgtgtcccaggg

SEQ ID NO: 4807 - DNA, 15 bp, Artificial Sequence
  dgRNA
  Fam210b
cacccactcatggat

SEQ ID NO: 4808 - DNA, 15 bp, Artificial Sequence
  dgRNA
  Fam210b
ggcggagctgttggg

SEQ ID NO: 4809 - DNA, 15 bp, Artificial Sequence
  dgRNA
  Fam210b
cgctcagctccgctc

SEQ ID NO: 4810 - DNA, 15 bp, Artificial Sequence
  dgRNA
  Fam210b
ctcagctccgctccg

SEQ ID NO: 4811 - DNA, 15 bp, Artificial Sequence
  dgRNA
  Wdr83
cccaatagcagtgag

SEQ ID NO: 4812 - DNA, 15 bp, Artificial Sequence
  dgRNA
  Wdr83
cgctgaaattttgca

SEQ ID NO: 4813 - DNA, 15 bp, Artificial Sequence
  dgRNA
  Wdr83
agaagcgctggctac

SEQ ID NO: 4814 - DNA, 15 bp, Artificial Sequence
  dgRNA
  Wdr83
cgttaatgacagttt

SEQ ID NO: 4815 - DNA, 15 bp, Artificial Sequence
  dgRNA
  Cog2
ctcggtgcatgcgtg

SEQ ID NO: 4816 - DNA, 15 bp, Artificial Sequence
  dgRNA
  Cog2
accacgctcgactcc

SEQ ID NO: 4817 - DNA, 15 bp, Artificial Sequence
  dgRNA
  Cog2
acgctcgactcccgg

SEQ ID NO: 4818 - DNA, 15 bp, Artificial Sequence
  dgRNA
  Cog2
ggaggcagtagcgcc

SEQ ID NO: 4819 - DNA, 15 bp, Artificial Sequence
  dgRNA
  Szt2
tcaccctcccgccag

SEQ ID NO: 4820 - DNA, 15 bp, Artificial Sequence
  dgRNA
  Szt2
ccgccagcggctata

SEQ ID NO: 4821 - DNA, 15 bp, Artificial Sequence
  dgRNA
  Szt2
tcacctgcattgccg

SEQ ID NO: 4822 - DNA, 15 bp, Artificial Sequence
  dgRNA
  Szt2
tgcattgccgcggcc

SEQ ID NO: 4823 - DNA, 15 bp, Artificial Sequence
  dgRNA
  Eif1
ctccgccagttttcg

SEQ ID NO: 4824 - DNA, 15 bp, Artificial Sequence
  dgRNA
  Eif1
actgcgcaagcgcgc

SEQ ID NO: 4825 - DNA, 15 bp, Artificial Sequence
  dgRNA
  Eif1
gcgcaagcgcgcagg

SEQ ID NO: 4826 - DNA, 15 bp, Artificial Sequence
  dgRNA
  Eif1
cgccccccgaccaat

SEQ ID NO: 4827 - DNA, 15 bp, Artificial Sequence
  dgRNA
  Cox6a2
tgggtcttgactggc

SEQ ID NO: 4828 - DNA, 15 bp, Artificial Sequence
  dgRNA
  Cox6a2
ggatggctattttta

SEQ ID NO: 4829 - DNA, 15 bp, Artificial Sequence
  dgRNA
  Cox6a2
gagcccgcacatgga

SEQ ID NO: 4830 - DNA, 15 bp, Artificial Sequence
  dgRNA
  Dclre1a
agggtcgcgctccag

SEQ ID NO: 4831 - DNA, 15 bp, Artificial Sequence
  dgRNA
  Dclre1a
cgctccagaggagct

SEQ ID NO: 4832 - DNA, 15 bp, Artificial Sequence
  dgRNA
  Dclre1a
cctttgaagcccggc

SEQ ID NO: 4833 - DNA, 15 bp, Artificial Sequence
  dgRNA
  Dclre1a
tgagatcagccgatt

SEQ ID NO: 4834 - DNA, 15 bp, Artificial Sequence
  dgRNA
  Nsmce1
gttttactacgacac

SEQ ID NO: 4835 - DNA, 15 bp, Artificial Sequence
  dgRNA
  Nsmce1
ctacgacacaggccg

SEQ ID NO: 4836 - DNA, 15 bp, Artificial Sequence
  dgRNA
  Nsmce1
tacgacacaggccgt

SEQ ID NO: 4837 - DNA, 15 bp, Artificial Sequence
  dgRNA
  Nsmce1
acaggccgtgggccg

SEQ ID NO: 4838 - DNA, 15 bp, Artificial Sequence
  dgRNA
  Atf7ip
atgcgatcgaaaaga

SEQ ID NO: 4839 - DNA, 15 bp, Artificial Sequence
  dgRNA
  Atf7ip
cgccaccaccgcaga

SEQ ID NO: 4840 - DNA, 15 bp, Artificial Sequence
  dgRNA
  Atf7ip
gccaccaccgcagac

SEQ ID NO: 4841 - DNA, 15 bp, Artificial Sequence
  dgRNA
  Atf7ip
cgggctacaatttca

SEQ ID NO: 4842 - DNA, 15 bp, Artificial Sequence
  dgRNA
  Cblb
agttcttctccaagt

SEQ ID NO: 4843 - DNA, 15 bp, Artificial Sequence
  dgRNA
  Cblb
ccaagtgggacgcag

SEQ ID NO: 4844 - DNA, 15 bp, Artificial Sequence
  dgRNA
  Cblb
gggacgcagtggagt

SEQ ID NO: 4845 - DNA, 15 bp, Artificial Sequence
  dgRNA
  Cblb
ggccattgtgtaccg

SEQ ID NO: 4846 - DNA, 15 bp, Artificial Sequence
  dgRNA
  Aifm2
cccctggcaaaacta

SEQ ID NO: 4847 - DNA, 15 bp, Artificial Sequence
  dgRNA
  Aifm2
gcaaaactaaggcgc

SEQ ID NO: 4848 - DNA, 15 bp, Artificial Sequence
  dgRNA
  Aifm2
taaggcgcaggatct

SEQ ID NO: 4849 - DNA, 15 bp, Artificial Sequence
  dgRNA
  Aifm2
aggctgcatcagcgc

SEQ ID NO: 4850 - DNA, 15 bp, Artificial Sequence
  dgRNA
  Kndc1
gtccgtggctgccac

SEQ ID NO: 4851 - DNA, 15 bp, Artificial Sequence
  dgRNA
  Kndc1
cgtggctgccactgg

SEQ ID NO: 4852 - DNA, 15 bp, Artificial Sequence
  dgRNA
  Kndc1
cagcaaccccgcccc

SEQ ID NO: 4853 - DNA, 15 bp, Artificial Sequence
  dgRNA
  Kndc1
agcaaccccgcccct

SEQ ID NO: 4854 - DNA, 15 bp, Artificial Sequence
  dgRNA
  Letmd1
ccccagggaccgacg

SEQ ID NO: 4855 - DNA, 15 bp, Artificial Sequence
  dgRNA
  Letmd1
cccagggaccgacga

SEQ ID NO: 4856 - DNA, 15 bp, Artificial Sequence
  dgRNA
  Letmd1
gaccgacgagggcac

SEQ ID NO: 4857 - DNA, 15 bp, Artificial Sequence
  dgRNA
  Letmd1
accgacgagggcact

SEQ ID NO: 4858 - DNA, 15 bp, Artificial Sequence
  dgRNA
  Adamts10
cggcgggcggggttt

SEQ ID NO: 4859 - DNA, 15 bp, Artificial Sequence
  dgRNA
  Adamts10
ccccggccacgccac

SEQ ID NO: 4860 - DNA, 15 bp, Artificial Sequence
  dgRNA
  Adamts10
cccggccacgccacc

SEQ ID NO: 4861 - DNA, 15 bp, Artificial Sequence
  dgRNA
  Adamts10
aaggaccccggagcc

SEQ ID NO: 4862 - DNA, 15 bp, Artificial Sequence
  dgRNA
  Scn7a
tattgcctctgcagc

SEQ ID NO: 4863 - DNA, 15 bp, Artificial Sequence
  dgRNA
  Scn7a
ggatccagtcggtca

SEQ ID NO: 4864 - DNA, 15 bp, Artificial Sequence
  dgRNA
  Scn7a
ctagataagcgtggg

SEQ ID NO: 4865 - DNA, 15 bp, Artificial Sequence
  dgRNA
  Scn7a
aagctagataagcgt

SEQ ID NO: 4866 - DNA, 15 bp, Artificial Sequence
  dgRNA
  1110001J03Rik
tcctcagagactcgg

SEQ ID NO: 4867 - DNA, 15 bp, Artificial Sequence
  dgRNA
  1110001J03Rik
gcggccatcagctta

SEQ ID NO: 4868 - DNA, 15 bp, Artificial Sequence
  dgRNA
  1110001J03Rik
ttacggcagtccaaa

SEQ ID NO: 4869 - DNA, 15 bp, Artificial Sequence
  dgRNA
  1110001J03Rik
gggacgcagtcagaa

SEQ ID NO: 4870 - DNA, 15 bp, Artificial Sequence
  dgRNA
  Gpr34
ttagtttaggctaga

SEQ ID NO: 4871 - DNA, 15 bp, Artificial Sequence
  dgRNA
  Gpr34
ccaaacgggacccaa

SEQ ID NO: 4872 - DNA, 15 bp, Artificial Sequence
  dgRNA
  Gpr34
caactgtaccacatg

SEQ ID NO: 4873 - DNA, 15 bp, Artificial Sequence
  dgRNA
  Gpr34
cccttgggtcccgtt

SEQ ID NO: 4874 - DNA, 15 bp, Artificial Sequence
  dgRNA
  Cript
catggcccctggcgc

SEQ ID NO: 4875 - DNA, 15 bp, Artificial Sequence
  dgRNA
  Cript
gcagaccagaaagcg

SEQ ID NO: 4876 - DNA, 15 bp, Artificial Sequence
  dgRNA
  Cript
cagaccagaaagcga

SEQ ID NO: 4877 - DNA, 15 bp, Artificial Sequence
  dgRNA
  Cript
gaccagaaagcgagg

SEQ ID NO: 4878 - DNA, 15 bp, Artificial Sequence
  dgRNA
  Pmm1
aaccccttttcccgc

SEQ ID NO: 4879 - DNA, 15 bp, Artificial Sequence
  dgRNA
  Pmm1
ggttcctatctccgt

SEQ ID NO: 4880 - DNA, 15 bp, Artificial Sequence
  dgRNA
  Pmm1
tctccgtcgggtacg

SEQ ID NO: 4881 - DNA, 15 bp, Artificial Sequence
  dgRNA
  Pmm1
acgcccctcaatcct

SEQ ID NO: 4882 - DNA, 15 bp, Artificial Sequence
  dgRNA
  Nptx1
gggcggtggcggatc

SEQ ID NO: 4883 - DNA, 15 bp, Artificial Sequence
  dgRNA
  Nptx1
ggcggtggcggatcc

SEQ ID NO: 4884 - DNA, 15 bp, Artificial Sequence
  dgRNA
  Nptx1
ggtggcggatccggg

SEQ ID NO: 4885 - DNA, 15 bp, Artificial Sequence
  dgRNA
  Nptx1
gtggcggatccggga

SEQ ID NO: 4886 - DNA, 15 bp, Artificial Sequence
  dgRNA
  Zkscan4
tttccccaacaataa

SEQ ID NO: 4887 - DNA, 15 bp, Artificial Sequence
  dgRNA
  Zkscan4
ttccccaacaataat

SEQ ID NO: 4888 - DNA, 15 bp, Artificial Sequence
  dgRNA
  Zkscan4
agaagcgcatcctag

SEQ ID NO: 4889 - DNA, 15 bp, Artificial Sequence
  dgRNA
  Zkscan4
gaagcgcatcctaga

SEQ ID NO: 4890 - DNA, 15 bp, Artificial Sequence
  dgRNA
  Irf2bp2
tagggccgcgtgaac

SEQ ID NO: 4891 - DNA, 15 bp, Artificial Sequence
  dgRNA
  Irf2bp2
cacgcgatcgagaaa

SEQ ID NO: 4892 - DNA, 15 bp, Artificial Sequence
  dgRNA
  Irf2bp2
gaaacggaagaatcc

SEQ ID NO: 4893 - DNA, 15 bp, Artificial Sequence
  dgRNA
  Irf2bp2
aaacggaagaatcca

SEQ ID NO: 4894 - DNA, 15 bp, Artificial Sequence
  dgRNA
  Gm13128
cacatgatgcccgta

SEQ ID NO: 4895 - DNA, 15 bp, Artificial Sequence
  dgRNA
  Gm13128
acatgatgcccgtaa

SEQ ID NO: 4896 - DNA, 15 bp, Artificial Sequence
  dgRNA
  Gm13128
cttacgggcatcatg

SEQ ID NO: 4897 - DNA, 15 bp, Artificial Sequence
  dgRNA
  Gm13128
gcaaactgcccttac

SEQ ID NO: 4898 - DNA, 15 bp, Artificial Sequence
  dgRNA
  Pou2f3
ccgggaccaagcgcg

SEQ ID NO: 4899 - DNA, 15 bp, Artificial Sequence
  dgRNA
  Pou2f3
cgggaccaagcgcgg

SEQ ID NO: 4900 - DNA, 15 bp, Artificial Sequence
  dgRNA
  Pou2f3
cgcgggggccctgcc

SEQ ID NO: 4901 - DNA, 15 bp, Artificial Sequence
  dgRNA
  Pou2f3
cgggggccctgccag

SEQ ID NO: 4902 - DNA, 15 bp, Artificial Sequence
  dgRNA
  Amph
atcacggtggacact

SEQ ID NO: 4903 - DNA, 15 bp, Artificial Sequence
  dgRNA
  Amph
catgcatctcactag

SEQ ID NO: 4904 - DNA, 15 bp, Artificial Sequence
  dgRNA
  Amph
cgttgtcacccctag

SEQ ID NO: 4905 - DNA, 15 bp, Artificial Sequence
  dgRNA
  Amph
ccaccgtgatggagg

SEQ ID NO: 4906 - DNA, 15 bp, Artificial Sequence
  dgRNA
  Dyx1c1
actccagactcaagt

SEQ ID NO: 4907 - DNA, 15 bp, Artificial Sequence
  dgRNA
  Dyx1c1
catagtgggagaccg

SEQ ID NO: 4908 - DNA, 15 bp, Artificial Sequence
  dgRNA
  Dyx1c1
atagtgggagaccga

SEQ ID NO: 4909 - DNA, 15 bp, Artificial Sequence
  dgRNA
  Dyx1c1
gaccgagggtcctac

SEQ ID NO: 4910 - DNA, 15 bp, Artificial Sequence
  dgRNA
  Lrwd1
tctcgcagataagac

SEQ ID NO: 4911 - DNA, 15 bp, Artificial Sequence
  dgRNA
  Lrwd1
gcaggcgcgagacgc

SEQ ID NO: 4912 - DNA, 15 bp, Artificial Sequence
  dgRNA
  Lrwd1
caggcgcgagacgca

SEQ ID NO: 4913 - DNA, 15 bp, Artificial Sequence
  dgRNA
  Lrwd1
aggcgcgagacgcag

SEQ ID NO: 4914 - DNA, 15 bp, Artificial Sequence
  dgRNA
  Lctl
gccgcccttcttcct

SEQ ID NO: 4915 - DNA, 15 bp, Artificial Sequence
  dgRNA
  Lctl
ccgcccttcttcctt

SEQ ID NO: 4916 - DNA, 15 bp, Artificial Sequence
  dgRNA
  Lctl
gggcggcatcggggg

SEQ ID NO: 4917 - DNA, 15 bp, Artificial Sequence
  dgRNA
  Lctl
gaagggcggcatcgg

SEQ ID NO: 4918 - DNA, 15 bp, Artificial Sequence
  dgRNA
  Yeats2
caggaagacaacggt

SEQ ID NO: 4919 - DNA, 15 bp, Artificial Sequence
  dgRNA
  Yeats2
aagacaacggttggc

SEQ ID NO: 4920 - DNA, 15 bp, Artificial Sequence
  dgRNA
  Yeats2
gttggccggctcaag

SEQ ID NO: 4921 - DNA, 15 bp, Artificial Sequence
  dgRNA
  Yeats2
aagcggtcaacctga

SEQ ID NO: 4922 - DNA, 15 bp, Artificial Sequence
  dgRNA
  Tnnt1
gttgaagccgatgac

SEQ ID NO: 4923 - DNA, 15 bp, Artificial Sequence
  dgRNA
  Tnnt1
gccgatgacaggtgt

SEQ ID NO: 4924 - DNA, 15 bp, Artificial Sequence
  dgRNA
  Tnnt1
gttggacccccaaac

SEQ ID NO: 4925 - DNA, 15 bp, Artificial Sequence
  dgRNA
  Tnnt1
gacccccaaactgga

SEQ ID NO: 4926 - DNA, 15 bp, Artificial Sequence
  dgRNA
  Cacnb3
gccctcagcctgcga

SEQ ID NO: 4927 - DNA, 15 bp, Artificial Sequence
  dgRNA
  Cacnb3
gcgggaaaggttcaa

SEQ ID NO: 4928 - DNA, 15 bp, Artificial Sequence
  dgRNA
  Cacnb3
atcgcaggctgaggg

SEQ ID NO: 4929 - DNA, 15 bp, Artificial Sequence
  dgRNA
  Cacnb3
gccatcgcaggctga

SEQ ID NO: 4930 - DNA, 15 bp, Artificial Sequence
  dgRNA
  Rnf11
gcagccgggacatac

SEQ ID NO: 4931 - DNA, 15 bp, Artificial Sequence
  dgRNA
  Rnf11
cagccgggacataca

SEQ ID NO: 4932 - DNA, 15 bp, Artificial Sequence
  dgRNA
  Rnf11
agccgggacatacag

SEQ ID NO: 4933 - DNA, 15 bp, Artificial Sequence
  dgRNA
  Rnf11
gccgggacatacagg

SEQ ID NO: 4934 - DNA, 15 bp, Artificial Sequence
  dgRNA
  Nfe2l1
ggcctgcacactcat

SEQ ID NO: 4935 - DNA, 15 bp, Artificial Sequence
  dgRNA
  Nfe2l1
tctccacgtcagtct

SEQ ID NO: 4936 - DNA, 15 bp, Artificial Sequence
  dgRNA
  Nfe2l1
ctccacgtcagtctc

SEQ ID NO: 4937 - DNA, 15 bp, Artificial Sequence
  dgRNA
  Nfe2l1
cacgtcagtctcggg

SEQ ID NO: 4938 - DNA, 15 bp, Artificial Sequence
  dgRNA
  Zfos1
aggccgcgcaggacg

SEQ ID NO: 4939 - DNA, 15 bp, Artificial Sequence
  dgRNA
  Zfos1
ccgcgcaggacgagg

SEQ ID NO: 4940 - DNA, 15 bp, Artificial Sequence
  dgRNA
  Zfos1
aggaggcggtgccgc

SEQ ID NO: 4941 - DNA, 15 bp, Artificial Sequence
  dgRNA
  Zfos1
gcgggctccagcgag

SEQ ID NO: 4942 - DNA, 15 bp, Artificial Sequence
  dgRNA
  Ankle2
ccagcagcgacaact

SEQ ID NO: 4943 - DNA, 15 bp, Artificial Sequence
  dgRNA
  Ankle2
cagcagcgacaactc

SEQ ID NO: 4944 - DNA, 15 bp, Artificial Sequence
  dgRNA
  Ankle2
agcagcgacaactcg

SEQ ID NO: 4945 - DNA, 15 bp, Artificial Sequence
  dgRNA
  Ankle2
agcgacaactcgggg

SEQ ID NO: 4946 - DNA, 15 bp, Artificial Sequence
  dgRNA
  Olfr1307
atcactagtaatcag

SEQ ID NO: 4947 - DNA, 15 bp, Artificial Sequence
  dgRNA
  Abcg8
aaaacgtcgctctgc

SEQ ID NO: 4948 - DNA, 15 bp, Artificial Sequence
  dgRNA
  Abcg8
gtcgctctgcaggaa

SEQ ID NO: 4949 - DNA, 15 bp, Artificial Sequence
  dgRNA
  Abcg8
gggtcgtcgaaatcc

SEQ ID NO: 4950 - DNA, 15 bp, Artificial Sequence
  dgRNA
  Abcg8
ggtcgtcgaaatccc

SEQ ID NO: 4951 - DNA, 15 bp, Artificial Sequence
  dgRNA
  Vps25
gcggcgcctcccgag

SEQ ID NO: 4952 - DNA, 15 bp, Artificial Sequence
  dgRNA
  Vps25
ctcccgagaggagtc

SEQ ID NO: 4953 - DNA, 15 bp, Artificial Sequence
  dgRNA
  Vps25
tgtcgcttaaacaga

SEQ ID NO: 4954 - DNA, 15 bp, Artificial Sequence
  dgRNA
  Vps25
ttgtcgcttaaacag

SEQ ID NO: 4955 - DNA, 15 bp, Artificial Sequence
  dgRNA
  Spryd7
caggcgtcaggccac

SEQ ID NO: 4956 - DNA, 15 bp, Artificial Sequence
  dgRNA
  Spryd7
gcccgggcccctgct

SEQ ID NO: 4957 - DNA, 15 bp, Artificial Sequence
  dgRNA
  Spryd7
acaccctctttgact

SEQ ID NO: 4958 - DNA, 15 bp, Artificial Sequence
  dgRNA
  Spryd7
caccctctttgactt

SEQ ID NO: 4959 - DNA, 15 bp, Artificial Sequence
  dgRNA
  Rpl22
cagccgacttcgccc

SEQ ID NO: 4960 - DNA, 15 bp, Artificial Sequence
  dgRNA
  Rpl22
ggccgatcgttactt

SEQ ID NO: 4961 - DNA, 15 bp, Artificial Sequence
  dgRNA
  Rpl22
cgatcgttacttagg

SEQ ID NO: 4962 - DNA, 15 bp, Artificial Sequence
  dgRNA
  Rpl22
cgttacttaggtggc

SEQ ID NO: 4963 - DNA, 15 bp, Artificial Sequence
  dgRNA
  Slc25a11
gaaatatatcgcgag

SEQ ID NO: 4964 - DNA, 15 bp, Artificial Sequence
  dgRNA
  Slc25a11
ctcatagcccgaact

SEQ ID NO: 4965 - DNA, 15 bp, Artificial Sequence
  dgRNA
  Slc25a11
tcacttgctctcgcg

SEQ ID NO: 4966 - DNA, 15 bp, Artificial Sequence
  dgRNA
  Slc25a11
ccgcgattccaattc

SEQ ID NO: 4967 - DNA, 15 bp, Artificial Sequence
  dgRNA
  Srebf1
attcggtccctccct

SEQ ID NO: 4968 - DNA, 15 bp, Artificial Sequence
  dgRNA
  Srebf1
tgcctgtgcacccgc

SEQ ID NO: 4969 - DNA, 15 bp, Artificial Sequence
  dgRNA
  Srebf1
agattgctagaaacc

SEQ ID NO: 4970 - DNA, 15 bp, Artificial Sequence
  dgRNA
  Srebf1
aaaccaggctcgggc

SEQ ID NO: 4971 - DNA, 15 bp, Artificial Sequence
  dgRNA
  Mcm4
gcccatccaaggcga

SEQ ID NO: 4972 - DNA, 15 bp, Artificial Sequence
  dgRNA
  Mcm4
cccatccaaggcgag

SEQ ID NO: 4973 - DNA, 15 bp, Artificial Sequence
  dgRNA
  Mcm4
cgtgcaagtgaatct

SEQ ID NO: 4974 - DNA, 15 bp, Artificial Sequence
  dgRNA
  Mcm4
taggctgtaattcct

SEQ ID NO: 4975 - DNA, 15 bp, Artificial Sequence
  dgRNA
  Taok1
tcgcgcactcccgag

SEQ ID NO: 4976 - DNA, 15 bp, Artificial Sequence
  dgRNA
  Taok1
tgtcctgtctcgcgc

SEQ ID NO: 4977 - DNA, 15 bp, Artificial Sequence
  dgRNA
  Taok1
gtcctgtctcgcgca

SEQ ID NO: 4978 - DNA, 15 bp, Artificial Sequence
  dgRNA
  Taok1
tgtctcgcgcagggt

SEQ ID NO: 4979 - DNA, 15 bp, Artificial Sequence
  dgRNA
  Slc37a1
tcccttgggcgcgcg

SEQ ID NO: 4980 - DNA, 15 bp, Artificial Sequence
  dgRNA
  Slc37a1
gggtcagggggcgcg

SEQ ID NO: 4981 - DNA, 15 bp, Artificial Sequence
  dgRNA
  Slc37a1
ggtcagggggcgcgc

SEQ ID NO: 4982 - DNA, 15 bp, Artificial Sequence
  dgRNA
  Slc37a1
ggagccgcacagggt

SEQ ID NO: 4983 - DNA, 15 bp, Artificial Sequence
  dgRNA
  Tfr2
tcttaggttttagtg

SEQ ID NO: 4984 - DNA, 15 bp, Artificial Sequence
  dgRNA
  Tfr2
agaaaaggacgtgcg

SEQ ID NO: 4985 - DNA, 15 bp, Artificial Sequence
  dgRNA
  Tfr2
gaaaaggacgtgcgg

SEQ ID NO: 4986 - DNA, 15 bp, Artificial Sequence
  dgRNA
  Tfr2
aaggacgtgcggggg

SEQ ID NO: 4987 - DNA, 15 bp, Artificial Sequence
  dgRNA
  Sla2
cgtcagaggaaatag

SEQ ID NO: 4988 - DNA, 15 bp, Artificial Sequence
  dgRNA
  Sla2
tgtctacacgggctc

SEQ ID NO: 4989 - DNA, 15 bp, Artificial Sequence
  dgRNA
  Sla2
cgggctcaggtccct

SEQ ID NO: 4990 - DNA, 15 bp, Artificial Sequence
  dgRNA
  Sla2
tcacatcgtagccca

SEQ ID NO: 4991 - DNA, 15 bp, Artificial Sequence
  dgRNA
  Apold1
tataattgggcagcc

SEQ ID NO: 4992 - DNA, 15 bp, Artificial Sequence
  dgRNA
  Apold1
ataattgggcagcct

SEQ ID NO: 4993 - DNA, 15 bp, Artificial Sequence
  dgRNA
  Apold1
taattgggcagcctg

SEQ ID NO: 4994 - DNA, 15 bp, Artificial Sequence
  dgRNA
  Apold1
gaaagcctcccccga

SEQ ID NO: 4995 - DNA, 15 bp, Artificial Sequence
  dgRNA
  Ubap2l
aagagcagtgtttcg

SEQ ID NO: 4996 - DNA, 15 bp, Artificial Sequence
  dgRNA
  Ubap2l
gcagtgtttcgtggc

SEQ ID NO: 4997 - DNA, 15 bp, Artificial Sequence
  dgRNA
  Ubap2l
cagtgtttcgtggcg

SEQ ID NO: 4998 - DNA, 15 bp, Artificial Sequence
  dgRNA
  Ubap2l
tgtttcgtggcgggg

SEQ ID NO: 4999 - DNA, 15 bp, Artificial Sequence
  dgRNA
  Wnt5b
agtggcccgaattag

SEQ ID NO: 5000 - DNA, 15 bp, Artificial Sequence
  dgRNA
  Wnt5b
gcccgaattagaggc

SEQ ID NO: 5001 - DNA, 15 bp, Artificial Sequence
  dgRNA
  Wnt5b
cccgaattagaggcc

SEQ ID NO: 5002 - DNA, 15 bp, Artificial Sequence
  dgRNA
  Wnt5b
gggtcatttccgagc

SEQ ID NO: 5003 - DNA, 15 bp, Artificial Sequence
  dgRNA
  Brinp1
ccttggaatctaccc

SEQ ID NO: 5004 - DNA, 15 bp, Artificial Sequence
  dgRNA
  Brinp1
gccgcctgaagggag

SEQ ID NO: 5005 - DNA, 15 bp, Artificial Sequence
  dgRNA
  Brinp1
ggccgcctgaaggga

SEQ ID NO: 5006 - DNA, 15 bp, Artificial Sequence
  dgRNA
  Brinp1
gggccgcctgaaggg

SEQ ID NO: 5007 - DNA, 15 bp, Artificial Sequence
  dgRNA
  Commd3
ggcgcgtcccgcccg

SEQ ID NO: 5008 - DNA, 15 bp, Artificial Sequence
  dgRNA
  Commd3
ccgcccgaggcccgc

SEQ ID NO: 5009 - DNA, 15 bp, Artificial Sequence
  dgRNA
  Commd3
cgcccgaggcccgca

SEQ ID NO: 5010 - DNA, 15 bp, Artificial Sequence
  dgRNA
  Commd3
ggcggctgagacgag

SEQ ID NO: 5011 - DNA, 15 bp, Artificial Sequence
  dgRNA
  Eif4e3
cgggtcctctgctcc

SEQ ID NO: 5012 - DNA, 15 bp, Artificial Sequence
  dgRNA
  Eif4e3
cctctgctcccggcg

SEQ ID NO: 5013 - DNA, 15 bp, Artificial Sequence
  dgRNA
  Eif4e3
ctctgctcccggcgc

SEQ ID NO: 5014 - DNA, 15 bp, Artificial Sequence
  dgRNA
  Eif4e3
ctcccggcgcgggcc

SEQ ID NO: 5015 - DNA, 15 bp, Artificial Sequence
  dgRNA
  Shc1
tttgaagtcctcgat

SEQ ID NO: 5016 - DNA, 15 bp, Artificial Sequence
  dgRNA
  Shc1
tcttcaagtcgtaaa

SEQ ID NO: 5017 - DNA, 15 bp, Artificial Sequence
  dgRNA
  Shc1
gagctgggtcaaact

SEQ ID NO: 5018 - DNA, 15 bp, Artificial Sequence
  dgRNA
  Shc1
aactaggattctcat

SEQ ID NO: 5019 - DNA, 15 bp, Artificial Sequence
  dgRNA
  Cxadr
ggatgcggtgactgc

SEQ ID NO: 5020 - DNA, 15 bp, Artificial Sequence
  dgRNA
  Cxadr
gtgactgctggctag

SEQ ID NO: 5021 - DNA, 15 bp, Artificial Sequence
  dgRNA
  Cxadr
cctagctcaaggttt

SEQ ID NO: 5022 - DNA, 15 bp, Artificial Sequence
  dgRNA
  Cxadr
ggagcaattccggcc

SEQ ID NO: 5023 - DNA, 15 bp, Artificial Sequence
  dgRNA
  Nms
tacaatgcttacact

SEQ ID NO: 5024 - DNA, 15 bp, Artificial Sequence
  dgRNA
  Nms
aatgcttacactcgg

SEQ ID NO: 5025 - DNA, 15 bp, Artificial Sequence
  dgRNA
  Nms
ctgcgcaacgctgat

SEQ ID NO: 5026 - DNA, 15 bp, Artificial Sequence
  dgRNA
  Nms
tcagcgttgcgcagg

SEQ ID NO: 5027 - DNA, 15 bp, Artificial Sequence
  dgRNA
  Zscan10
ttaccccacccagac

SEQ ID NO: 5028 - DNA, 15 bp, Artificial Sequence
  dgRNA
  Zscan10
atccccttacctgaa

SEQ ID NO: 5029 - DNA, 15 bp, Artificial Sequence
  dgRNA
  Zscan10
ttacctgaaagggat

SEQ ID NO: 5030 - DNA, 15 bp, Artificial Sequence
  dgRNA
  Zscan10
gcttctccatctacg

SEQ ID NO: 5031 - DNA, 15 bp, Artificial Sequence
  dgRNA
  Atn1
agccccgcgcccgac

SEQ ID NO: 5032 - DNA, 15 bp, Artificial Sequence
  dgRNA
  Atn1
gccccgcgcccgacc

SEQ ID NO: 5033 - DNA, 15 bp, Artificial Sequence
  dgRNA
  Atn1
ccccgcgcccgaccg

SEQ ID NO: 5034 - DNA, 15 bp, Artificial Sequence
  dgRNA
  Atn1
gcccgaccggggcct

SEQ ID NO: 5035 - DNA, 15 bp, Artificial Sequence
  dgRNA
  Cpa5
ctctgccgtctgaaa

SEQ ID NO: 5036 - DNA, 15 bp, Artificial Sequence
  dgRNA
  Cpa5
agacattccctacat

SEQ ID NO: 5037 - DNA, 15 bp, Artificial Sequence
  dgRNA
  Cpa5
tcctgttggatgatg

SEQ ID NO: 5038 - DNA, 15 bp, Artificial Sequence
  dgRNA
  Cpa5
cctgttggatgatgc

SEQ ID NO: 5039 - DNA, 15 bp, Artificial Sequence
  dgRNA
  Ippk
tgccagcacataata

SEQ ID NO: 5040 - DNA, 15 bp, Artificial Sequence
  dgRNA
  Ippk
ccaccctggacgtcg

SEQ ID NO: 5041 - DNA, 15 bp, Artificial Sequence
  dgRNA
  Ippk
caccctggacgtcga

SEQ ID NO: 5042 - DNA, 15 bp, Artificial Sequence
  dgRNA
  Ippk
tggacgtcgagggta

SEQ ID NO: 5043 - DNA, 15 bp, Artificial Sequence
  dgRNA
  Foxd3
ggccagtccttaaaa

SEQ ID NO: 5044 - DNA, 15 bp, Artificial Sequence
  dgRNA
  Foxd3
gccagtccttaaaac

SEQ ID NO: 5045 - DNA, 15 bp, Artificial Sequence
  dgRNA
  Foxd3
gactttcgactaccc

SEQ ID NO: 5046 - DNA, 15 bp, Artificial Sequence
  dgRNA
  Foxd3
tcgactacccaggct

SEQ ID NO: 5047 - DNA, 15 bp, Artificial Sequence
  dgRNA
  Olfr530
catggagtctgtatt

SEQ ID NO: 5048 - DNA, 15 bp, Artificial Sequence
  dgRNA
  Kat6a
ttcccggcgacgagc

SEQ ID NO: 5049 - DNA, 15 bp, Artificial Sequence
  dgRNA
  Kat6a
ggctgttccgccgct

SEQ ID NO: 5050 - DNA, 15 bp, Artificial Sequence
  dgRNA
  Kat6a
aagggccggagggcg

SEQ ID NO: 5051 - DNA, 15 bp, Artificial Sequence
  dgRNA
  Kat6a
ccgggaagggccgga

SEQ ID NO: 5052 - DNA, 15 bp, Artificial Sequence
  dgRNA
  Aqp2
tggagtccattaatg

SEQ ID NO: 5053 - DNA, 15 bp, Artificial Sequence
  dgRNA
  Aqp2
ctaagatggggtgat

SEQ ID NO: 5054 - DNA, 15 bp, Artificial Sequence
  dgRNA
  Aqp2
ggggtgataggcctt

SEQ ID NO: 5055 - DNA, 15 bp, Artificial Sequence
  dgRNA
  Aqp2
gggtgataggccttc

SEQ ID NO: 5056 - DNA, 15 bp, Artificial Sequence
  dgRNA
  Dhx35
atccgagagacaata

SEQ ID NO: 5057 - DNA, 15 bp, Artificial Sequence
  dgRNA
  Dhx35
gacaatatggccgcg

SEQ ID NO: 5058 - DNA, 15 bp, Artificial Sequence
  dgRNA
  Dhx35
ccgcgcggcatcacg

SEQ ID NO: 5059 - DNA, 15 bp, Artificial Sequence
  dgRNA
  Dhx35
cgcgcggcatcacgt

SEQ ID NO: 5060 - DNA, 15 bp, Artificial Sequence
  dgRNA
  Lef1
atagctttgcagcgc

SEQ ID NO: 5061 - DNA, 15 bp, Artificial Sequence
  dgRNA
  Lef1
tttgcagcgccggct

SEQ ID NO: 5062 - DNA, 15 bp, Artificial Sequence
  dgRNA
  Lef1
agcgccggctaggcg

SEQ ID NO: 5063 - DNA, 15 bp, Artificial Sequence
  dgRNA
  Lef1
cgcggcgaggagaag

SEQ ID NO: 5064 - DNA, 15 bp, Artificial Sequence
  dgRNA
  Fgf14
ttcagtccgatccta

SEQ ID NO: 5065 - DNA, 15 bp, Artificial Sequence
  dgRNA
  Fgf14
gatcctacggagctc

SEQ ID NO: 5066 - DNA, 15 bp, Artificial Sequence
  dgRNA
  Fgf14
agaaaaaattgaccg

SEQ ID NO: 5067 - DNA, 15 bp, Artificial Sequence
  dgRNA
  Fgf14
gaaaaaattgaccgc

SEQ ID NO: 5068 - DNA, 15 bp, Artificial Sequence
  dgRNA
  Dcps
ctactccacctcgtt

SEQ ID NO: 5069 - DNA, 15 bp, Artificial Sequence
  dgRNA
  Dcps
tcgttaggacctcgc

SEQ ID NO: 5070 - DNA, 15 bp, Artificial Sequence
  dgRNA
  Dcps
ctaggcaaaagtcat

SEQ ID NO: 5071 - DNA, 15 bp, Artificial Sequence
  dgRNA
  Dcps
ggccctcacccaaac

SEQ ID NO: 5072 - DNA, 15 bp, Artificial Sequence
  dgRNA
  Prdm6
ccgcgctgcacgccc

SEQ ID NO: 5073 - DNA, 15 bp, Artificial Sequence
  dgRNA
  Prdm6
gtaaactttgcgccc

SEQ ID NO: 5074 - DNA, 15 bp, Artificial Sequence
  dgRNA
  Prdm6
aactttgcgcccagg

SEQ ID NO: 5075 - DNA, 15 bp, Artificial Sequence
  dgRNA
  Prdm6
gcgcccaggaggagt

SEQ ID NO: 5076 - DNA, 15 bp, Artificial Sequence
  dgRNA
  Foxred1
ctgctgcgccaagcg

SEQ ID NO: 5077 - DNA, 15 bp, Artificial Sequence
  dgRNA
  Foxred1
tgctgcgccaagcgc

SEQ ID NO: 5078 - DNA, 15 bp, Artificial Sequence
  dgRNA
  Foxred1
cgctacgagcctccg

SEQ ID NO: 5079 - DNA, 15 bp, Artificial Sequence
  dgRNA
  Foxred1
gcccctttcccgctc

SEQ ID NO: 5080 - DNA, 15 bp, Artificial Sequence
  dgRNA
  4922502D21Rik
tcagatagtttacac

SEQ ID NO: 5081 - DNA, 15 bp, Artificial Sequence
  dgRNA
  4922502D21Rik
tgactggatagctga

SEQ ID NO: 5082 - DNA, 15 bp, Artificial Sequence
  dgRNA
  4922502D21Rik
gagaggatgctaatc

SEQ ID NO: 5083 - DNA, 15 bp, Artificial Sequence
  dgRNA
  4922502D21Rik
ctgctggtcgccatg

SEQ ID NO: 5084 - DNA, 15 bp, Artificial Sequence
  dgRNA
  Fpgt
cagacacggtaaggc

SEQ ID NO: 5085 - DNA, 15 bp, Artificial Sequence
  dgRNA
  Fpgt
caacccgaccccgct

SEQ ID NO: 5086 - DNA, 15 bp, Artificial Sequence
  dgRNA
  Fpgt
cacagatcgttgccc

SEQ ID NO: 5087 - DNA, 15 bp, Artificial Sequence
  dgRNA
  Fpgt
tctcagggcgcttcc

SEQ ID NO: 5088 - DNA, 15 bp, Artificial Sequence
  dgRNA
  Cdh8
agttgtgcgcactct

SEQ ID NO: 5089 - DNA, 15 bp, Artificial Sequence
  dgRNA
  Cdh8
gtgcgcactcttggt

SEQ ID NO: 5090 - DNA, 15 bp, Artificial Sequence
  dgRNA
  Cdh8
cgcactcttggtagg

SEQ ID NO: 5091 - DNA, 15 bp, Artificial Sequence
  dgRNA
  Cdh8
agtggaaaccaagcg

SEQ ID NO: 5092 - DNA, 15 bp, Artificial Sequence
  dgRNA
  9930012K11Rik
cctctcgcagccagc

SEQ ID NO: 5093 - DNA, 15 bp, Artificial Sequence
  dgRNA
  9930012K11Rik
gctaaagccctcgag

SEQ ID NO: 5094 - DNA, 15 bp, Artificial Sequence
  dgRNA
  9930012K11Rik
ctaaagccctcgagt

SEQ ID NO: 5095 - DNA, 15 bp, Artificial Sequence
  dgRNA
  9930012K11Rik
ccaagagcacttaat

SEQ ID NO: 5096 - DNA, 15 bp, Artificial Sequence
  dgRNA
  Tex30
acagactccggcttc

SEQ ID NO: 5097 - DNA, 15 bp, Artificial Sequence
  dgRNA
  Tex30
ctccaggcgcccgcg

SEQ ID NO: 5098 - DNA, 15 bp, Artificial Sequence
  dgRNA
  Tex30
tccaggcgcccgcga

SEQ ID NO: 5099 - DNA, 15 bp, Artificial Sequence
  dgRNA
  Tex30
cgcccgcgaggggcg

SEQ ID NO: 5100 - DNA, 15 bp, Artificial Sequence
  dgRNA
  Dpp7
ccccgcccgttgtgt

SEQ ID NO: 5101 - DNA, 15 bp, Artificial Sequence
  dgRNA
  Dpp7
tggctaaggctcatc

SEQ ID NO: 5102 - DNA, 15 bp, Artificial Sequence
  dgRNA
  Dpp7
atactgtggaggtcc

SEQ ID NO: 5103 - DNA, 15 bp, Artificial Sequence
  dgRNA
  Dpp7
gttcctccaaatttc

SEQ ID NO: 5104 - DNA, 15 bp, Artificial Sequence
  dgRNA
  Mtmr4
cctccgggtactgtc

SEQ ID NO: 5105 - DNA, 15 bp, Artificial Sequence
  dgRNA
  Mtmr4
ctggtctccgggtgc

SEQ ID NO: 5106 - DNA, 15 bp, Artificial Sequence
  dgRNA
  Mtmr4
ctccgggtgccggat

SEQ ID NO: 5107 - DNA, 15 bp, Artificial Sequence
  dgRNA
  Mtmr4
ggttacaagctgaga

SEQ ID NO: 5108 - DNA, 15 bp, Artificial Sequence
  dgRNA
  C1ql2
cgctgctcccacttg

SEQ ID NO: 5109 - DNA, 15 bp, Artificial Sequence
  dgRNA
  C1ql2
ctgggcgccgccagc

SEQ ID NO: 5110 - DNA, 15 bp, Artificial Sequence
  dgRNA
  C1ql2
ctccggaggacgccg

SEQ ID NO: 5111 - DNA, 15 bp, Artificial Sequence
  dgRNA
  C1ql2
tccggaggacgccgc

SEQ ID NO: 5112 - DNA, 15 bp, Artificial Sequence
  dgRNA
  Osm
tagaggcacaatctt

SEQ ID NO: 5113 - DNA, 15 bp, Artificial Sequence
  dgRNA
  Osm
tttggggcccaagtc

SEQ ID NO: 5114 - DNA, 15 bp, Artificial Sequence
  dgRNA
  Osm
gacagcccaagcgag

SEQ ID NO: 5115 - DNA, 15 bp, Artificial Sequence
  dgRNA
  Osm
acagcccaagcgaga

SEQ ID NO: 5116 - DNA, 15 bp, Artificial Sequence
  dgRNA
  Chn1
tgcacccgcttagcc

SEQ ID NO: 5117 - DNA, 15 bp, Artificial Sequence
  dgRNA
  Chn1
gcacccgcttagccc

SEQ ID NO: 5118 - DNA, 15 bp, Artificial Sequence
  dgRNA
  Chn1
cacccgcttagcccg

SEQ ID NO: 5119 - DNA, 15 bp, Artificial Sequence
  dgRNA
  Chn1
ccgcttagcccgggg

SEQ ID NO: 5120 - DNA, 15 bp, Artificial Sequence
  dgRNA
  Cmtm2a
tttttgagggcggcc

SEQ ID NO: 5121 - DNA, 15 bp, Artificial Sequence
  dgRNA
  Cmtm2a
aggccgccctcaaaa

SEQ ID NO: 5122 - DNA, 15 bp, Artificial Sequence
  dgRNA
  Tmem184a
tcggggacttctccc

SEQ ID NO: 5123 - DNA, 15 bp, Artificial Sequence
  dgRNA
  Tmem184a
ctacctagtgccagc

SEQ ID NO: 5124 - DNA, 15 bp, Artificial Sequence
  dgRNA
  Tmem184a
gcaaacagtcccagc

SEQ ID NO: 5125 - DNA, 15 bp, Artificial Sequence
  dgRNA
  Tmem184a
ggatagagtgtcgcc

SEQ ID NO: 5126 - DNA, 15 bp, Artificial Sequence
  dgRNA
  Cd247
tgcctatgaatcgag

SEQ ID NO: 5127 - DNA, 15 bp, Artificial Sequence
  dgRNA
  Cd247
gcctatgaatcgaga

SEQ ID NO: 5128 - DNA, 15 bp, Artificial Sequence
  dgRNA
  Cd247
cctatgaatcgagag

SEQ ID NO: 5129 - DNA, 15 bp, Artificial Sequence
  dgRNA
  Cd247
ctatgaatcgagagg

SEQ ID NO: 5130 - DNA, 15 bp, Artificial Sequence
  dgRNA
  Hoxb3
caaatctccgcagac

SEQ ID NO: 5131 - DNA, 15 bp, Artificial Sequence
  dgRNA
  Hoxb3
ccgcagaccggctgt

SEQ ID NO: 5132 - DNA, 15 bp, Artificial Sequence
  dgRNA
  Hoxb3
cgcagaccggctgtt

SEQ ID NO: 5133 - DNA, 15 bp, Artificial Sequence
  dgRNA
  Hoxb3
gcagaccggctgttg

SEQ ID NO: 5134 - DNA, 15 bp, Artificial Sequence
  dgRNA
  Rpain
tccaagaaagcccgg

SEQ ID NO: 5135 - DNA, 15 bp, Artificial Sequence
  dgRNA
  Rpain
agaatcctttgcgcg

SEQ ID NO: 5136 - DNA, 15 bp, Artificial Sequence
  dgRNA
  Rpain
ctttgcgcgcggcta

SEQ ID NO: 5137 - DNA, 15 bp, Artificial Sequence
  dgRNA
  Rpain
tttgcgcgcggctaa

SEQ ID NO: 5138 - DNA, 15 bp, Artificial Sequence
  dgRNA
  Myl10
tgccacctactctta

SEQ ID NO: 5139 - DNA, 15 bp, Artificial Sequence
  dgRNA
  Myl10
cacctactcttaggg

SEQ ID NO: 5140 - DNA, 15 bp, Artificial Sequence
  dgRNA
  Myl10
aaccaccctaagagt

SEQ ID NO: 5141 - DNA, 15 bp, Artificial Sequence
  dgRNA
  Myl10
ttcacaagtgtcaac

SEQ ID NO: 5142 - DNA, 15 bp, Artificial Sequence
  dgRNA
  Gpn2
tgcctagagacggat

SEQ ID NO: 5143 - DNA, 15 bp, Artificial Sequence
  dgRNA
  Gpn2
ataaaccagtttacc

SEQ ID NO: 5144 - DNA, 15 bp, Artificial Sequence
  dgRNA
  Gpn2
ccagtttacccggca

SEQ ID NO: 5145 - DNA, 15 bp, Artificial Sequence
  dgRNA
  Gpn2
tgccttagtgaagcc

SEQ ID NO: 5146 - DNA, 15 bp, Artificial Sequence
  dgRNA
  Acsf2
ctgcagagccggtct

SEQ ID NO: 5147 - DNA, 15 bp, Artificial Sequence
  dgRNA
  Acsf2
tgcagagccggtctt

SEQ ID NO: 5148 - DNA, 15 bp, Artificial Sequence
  dgRNA
  Acsf2
cggtcttgggagccc

SEQ ID NO: 5149 - DNA, 15 bp, Artificial Sequence
  dgRNA
  Acsf2
cttgggagccccggg

SEQ ID NO: 5150 - DNA, 15 bp, Artificial Sequence
  dgRNA
  Fez2
ggaagtgactcaact

SEQ ID NO: 5151 - DNA, 15 bp, Artificial Sequence
  dgRNA
  Fez2
gactcaactcggtta

SEQ ID NO: 5152 - DNA, 15 bp, Artificial Sequence
  dgRNA
  Fez2
cgctcaaccaagagc

SEQ ID NO: 5153 - DNA, 15 bp, Artificial Sequence
  dgRNA
  Fez2
ggcgtggcctcaagt

SEQ ID NO: 5154 - DNA, 15 bp, Artificial Sequence
  dgRNA
  Gnpnat1
tcgcctccggagccc

SEQ ID NO: 5155 - DNA, 15 bp, Artificial Sequence
  dgRNA
  Gnpnat1
tccggagcccaggag

SEQ ID NO: 5156 - DNA, 15 bp, Artificial Sequence
  dgRNA
  Gnpnat1
caggagtggtgtgcg

SEQ ID NO: 5157 - DNA, 15 bp, Artificial Sequence
  dgRNA
  Gnpnat1
cctccgcgtgcgcag

SEQ ID NO: 5158 - DNA, 15 bp, Artificial Sequence
  dgRNA
  Agl
ctctcgcgagatcag

SEQ ID NO: 5159 - DNA, 15 bp, Artificial Sequence
  dgRNA
  Agl
gtggtctgtgctagc

SEQ ID NO: 5160 - DNA, 15 bp, Artificial Sequence
  dgRNA
  Agl
tggtctgtgctagcg

SEQ ID NO: 5161 - DNA, 15 bp, Artificial Sequence
  dgRNA
  Agl
tgctagcgggggcga

SEQ ID NO: 5162 - DNA, 15 bp, Artificial Sequence
  dgRNA
  Rad23a
aagacagcggaatgc

SEQ ID NO: 5163 - DNA, 15 bp, Artificial Sequence
  dgRNA
  Rad23a
gattgcgcatgtcta

SEQ ID NO: 5164 - DNA, 15 bp, Artificial Sequence
  dgRNA
  Rad23a
cgcatgtctaaggta

SEQ ID NO: 5165 - DNA, 15 bp, Artificial Sequence
  dgRNA
  Rad23a
ccgcgcatgctctag

SEQ ID NO: 5166 - DNA, 15 bp, Artificial Sequence
  dgRNA
  Sh3bp2
ttaagctgccagagc

SEQ ID NO: 5167 - DNA, 15 bp, Artificial Sequence
  dgRNA
  Sh3bp2
gagaaggcgggccag

SEQ ID NO: 5168 - DNA, 15 bp, Artificial Sequence
  dgRNA
  Sh3bp2
ggagtggcagtgcga

SEQ ID NO: 5169 - DNA, 15 bp, Artificial Sequence
  dgRNA
  Sh3bp2
gaggcggggccagat

SEQ ID NO: 5170 - DNA, 15 bp, Artificial Sequence
  dgRNA
  Fer
acccaacaacccagt

SEQ ID NO: 5171 - DNA, 15 bp, Artificial Sequence
  dgRNA
  Fer
ggccatccttttgac

SEQ ID NO: 5172 - DNA, 15 bp, Artificial Sequence
  dgRNA
  Fer
gcccactgggttgtt

SEQ ID NO: 5173 - DNA, 15 bp, Artificial Sequence
  dgRNA
  Fer
ggcccactgggttgt

SEQ ID NO: 5174 - DNA, 15 bp, Artificial Sequence
  dgRNA
  Ccne2
aggtgaagcgccgag

SEQ ID NO: 5175 - DNA, 15 bp, Artificial Sequence
  dgRNA
  Ccne2
ggtgaagcgccgaga

SEQ ID NO: 5176 - DNA, 15 bp, Artificial Sequence
  dgRNA
  Ccne2
gtgaagcgccgagag

SEQ ID NO: 5177 - DNA, 15 bp, Artificial Sequence
  dgRNA
  Ccne2
aagcgccgagagggg

SEQ ID NO: 5178 - DNA, 15 bp, Artificial Sequence
  dgRNA
  Il1rn
actgagtcacgcctc

SEQ ID NO: 5179 - DNA, 15 bp, Artificial Sequence
  dgRNA
  Il1rn
cacgcctctggaagc

SEQ ID NO: 5180 - DNA, 15 bp, Artificial Sequence
  dgRNA
  Il1rn
acgcctctggaagct

SEQ ID NO: 5181 - DNA, 15 bp, Artificial Sequence
  dgRNA
  Il1rn
agcaaccaacctcct

SEQ ID NO: 5182 - DNA, 15 bp, Artificial Sequence
  dgRNA
  Apoo
cccgcgcgcgcctct

SEQ ID NO: 5183 - DNA, 15 bp, Artificial Sequence
  dgRNA
  Apoo
cgacacgccacctag

SEQ ID NO: 5184 - DNA, 15 bp, Artificial Sequence
  dgRNA
  Apoo
gccacctagcggcgc

SEQ ID NO: 5185 - DNA, 15 bp, Artificial Sequence
  dgRNA
  Apoo
cgcaggccgagcttt

SEQ ID NO: 5186 - DNA, 15 bp, Artificial Sequence
  dgRNA
  Sgip1
catcccctgtcaggg

SEQ ID NO: 5187 - DNA, 15 bp, Artificial Sequence
  dgRNA
  Sgip1
ccccagagccgcaat

SEQ ID NO: 5188 - DNA, 15 bp, Artificial Sequence
  dgRNA
  Sgip1
cgcaataggcttgca

SEQ ID NO: 5189 - DNA, 15 bp, Artificial Sequence
  dgRNA
  Sgip1
cttgcaaggaccacg

SEQ ID NO: 5190 - DNA, 15 bp, Artificial Sequence
  dgRNA
  Tas2r126
atatttcccgggctc

SEQ ID NO: 5191 - DNA, 15 bp, Artificial Sequence
  dgRNA
  Tas2r126
aatatttcccgggct

SEQ ID NO: 5192 - DNA, 15 bp, Artificial Sequence
  dgRNA
  Tas2r126
caccactgattgcct

SEQ ID NO: 5193 - DNA, 15 bp, Artificial Sequence
  dgRNA
  Krtcap2
ccgggtgcccgatcc

SEQ ID NO: 5194 - DNA, 15 bp, Artificial Sequence
  dgRNA
  Krtcap2
tgctgctgcgaaccc

SEQ ID NO: 5195 - DNA, 15 bp, Artificial Sequence
  dgRNA
  Krtcap2
gctgctgcgaacccg

SEQ ID NO: 5196 - DNA, 15 bp, Artificial Sequence
  dgRNA
  Krtcap2
cccggggcttaatgc

SEQ ID NO: 5197 - DNA, 15 bp, Artificial Sequence
  dgRNA
  Kir3dl2
atctgttggtgaatc

SEQ ID NO: 5198 - DNA, 15 bp, Artificial Sequence
  dgRNA
  Kir3dl2
accggatgtcctgag

SEQ ID NO: 5199 - DNA, 15 bp, Artificial Sequence
  dgRNA
  Tfap2b
tgcacggttagtctg

SEQ ID NO: 5200 - DNA, 15 bp, Artificial Sequence
  dgRNA
  Tfap2b
aaccgtgcatttaaa

SEQ ID NO: 5201 - DNA, 15 bp, Artificial Sequence
  dgRNA
  Tfap2b
taaccgtgcatttaa

SEQ ID NO: 5202 - DNA, 15 bp, Artificial Sequence
  dgRNA
  Tfap2b
tacataaacacctct

SEQ ID NO: 5203 - DNA, 15 bp, Artificial Sequence
  dgRNA
  Sft2d3
atcgctttcaaattc

SEQ ID NO: 5204 - DNA, 15 bp, Artificial Sequence
  dgRNA
  Sft2d3
tcctccaaacagtct

SEQ ID NO: 5205 - DNA, 15 bp, Artificial Sequence
  dgRNA
  Rc3h1
acagcgctcgagaca

SEQ ID NO: 5206 - DNA, 15 bp, Artificial Sequence
  dgRNA
  Rc3h1
cagcgctcgagacac

SEQ ID NO: 5207 - DNA, 15 bp, Artificial Sequence
  dgRNA
  Rc3h1
cgctcgagacacggg

SEQ ID NO: 5208 - DNA, 15 bp, Artificial Sequence
  dgRNA
  Rc3h1
gctcgagacacgggc

SEQ ID NO: 5209 - DNA, 15 bp, Artificial Sequence
  dgRNA
  Zdbf2
taacttttcaacgta

SEQ ID NO: 5210 - DNA, 15 bp, Artificial Sequence
  dgRNA
  Zdbf2
gcagaccctcactaa

SEQ ID NO: 5211 - DNA, 15 bp, Artificial Sequence
  dgRNA
  Zdbf2
tactctactagatct

SEQ ID NO: 5212 - DNA, 15 bp, Artificial Sequence
  dgRNA
  Zdbf2
gtagagattctaggt

SEQ ID NO: 5213 - DNA, 15 bp, Artificial Sequence
  dgRNA
  Zfp422
ggccggtgttgggtc

SEQ ID NO: 5214 - DNA, 15 bp, Artificial Sequence
  dgRNA
  Zfp422
ggtgttgggtcgggt

SEQ ID NO: 5215 - DNA, 15 bp, Artificial Sequence
  dgRNA
  Zfp422
gtgttgggtcgggtc

SEQ ID NO: 5216 - DNA, 15 bp, Artificial Sequence
  dgRNA
  Zfp422
ggtcgggtcgggctg

SEQ ID NO: 5217 - DNA, 15 bp, Artificial Sequence
  dgRNA
  Armc1
ttgtttagcactccg

SEQ ID NO: 5218 - DNA, 15 bp, Artificial Sequence
  dgRNA
  Armc1
ttagcactccgtgga

SEQ ID NO: 5219 - DNA, 15 bp, Artificial Sequence
  dgRNA
  Armc1
tggacggcgagccct

SEQ ID NO: 5220 - DNA, 15 bp, Artificial Sequence
  dgRNA
  Armc1
gggtcctcataggtc

SEQ ID NO: 5221 - DNA, 15 bp, Artificial Sequence
  dgRNA
  Ppp2r3c
cttttagtatccgag

SEQ ID NO: 5222 - DNA, 15 bp, Artificial Sequence
  dgRNA
  Ppp2r3c
ttttagtatccgaga

SEQ ID NO: 5223 - DNA, 15 bp, Artificial Sequence
  dgRNA
  Ppp2r3c
agtatccgagagggc

SEQ ID NO: 5224 - DNA, 15 bp, Artificial Sequence
  dgRNA
  Ppp2r3c
cgtctattacatcgt

SEQ ID NO: 5225 - DNA, 15 bp, Artificial Sequence
  dgRNA
  Taf1a
tctgggccaaaccaa

SEQ ID NO: 5226 - DNA, 15 bp, Artificial Sequence
  dgRNA
  Taf1a
ctgggccaaaccaat

SEQ ID NO: 5227 - DNA, 15 bp, Artificial Sequence
  dgRNA
  Taf1a
tgggccaaaccaatg

SEQ ID NO: 5228 - DNA, 15 bp, Artificial Sequence
  dgRNA
  Taf1a
gccaaaccaatgggg

SEQ ID NO: 5229 - DNA, 15 bp, Artificial Sequence
  dgRNA
  Spata45
caagtcgtccgtgca

SEQ ID NO: 5230 - DNA, 15 bp, Artificial Sequence
  dgRNA
  Spata45
ccgtgcaaggccacc

SEQ ID NO: 5231 - DNA, 15 bp, Artificial Sequence
  dgRNA
  Spata45
gaaaagtctatcacc

SEQ ID NO: 5232 - DNA, 15 bp, Artificial Sequence
  dgRNA
  Spata45
accctggttaacaga

SEQ ID NO: 5233 - DNA, 15 bp, Artificial Sequence
  dgRNA
  Cstad
ctgctcgcgcctggc

SEQ ID NO: 5234 - DNA, 15 bp, Artificial Sequence
  dgRNA
  Cstad
tttttgcaactagag

SEQ ID NO: 5235 - DNA, 15 bp, Artificial Sequence
  dgRNA
  Cstad
ttttgcaactagagg

SEQ ID NO: 5236 - DNA, 15 bp, Artificial Sequence
  dgRNA
  Cstad
cagccaggcgcgagc

SEQ ID NO: 5237 - DNA, 15 bp, Artificial Sequence
  dgRNA
  Tbcc
cgcgaagaaaccaat

SEQ ID NO: 5238 - DNA, 15 bp, Artificial Sequence
  dgRNA
  Tbcc
agaaaccaataggcg

SEQ ID NO: 5239 - DNA, 15 bp, Artificial Sequence
  dgRNA
  Tbcc
taggcgaggagaata

SEQ ID NO: 5240 - DNA, 15 bp, Artificial Sequence
  dgRNA
  Tbcc
gcgaggagaatatgg

SEQ ID NO: 5241 - DNA, 15 bp, Artificial Sequence
  dgRNA
  Fabp2
tgcacactatgtagc

SEQ ID NO: 5242 - DNA, 15 bp, Artificial Sequence
  dgRNA
  Sash3
actgtagtggatgac

SEQ ID NO: 5243 - DNA, 15 bp, Artificial Sequence
  dgRNA
  Sash3
atgaccggagacaac

SEQ ID NO: 5244 - DNA, 15 bp, Artificial Sequence
  dgRNA
  Sash3
cggagacaacaggat

SEQ ID NO: 5245 - DNA, 15 bp, Artificial Sequence
  dgRNA
  Sash3
ccctagaggccggca

SEQ ID NO: 5246 - DNA, 15 bp, Artificial Sequence
  dgRNA
  Kcns3
cgcactgctgtgtct

SEQ ID NO: 5247 - DNA, 15 bp, Artificial Sequence
  dgRNA
  Kcns3
ccaaccatccgtgcg

SEQ ID NO: 5248 - DNA, 15 bp, Artificial Sequence
  dgRNA
  Kcns3
caaccatccgtgcgt

SEQ ID NO: 5249 - DNA, 15 bp, Artificial Sequence
  dgRNA
  Kcns3
aaccatccgtgcgtg

SEQ ID NO: 5250 - DNA, 15 bp, Artificial Sequence
  dgRNA
  Sorbs1
ggtgaaccggaagcc

SEQ ID NO: 5251 - DNA, 15 bp, Artificial Sequence
  dgRNA
  Sorbs1
aaccggaagcctggc

SEQ ID NO: 5252 - DNA, 15 bp, Artificial Sequence
  dgRNA
  Sorbs1
gcctggccggccgcg

SEQ ID NO: 5253 - DNA, 15 bp, Artificial Sequence
  dgRNA
  Sorbs1
ttaaacactaactgg

SEQ ID NO: 5254 - DNA, 15 bp, Artificial Sequence
  dgRNA
  Srrt
acccaggatacctta

SEQ ID NO: 5255 - DNA, 15 bp, Artificial Sequence
  dgRNA
  Srrt
cccaggataccttac

SEQ ID NO: 5256 - DNA, 15 bp, Artificial Sequence
  dgRNA
  Srrt
acgagcacgttcaga

SEQ ID NO: 5257 - DNA, 15 bp, Artificial Sequence
  dgRNA
  Srrt
cacgttcagaaggcc

SEQ ID NO: 5258 - DNA, 15 bp, Artificial Sequence
  dgRNA
  Exoc4
tgatgaagttgccct

SEQ ID NO: 5259 - DNA, 15 bp, Artificial Sequence
  dgRNA
  Exoc4
aggcatgcccgggac

SEQ ID NO: 5260 - DNA, 15 bp, Artificial Sequence
  dgRNA
  Exoc4
ccagaatgcttagag

SEQ ID NO: 5261 - DNA, 15 bp, Artificial Sequence
  dgRNA
  Exoc4
ccgcctcctaactcc

SEQ ID NO: 5262 - DNA, 15 bp, Artificial Sequence
  dgRNA
  Plk4
ttagcgtccgcgcta

SEQ ID NO: 5263 - DNA, 15 bp, Artificial Sequence
  dgRNA
  Plk4
ttccggcctagagcg

SEQ ID NO: 5264 - DNA, 15 bp, Artificial Sequence
  dgRNA
  Plk4
tccggcctagagcga

SEQ ID NO: 5265 - DNA, 15 bp, Artificial Sequence
  dgRNA
  Plk4
gctgcgcatgcgtgt

SEQ ID NO: 5266 - DNA, 15 bp, Artificial Sequence
  dgRNA
  Eif3k
cttttctcacgctat

SEQ ID NO: 5267 - DNA, 15 bp, Artificial Sequence
  dgRNA
  Eif3k
gcaagttacaactgc

SEQ ID NO: 5268 - DNA, 15 bp, Artificial Sequence
  dgRNA
  Eif3k
gttacaactgctgga

SEQ ID NO: 5269 - DNA, 15 bp, Artificial Sequence
  dgRNA
  Eif3k
tggaaggaaatcacg

SEQ ID NO: 5270 - DNA, 15 bp, Artificial Sequence
  dgRNA
  Rpl37a
gagacgggttttagg

SEQ ID NO: 5271 - DNA, 15 bp, Artificial Sequence
  dgRNA
  Rpl37a
gaagagacgggtttt

SEQ ID NO: 5272 - DNA, 15 bp, Artificial Sequence
  dgRNA
  Rpl37a
tgctcgcgaagagac

SEQ ID NO: 5273 - DNA, 15 bp, Artificial Sequence
  dgRNA
  Rpl37a
ctgctcgcgaagaga

SEQ ID NO: 5274 - DNA, 15 bp, Artificial Sequence
  dgRNA
  Fgf8
cccagcgcccagccg

SEQ ID NO: 5275 - DNA, 15 bp, Artificial Sequence
  dgRNA
  Fgf8
ccagcgcccagccgg

SEQ ID NO: 5276 - DNA, 15 bp, Artificial Sequence
  dgRNA
  Fgf8
cgggggtgcgggctc

SEQ ID NO: 5277 - DNA, 15 bp, Artificial Sequence
  dgRNA
  Fgf8
cgcgctcccccctcg

SEQ ID NO: 5278 - DNA, 15 bp, Artificial Sequence
  dgRNA
  Olfr263
taaattgttagccta

SEQ ID NO: 5279 - DNA, 15 bp, Artificial Sequence
  dgRNA
  Wdr3
gaggctgaagcgaac

SEQ ID NO: 5280 - DNA, 15 bp, Artificial Sequence
  dgRNA
  Wdr3
cgaaccggtctccag

SEQ ID NO: 5281 - DNA, 15 bp, Artificial Sequence
  dgRNA
  Wdr3
gcgatctgacagcga

SEQ ID NO: 5282 - DNA, 15 bp, Artificial Sequence
  dgRNA
  Wdr3
tcacttccgcctaga

SEQ ID NO: 5283 - DNA, 15 bp, Artificial Sequence
  dgRNA
  Kcnh4
ccgctcccctctggg

SEQ ID NO: 5284 - DNA, 15 bp, Artificial Sequence
  dgRNA
  Kcnh4
ggcttcgggtgtctc

SEQ ID NO: 5285 - DNA, 15 bp, Artificial Sequence
  dgRNA
  Kcnh4
ttcgggtgtctctgg

SEQ ID NO: 5286 - DNA, 15 bp, Artificial Sequence
  dgRNA
  Kcnh4
tctggcggcccctcc

SEQ ID NO: 5287 - DNA, 15 bp, Artificial Sequence
  dgRNA
  Eya3
ctacttccggtggct

SEQ ID NO: 5288 - DNA, 15 bp, Artificial Sequence
  dgRNA
  Eya3
tacttccggtggcta

SEQ ID NO: 5289 - DNA, 15 bp, Artificial Sequence
  dgRNA
  Eya3
cgcatccctagccac

SEQ ID NO: 5290 - DNA, 15 bp, Artificial Sequence
  dgRNA
  Nsdhl
cgcttcccattggtt

SEQ ID NO: 5291 - DNA, 15 bp, Artificial Sequence
  dgRNA
  Nsdhl
ggtttgggaacgaag

SEQ ID NO: 5292 - DNA, 15 bp, Artificial Sequence
  dgRNA
  Nsdhl
tcgcccaagagcaag

SEQ ID NO: 5293 - DNA, 15 bp, Artificial Sequence
  dgRNA
  Nsdhl
aagagggcggtgcgt

SEQ ID NO: 5294 - DNA, 15 bp, Artificial Sequence
  dgRNA
  Igf2
ctaaggaatggtcca

SEQ ID NO: 5295 - DNA, 15 bp, Artificial Sequence
  dgRNA
  Igf2
aaggctagctcttgg

SEQ ID NO: 5296 - DNA, 15 bp, Artificial Sequence
  dgRNA
  Igf2
agggggcgggtgcaa

SEQ ID NO: 5297 - DNA, 15 bp, Artificial Sequence
  dgRNA
  Igf2
ggggcgggtgcaaag

SEQ ID NO: 5298 - DNA, 15 bp, Artificial Sequence
  dgRNA
  Rars
tctcgcagtgtctcc

SEQ ID NO: 5299 - DNA, 15 bp, Artificial Sequence
  dgRNA
  Rars
ctcctggatcccgtt

SEQ ID NO: 5300 - DNA, 15 bp, Artificial Sequence
  dgRNA
  Rars
tcctggatcccgtta

SEQ ID NO: 5301 - DNA, 15 bp, Artificial Sequence
  dgRNA
  Rars
cctggatcccgttag

SEQ ID NO: 5302 - DNA, 15 bp, Artificial Sequence
  dgRNA
  Foxj2
ccttagcgtggacgc

SEQ ID NO: 5303 - DNA, 15 bp, Artificial Sequence
  dgRNA
  Foxj2
gcatcgccagtgccc

SEQ ID NO: 5304 - DNA, 15 bp, Artificial Sequence
  dgRNA
  Foxj2
cgccagtgcccggga

SEQ ID NO: 5305 - DNA, 15 bp, Artificial Sequence
  dgRNA
  Foxj2
cagtgcccgggacgg

SEQ ID NO: 5306 - DNA, 15 bp, Artificial Sequence
  dgRNA
  Mlx
aagattctcattcgg

SEQ ID NO: 5307 - DNA, 15 bp, Artificial Sequence
  dgRNA
  Mlx
cattcggaggccagt

SEQ ID NO: 5308 - DNA, 15 bp, Artificial Sequence
  dgRNA
  Mlx
attcggaggccagtg

SEQ ID NO: 5309 - DNA, 15 bp, Artificial Sequence
  dgRNA
  Mlx
cagtggggaccctta

SEQ ID NO: 5310 - DNA, 15 bp, Artificial Sequence
  dgRNA
  Slc6a17
ccttcggatctcaag

SEQ ID NO: 5311 - DNA, 15 bp, Artificial Sequence
  dgRNA
  Slc6a17
acccaccactctgtt

SEQ ID NO: 5312 - DNA, 15 bp, Artificial Sequence
  dgRNA
  Slc6a17
cccaccactctgttt

SEQ ID NO: 5313 - DNA, 15 bp, Artificial Sequence
  dgRNA
  Slc6a17
agcctcgcacgcagc

SEQ ID NO: 5314 - DNA, 15 bp, Artificial Sequence
  dgRNA
  Faim2
accgggagccctggt

SEQ ID NO: 5315 - DNA, 15 bp, Artificial Sequence
  dgRNA
  Faim2
gaaatagacgatgag

SEQ ID NO: 5316 - DNA, 15 bp, Artificial Sequence
  dgRNA
  Faim2
aaatagacgatgaga

SEQ ID NO: 5317 - DNA, 15 bp, Artificial Sequence
  dgRNA
  Faim2
tgaggccattcgaac

SEQ ID NO: 5318 - DNA, 15 bp, Artificial Sequence
  dgRNA
  Gm14085
atatagctagcaagc

SEQ ID NO: 5319 - DNA, 15 bp, Artificial Sequence
  dgRNA
  Gm14085
ctgatttgatcacaa

SEQ ID NO: 5320 - DNA, 15 bp, Artificial Sequence
  dgRNA
  Gpr162
ttcgtgttgaaaatc

SEQ ID NO: 5321 - DNA, 15 bp, Artificial Sequence
  dgRNA
  Gpr162
tcgtgttgaaaatcc

SEQ ID NO: 5322 - DNA, 15 bp, Artificial Sequence
  dgRNA
  Gpr162
gttgaaaatccggga

SEQ ID NO: 5323 - DNA, 15 bp, Artificial Sequence
  dgRNA
  Gpr162
ttgaaaatccgggat

SEQ ID NO: 5324 - DNA, 15 bp, Artificial Sequence
  dgRNA
  Tmem219
gttactccctccact

SEQ ID NO: 5325 - DNA, 15 bp, Artificial Sequence
  dgRNA
  Tmem219
tccacttggcccatt

SEQ ID NO: 5326 - DNA, 15 bp, Artificial Sequence
  dgRNA
  Tmem219
ttcttttggttcggc

SEQ ID NO: 5327 - DNA, 15 bp, Artificial Sequence
  dgRNA
  Tmem219
ggttcggccggaact

SEQ ID NO: 5328 - DNA, 15 bp, Artificial Sequence
  dgRNA
  Blzf1
ctgcttcgtctccat

SEQ ID NO: 5329 - DNA, 15 bp, Artificial Sequence
  dgRNA
  Blzf1
ttcgtctccattggc

SEQ ID NO: 5330 - DNA, 15 bp, Artificial Sequence
  dgRNA
  Blzf1
tcgtctccattggct

SEQ ID NO: 5331 - DNA, 15 bp, Artificial Sequence
  dgRNA
  Blzf1
ctttgcctcatcgcc

SEQ ID NO: 5332 - DNA, 15 bp, Artificial Sequence
  dgRNA
  Mturn
tcaccgggctccggg

SEQ ID NO: 5333 - DNA, 15 bp, Artificial Sequence
  dgRNA
  Mturn
cgggcggcgccgagt

SEQ ID NO: 5334 - DNA, 15 bp, Artificial Sequence
  dgRNA
  Mturn
gggcggcgccgagta

SEQ ID NO: 5335 - DNA, 15 bp, Artificial Sequence
  dgRNA
  Mturn
cgccgagtagggctc

SEQ ID NO: 5336 - DNA, 15 bp, Artificial Sequence
  dgRNA
  Pom121l2
tcccgccagggtgca

SEQ ID NO: 5337 - DNA, 15 bp, Artificial Sequence
  dgRNA
  Pom121l2
tgaaggtatgatgct

SEQ ID NO: 5338 - DNA, 15 bp, Artificial Sequence
  dgRNA
  Pom121l2
caccctggcgggaaa

SEQ ID NO: 5339 - DNA, 15 bp, Artificial Sequence
  dgRNA
  Pom121l2
gcaccctggcgggaa

SEQ ID NO: 5340 - DNA, 15 bp, Artificial Sequence
  dgRNA
  Apbb2
cgcggcctccgcccc

SEQ ID NO: 5341 - DNA, 15 bp, Artificial Sequence
  dgRNA
  Apbb2
ccggccccgccttgc

SEQ ID NO: 5342 - DNA, 15 bp, Artificial Sequence
  dgRNA
  Apbb2
cggccccgccttgct

SEQ ID NO: 5343 - DNA, 15 bp, Artificial Sequence
  dgRNA
  Apbb2
cttgctgggttcgcc

SEQ ID NO: 5344 - DNA, 15 bp, Artificial Sequence
  dgRNA
  Dusp1
gcgctcagagccgag

SEQ ID NO: 5345 - DNA, 15 bp, Artificial Sequence
  dgRNA
  Dusp1
tggcggcgccaagct

SEQ ID NO: 5346 - DNA, 15 bp, Artificial Sequence
  dgRNA
  Dusp1
ggcgccaagctcggt

SEQ ID NO: 5347 - DNA, 15 bp, Artificial Sequence
  dgRNA
  Dusp1
gcgccaagctcggta

SEQ ID NO: 5348 - DNA, 15 bp, Artificial Sequence
  dgRNA
  Acp1
cttagacgtgcgacc

SEQ ID NO: 5349 - DNA, 15 bp, Artificial Sequence
  dgRNA
  Acp1
ttagacgtgcgacct

SEQ ID NO: 5350 - DNA, 15 bp, Artificial Sequence
  dgRNA
  Acp1
gagtgaacgctagcc

SEQ ID NO: 5351 - DNA, 15 bp, Artificial Sequence
  dgRNA
  Acp1
agtgaacgctagccc

SEQ ID NO: 5352 - DNA, 15 bp, Artificial Sequence
  dgRNA
  Tmprss11g
ggagttgcttaccct

SEQ ID NO: 5353 - DNA, 15 bp, Artificial Sequence
  dgRNA
  Tmprss11g
caattagcctgaacc

SEQ ID NO: 5354 - DNA, 15 bp, Artificial Sequence
  dgRNA
  Tmprss11g
ctcaaaccatactct

SEQ ID NO: 5355 - DNA, 15 bp, Artificial Sequence
  dgRNA
  Tmprss11g
ctcccttgactcgtg

SEQ ID NO: 5356 - DNA, 15 bp, Artificial Sequence
  dgRNA
  Zdhhc3
tccgtcctgaccacg

SEQ ID NO: 5357 - DNA, 15 bp, Artificial Sequence
  dgRNA
  Zdhhc3
cctccctgcgcaata

SEQ ID NO: 5358 - DNA, 15 bp, Artificial Sequence
  dgRNA
  Zdhhc3
tatggcctgcactcg

SEQ ID NO: 5359 - DNA, 15 bp, Artificial Sequence
  dgRNA
  Zdhhc3
gctcaccgcgcgcgc

SEQ ID NO: 5360 - DNA, 15 bp, Artificial Sequence
  dgRNA
  Rab11a
agccgggtgagaatg

SEQ ID NO: 5361 - DNA, 15 bp, Artificial Sequence
  dgRNA
  Rab11a
ccctgcctagcttat

SEQ ID NO: 5362 - DNA, 15 bp, Artificial Sequence
  dgRNA
  Rab11a
cctagcttatgggcg

SEQ ID NO: 5363 - DNA, 15 bp, Artificial Sequence
  dgRNA
  Rab11a
gaagtactttctgcg

SEQ ID NO: 5364 - DNA, 15 bp, Artificial Sequence
  dgRNA
  Fbxl13
tcttcatctcgcgaa

SEQ ID NO: 5365 - DNA, 15 bp, Artificial Sequence
  dgRNA
  Fbxl13
atctcgcgaaaggct

SEQ ID NO: 5366 - DNA, 15 bp, Artificial Sequence
  dgRNA
  Fbxl13
aaggcttggactatt

SEQ ID NO: 5367 - DNA, 15 bp, Artificial Sequence
  dgRNA
  Fbxl13
gtacaggccggggcc

SEQ ID NO: 5368 - DNA, 15 bp, Artificial Sequence
  dgRNA
  Srp19
ggtaccggccccgca

SEQ ID NO: 5369 - DNA, 15 bp, Artificial Sequence
  dgRNA
  Srp19
ccggccccgcacggc

SEQ ID NO: 5370 - DNA, 15 bp, Artificial Sequence
  dgRNA
  Srp19
ccgcacggccggcca

SEQ ID NO: 5371 - DNA, 15 bp, Artificial Sequence
  dgRNA
  Srp19
acggaactcttctcg

SEQ ID NO: 5372 - DNA, 15 bp, Artificial Sequence
  dgRNA
  Pgls
catgcgccacgacct

SEQ ID NO: 5373 - DNA, 15 bp, Artificial Sequence
  dgRNA
  Pgls
aagtgctcggaccca

SEQ ID NO: 5374 - DNA, 15 bp, Artificial Sequence
  dgRNA
  Pgls
ggacccatggcagcg

SEQ ID NO: 5375 - DNA, 15 bp, Artificial Sequence
  dgRNA
  Pgls
gcgcggccgtcgcgc

SEQ ID NO: 5376 - DNA, 15 bp, Artificial Sequence
  dgRNA
  Thrsp
gctgtgtgcgttagg

SEQ ID NO: 5377 - DNA, 15 bp, Artificial Sequence
  dgRNA
  Thrsp
ctgtgtgcgttagga

SEQ ID NO: 5378 - DNA, 15 bp, Artificial Sequence
  dgRNA
  Thrsp
cgttaggagggaagc

SEQ ID NO: 5379 - DNA, 15 bp, Artificial Sequence
  dgRNA
  Thrsp
gaggtaatgtgattt

SEQ ID NO: 5380 - DNA, 15 bp, Artificial Sequence
  dgRNA
  Mrpl16
ctgagaagaccctcg

SEQ ID NO: 5381 - DNA, 15 bp, Artificial Sequence
  dgRNA
  Mrpl16
gaaacacctcgggcg

SEQ ID NO: 5382 - DNA, 15 bp, Artificial Sequence
  dgRNA
  Mrpl16
acctcgggcgtggct

SEQ ID NO: 5383 - DNA, 15 bp, Artificial Sequence
  dgRNA
  Mrpl16
cgtggcttggcctgt

SEQ ID NO: 5384 - DNA, 15 bp, Artificial Sequence
  dgRNA
  Efna5
ctctcccggggtgac

SEQ ID NO: 5385 - DNA, 15 bp, Artificial Sequence
  dgRNA
  Efna5
tcccgagcccttcag

SEQ ID NO: 5386 - DNA, 15 bp, Artificial Sequence
  dgRNA
  Efna5
cccgagcccttcagt

SEQ ID NO: 5387 - DNA, 15 bp, Artificial Sequence
  dgRNA
  Efna5
ccgagcccttcagtg

SEQ ID NO: 5388 - DNA, 15 bp, Artificial Sequence
  dgRNA
  Hsd3b2
gtactaccttagttg

SEQ ID NO: 5389 - DNA, 15 bp, Artificial Sequence
  dgRNA
  Kif16b
ttgccattgacttcg

SEQ ID NO: 5390 - DNA, 15 bp, Artificial Sequence
  dgRNA
  Kif16b
ccattgacttcgagg

SEQ ID NO: 5391 - DNA, 15 bp, Artificial Sequence
  dgRNA
  Kif16b
cattgacttcgaggt

SEQ ID NO: 5392 - DNA, 15 bp, Artificial Sequence
  dgRNA
  Kif16b
attgacttcgaggtg

SEQ ID NO: 5393 - DNA, 15 bp, Artificial Sequence
  dgRNA
  Srsf5
cccactgctctcgcc

SEQ ID NO: 5394 - DNA, 15 bp, Artificial Sequence
  dgRNA
  Srsf5
tctcgccaggggtcg

SEQ ID NO: 5395 - DNA, 15 bp, Artificial Sequence
  dgRNA
  Srsf5
ccaggggtcgcggta

SEQ ID NO: 5396 - DNA, 15 bp, Artificial Sequence
  dgRNA
  Srsf5
ccctactagaacttc

SEQ ID NO: 5397 - DNA, 15 bp, Artificial Sequence
  dgRNA
  Cox18
taagagagcctcaag

SEQ ID NO: 5398 - DNA, 15 bp, Artificial Sequence
  dgRNA
  Cox18
cggctcattgccgcg

SEQ ID NO: 5399 - DNA, 15 bp, Artificial Sequence
  dgRNA
  Cox18
ggctcattgccgcgt

SEQ ID NO: 5400 - DNA, 15 bp, Artificial Sequence
  dgRNA
  Cox18
attgccgcgtgggaa

SEQ ID NO: 5401 - DNA, 15 bp, Artificial Sequence
  dgRNA
  Thoc3
aaaaaagcgaattta

SEQ ID NO: 5402 - DNA, 15 bp, Artificial Sequence
  dgRNA
  Thoc3
tggacgcgcgctgca

SEQ ID NO: 5403 - DNA, 15 bp, Artificial Sequence
  dgRNA
  Thoc3
acgcgcgctgcatgg

SEQ ID NO: 5404 - DNA, 15 bp, Artificial Sequence
  dgRNA
  Thoc3
cgcgcgctgcatggc

SEQ ID NO: 5405 - DNA, 15 bp, Artificial Sequence
  dgRNA
  Olfr1290
cctacccagtttgtt

SEQ ID NO: 5406 - DNA, 15 bp, Artificial Sequence
  dgRNA
  Olfr1290
acaactagaggtatg

SEQ ID NO: 5407 - DNA, 15 bp, Artificial Sequence
  dgRNA
  Olfr1290
caaactgggtaggta

SEQ ID NO: 5408 - DNA, 15 bp, Artificial Sequence
  dgRNA
  Olfr1290
acaaactgggtaggt

SEQ ID NO: 5409 - DNA, 15 bp, Artificial Sequence
  dgRNA
  Pcdh15
ccgcagcgtgaacag

SEQ ID NO: 5410 - DNA, 15 bp, Artificial Sequence
  dgRNA
  Pcdh15
cgcagcgtgaacagt

SEQ ID NO: 5411 - DNA, 15 bp, Artificial Sequence
  dgRNA
  Pcdh15
gtcaatttgtcttcg

SEQ ID NO: 5412 - DNA, 15 bp, Artificial Sequence
  dgRNA
  Pcdh15
gcacctgctcctaat

SEQ ID NO: 5413 - DNA, 15 bp, Artificial Sequence
  dgRNA
  Prl3d1
ggttcaggtatagtc

SEQ ID NO: 5414 - DNA, 15 bp, Artificial Sequence
  dgRNA
  Prl3d1
ctatacctgaaccca

SEQ ID NO: 5415 - DNA, 15 bp, Artificial Sequence
  dgRNA
  Trpm5
ttattcacaaccgcc

SEQ ID NO: 5416 - DNA, 15 bp, Artificial Sequence
  dgRNA
  Trpm5
aaccgcctggaagct

SEQ ID NO: 5417 - DNA, 15 bp, Artificial Sequence
  dgRNA
  Trpm5
agtatctcggtctac

SEQ ID NO: 5418 - DNA, 15 bp, Artificial Sequence
  dgRNA
  Trpm5
gggacttcgtgttga

SEQ ID NO: 5419 - DNA, 15 bp, Artificial Sequence
  dgRNA
  Hoxa5
cctaatggaactgcg

SEQ ID NO: 5420 - DNA, 15 bp, Artificial Sequence
  dgRNA
  Hoxa5
ctaatggaactgcga

SEQ ID NO: 5421 - DNA, 15 bp, Artificial Sequence
  dgRNA
  Hoxa5
ataattttgccataa

SEQ ID NO: 5422 - DNA, 15 bp, Artificial Sequence
  dgRNA
  Hoxa5
acctcaattcgaccc

SEQ ID NO: 5423 - DNA, 15 bp, Artificial Sequence
  dgRNA
  Adam7
gtctacctactaggc

SEQ ID NO: 5424 - DNA, 15 bp, Artificial Sequence
  dgRNA
  Adam7
tctacctactaggct

SEQ ID NO: 5425 - DNA, 15 bp, Artificial Sequence
  dgRNA
  Adam7
caagaacggggagta

SEQ ID NO: 5426 - DNA, 15 bp, Artificial Sequence
  dgRNA
  Adam7
cagtggagctagtgg

SEQ ID NO: 5427 - DNA, 15 bp, Artificial Sequence
  dgRNA
  Plch1
acatcgtcacagccc

SEQ ID NO: 5428 - DNA, 15 bp, Artificial Sequence
  dgRNA
  Plcxd1
gtaagggcttgaccc

SEQ ID NO: 5429 - DNA, 15 bp, Artificial Sequence
  dgRNA
  Plcxd1
gggcttgaccctgga

SEQ ID NO: 5430 - DNA, 15 bp, Artificial Sequence
  dgRNA
  Plcxd1
catcctaaccagctg

SEQ ID NO: 5431 - DNA, 15 bp, Artificial Sequence
  dgRNA
  Plcxd1
gggtcaagcccttac

SEQ ID NO: 5432 - DNA, 15 bp, Artificial Sequence
  dgRNA
  Mrps36
aactagctatctagg

SEQ ID NO: 5433 - DNA, 15 bp, Artificial Sequence
  dgRNA
  Mrps36
actagctatctagga

SEQ ID NO: 5434 - DNA, 15 bp, Artificial Sequence
  dgRNA
  Mrps36
ggtcctagataattt

SEQ ID NO: 5435 - DNA, 15 bp, Artificial Sequence
  dgRNA
  Mrps36
gcacaacgttgtaat

SEQ ID NO: 5436 - DNA, 15 bp, Artificial Sequence
  dgRNA
  Gamt
cccgccccagcgagt

SEQ ID NO: 5437 - DNA, 15 bp, Artificial Sequence
  dgRNA
  Gamt
taggccccgcccaca

SEQ ID NO: 5438 - DNA, 15 bp, Artificial Sequence
  dgRNA
  Gamt
cacacggctcagcca

SEQ ID NO: 5439 - DNA, 15 bp, Artificial Sequence
  dgRNA
  Gamt
gccacggagttcttt

SEQ ID NO: 5440 - DNA, 15 bp, Artificial Sequence
  dgRNA
  Adam34
cgatggcacagcttg

SEQ ID NO: 5441 - DNA, 15 bp, Artificial Sequence
  dgRNA
  Adam34
tctatgcaatatgca

SEQ ID NO: 5442 - DNA, 15 bp, Artificial Sequence
  dgRNA
  Adam34
agactgttgactacc

SEQ ID NO: 5443 - DNA, 15 bp, Artificial Sequence
  dgRNA
  Adam34
actacctggcttagg

SEQ ID NO: 5444 - DNA, 15 bp, Artificial Sequence
  dgRNA
  Kdm5a
aacgatgttaaaaac

SEQ ID NO: 5445 - DNA, 15 bp, Artificial Sequence
  dgRNA
  Kdm5a
gagaacgaacaaacc

SEQ ID NO: 5446 - DNA, 15 bp, Artificial Sequence
  dgRNA
  Kdm5a
ccggccgactagcca

SEQ ID NO: 5447 - DNA, 15 bp, Artificial Sequence
  dgRNA
  Kdm5a
gccgactagccacgg

SEQ ID NO: 5448 - DNA, 15 bp, Artificial Sequence
  dgRNA
  Mdm4
ctgacctcggaggtc

SEQ ID NO: 5449 - DNA, 15 bp, Artificial Sequence
  dgRNA
  Mdm4
acctcggaggtccgg

SEQ ID NO: 5450 - DNA, 15 bp, Artificial Sequence
  dgRNA
  Mdm4
gctctatggttcccc

SEQ ID NO: 5451 - DNA, 15 bp, Artificial Sequence
  dgRNA
  Mdm4
agctcttgcgaacgc

SEQ ID NO: 5452 - DNA, 15 bp, Artificial Sequence
  dgRNA
  Rem2
ggagtatgctcccag

SEQ ID NO: 5453 - DNA, 15 bp, Artificial Sequence
  dgRNA
  Rem2
gagtatgctcccaga

SEQ ID NO: 5454 - DNA, 15 bp, Artificial Sequence
  dgRNA
  Rem2
tttcagagggcggtg

SEQ ID NO: 5455 - DNA, 15 bp, Artificial Sequence
  dgRNA
  Rem2
cacagcttggcatac

SEQ ID NO: 5456 - DNA, 15 bp, Artificial Sequence
  dgRNA
  Anp32a
cgcgctcctcttcgg

SEQ ID NO: 5457 - DNA, 15 bp, Artificial Sequence
  dgRNA
  Anp32a
cctcttcggcggccc

SEQ ID NO: 5458 - DNA, 15 bp, Artificial Sequence
  dgRNA
  Anp32a
ggccccggtatctaa

SEQ ID NO: 5459 - DNA, 15 bp, Artificial Sequence
  dgRNA
  Anp32a
gccccggtatctaaa

SEQ ID NO: 5460 - DNA, 15 bp, Artificial Sequence
  dgRNA
  Npm1
ccgccaagcacctgg

SEQ ID NO: 5461 - DNA, 15 bp, Artificial Sequence
  dgRNA
  Npm1
gggggcgaggtacct

SEQ ID NO: 5462 - DNA, 15 bp, Artificial Sequence
  dgRNA
  Npm1
aggtacctaggcgtg

SEQ ID NO: 5463 - DNA, 15 bp, Artificial Sequence
  dgRNA
  Npm1
aaaagcgcgactgtg

SEQ ID NO: 5464 - DNA, 15 bp, Artificial Sequence
  dgRNA
  Brca2
attttaggccacagc

SEQ ID NO: 5465 - DNA, 15 bp, Artificial Sequence
  dgRNA
  Brca2
acacacatatcgtga

SEQ ID NO: 5466 - DNA, 15 bp, Artificial Sequence
  dgRNA
  Brca2
cacacatatcgtgag

SEQ ID NO: 5467 - DNA, 15 bp, Artificial Sequence
  dgRNA
  Brca2
tcgtgaggggaagaa

SEQ ID NO: 5468 - DNA, 15 bp, Artificial Sequence
  dgRNA
  Bdh2
agtatttagtgcctc

SEQ ID NO: 5469 - DNA, 15 bp, Artificial Sequence
  dgRNA
  Bdh2
cctggccattggatc

SEQ ID NO: 5470 - DNA, 15 bp, Artificial Sequence
  dgRNA
  Bdh2
taaagtgcacggctg

SEQ ID NO: 5471 - DNA, 15 bp, Artificial Sequence
  dgRNA
  Bdh2
aggcactaaatactc

SEQ ID NO: 5472 - DNA, 15 bp, Artificial Sequence
  dgRNA
  Cacna1c
aggtgacgaactgac

SEQ ID NO: 5473 - DNA, 15 bp, Artificial Sequence
  dgRNA
  Cacna1c
atccaagggctccac

SEQ ID NO: 5474 - DNA, 15 bp, Artificial Sequence
  dgRNA
  Cacna1c
tccaagggctccact

SEQ ID NO: 5475 - DNA, 15 bp, Artificial Sequence
  dgRNA
  Cacna1c
ggcttgtctccgcat

SEQ ID NO: 5476 - DNA, 15 bp, Artificial Sequence
  dgRNA
  Ccl24
aattgctgactccac

SEQ ID NO: 5477 - DNA, 15 bp, Artificial Sequence
  dgRNA
  Ccl24
gctcaacgattttcg

SEQ ID NO: 5478 - DNA, 15 bp, Artificial Sequence
  dgRNA
  Ccl24
tttcgaggaagtccg

SEQ ID NO: 5479 - DNA, 15 bp, Artificial Sequence
  dgRNA
  Ccl24
ttcgaggaagtccgt

SEQ ID NO: 5480 - DNA, 15 bp, Artificial Sequence
  dgRNA
  Zc3hav1
attcgctctcccgcg

SEQ ID NO: 5481 - DNA, 15 bp, Artificial Sequence
  dgRNA
  Zc3hav1
aggacctcgtcgtcg

SEQ ID NO: 5482 - DNA, 15 bp, Artificial Sequence
  dgRNA
  Zc3hav1
cctcgtcgtcgaggt

SEQ ID NO: 5483 - DNA, 15 bp, Artificial Sequence
  dgRNA
  Zc3hav1
ctcgtcgtcgaggtc

SEQ ID NO: 5484 - DNA, 15 bp, Artificial Sequence
  dgRNA
  Tmem59l
tcaccgtatctagcc

SEQ ID NO: 5485 - DNA, 15 bp, Artificial Sequence
  dgRNA
  Tmem59l
acgcagatccaagtc

SEQ ID NO: 5486 - DNA, 15 bp, Artificial Sequence
  dgRNA
  Tmem59l
gtccggtcaaagagc

SEQ ID NO: 5487 - DNA, 15 bp, Artificial Sequence
  dgRNA
  Tmem59l
gaatatgtccccgac

SEQ ID NO: 5488 - DNA, 15 bp, Artificial Sequence
  dgRNA
  Slc25a36
tgctgatcagcgcat

SEQ ID NO: 5489 - DNA, 15 bp, Artificial Sequence
  dgRNA
  Slc25a36
cattgaagagccccc

SEQ ID NO: 5490 - DNA, 15 bp, Artificial Sequence
  dgRNA
  Slc25a36
attgaagagccccct

SEQ ID NO: 5491 - DNA, 15 bp, Artificial Sequence
  dgRNA
  Slc25a36
gcgatcacgtgaaag

SEQ ID NO: 5492 - DNA, 15 bp, Artificial Sequence
  dgRNA
  Cts6
gaatttccatagcct

SEQ ID NO: 5493 - DNA, 15 bp, Artificial Sequence
  dgRNA
  Cts6
atttccatagcctgg

SEQ ID NO: 5494 - DNA, 15 bp, Artificial Sequence
  dgRNA
  Cts6
aatcagaaaacgacc

SEQ ID NO: 5495 - DNA, 15 bp, Artificial Sequence
  dgRNA
  Cts6
cccggactaagaaat

SEQ ID NO: 5496 - DNA, 15 bp, Artificial Sequence
  dgRNA
  Gm10639
tctatcacgaaactc

SEQ ID NO: 5497 - DNA, 15 bp, Artificial Sequence
  dgRNA
  Gm10639
cgtgatagactagaa

SEQ ID NO: 5498 - DNA, 15 bp, Artificial Sequence
  dgRNA
  Gm10639
gtaaattcttaccca

SEQ ID NO: 5499 - DNA, 15 bp, Artificial Sequence
  dgRNA
  Gm10639
ggtaaattcttaccc

SEQ ID NO: 5500 - DNA, 15 bp, Artificial Sequence
  dgRNA
  Vezf1
tgaccccaccgcccg

SEQ ID NO: 5501 - DNA, 15 bp, Artificial Sequence
  dgRNA
  Vezf1
gaccccaccgcccgc

SEQ ID NO: 5502 - DNA, 15 bp, Artificial Sequence
  dgRNA
  Vezf1
accgcccgcgggcac

SEQ ID NO: 5503 - DNA, 15 bp, Artificial Sequence
  dgRNA
  Vezf1
actggctgagctccg

SEQ ID NO: 5504 - DNA, 15 bp, Artificial Sequence
  dgRNA
  Dido1
ttcgtgaggggactg

SEQ ID NO: 5505 - DNA, 15 bp, Artificial Sequence
  dgRNA
  Dido1
gtaggcacgaatgcc

SEQ ID NO: 5506 - DNA, 15 bp, Artificial Sequence
  dgRNA
  Dido1
cgaatgcctggactt

SEQ ID NO: 5507 - DNA, 15 bp, Artificial Sequence
  dgRNA
  Dido1
cggggcaaggagtaa

SEQ ID NO: 5508 - DNA, 15 bp, Artificial Sequence
  dgRNA
  Hhat
ttattttgggcaacc

SEQ ID NO: 5509 - DNA, 15 bp, Artificial Sequence
  dgRNA
  Hhat
gcaacctggcactcc

SEQ ID NO: 5510 - DNA, 15 bp, Artificial Sequence
  dgRNA
  Hhat
tccggctgttttagt

SEQ ID NO: 5511 - DNA, 15 bp, Artificial Sequence
  dgRNA
  Hhat
tagtctgcccttcac

SEQ ID NO: 5512 - DNA, 15 bp, Artificial Sequence
  dgRNA
  Lrrc57
cagctgcagtctgcg

SEQ ID NO: 5513 - DNA, 15 bp, Artificial Sequence
  dgRNA
  Lrrc57
agtctgcgaggacgc

SEQ ID NO: 5514 - DNA, 15 bp, Artificial Sequence
  dgRNA
  Lrrc57
gacgctgggtcccac

SEQ ID NO: 5515 - DNA, 15 bp, Artificial Sequence
  dgRNA
  Lrrc57
ggtcccacgggttgg

SEQ ID NO: 5516 - DNA, 15 bp, Artificial Sequence
  dgRNA
  Pex5
ccactccgggtgcct

SEQ ID NO: 5517 - DNA, 15 bp, Artificial Sequence
  dgRNA
  Pex5
tccgggtgcctcggc

SEQ ID NO: 5518 - DNA, 15 bp, Artificial Sequence
  dgRNA
  Pex5
ggtgcctcggccggt

SEQ ID NO: 5519 - DNA, 15 bp, Artificial Sequence
  dgRNA
  Pex5
cctcggccggtcgga

SEQ ID NO: 5520 - DNA, 15 bp, Artificial Sequence
  dgRNA
  Ankrd34c
ttctcgggcgccagc

SEQ ID NO: 5521 - DNA, 15 bp, Artificial Sequence
  dgRNA
  Ankrd34c
gcttaacaacttggc

SEQ ID NO: 5522 - DNA, 15 bp, Artificial Sequence
  dgRNA
  Ankrd34c
acttgcttaacaact

SEQ ID NO: 5523 - DNA, 15 bp, Artificial Sequence
  dgRNA
  Ankrd34c
gaaaggctctccagc

SEQ ID NO: 5524 - DNA, 15 bp, Artificial Sequence
  dgRNA
  Trat1
gagcaacggcattta

SEQ ID NO: 5525 - DNA, 15 bp, Artificial Sequence
  dgRNA
  Trat1
agaattcttagccta

SEQ ID NO: 5526 - DNA, 15 bp, Artificial Sequence
  dgRNA
  Trat1
ctttatcagtactca

SEQ ID NO: 5527 - DNA, 15 bp, Artificial Sequence
  dgRNA
  Ceacam12
tcatgcgagggcctg

SEQ ID NO: 5528 - DNA, 15 bp, Artificial Sequence
  dgRNA
  Ceacam12
gactgtgacataatg

SEQ ID NO: 5529 - DNA, 15 bp, Artificial Sequence
  dgRNA
  Ceacam12
ctgtgacataatgag

SEQ ID NO: 5530 - DNA, 15 bp, Artificial Sequence
  dgRNA
  Ceacam12
ccatttaattctagg

SEQ ID NO: 5531 - DNA, 15 bp, Artificial Sequence
  dgRNA
  Nufip1
agtttagctaaaccc

SEQ ID NO: 5532 - DNA, 15 bp, Artificial Sequence
  dgRNA
  Nufip1
tagctaaacccaggc

SEQ ID NO: 5533 - DNA, 15 bp, Artificial Sequence
  dgRNA
  Nufip1
tggacggtgtagacc

SEQ ID NO: 5534 - DNA, 15 bp, Artificial Sequence
  dgRNA
  Nufip1
tgctgcaaggcccga

SEQ ID NO: 5535 - DNA, 15 bp, Artificial Sequence
  dgRNA
  Matn1
cacctccattcagac

SEQ ID NO: 5536 - DNA, 15 bp, Artificial Sequence
  dgRNA
  Matn1
gactggccccgcctt

SEQ ID NO: 5537 - DNA, 15 bp, Artificial Sequence
  dgRNA
  Matn1
actggccccgccttt

SEQ ID NO: 5538 - DNA, 15 bp, Artificial Sequence
  dgRNA
  Matn1
ctggccccgcctttg

SEQ ID NO: 5539 - DNA, 15 bp, Artificial Sequence
  dgRNA
  Ceacam1
gaactcctgtcagtg

SEQ ID NO: 5540 - DNA, 15 bp, Artificial Sequence
  dgRNA
  Ceacam1
atccacgtgggctgg

SEQ ID NO: 5541 - DNA, 15 bp, Artificial Sequence
  dgRNA
  Ceacam1
gatccacgtgggctg

SEQ ID NO: 5542 - DNA, 15 bp, Artificial Sequence
  dgRNA
  Ceacam1
agatccacgtgggct

SEQ ID NO: 5543 - DNA, 15 bp, Artificial Sequence
  dgRNA
  Gcnt7
tttccacaacgcatc

SEQ ID NO: 5544 - DNA, 15 bp, Artificial Sequence
  dgRNA
  Gcnt7
tcccccgggacacag

SEQ ID NO: 5545 - DNA, 15 bp, Artificial Sequence
  dgRNA
  Gcnt7
gtggcgggcctggcg

SEQ ID NO: 5546 - DNA, 15 bp, Artificial Sequence
  dgRNA
  Gcnt7
tgtggcgggcctggc

SEQ ID NO: 5547 - DNA, 15 bp, Artificial Sequence
  dgRNA
  Sepp1
gatcggaaactgttc

SEQ ID NO: 5548 - DNA, 15 bp, Artificial Sequence
  dgRNA
  Sepp1
atcggaaactgttca

SEQ ID NO: 5549 - DNA, 15 bp, Artificial Sequence
  dgRNA
  Sepp1
tcggaaactgttcag

SEQ ID NO: 5550 - DNA, 15 bp, Artificial Sequence
  dgRNA
  Sepp1
tttgcaaggtcgcag

SEQ ID NO: 5551 - DNA, 15 bp, Artificial Sequence
  dgRNA
  Obox6
gtggcaccaaagggt

SEQ ID NO: 5552 - DNA, 15 bp, Artificial Sequence
  dgRNA
  Obox6
gaggaaccaaaatgt

SEQ ID NO: 5553 - DNA, 15 bp, Artificial Sequence
  dgRNA
  Obox6
cattgaattcaagtt

SEQ ID NO: 5554 - DNA, 15 bp, Artificial Sequence
  dgRNA
  Obox6
gagaaacgtaactgc

SEQ ID NO: 5555 - DNA, 15 bp, Artificial Sequence
  dgRNA
  Lyrm4
cccgggcggttcgaa

SEQ ID NO: 5556 - DNA, 15 bp, Artificial Sequence
  dgRNA
  Lyrm4
gggcggttcgaaagg

SEQ ID NO: 5557 - DNA, 15 bp, Artificial Sequence
  dgRNA
  Lyrm4
cggttcgaaaggcgg

SEQ ID NO: 5558 - DNA, 15 bp, Artificial Sequence
  dgRNA
  Lyrm4
ttcgaaaggcggagg

SEQ ID NO: 5559 - DNA, 15 bp, Artificial Sequence
  dgRNA
  Lcat
cggctcttttttccc

SEQ ID NO: 5560 - DNA, 15 bp, Artificial Sequence
  dgRNA
  Lcat
ttttccctggcgcca

SEQ ID NO: 5561 - DNA, 15 bp, Artificial Sequence
  dgRNA
  Lcat
cctggccacccccat

SEQ ID NO: 5562 - DNA, 15 bp, Artificial Sequence
  dgRNA
  Lcat
tcccactggccccgg

SEQ ID NO: 5563 - DNA, 15 bp, Artificial Sequence
  dgRNA
  Dip2a
tccggcgtgtcttat

SEQ ID NO: 5564 - DNA, 15 bp, Artificial Sequence
  dgRNA
  Dip2a
gcctttaaagttgct

SEQ ID NO: 5565 - DNA, 15 bp, Artificial Sequence
  dgRNA
  Dip2a
ttaaagttgctgggc

SEQ ID NO: 5566 - DNA, 15 bp, Artificial Sequence
  dgRNA
  Dip2a
taaagttgctgggcg

SEQ ID NO: 5567 - DNA, 15 bp, Artificial Sequence
  dgRNA
  Wars
taaagacctccaccc

SEQ ID NO: 5568 - DNA, 15 bp, Artificial Sequence
  dgRNA
  Wars
gtttcacttactgag

SEQ ID NO: 5569 - DNA, 15 bp, Artificial Sequence
  dgRNA
  Hsd3b5
ggtgaaattagcttc

SEQ ID NO: 5570 - DNA, 15 bp, Artificial Sequence
  dgRNA
  Hsd3b5
ggtaccaaatcttgt

SEQ ID NO: 5571 - DNA, 15 bp, Artificial Sequence
  dgRNA
  Hsd3b5
tggtaccaaatcttg

SEQ ID NO: 5572 - DNA, 15 bp, Artificial Sequence
  dgRNA
  Ptcd1
agccgccgccccgcg

SEQ ID NO: 5573 - DNA, 15 bp, Artificial Sequence
  dgRNA
  Ptcd1
ccccgcgagggatgc

SEQ ID NO: 5574 - DNA, 15 bp, Artificial Sequence
  dgRNA
  Ptcd1
cccgcgagggatgcc

SEQ ID NO: 5575 - DNA, 15 bp, Artificial Sequence
  dgRNA
  Ptcd1
ggatgccgggagcgc

SEQ ID NO: 5576 - DNA, 15 bp, Artificial Sequence
  dgRNA
  Taf1c
cacttgttcgttgag

SEQ ID NO: 5577 - DNA, 15 bp, Artificial Sequence
  dgRNA
  Taf1c
cacgaccatgcatat

SEQ ID NO: 5578 - DNA, 15 bp, Artificial Sequence
  dgRNA
  Taf1c
ctctgcaggtggcgc

SEQ ID NO: 5579 - DNA, 15 bp, Artificial Sequence
  dgRNA
  Taf1c
ctcggttagatgatc

SEQ ID NO: 5580 - DNA, 15 bp, Artificial Sequence
  dgRNA
  Anp32e
aaccctctagcccaa

SEQ ID NO: 5581 - DNA, 15 bp, Artificial Sequence
  dgRNA
  Anp32e
agtcgtgtgacgcta

SEQ ID NO: 5582 - DNA, 15 bp, Artificial Sequence
  dgRNA
  Anp32e
ctcgaccaatcccgt

SEQ ID NO: 5583 - DNA, 15 bp, Artificial Sequence
  dgRNA
  Anp32e
tcgaccaatcccgtt

SEQ ID NO: 5584 - DNA, 15 bp, Artificial Sequence
  dgRNA
  Heph
ccggagatcctcacc

SEQ ID NO: 5585 - DNA, 15 bp, Artificial Sequence
  dgRNA
  Heph
ttaaagaaccacccc

SEQ ID NO: 5586 - DNA, 15 bp, Artificial Sequence
  dgRNA
  Heph
ggttttgtaccaaac

SEQ ID NO: 5587 - DNA, 15 bp, Artificial Sequence
  dgRNA
  Heph
tttgtaccaaaccgg

SEQ ID NO: 5588 - DNA, 15 bp, Artificial Sequence
  dgRNA
  Pbrm1
ggccgcggacgcttc

SEQ ID NO: 5589 - DNA, 15 bp, Artificial Sequence
  dgRNA
  Pbrm1
acgcttcaggagcag

SEQ ID NO: 5590 - DNA, 15 bp, Artificial Sequence
  dgRNA
  Pbrm1
atcaccacgacttct

SEQ ID NO: 5591 - DNA, 15 bp, Artificial Sequence
  dgRNA
  Pbrm1
gcgccacgtgcgaac

SEQ ID NO: 5592 - DNA, 15 bp, Artificial Sequence
  dgRNA
  Slc39a4
caagccgcccaccta

SEQ ID NO: 5593 - DNA, 15 bp, Artificial Sequence
  dgRNA
  Slc39a4
cgcccacctaaggac

SEQ ID NO: 5594 - DNA, 15 bp, Artificial Sequence
  dgRNA
  Slc39a4
ctccccaggctttcg

SEQ ID NO: 5595 - DNA, 15 bp, Artificial Sequence
  dgRNA
  Slc39a4
cccaggctttcgggg

SEQ ID NO: 5596 - DNA, 15 bp, Artificial Sequence
  dgRNA
  Senp7
caacgacagaacgat

SEQ ID NO: 5597 - DNA, 15 bp, Artificial Sequence
  dgRNA
  Senp7
gaacgataggctcgc

SEQ ID NO: 5598 - DNA, 15 bp, Artificial Sequence
  dgRNA
  Senp7
ctcgcaggctaaaca

SEQ ID NO: 5599 - DNA, 15 bp, Artificial Sequence
  dgRNA
  Senp7
ggctaaacaaggccc

SEQ ID NO: 5600 - DNA, 15 bp, Artificial Sequence
  dgRNA
  Rcsd1
atttaaaccccgatc

SEQ ID NO: 5601 - DNA, 15 bp, Artificial Sequence
  dgRNA
  Rcsd1
ctcgttctctggcgc

SEQ ID NO: 5602 - DNA, 15 bp, Artificial Sequence
  dgRNA
  Rcsd1
tcgttctctggcgca

SEQ ID NO: 5603 - DNA, 15 bp, Artificial Sequence
  dgRNA
  Rcsd1
cgcagggcccccagc

SEQ ID NO: 5604 - DNA, 15 bp, Artificial Sequence
  dgRNA
  Tceal6
agtgggttaacctct

SEQ ID NO: 5605 - DNA, 15 bp, Artificial Sequence
  dgRNA
  Tceal6
agatcctccagggat

SEQ ID NO: 5606 - DNA, 15 bp, Artificial Sequence
  dgRNA
  Tceal6
gagatggatttagct

SEQ ID NO: 5607 - DNA, 15 bp, Artificial Sequence
  dgRNA
  Tceal6
agatggatttagcta

SEQ ID NO: 5608 - DNA, 15 bp, Artificial Sequence
  dgRNA
  Grip2
gctaggcagcacttt

SEQ ID NO: 5609 - DNA, 15 bp, Artificial Sequence
  dgRNA
  Grip2
acttttggcgggaag

SEQ ID NO: 5610 - DNA, 15 bp, Artificial Sequence
  dgRNA
  Grip2
ggaaatagaggatcg

SEQ ID NO: 5611 - DNA, 15 bp, Artificial Sequence
  dgRNA
  Grip2
cggggtgctgaatat

SEQ ID NO: 5612 - DNA, 15 bp, Artificial Sequence
  dgRNA
  Ech1
aggccagcgtcccac

SEQ ID NO: 5613 - DNA, 15 bp, Artificial Sequence
  dgRNA
  Ech1
ggccagcgtcccact

SEQ ID NO: 5614 - DNA, 15 bp, Artificial Sequence
  dgRNA
  Ech1
gtcccactgggccaa

SEQ ID NO: 5615 - DNA, 15 bp, Artificial Sequence
  dgRNA
  Ech1
agcagtttagttgct

SEQ ID NO: 5616 - DNA, 15 bp, Artificial Sequence
  dgRNA
  Chst12
gcccccactccggat

SEQ ID NO: 5617 - DNA, 15 bp, Artificial Sequence
  dgRNA
  Chst12
attggttgctgcaaa

SEQ ID NO: 5618 - DNA, 15 bp, Artificial Sequence
  dgRNA
  Chst12
ttggttgctgcaaaa

SEQ ID NO: 5619 - DNA, 15 bp, Artificial Sequence
  dgRNA
  Chst12
aggggcgggacgctc

SEQ ID NO: 5620 - DNA, 15 bp, Artificial Sequence
  dgRNA
  Lrrc40
catgttccccccacg

SEQ ID NO: 5621 - DNA, 15 bp, Artificial Sequence
  dgRNA
  Lrrc40
tcctgagggcgaggt

SEQ ID NO: 5622 - DNA, 15 bp, Artificial Sequence
  dgRNA
  Lrrc40
agggcgaggttggtg

SEQ ID NO: 5623 - DNA, 15 bp, Artificial Sequence
  dgRNA
  Lrrc40
gggcgaggttggtga

SEQ ID NO: 5624 - DNA, 15 bp, Artificial Sequence
  dgRNA
  Cbln1
taacaacggcgccct

SEQ ID NO: 5625 - DNA, 15 bp, Artificial Sequence
  dgRNA
  Cbln1
acggcgccctaggtc

SEQ ID NO: 5626 - DNA, 15 bp, Artificial Sequence
  dgRNA
  Cbln1
gcgccctaggtcagg

SEQ ID NO: 5627 - DNA, 15 bp, Artificial Sequence
  dgRNA
  Cbln1
tcaggtggccgcgcg

SEQ ID NO: 5628 - DNA, 15 bp, Artificial Sequence
  dgRNA
  Nmnat2
agccttggatcgagc

SEQ ID NO: 5629 - DNA, 15 bp, Artificial Sequence
  dgRNA
  Nmnat2
tggatcgagccggag

SEQ ID NO: 5630 - DNA, 15 bp, Artificial Sequence
  dgRNA
  Nmnat2
agtggcaagcgttaa

SEQ ID NO: 5631 - DNA, 15 bp, Artificial Sequence
  dgRNA
  Nmnat2
gtggcaagcgttaaa

SEQ ID NO: 5632 - DNA, 15 bp, Artificial Sequence
  dgRNA
  Grin1
catttacgccaacgc

SEQ ID NO: 5633 - DNA, 15 bp, Artificial Sequence
  dgRNA
  Grin1
acgcaggcgcgcgtc

SEQ ID NO: 5634 - DNA, 15 bp, Artificial Sequence
  dgRNA
  Grin1
caggcgcgcgtcagg

SEQ ID NO: 5635 - DNA, 15 bp, Artificial Sequence
  dgRNA
  Grin1
gctcgactccgcgtc

SEQ ID NO: 5636 - DNA, 15 bp, Artificial Sequence
  dgRNA
  Ebf2
tgaagtgacgtgctc

SEQ ID NO: 5637 - DNA, 15 bp, Artificial Sequence
  dgRNA
  Ebf2
gtgtaccctaactcc

SEQ ID NO: 5638 - DNA, 15 bp, Artificial Sequence
  dgRNA
  Ebf2
ctggagtcgcgttga

SEQ ID NO: 5639 - DNA, 15 bp, Artificial Sequence
  dgRNA
  Ebf2
gtgctccggaagact

SEQ ID NO: 5640 - DNA, 15 bp, Artificial Sequence
  dgRNA
  Kif2a
gtccgcccgcaggcc

SEQ ID NO: 5641 - DNA, 15 bp, Artificial Sequence
  dgRNA
  Kif2a
tccgcccgcaggccc

SEQ ID NO: 5642 - DNA, 15 bp, Artificial Sequence
  dgRNA
  Kif2a
ccgcccgcaggcccg

SEQ ID NO: 5643 - DNA, 15 bp, Artificial Sequence
  dgRNA
  Kif2a
gtccacgctgcctcc

SEQ ID NO: 5644 - DNA, 15 bp, Artificial Sequence
  dgRNA
  Lin54
cctgagtgcgtttga

SEQ ID NO: 5645 - DNA, 15 bp, Artificial Sequence
  dgRNA
  Lin54
agtgcgtttgaaggt

SEQ ID NO: 5646 - DNA, 15 bp, Artificial Sequence
  dgRNA
  Lin54
gcgtttgaaggttgg

SEQ ID NO: 5647 - DNA, 15 bp, Artificial Sequence
  dgRNA
  Lin54
cgtttgaaggttggc

SEQ ID NO: 5648 - DNA, 15 bp, Artificial Sequence
  dgRNA
  Kif15
ggttccgcttgctca

SEQ ID NO: 5649 - DNA, 15 bp, Artificial Sequence
  dgRNA
  Kif15
ctcggcagacttggc

SEQ ID NO: 5650 - DNA, 15 bp, Artificial Sequence
  dgRNA
  Kif15
tcggcagacttggca

SEQ ID NO: 5651 - DNA, 15 bp, Artificial Sequence
  dgRNA
  Kif15
tgtctgtcgcccgcg

SEQ ID NO: 5652 - DNA, 15 bp, Artificial Sequence
  dgRNA
  Hes3
cttgcatgagcaaaa

SEQ ID NO: 5653 - DNA, 15 bp, Artificial Sequence
  dgRNA
  Hes3
cccgtttgcataagc

SEQ ID NO: 5654 - DNA, 15 bp, Artificial Sequence
  dgRNA
  Hes3
ccgtttgcataagca

SEQ ID NO: 5655 - DNA, 15 bp, Artificial Sequence
  dgRNA
  Hes3
gcagggtttctaagt

SEQ ID NO: 5656 - DNA, 15 bp, Artificial Sequence
  dgRNA
  Ccne2
cgcccgctcgtcgcc

SEQ ID NO: 5657 - DNA, 15 bp, Artificial Sequence
  dgRNA
  Ccne2
ccgctcgtcgcccgg

SEQ ID NO: 5658 - DNA, 15 bp, Artificial Sequence
  dgRNA
  Ccne2
tcgtcgcccggcgga

SEQ ID NO: 5659 - DNA, 15 bp, Artificial Sequence
  dgRNA
  Ccne2
cccggcggatggctc

SEQ ID NO: 5660 - DNA, 15 bp, Artificial Sequence
  dgRNA
  Krt5
ccaacccacttctaa

SEQ ID NO: 5661 - DNA, 15 bp, Artificial Sequence
  dgRNA
  Krt5
caacccacttctaag

SEQ ID NO: 5662 - DNA, 15 bp, Artificial Sequence
  dgRNA
  Krt5
gaatgattagtgggc

SEQ ID NO: 5663 - DNA, 15 bp, Artificial Sequence
  dgRNA
  Krt5
ctgtgaatgattagt

SEQ ID NO: 5664 - DNA, 15 bp, Artificial Sequence
  dgRNA
  Lrrc16a
cagccgccttgcgtt

SEQ ID NO: 5665 - DNA, 15 bp, Artificial Sequence
  dgRNA
  Lrrc16a
aagcagcgagccgag

SEQ ID NO: 5666 - DNA, 15 bp, Artificial Sequence
  dgRNA
  Lrrc16a
agcagcgagccgaga

SEQ ID NO: 5667 - DNA, 15 bp, Artificial Sequence
  dgRNA
  Lrrc16a
agcgagccgagaggg

SEQ ID NO: 5668 - DNA, 15 bp, Artificial Sequence
  dgRNA
  Gulo
ctggactcccaaggt

SEQ ID NO: 5669 - DNA, 15 bp, Artificial Sequence
  dgRNA
  Gulo
ggagctcgcagacag

SEQ ID NO: 5670 - DNA, 15 bp, Artificial Sequence
  dgRNA
  Gulo
gagctcgcagacaga

SEQ ID NO: 5671 - DNA, 15 bp, Artificial Sequence
  dgRNA
  Gulo
tcgcagacagagggc

SEQ ID NO: 5672 - DNA, 15 bp, Artificial Sequence
  dgRNA
  Cryab
ggtgaaggcccaact

SEQ ID NO: 5673 - DNA, 15 bp, Artificial Sequence
  dgRNA
  Dctn6
accagtgagagccgt

SEQ ID NO: 5674 - DNA, 15 bp, Artificial Sequence
  dgRNA
  Dctn6
agtgagagccgttgg

SEQ ID NO: 5675 - DNA, 15 bp, Artificial Sequence
  dgRNA
  Dctn6
catgtatcggtgtta

SEQ ID NO: 5676 - DNA, 15 bp, Artificial Sequence
  dgRNA
  Dctn6
accaacggctctcac

SEQ ID NO: 5677 - DNA, 15 bp, Artificial Sequence
  dgRNA
  Cyp2c29
atgggcactctgtaa

SEQ ID NO: 5678 - DNA, 15 bp, Artificial Sequence
  dgRNA
  Cyp2c29
gttaacagtacagac

SEQ ID NO: 5679 - DNA, 15 bp, Artificial Sequence
  dgRNA
  Cyp2c29
attgactaatccatt

SEQ ID NO: 5680 - DNA, 15 bp, Artificial Sequence
  dgRNA
  Dst
tcctctgcagcgccg

SEQ ID NO: 5681 - DNA, 15 bp, Artificial Sequence
  dgRNA
  Dst
tgcagcgccgtggcc

SEQ ID NO: 5682 - DNA, 15 bp, Artificial Sequence
  dgRNA
  Dst
gcagcgccgtggccc

SEQ ID NO: 5683 - DNA, 15 bp, Artificial Sequence
  dgRNA
  Dst
cagcgccgtggcccg

SEQ ID NO: 5684 - DNA, 15 bp, Artificial Sequence
  dgRNA
  Grik1
catcttaattcagcc

SEQ ID NO: 5685 - DNA, 15 bp, Artificial Sequence
  dgRNA
  Grik1
ttttagatcccatac

SEQ ID NO: 5686 - DNA, 15 bp, Artificial Sequence
  dgRNA
  Grik1
atactgggatgacca

SEQ ID NO: 5687 - DNA, 15 bp, Artificial Sequence
  dgRNA
  Grik1
ttagacgggatgcta

SEQ ID NO: 5688 - DNA, 15 bp, Artificial Sequence
  dgRNA
  Ttpa
tggctgcggttaccc

SEQ ID NO: 5689 - DNA, 15 bp, Artificial Sequence
  dgRNA
  Ttpa
taccctggtgagcac

SEQ ID NO: 5690 - DNA, 15 bp, Artificial Sequence
  dgRNA
  Ttpa
cctggtgagcaccgg

SEQ ID NO: 5691 - DNA, 15 bp, Artificial Sequence
  dgRNA
  Ttpa
ctggtgagcaccgga

SEQ ID NO: 5692 - DNA, 15 bp, Artificial Sequence
  dgRNA
  Map4
aagacccgtgagcgt

SEQ ID NO: 5693 - DNA, 15 bp, Artificial Sequence
  dgRNA
  Map4
acccgtgagcgtggg

SEQ ID NO: 5694 - DNA, 15 bp, Artificial Sequence
  dgRNA
  Map4
taccaggtgtaaaaa

SEQ ID NO: 5695 - DNA, 15 bp, Artificial Sequence
  dgRNA
  Map4
ctaaatgcatttacc

SEQ ID NO: 5696 - DNA, 15 bp, Artificial Sequence
  dgRNA
  Olfr1228
ccaatattctagatg

SEQ ID NO: 5697 - DNA, 15 bp, Artificial Sequence
  dgRNA
  Olfr1228
ccacatctagaatat

SEQ ID NO: 5698 - DNA, 15 bp, Artificial Sequence
  dgRNA
  Olfr1228
gctgagataaagtag

SEQ ID NO: 5699 - DNA, 15 bp, Artificial Sequence
  dgRNA
  Sell
gatatcctgagcagg

SEQ ID NO: 5700 - DNA, 15 bp, Artificial Sequence
  dgRNA
  Sell
agggggcatagcttc

SEQ ID NO: 5701 - DNA, 15 bp, Artificial Sequence
  dgRNA
  Sell
gcccagattaggaaa

SEQ ID NO: 5702 - DNA, 15 bp, Artificial Sequence
  dgRNA
  Sell
cccagattaggaaag

SEQ ID NO: 5703 - DNA, 15 bp, Artificial Sequence
  dgRNA
  Zfp384
ggcgtggaggactcg

SEQ ID NO: 5704 - DNA, 15 bp, Artificial Sequence
  dgRNA
  Zfp384
aggactcggggttcc

SEQ ID NO: 5705 - DNA, 15 bp, Artificial Sequence
  dgRNA
  Zfp384
tttctcggagaaggc

SEQ ID NO: 5706 - DNA, 15 bp, Artificial Sequence
  dgRNA
  Zfp384
gtttctcggagaagg

SEQ ID NO: 5707 - DNA, 15 bp, Artificial Sequence
  dgRNA
  Wfdc10
actatatatatcgtg

SEQ ID NO: 5708 - DNA, 15 bp, Artificial Sequence
  dgRNA
  Wfdc10
tatgttagcgcgaag

SEQ ID NO: 5709 - DNA, 15 bp, Artificial Sequence
  dgRNA
  Wfdc10
atgttagcgcgaaga

SEQ ID NO: 5710 - DNA, 15 bp, Artificial Sequence
  dgRNA
  Wfdc10
tgttagcgcgaagag

SEQ ID NO: 5711 - DNA, 15 bp, Artificial Sequence
  dgRNA
  Tmem200c
acaagtcgctgtcga

SEQ ID NO: 5712 - DNA, 15 bp, Artificial Sequence
  dgRNA
  Tmem200c
caagtcgctgtcgaa

SEQ ID NO: 5713 - DNA, 15 bp, Artificial Sequence
  dgRNA
  Tmem200c
tcgctgtcgaaggga

SEQ ID NO: 5714 - DNA, 15 bp, Artificial Sequence
  dgRNA
  Tmem200c
tgtcgaagggacgga

SEQ ID NO: 5715 - DNA, 15 bp, Artificial Sequence
  dgRNA
  Ly6d
gccaagcctgtactg

SEQ ID NO: 5716 - DNA, 15 bp, Artificial Sequence
  dgRNA
  Ly6d
ccaagcctgtactga

SEQ ID NO: 5717 - DNA, 15 bp, Artificial Sequence
  dgRNA
  Ly6d
ccatgccctcagtac

SEQ ID NO: 5718 - DNA, 15 bp, Artificial Sequence
  dgRNA
  Ly6d
agcagcatgcaaatc

SEQ ID NO: 5719 - DNA, 15 bp, Artificial Sequence
  dgRNA
  Csnka2ip
ttgaattcagtcgag

SEQ ID NO: 5720 - DNA, 15 bp, Artificial Sequence
  dgRNA
  Csnka2ip
atgatggcgaactca

SEQ ID NO: 5721 - DNA, 15 bp, Artificial Sequence
  dgRNA
  Csnka2ip
aatgatggcgaactc

SEQ ID NO: 5722 - DNA, 15 bp, Artificial Sequence
  dgRNA
  Csnka2ip
gctacagtcgggtag

SEQ ID NO: 5723 - DNA, 15 bp, Artificial Sequence
  dgRNA
  Chchd4
cgcgtgcgcatctta

SEQ ID NO: 5724 - DNA, 15 bp, Artificial Sequence
  dgRNA
  Chchd4
gcgtgcgcatcttaa

SEQ ID NO: 5725 - DNA, 15 bp, Artificial Sequence
  dgRNA
  Chchd4
catcttaagggctgc

SEQ ID NO: 5726 - DNA, 15 bp, Artificial Sequence
  dgRNA
  Chchd4
atcttaagggctgct

SEQ ID NO: 5727 - DNA, 15 bp, Artificial Sequence
  dgRNA
  Sncg
ctgcatataagagcc

SEQ ID NO: 5728 - DNA, 15 bp, Artificial Sequence
  dgRNA
  Sncg
tgcatataagagcca

SEQ ID NO: 5729 - DNA, 15 bp, Artificial Sequence
  dgRNA
  Sncg
gggcacgagaccacc

SEQ ID NO: 5730 - DNA, 15 bp, Artificial Sequence
  dgRNA
  Sncg
ggcacgagaccacca

SEQ ID NO: 5731 - DNA, 15 bp, Artificial Sequence
  dgRNA
  Ttc26
agtactattacaact

SEQ ID NO: 5732 - DNA, 15 bp, Artificial Sequence
  dgRNA
  Ttc26
taggtgcttctctca

SEQ ID NO: 5733 - DNA, 15 bp, Artificial Sequence
  dgRNA
  Ttc26
gtgtgtttccgcagc

SEQ ID NO: 5734 - DNA, 15 bp, Artificial Sequence
  dgRNA
  Cntnap4
accagtactgagggc

SEQ ID NO: 5735 - DNA, 15 bp, Artificial Sequence
  dgRNA
  Cntnap4
gagcgcgcgcgtgag

SEQ ID NO: 5736 - DNA, 15 bp, Artificial Sequence
  dgRNA
  Cntnap4
cgcgcgcgtgagagg

SEQ ID NO: 5737 - DNA, 15 bp, Artificial Sequence
  dgRNA
  Cntnap4
gcgcgcgtgagagga

SEQ ID NO: 5738 - DNA, 15 bp, Artificial Sequence
  dgRNA
  Slc22a8
cccatgcacatccgc

SEQ ID NO: 5739 - DNA, 15 bp, Artificial Sequence
  dgRNA
  Slc22a8
ccatgcacatccgct

SEQ ID NO: 5740 - DNA, 15 bp, Artificial Sequence
  dgRNA
  Slc22a8
catgcacatccgctg

SEQ ID NO: 5741 - DNA, 15 bp, Artificial Sequence
  dgRNA
  Slc22a8
atgcacatccgctgg

SEQ ID NO: 5742 - DNA, 15 bp, Artificial Sequence
  dgRNA
  Ndnf
cacgctggcgcgcag

SEQ ID NO: 5743 - DNA, 15 bp, Artificial Sequence
  dgRNA
  Ndnf
acgctggcgcgcagc

SEQ ID NO: 5744 - DNA, 15 bp, Artificial Sequence
  dgRNA
  Ndnf
cgcgcagcgggagag

SEQ ID NO: 5745 - DNA, 15 bp, Artificial Sequence
  dgRNA
  Ndnf
gcgcagcgggagaga

SEQ ID NO: 5746 - DNA, 15 bp, Artificial Sequence
  dgRNA
  Tubb2b
cacgcccgcgctgat

SEQ ID NO: 5747 - DNA, 15 bp, Artificial Sequence
  dgRNA
  Tubb2b
ccccaagaccgtccc

SEQ ID NO: 5748 - DNA, 15 bp, Artificial Sequence
  dgRNA
  Tubb2b
cccaagaccgtccct

SEQ ID NO: 5749 - DNA, 15 bp, Artificial Sequence
  dgRNA
  Tubb2b
ccaagaccgtccctg

SEQ ID NO: 5750 - DNA, 15 bp, Artificial Sequence
  dgRNA
  Rab26
acacatcgtagtccc

SEQ ID NO: 5751 - DNA, 15 bp, Artificial Sequence
  dgRNA
  Rab26
ctagtctattgagct

SEQ ID NO: 5752 - DNA, 15 bp, Artificial Sequence
  dgRNA
  Rab26
gctaggttactgacc

SEQ ID NO: 5753 - DNA, 15 bp, Artificial Sequence
  dgRNA
  Rab26
atggcttgcatgaat

SEQ ID NO: 5754 - DNA, 15 bp, Artificial Sequence
  dgRNA
  Gpr143
cctcgtgagacctcg

SEQ ID NO: 5755 - DNA, 15 bp, Artificial Sequence
  dgRNA
  Gpr143
acctcgtggcctttg

SEQ ID NO: 5756 - DNA, 15 bp, Artificial Sequence
  dgRNA
  Gpr143
tcgtggcctttgagg

SEQ ID NO: 5757 - DNA, 15 bp, Artificial Sequence
  dgRNA
  Gpr143
ggcacaccgcccagc

SEQ ID NO: 5758 - DNA, 15 bp, Artificial Sequence
  dgRNA
  Daglb
atgaccacaccggaa

SEQ ID NO: 5759 - DNA, 15 bp, Artificial Sequence
  dgRNA
  Daglb
tcatacgccaccgac

SEQ ID NO: 5760 - DNA, 15 bp, Artificial Sequence
  dgRNA
  Daglb
gctgacttccgggtc

SEQ ID NO: 5761 - DNA, 15 bp, Artificial Sequence
  dgRNA
  Daglb
ctgacttccgggtca

SEQ ID NO: 5762 - DNA, 15 bp, Artificial Sequence
  dgRNA
  Rhbdl2
gacccaagtaggagg

SEQ ID NO: 5763 - DNA, 15 bp, Artificial Sequence
  dgRNA
  Rhbdl2
atccagggccaaccc

SEQ ID NO: 5764 - DNA, 15 bp, Artificial Sequence
  dgRNA
  Rhbdl2
ggcccggcttaggcc

SEQ ID NO: 5765 - DNA, 15 bp, Artificial Sequence
  dgRNA
  Rhbdl2
ggaggggatttcctc

SEQ ID NO: 5766 - DNA, 15 bp, Artificial Sequence
  dgRNA
  Rhobtb1
acctagcattagatc

SEQ ID NO: 5767 - DNA, 15 bp, Artificial Sequence
  dgRNA
  Rhobtb1
ggcatgccagaccaa

SEQ ID NO: 5768 - DNA, 15 bp, Artificial Sequence
  dgRNA
  Rhobtb1
gcatgccagaccaaa

SEQ ID NO: 5769 - DNA, 15 bp, Artificial Sequence
  dgRNA
  Rhobtb1
tgccagaccaaaggg

SEQ ID NO: 5770 - DNA, 15 bp, Artificial Sequence
  dgRNA
  Nkd1
tgtggtcccgcccat

SEQ ID NO: 5771 - DNA, 15 bp, Artificial Sequence
  dgRNA
  Nkd1
ccagcccctacccgc

SEQ ID NO: 5772 - DNA, 15 bp, Artificial Sequence
  dgRNA
  Nkd1
ccgcctcgcctttga

SEQ ID NO: 5773 - DNA, 15 bp, Artificial Sequence
  dgRNA
  Nkd1
cgcctcgcctttgat

SEQ ID NO: 5774 - DNA, 15 bp, Artificial Sequence
  dgRNA
  Olfr1238
tagtagcatctattc

SEQ ID NO: 5775 - DNA, 15 bp, Artificial Sequence
  dgRNA
  Olfr1238
tagtagcaaacatgt

SEQ ID NO: 5776 - DNA, 15 bp, Artificial Sequence
  dgRNA
  Olfr1238
ggattgtttctcact

SEQ ID NO: 5777 - DNA, 15 bp, Artificial Sequence
  dgRNA
  Plaa
actactacagatttt

SEQ ID NO: 5778 - DNA, 15 bp, Artificial Sequence
  dgRNA
  Plaa
ggaccgggttccgac

SEQ ID NO: 5779 - DNA, 15 bp, Artificial Sequence
  dgRNA
  Plaa
ccggacccagacctc

SEQ ID NO: 5780 - DNA, 15 bp, Artificial Sequence
  dgRNA
  Plaa
tcaccgtcccttctt

SEQ ID NO: 5781 - DNA, 15 bp, Artificial Sequence
  dgRNA
  Slc4a9
taggggccctctggc

SEQ ID NO: 5782 - DNA, 15 bp, Artificial Sequence
  dgRNA
  Slc4a9
atcctaggggccctc

SEQ ID NO: 5783 - DNA, 15 bp, Artificial Sequence
  dgRNA
  Prl3a1
atcgtcttgtctagc

SEQ ID NO: 5784 - DNA, 15 bp, Artificial Sequence
  dgRNA
  Hist1h4d
aggataaacgccaga

SEQ ID NO: 5785 - DNA, 15 bp, Artificial Sequence
  dgRNA
  Hist1h4d
ggataaacgccagaa

SEQ ID NO: 5786 - DNA, 15 bp, Artificial Sequence
  dgRNA
  Hist1h4d
taaacgccagaaggg

SEQ ID NO: 5787 - DNA, 15 bp, Artificial Sequence
  dgRNA
  Hist1h4d
aaacgccagaagggc

SEQ ID NO: 5788 - DNA, 15 bp, Artificial Sequence
  dgRNA
  Rnpep
ccacaccacctactt

SEQ ID NO: 5789 - DNA, 15 bp, Artificial Sequence
  dgRNA
  Rnpep
acctacttcggtctc

SEQ ID NO: 5790 - DNA, 15 bp, Artificial Sequence
  dgRNA
  Rnpep
cctacttcggtctca

SEQ ID NO: 5791 - DNA, 15 bp, Artificial Sequence
  dgRNA
  Rnpep
gccgcccgaattcct

SEQ ID NO: 5792 - DNA, 15 bp, Artificial Sequence
  dgRNA
  Cdhr1
gttgctagggcagac

SEQ ID NO: 5793 - DNA, 15 bp, Artificial Sequence
  dgRNA
  Cdhr1
ttgctagggcagact

SEQ ID NO: 5794 - DNA, 15 bp, Artificial Sequence
  dgRNA
  Cdhr1
cagactgggcgtggt

SEQ ID NO: 5795 - DNA, 15 bp, Artificial Sequence
  dgRNA
  Cdhr1
cccgccgctataagc

SEQ ID NO: 5796 - DNA, 15 bp, Artificial Sequence
  dgRNA
  Phf14
caatgactagttctt

SEQ ID NO: 5797 - DNA, 15 bp, Artificial Sequence
  dgRNA
  Phf14
tactgagttccggcg

SEQ ID NO: 5798 - DNA, 15 bp, Artificial Sequence
  dgRNA
  Phf14
actgagttccggcga

SEQ ID NO: 5799 - DNA, 15 bp, Artificial Sequence
  dgRNA
  Phf14
atgcgccctcagctt

SEQ ID NO: 5800 - DNA, 15 bp, Artificial Sequence
  dgRNA
  Samd7
gaaggattatgctaa

SEQ ID NO: 5801 - DNA, 15 bp, Artificial Sequence
  dgRNA
  Samd7
cttttagcctatctg

SEQ ID NO: 5802 - DNA, 15 bp, Artificial Sequence
  dgRNA
  Samd7
ttagcctatctgtgg

SEQ ID NO: 5803 - DNA, 15 bp, Artificial Sequence
  dgRNA
  Samd7
tgtggaggatgtccg

SEQ ID NO: 5804 - DNA, 15 bp, Artificial Sequence
  dgRNA
  Cuta
gccagcaaccggttg

SEQ ID NO: 5805 - DNA, 15 bp, Artificial Sequence
  dgRNA
  Cuta
ccggttgaggattca

SEQ ID NO: 5806 - DNA, 15 bp, Artificial Sequence
  dgRNA
  Cuta
gaggattcacggaaa

SEQ ID NO: 5807 - DNA, 15 bp, Artificial Sequence
  dgRNA
  Cuta
aggattcacggaaat

SEQ ID NO: 5808 - DNA, 15 bp, Artificial Sequence
  dgRNA
  Serinc1
ccacgcccttcctct

SEQ ID NO: 5809 - DNA, 15 bp, Artificial Sequence
  dgRNA
  Serinc1
cgcattgcgcacgcc

SEQ ID NO: 5810 - DNA, 15 bp, Artificial Sequence
  dgRNA
  Serinc1
cccggcagcagtcac

SEQ ID NO: 5811 - DNA, 15 bp, Artificial Sequence
  dgRNA
  Serinc1
ccggcagcagtcacc

SEQ ID NO: 5812 - DNA, 15 bp, Artificial Sequence
  dgRNA
  Dusp10
ctagcgggtccgagc

SEQ ID NO: 5813 - DNA, 15 bp, Artificial Sequence
  dgRNA
  Dusp10
ctccctcccaaggcg

SEQ ID NO: 5814 - DNA, 15 bp, Artificial Sequence
  dgRNA
  Dusp10
accactgtgatgtag

SEQ ID NO: 5815 - DNA, 15 bp, Artificial Sequence
  dgRNA
  Dusp10
ctgtgatgtagcggg

SEQ ID NO: 5816 - DNA, 15 bp, Artificial Sequence
  dgRNA
  Rnf13
ggatgatgtatcacg

SEQ ID NO: 5817 - DNA, 15 bp, Artificial Sequence
  dgRNA
  Rnf13
acgacactcaaaaac

SEQ ID NO: 5818 - DNA, 15 bp, Artificial Sequence
  dgRNA
  Rnf13
cgacactcaaaaact

SEQ ID NO: 5819 - DNA, 15 bp, Artificial Sequence
  dgRNA
  Rnf13
gcgcgactccgcgag

SEQ ID NO: 5820 - DNA, 15 bp, Artificial Sequence
  dgRNA
  Mrps10
ggagcaccgtctcta

SEQ ID NO: 5821 - DNA, 15 bp, Artificial Sequence
  dgRNA
  Mrps10
ccttttcgaactcta

SEQ ID NO: 5822 - DNA, 15 bp, Artificial Sequence
  dgRNA
  Mrps10
ctgtgaccccggaag

SEQ ID NO: 5823 - DNA, 15 bp, Artificial Sequence
  dgRNA
  Mrps10
gtcgcttccgccgtc

SEQ ID NO: 5824 - DNA, 15 bp, Artificial Sequence
  dgRNA
  Ing3
agaggcaccgcattt

SEQ ID NO: 5825 - DNA, 15 bp, Artificial Sequence
  dgRNA
  Ing3
ccgcatttcggattc

SEQ ID NO: 5826 - DNA, 15 bp, Artificial Sequence
  dgRNA
  Ing3
gtgcccgtttcgcgc

SEQ ID NO: 5827 - DNA, 15 bp, Artificial Sequence
  dgRNA
  Ing3
tttcgcgcaggcgtg

SEQ ID NO: 5828 - DNA, 15 bp, Artificial Sequence
  dgRNA
  Ap3d1
gctgctaggcgtcaa

SEQ ID NO: 5829 - DNA, 15 bp, Artificial Sequence
  dgRNA
  Ap3d1
ctaggcgtcaaaggg

SEQ ID NO: 5830 - DNA, 15 bp, Artificial Sequence
  dgRNA
  Ap3d1
ctattgggtggcgtg

SEQ ID NO: 5831 - DNA, 15 bp, Artificial Sequence
  dgRNA
  Ap3d1
ggcgtgtggttgtca

SEQ ID NO: 5832 - DNA, 15 bp, Artificial Sequence
  dgRNA
  Pcdh10
gacgtaactacttga

SEQ ID NO: 5833 - DNA, 15 bp, Artificial Sequence
  dgRNA
  Pcdh10
caacgaacagtcgct

SEQ ID NO: 5834 - DNA, 15 bp, Artificial Sequence
  dgRNA
  Pcdh10
cgaacagtcgctcgg

SEQ ID NO: 5835 - DNA, 15 bp, Artificial Sequence
  dgRNA
  Pcdh10
gaacagtcgctcggt

SEQ ID NO: 5836 - DNA, 15 bp, Artificial Sequence
  dgRNA
  Klra10
ccatgtcagggtatt

SEQ ID NO: 5837 - DNA, 15 bp, Artificial Sequence
  dgRNA
  Klra10
ccaaataccctgaca

SEQ ID NO: 5838 - DNA, 15 bp, Artificial Sequence
  dgRNA
  Mtus1
ccaggataagtgtga

SEQ ID NO: 5839 - DNA, 15 bp, Artificial Sequence
  dgRNA
  Mtus1
attgttcgggccatg

SEQ ID NO: 5840 - DNA, 15 bp, Artificial Sequence
  dgRNA
  Mtus1
ggccatgcggacaat

SEQ ID NO: 5841 - DNA, 15 bp, Artificial Sequence
  dgRNA
  Mtus1
ggttcacccgtgcgc

SEQ ID NO: 5842 - DNA, 15 bp, Artificial Sequence
  dgRNA
  Cd52
tgacaactcatctac

SEQ ID NO: 5843 - DNA, 15 bp, Artificial Sequence
  dgRNA
  Cd52
tctacaggaacctca

SEQ ID NO: 5844 - DNA, 15 bp, Artificial Sequence
  dgRNA
  Cd52
gtttcatccaccccc

SEQ ID NO: 5845 - DNA, 15 bp, Artificial Sequence
  dgRNA
  Atp6v1b2
gtcaattttgccctc

SEQ ID NO: 5846 - DNA, 15 bp, Artificial Sequence
  dgRNA
  Atp6v1b2
attcattggaatgta

SEQ ID NO: 5847 - DNA, 15 bp, Artificial Sequence
  dgRNA
  Atp6v1b2
gattcattggaatgt

SEQ ID NO: 5848 - DNA, 15 bp, Artificial Sequence
  dgRNA
  Atp6v1b2
gcgaaaggggccaga

SEQ ID NO: 5849 - DNA, 15 bp, Artificial Sequence
  dgRNA
  Tdrd6
aaccctgtcccgcac

SEQ ID NO: 5850 - DNA, 15 bp, Artificial Sequence
  dgRNA
  Tdrd6
cccgcacaggcttgc

SEQ ID NO: 5851 - DNA, 15 bp, Artificial Sequence
  dgRNA
  Tdrd6
ttgctggtagtcccc

SEQ ID NO: 5852 - DNA, 15 bp, Artificial Sequence
  dgRNA
  Tdrd6
ggcgtcccctgcgcc

SEQ ID NO: 5853 - DNA, 15 bp, Artificial Sequence
  dgRNA
  Mdga2
caccagtgcctaccc

SEQ ID NO: 5854 - DNA, 15 bp, Artificial Sequence
  dgRNA
  Mdga2
cggttttgacgtcgc

SEQ ID NO: 5855 - DNA, 15 bp, Artificial Sequence
  dgRNA
  Mdga2
ggttttgacgtcgcc

SEQ ID NO: 5856 - DNA, 15 bp, Artificial Sequence
  dgRNA
  Mdga2
gacgtcgccgggctg

SEQ ID NO: 5857 - DNA, 15 bp, Artificial Sequence
  dgRNA
  Rfc1
gggaacccggcttag

SEQ ID NO: 5858 - DNA, 15 bp, Artificial Sequence
  dgRNA
  Rfc1
ctcagatcccaaatt

SEQ ID NO: 5859 - DNA, 15 bp, Artificial Sequence
  dgRNA
  Rfc1
aaattgggcgtctcc

SEQ ID NO: 5860 - DNA, 15 bp, Artificial Sequence
  dgRNA
  Rfc1
actcgccgtcctaca

SEQ ID NO: 5861 - DNA, 15 bp, Artificial Sequence
  dgRNA
  Pik3r1
tatgcgtgatatcta

SEQ ID NO: 5862 - DNA, 15 bp, Artificial Sequence
  dgRNA
  Pik3r1
atgcgtgatatctaa

SEQ ID NO: 5863 - DNA, 15 bp, Artificial Sequence
  dgRNA
  Pik3r1
tgtaatagagacctt

SEQ ID NO: 5864 - DNA, 15 bp, Artificial Sequence
  dgRNA
  Pik3r1
gtaatagagacctta

SEQ ID NO: 5865 - DNA, 15 bp, Artificial Sequence
  dgRNA
  Usp2
ccaccggctccaaac

SEQ ID NO: 5866 - DNA, 15 bp, Artificial Sequence
  dgRNA
  Usp2
atatacccggttacc

SEQ ID NO: 5867 - DNA, 15 bp, Artificial Sequence
  dgRNA
  Usp2
tatacccggttacct

SEQ ID NO: 5868 - DNA, 15 bp, Artificial Sequence
  dgRNA
  Usp2
ctgggagatgcgcgc

SEQ ID NO: 5869 - DNA, 15 bp, Artificial Sequence
  dgRNA
  Ago4
gcctgacgcgtcctc

SEQ ID NO: 5870 - DNA, 15 bp, Artificial Sequence
  dgRNA
  Ago4
cctgacgcgtcctct

SEQ ID NO: 5871 - DNA, 15 bp, Artificial Sequence
  dgRNA
  Ago4
cgcgtcctctgggct

SEQ ID NO: 5872 - DNA, 15 bp, Artificial Sequence
  dgRNA
  Ago4
tgggctcggcccccc

SEQ ID NO: 5873 - DNA, 15 bp, Artificial Sequence
  dgRNA
  Erv3
tgctcaagataacca

SEQ ID NO: 5874 - DNA, 15 bp, Artificial Sequence
  dgRNA
  Erv3
ccacattgtaacctg

SEQ ID NO: 5875 - DNA, 15 bp, Artificial Sequence
  dgRNA
  Erv3
cagactaacagtagc

SEQ ID NO: 5876 - DNA, 15 bp, Artificial Sequence
  dgRNA
  Erv3
gagcaatcaagcgtt

SEQ ID NO: 5877 - DNA, 15 bp, Artificial Sequence
  dgRNA
  P2ry14
catcctcctgccggc

SEQ ID NO: 5878 - DNA, 15 bp, Artificial Sequence
  dgRNA
  P2ry14
atcctcctgccggct

SEQ ID NO: 5879 - DNA, 15 bp, Artificial Sequence
  dgRNA
  P2ry14
ggttttaactagcta

SEQ ID NO: 5880 - DNA, 15 bp, Artificial Sequence
  dgRNA
  Spata1
cggcaggtcgcggga

SEQ ID NO: 5881 - DNA, 15 bp, Artificial Sequence
  dgRNA
  Spata1
caggtcgcgggacgg

SEQ ID NO: 5882 - DNA, 15 bp, Artificial Sequence
  dgRNA
  Spata1
aggtcgcgggacggc

SEQ ID NO: 5883 - DNA, 15 bp, Artificial Sequence
  dgRNA
  Spata1
ggtcgcgggacggcg

SEQ ID NO: 5884 - DNA, 15 bp, Artificial Sequence
  dgRNA
  Zfp949
gctctgacatttggc

SEQ ID NO: 5885 - DNA, 15 bp, Artificial Sequence
  dgRNA
  Zfp949
tagaaagtcgcatcc

SEQ ID NO: 5886 - DNA, 15 bp, Artificial Sequence
  dgRNA
  Zfp949
ggacatttttccacc

SEQ ID NO: 5887 - DNA, 15 bp, Artificial Sequence
  dgRNA
  Zfp949
aggacatttttccac

SEQ ID NO: 5888 - DNA, 15 bp, Artificial Sequence
  dgRNA
  Lbhd1
aatccatcgtcaccc

SEQ ID NO: 5889 - DNA, 15 bp, Artificial Sequence
  dgRNA
  Lbhd1
cggctctttatttat

SEQ ID NO: 5890 - DNA, 15 bp, Artificial Sequence
  dgRNA
  Lbhd1
ggctctttatttata

SEQ ID NO: 5891 - DNA, 15 bp, Artificial Sequence
  dgRNA
  Lbhd1
gagccggggtgacga

SEQ ID NO: 5892 - DNA, 15 bp, Artificial Sequence
  dgRNA
  Sox1
cagcgggcacagagt

SEQ ID NO: 5893 - DNA, 15 bp, Artificial Sequence
  dgRNA
  Sox1
atttaaacacgaccc

SEQ ID NO: 5894 - DNA, 15 bp, Artificial Sequence
  dgRNA
  Sox1
tttaaacacgaccca

SEQ ID NO: 5895 - DNA, 15 bp, Artificial Sequence
  dgRNA
  Sox1
tgtgcccgctgggaa

SEQ ID NO: 5896 - DNA, 15 bp, Artificial Sequence
  dgRNA
  Tmem204
catcctgttagtgtc

SEQ ID NO: 5897 - DNA, 15 bp, Artificial Sequence
  dgRNA
  Tmem204
gctatttgttgcagt

SEQ ID NO: 5898 - DNA, 15 bp, Artificial Sequence
  dgRNA
  Tmem204
ccataggaatagtca

SEQ ID NO: 5899 - DNA, 15 bp, Artificial Sequence
  dgRNA
  Tmem204
cccataggaatagtc

SEQ ID NO: 5900 - DNA, 15 bp, Artificial Sequence
  dgRNA
  Mef2d
gcgcggtgcctacgt

SEQ ID NO: 5901 - DNA, 15 bp, Artificial Sequence
  dgRNA
  Mef2d
cgtcggcctcgagtc

SEQ ID NO: 5902 - DNA, 15 bp, Artificial Sequence
  dgRNA
  Mef2d
gtcggcctcgagtct

SEQ ID NO: 5903 - DNA, 15 bp, Artificial Sequence
  dgRNA
  Mef2d
tcggcctcgagtctg

SEQ ID NO: 5904 - DNA, 15 bp, Artificial Sequence
  dgRNA
  Fam175b
acaggccggtgtctg

SEQ ID NO: 5905 - DNA, 15 bp, Artificial Sequence
  dgRNA
  Fam175b
tggttctctttgatc

SEQ ID NO: 5906 - DNA, 15 bp, Artificial Sequence
  dgRNA
  Fam175b
tagcttcgagtagct

SEQ ID NO: 5907 - DNA, 15 bp, Artificial Sequence
  dgRNA
  Fam175b
cttcgagtagcttgg

SEQ ID NO: 5908 - DNA, 15 bp, Artificial Sequence
  dgRNA
  Mroh9
tttcctttcagtcgt

SEQ ID NO: 5909 - DNA, 15 bp, Artificial Sequence
  dgRNA
  Mroh9
tgcagttgccatgac

SEQ ID NO: 5910 - DNA, 15 bp, Artificial Sequence
  dgRNA
  Mroh9
cagttcaatacaagt

SEQ ID NO: 5911 - DNA, 15 bp, Artificial Sequence
  dgRNA
  Mroh9
ttccctacgactgaa

SEQ ID NO: 5912 - DNA, 15 bp, Artificial Sequence
  dgRNA
  Tmem132d
ttcgagcacatagag

SEQ ID NO: 5913 - DNA, 15 bp, Artificial Sequence
  dgRNA
  Tmem132d
tcgagcacatagaga

SEQ ID NO: 5914 - DNA, 15 bp, Artificial Sequence
  dgRNA
  Tmem132d
gagagggcgactgcg

SEQ ID NO: 5915 - DNA, 15 bp, Artificial Sequence
  dgRNA
  Tmem132d
gggcgactgcgaggc

SEQ ID NO: 5916 - DNA, 15 bp, Artificial Sequence
  dgRNA
  Ptov1
cctgtttgtcagcgc

SEQ ID NO: 5917 - DNA, 15 bp, Artificial Sequence
  dgRNA
  Ptov1
agctccatagtctgt

SEQ ID NO: 5918 - DNA, 15 bp, Artificial Sequence
  dgRNA
  Ptov1
cggtagacaggataa

SEQ ID NO: 5919 - DNA, 15 bp, Artificial Sequence
  dgRNA
  Ptov1
cagaaggcggtagac

SEQ ID NO: 5920 - DNA, 15 bp, Artificial Sequence
  dgRNA
  Renbp
ttgactgctcagtcc

SEQ ID NO: 5921 - DNA, 15 bp, Artificial Sequence
  dgRNA
  Renbp
cccgcccccaactcg

SEQ ID NO: 5922 - DNA, 15 bp, Artificial Sequence
  dgRNA
  Renbp
ttcggaactctgaag

SEQ ID NO: 5923 - DNA, 15 bp, Artificial Sequence
  dgRNA
  Renbp
cccctggtgggaact

SEQ ID NO: 5924 - DNA, 15 bp, Artificial Sequence
  dgRNA
  Pag1
cccaaccccgcccgt

SEQ ID NO: 5925 - DNA, 15 bp, Artificial Sequence
  dgRNA
  Pag1
tcgcaaaatcagggc

SEQ ID NO: 5926 - DNA, 15 bp, Artificial Sequence
  dgRNA
  Pag1
agcttcgcaaaatca

SEQ ID NO: 5927 - DNA, 15 bp, Artificial Sequence
  dgRNA
  Pag1
gagcttcgcaaaatc

SEQ ID NO: 5928 - DNA, 15 bp, Artificial Sequence
  dgRNA
  Creb3l1
cacacgtctctttaa

SEQ ID NO: 5929 - DNA, 15 bp, Artificial Sequence
  dgRNA
  Creb3l1
tcgtgaatattgatg

SEQ ID NO: 5930 - DNA, 15 bp, Artificial Sequence
  dgRNA
  Creb3l1
cgtgaatattgatgt

SEQ ID NO: 5931 - DNA, 15 bp, Artificial Sequence
  dgRNA
  Creb3l1
tgggggcgtggcgcc

SEQ ID NO: 5932 - DNA, 15 bp, Artificial Sequence
  dgRNA
  Sh2d5
gtctggacagcttcg

SEQ ID NO: 5933 - DNA, 15 bp, Artificial Sequence
  dgRNA
  Sh2d5
tggacagcttcgtgg

SEQ ID NO: 5934 - DNA, 15 bp, Artificial Sequence
  dgRNA
  Sh2d5
acccaggtcgcagcg

SEQ ID NO: 5935 - DNA, 15 bp, Artificial Sequence
  dgRNA
  Sh2d5
cccaggtcgcagcgt

SEQ ID NO: 5936 - DNA, 15 bp, Artificial Sequence
  dgRNA
  Abcg1
caggcccaggcggtt

SEQ ID NO: 5937 - DNA, 15 bp, Artificial Sequence
  dgRNA
  Abcg1
ccaggcggttgggag

SEQ ID NO: 5938 - DNA, 15 bp, Artificial Sequence
  dgRNA
  Abcg1
cagccgctccgcaac

SEQ ID NO: 5939 - DNA, 15 bp, Artificial Sequence
  dgRNA
  Abcg1
agcacgcgcacctgt

SEQ ID NO: 5940 - DNA, 15 bp, Artificial Sequence
  dgRNA
  Nup153
agaggctcccacgac

SEQ ID NO: 5941 - DNA, 15 bp, Artificial Sequence
  dgRNA
  Nup153
gaggctcccacgaca

SEQ ID NO: 5942 - DNA, 15 bp, Artificial Sequence
  dgRNA
  Nup153
ccacgacagggagcg

SEQ ID NO: 5943 - DNA, 15 bp, Artificial Sequence
  dgRNA
  Nup153
cacgacagggagcgc

SEQ ID NO: 5944 - DNA, 15 bp, Artificial Sequence
  dgRNA
  Rfpl4
cgtctttaactaaaa

SEQ ID NO: 5945 - DNA, 15 bp, Artificial Sequence
  dgRNA
  Rfpl4
atacctcatggaggt

SEQ ID NO: 5946 - DNA, 15 bp, Artificial Sequence
  dgRNA
  Rfpl4
tacaaaaccggggga

SEQ ID NO: 5947 - DNA, 15 bp, Artificial Sequence
  dgRNA
  Rfpl4
aaaatacaaaaccgg

SEQ ID NO: 5948 - DNA, 15 bp, Artificial Sequence
  dgRNA
  Farp2
gccctgttgcacccg

SEQ ID NO: 5949 - DNA, 15 bp, Artificial Sequence
  dgRNA
  Farp2
aggtgctgcgctcgc

SEQ ID NO: 5950 - DNA, 15 bp, Artificial Sequence
  dgRNA
  Farp2
tgcgctcgcaggcgc

SEQ ID NO: 5951 - DNA, 15 bp, Artificial Sequence
  dgRNA
  Farp2
ctcgcaggcgccggt

SEQ ID NO: 5952 - DNA, 15 bp, Artificial Sequence
  dgRNA
  Olfr885
atgtggtcagttgat

SEQ ID NO: 5953 - DNA, 15 bp, Artificial Sequence
  dgRNA
  Olfr885
tacagatctgatcta

SEQ ID NO: 5954 - DNA, 15 bp, Artificial Sequence
  dgRNA
  Dhx57
ccacattcaaatttc

SEQ ID NO: 5955 - DNA, 15 bp, Artificial Sequence
  dgRNA
  Dhx57
attatgtgagttagc

SEQ ID NO: 5956 - DNA, 15 bp, Artificial Sequence
  dgRNA
  Dhx57
gatctggcaccgtaa

SEQ ID NO: 5957 - DNA, 15 bp, Artificial Sequence
  dgRNA
  Dhx57
gtaagcctgtacaaa

SEQ ID NO: 5958 - DNA, 15 bp, Artificial Sequence
  dgRNA
  Colq
ttaatgggacatggc

SEQ ID NO: 5959 - DNA, 15 bp, Artificial Sequence
  dgRNA
  Colq
gcaaggaggaagtcg

SEQ ID NO: 5960 - DNA, 15 bp, Artificial Sequence
  dgRNA
  Pycr1
aatgaagtgagggcg

SEQ ID NO: 5961 - DNA, 15 bp, Artificial Sequence
  dgRNA
  Pycr1
ggggccggtgggcgc

SEQ ID NO: 5962 - DNA, 15 bp, Artificial Sequence
  dgRNA
  Pycr1
ggcgcgggtgccgcg

SEQ ID NO: 5963 - DNA, 15 bp, Artificial Sequence
  dgRNA
  Pycr1
gtggcgaatgcaaga

SEQ ID NO: 5964 - DNA, 15 bp, Artificial Sequence
  dgRNA
  Vmn1r188
aaagtctttacgtct

SEQ ID NO: 5965 - DNA, 15 bp, Artificial Sequence
  dgRNA
  Vmn1r188
gctccaacagtgagt

SEQ ID NO: 5966 - DNA, 15 bp, Artificial Sequence
  dgRNA
  Vmn1r188
gactttttcaagaac

SEQ ID NO: 5967 - DNA, 15 bp, Artificial Sequence
  dgRNA
  Hsd3b1
ctaagtctttactaa

SEQ ID NO: 5968 - DNA, 15 bp, Artificial Sequence
  dgRNA
  Hsd3b1
tctagcgtaaatgtg

SEQ ID NO: 5969 - DNA, 15 bp, Artificial Sequence
  dgRNA
  Hsd3b1
atctagcgtaaatgt

SEQ ID NO: 5970 - DNA, 15 bp, Artificial Sequence
  dgRNA
  Hsd3b1
gatctagcgtaaatg

SEQ ID NO: 5971 - DNA, 15 bp, Artificial Sequence
  dgRNA
  Bscl2
gttgtggttgaggcc

SEQ ID NO: 5972 - DNA, 15 bp, Artificial Sequence
  dgRNA
  Bscl2
agtcccagactgcgt

SEQ ID NO: 5973 - DNA, 15 bp, Artificial Sequence
  dgRNA
  Bscl2
cgttggagattataa

SEQ ID NO: 5974 - DNA, 15 bp, Artificial Sequence
  dgRNA
  Bscl2
taggcgattgacagt

SEQ ID NO: 5975 - DNA, 15 bp, Artificial Sequence
  dgRNA
  Lrrc69
ctagcttcatcataa

SEQ ID NO: 5976 - DNA, 15 bp, Artificial Sequence
  dgRNA
  Lrrc69
tagcttcatcataat

SEQ ID NO: 5977 - DNA, 15 bp, Artificial Sequence
  dgRNA
  Lrrc69
atagtcactgcaggt

SEQ ID NO: 5978 - DNA, 15 bp, Artificial Sequence
  dgRNA
  Lrrc69
ttcctaagtagaggg

SEQ ID NO: 5979 - DNA, 15 bp, Artificial Sequence
  dgRNA
  N4bp1
ggcccttatcaaata

SEQ ID NO: 5980 - DNA, 15 bp, Artificial Sequence
  dgRNA
  N4bp1
caaatatggccgccc

SEQ ID NO: 5981 - DNA, 15 bp, Artificial Sequence
  dgRNA
  N4bp1
gccgacgcttgccca

SEQ ID NO: 5982 - DNA, 15 bp, Artificial Sequence
  dgRNA
  N4bp1
tgcccacggtcaaca

SEQ ID NO: 5983 - DNA, 15 bp, Artificial Sequence
  dgRNA
  Olfr90
ggactctatctgacc

SEQ ID NO: 5984 - DNA, 15 bp, Artificial Sequence
  dgRNA
  Olfr90
ctctatctgaccagg

SEQ ID NO: 5985 - DNA, 15 bp, Artificial Sequence
  dgRNA
  Olfr90
cttaggtgacgggcc

SEQ ID NO: 5986 - DNA, 15 bp, Artificial Sequence
  dgRNA
  Olfr90
tgacgggcctggaga

SEQ ID NO: 5987 - DNA, 15 bp, Artificial Sequence
  dgRNA
  Nudt7
tcaacactttaaatc

SEQ ID NO: 5988 - DNA, 15 bp, Artificial Sequence
  dgRNA
  Nudt7
acacgccctacctat

SEQ ID NO: 5989 - DNA, 15 bp, Artificial Sequence
  dgRNA
  Nudt7
ccgcccctagcactt

SEQ ID NO: 5990 - DNA, 15 bp, Artificial Sequence
  dgRNA
  Nudt7
cgcccctagcacttc

SEQ ID NO: 5991 - DNA, 15 bp, Artificial Sequence
  dgRNA
  BC021785
agcatccggtcttcc

SEQ ID NO: 5992 - DNA, 15 bp, Artificial Sequence
  dgRNA
  BC021785
cctatttctgccaaa

SEQ ID NO: 5993 - DNA, 15 bp, Artificial Sequence
  dgRNA
  BC021785
ccaaacggtcttctt

SEQ ID NO: 5994 - DNA, 15 bp, Artificial Sequence
  dgRNA
  BC021785
caaacggtcttctta

SEQ ID NO: 5995 - DNA, 15 bp, Artificial Sequence
  dgRNA
  Slc16a13
gacctgcatcctaat

SEQ ID NO: 5996 - DNA, 15 bp, Artificial Sequence
  dgRNA
  Slc16a13
gatgttggcccactt

SEQ ID NO: 5997 - DNA, 15 bp, Artificial Sequence
  dgRNA
  Slc16a13
ttggcccacttaggc

SEQ ID NO: 5998 - DNA, 15 bp, Artificial Sequence
  dgRNA
  Slc16a13
ggtcccacgtgacaa

SEQ ID NO: 5999 - DNA, 15 bp, Artificial Sequence
  dgRNA
  Hemgn
cttggtgtcctaaaa

SEQ ID NO: 6000 - DNA, 15 bp, Artificial Sequence
  dgRNA
  Hemgn
tacatggctgccgag

SEQ ID NO: 6001 - DNA, 15 bp, Artificial Sequence
  dgRNA
  Hemgn
cgctagactgtgtca

SEQ ID NO: 6002 - DNA, 15 bp, Artificial Sequence
  dgRNA
  Hemgn
gctagactgtgtcat

SEQ ID NO: 6003 - DNA, 15 bp, Artificial Sequence
  dgRNA
  Fnbp1
gggcaactgcgccaa

SEQ ID NO: 6004 - DNA, 15 bp, Artificial Sequence
  dgRNA
  Fnbp1
ggcaactgcgccaaa

SEQ ID NO: 6005 - DNA, 15 bp, Artificial Sequence
  dgRNA
  Fnbp1
cacgagctgtcagtc

SEQ ID NO: 6006 - DNA, 15 bp, Artificial Sequence
  dgRNA
  Fnbp1
ctcagctccggtgcg

SEQ ID NO: 6007 - DNA, 15 bp, Artificial Sequence
  dgRNA
  Layn
agcggccccttccgt

SEQ ID NO: 6008 - DNA, 15 bp, Artificial Sequence
  dgRNA
  Layn
cagagcactagacgt

SEQ ID NO: 6009 - DNA, 15 bp, Artificial Sequence
  dgRNA
  Layn
gagcactagacgttg

SEQ ID NO: 6010 - DNA, 15 bp, Artificial Sequence
  dgRNA
  Layn
agcactagacgttgg

SEQ ID NO: 6011 - DNA, 15 bp, Artificial Sequence
  dgRNA
  Dbil5
gcccaggaggtgctt

SEQ ID NO: 6012 - DNA, 15 bp, Artificial Sequence
  dgRNA
  Dbil5
cccaggaggtgcttt

SEQ ID NO: 6013 - DNA, 15 bp, Artificial Sequence
  dgRNA
  Dbil5
ggggggtgcggccca

SEQ ID NO: 6014 - DNA, 15 bp, Artificial Sequence
  dgRNA
  Dbil5
gtgcggcccaggggc

SEQ ID NO: 6015 - DNA, 15 bp, Artificial Sequence
  dgRNA
  Tmem161a
cccttgccgtgtgtg

SEQ ID NO: 6016 - DNA, 15 bp, Artificial Sequence
  dgRNA
  Tmem161a
ggtcgtttcgtctgc

SEQ ID NO: 6017 - DNA, 15 bp, Artificial Sequence
  dgRNA
  Tmem161a
tgcgcaatgcatgct

SEQ ID NO: 6018 - DNA, 15 bp, Artificial Sequence
  dgRNA
  Tmem161a
catcgggctaagaat

SEQ ID NO: 6019 - DNA, 15 bp, Artificial Sequence
  dgRNA
  Zfp335
cctctaaaccatccc

SEQ ID NO: 6020 - DNA, 15 bp, Artificial Sequence
  dgRNA
  Zfp335
catcccaggtcgcga

SEQ ID NO: 6021 - DNA, 15 bp, Artificial Sequence
  dgRNA
  Zfp335
tctctaagcgacccc

SEQ ID NO: 6022 - DNA, 15 bp, Artificial Sequence
  dgRNA
  Zfp335
cgacccctggaggtg

SEQ ID NO: 6023 - DNA, 15 bp, Artificial Sequence
  dgRNA
  Xpr1
ccccctccgtcggag

SEQ ID NO: 6024 - DNA, 15 bp, Artificial Sequence
  dgRNA
  Xpr1
ccgtcggagcggcgt

SEQ ID NO: 6025 - DNA, 15 bp, Artificial Sequence
  dgRNA
  Xpr1
tcggagcggcgtagg

SEQ ID NO: 6026 - DNA, 15 bp, Artificial Sequence
  dgRNA
  Xpr1
cgtaggcggttacca

SEQ ID NO: 6027 - DNA, 15 bp, Artificial Sequence
  dgRNA
  Usp39
gccgtgaagagatgt

SEQ ID NO: 6028 - DNA, 15 bp, Artificial Sequence
  dgRNA
  Usp39
tgttcgaaactatct

SEQ ID NO: 6029 - DNA, 15 bp, Artificial Sequence
  dgRNA
  Usp39
cgaaactatctcggt

SEQ ID NO: 6030 - DNA, 15 bp, Artificial Sequence
  dgRNA
  Usp39
gaaactatctcggtt

SEQ ID NO: 6031 - DNA, 15 bp, Artificial Sequence
  dgRNA
  Dcaf8
cgcacgcgcccctcg

SEQ ID NO: 6032 - DNA, 15 bp, Artificial Sequence
  dgRNA
  Dcaf8
cgcccctcgcggctt

SEQ ID NO: 6033 - DNA, 15 bp, Artificial Sequence
  dgRNA
  Dcaf8
cctcgcggcttcggt

SEQ ID NO: 6034 - DNA, 15 bp, Artificial Sequence
  dgRNA
  Dcaf8
gcttcggttggcccg

SEQ ID NO: 6035 - DNA, 15 bp, Artificial Sequence
  dgRNA
  Cd180
atccgtgtgtttgac

SEQ ID NO: 6036 - DNA, 15 bp, Artificial Sequence
  dgRNA
  Cd180
tgcagtaggccatca

SEQ ID NO: 6037 - DNA, 15 bp, Artificial Sequence
  dgRNA
  Cd180
ggccatcatggggta

SEQ ID NO: 6038 - DNA, 15 bp, Artificial Sequence
  dgRNA
  Cd180
tttggccaagatggt

SEQ ID NO: 6039 - DNA, 15 bp, Artificial Sequence
  dgRNA
  Slc4a3
agggcaatggctttc

SEQ ID NO: 6040 - DNA, 15 bp, Artificial Sequence
  dgRNA
  Slc4a3
atctcgtgtccaagc

SEQ ID NO: 6041 - DNA, 15 bp, Artificial Sequence
  dgRNA
  Slc4a3
cttgtatgtgcgaag

SEQ ID NO: 6042 - DNA, 15 bp, Artificial Sequence
  dgRNA
  Slc4a3
ttgtatgtgcgaaga

SEQ ID NO: 6043 - DNA, 15 bp, Artificial Sequence
  dgRNA
  Hamp
gcgccactattttct

SEQ ID NO: 6044 - DNA, 15 bp, Artificial Sequence
  dgRNA
  Hamp
gcgggaacagtgaca

SEQ ID NO: 6045 - DNA, 15 bp, Artificial Sequence
  dgRNA
  Hamp
agcgggaacagtgac

SEQ ID NO: 6046 - DNA, 15 bp, Artificial Sequence
  dgRNA
  Hamp
gcgggagagataagc

SEQ ID NO: 6047 - DNA, 15 bp, Artificial Sequence
  dgRNA
  Srm
aaccctcccgccgcc

SEQ ID NO: 6048 - DNA, 15 bp, Artificial Sequence
  dgRNA
  Srm
accctcccgccgcca

SEQ ID NO: 6049 - DNA, 15 bp, Artificial Sequence
  dgRNA
  Srm
gggcctctccccacg

SEQ ID NO: 6050 - DNA, 15 bp, Artificial Sequence
  dgRNA
  Srm
acgtggcccggcagc

SEQ ID NO: 6051 - DNA, 15 bp, Artificial Sequence
  dgRNA
  Prkab1
gctcgcgcctcccgc

SEQ ID NO: 6052 - DNA, 15 bp, Artificial Sequence
  dgRNA
  Prkab1
ctacgaagctcgatc

SEQ ID NO: 6053 - DNA, 15 bp, Artificial Sequence
  dgRNA
  Prkab1
cgaagctcgatctgg

SEQ ID NO: 6054 - DNA, 15 bp, Artificial Sequence
  dgRNA
  Prkab1
ttcgcgctgagcagc

SEQ ID NO: 6055 - DNA, 15 bp, Artificial Sequence
  dgRNA
  Sclt1
ctcgctgcgccactg

SEQ ID NO: 6056 - DNA, 15 bp, Artificial Sequence
  dgRNA
  Sclt1
ctgcgccactgcgga

SEQ ID NO: 6057 - DNA, 15 bp, Artificial Sequence
  dgRNA
  Sclt1
actcagcccccaacg

SEQ ID NO: 6058 - DNA, 15 bp, Artificial Sequence
  dgRNA
  Sclt1
ccccaacgcggcctc

SEQ ID NO: 6059 - DNA, 15 bp, Artificial Sequence
  dgRNA
  Inca1
gagttgcggacacta

SEQ ID NO: 6060 - DNA, 15 bp, Artificial Sequence
  dgRNA
  Inca1
agttgcggacactaa

SEQ ID NO: 6061 - DNA, 15 bp, Artificial Sequence
  dgRNA
  Inca1
caaatcaccagaacg

SEQ ID NO: 6062 - DNA, 15 bp, Artificial Sequence
  dgRNA
  Inca1
aaatcaccagaacgt

SEQ ID NO: 6063 - DNA, 15 bp, Artificial Sequence
  dgRNA
  Il5ra
gactcactgtagggt

SEQ ID NO: 6064 - DNA, 15 bp, Artificial Sequence
  dgRNA
  Il5ra
actgtagggttggta

SEQ ID NO: 6065 - DNA, 15 bp, Artificial Sequence
  dgRNA
  Il5ra
tttctatgactaggc

SEQ ID NO: 6066 - DNA, 15 bp, Artificial Sequence
  dgRNA
  Il5ra
gctggagacacgccc

SEQ ID NO: 6067 - DNA, 15 bp, Artificial Sequence
  dgRNA
  Dhrs3
ctgcaatcactcccc

SEQ ID NO: 6068 - DNA, 15 bp, Artificial Sequence
  dgRNA
  Dhrs3
ggggggcgctacaat

SEQ ID NO: 6069 - DNA, 15 bp, Artificial Sequence
  dgRNA
  Dhrs3
gggggcgctacaatt

SEQ ID NO: 6070 - DNA, 15 bp, Artificial Sequence
  dgRNA
  Dhrs3
gctgtgtgcgcgctg

SEQ ID NO: 6071 - DNA, 15 bp, Artificial Sequence
  dgRNA
  Fbxo2
ccggaagccgcacct

SEQ ID NO: 6072 - DNA, 15 bp, Artificial Sequence
  dgRNA
  Fbxo2
cggaagccgcacctt

SEQ ID NO: 6073 - DNA, 15 bp, Artificial Sequence
  dgRNA
  Fbxo2
ccgcaccttgggtta

SEQ ID NO: 6074 - DNA, 15 bp, Artificial Sequence
  dgRNA
  Fbxo2
gcaccttgggttacg

SEQ ID NO: 6075 - DNA, 15 bp, Artificial Sequence
  dgRNA
  Oog4
ctgaaaatgagcgag

SEQ ID NO: 6076 - DNA, 15 bp, Artificial Sequence
  dgRNA
  Oog4
tggtgtcaataatat

SEQ ID NO: 6077 - DNA, 15 bp, Artificial Sequence
  dgRNA
  Oog4
atggtgtcaataata

SEQ ID NO: 6078 - DNA, 15 bp, Artificial Sequence
  dgRNA
  Oog4
attttcagatttcga

SEQ ID NO: 6079 - DNA, 15 bp, Artificial Sequence
  dgRNA
  Gpbar1
acttccctatgcagt

SEQ ID NO: 6080 - DNA, 15 bp, Artificial Sequence
  dgRNA
  Gpbar1
ggaccaacctaactc

SEQ ID NO: 6081 - DNA, 15 bp, Artificial Sequence
  dgRNA
  Gpbar1
tggccagagttaggt

SEQ ID NO: 6082 - DNA, 15 bp, Artificial Sequence
  dgRNA
  Rnmt
tccgtgcccgctcgc

SEQ ID NO: 6083 - DNA, 15 bp, Artificial Sequence
  dgRNA
  Rnmt
ccgtgcccgctcgca

SEQ ID NO: 6084 - DNA, 15 bp, Artificial Sequence
  dgRNA
  Rnmt
cgctcgcagggctag

SEQ ID NO: 6085 - DNA, 15 bp, Artificial Sequence
  dgRNA
  Rnmt
aggcacgccgccgcg

SEQ ID NO: 6086 - DNA, 15 bp, Artificial Sequence
  dgRNA
  St6galnac1
gaccagataaaagcg

SEQ ID NO: 6087 - DNA, 15 bp, Artificial Sequence
  dgRNA
  St6galnac1
gtctcatatagcttc

SEQ ID NO: 6088 - DNA, 15 bp, Artificial Sequence
  dgRNA
  St6galnac1
atagcttccggaatt

SEQ ID NO: 6089 - DNA, 15 bp, Artificial Sequence
  dgRNA
  St6galnac1
agcctcgcttttatc

SEQ ID NO: 6090 - DNA, 15 bp, Artificial Sequence
  dgRNA
  Ints5
tgcctacgaagcccc

SEQ ID NO: 6091 - DNA, 15 bp, Artificial Sequence
  dgRNA
  Ints5
gcctacgaagcccct

SEQ ID NO: 6092 - DNA, 15 bp, Artificial Sequence
  dgRNA
  Ints5
cctacgaagcccctg

SEQ ID NO: 6093 - DNA, 15 bp, Artificial Sequence
  dgRNA
  Ints5
ctacgaagcccctgg

SEQ ID NO: 6094 - DNA, 15 bp, Artificial Sequence
  dgRNA
  Slco1c1
aagctttatcacgtg

SEQ ID NO: 6095 - DNA, 15 bp, Artificial Sequence
  dgRNA
  Slco1c1
attccacagggggtt

SEQ ID NO: 6096 - DNA, 15 bp, Artificial Sequence
  dgRNA
  Slco1c1
cattccacagggggt

SEQ ID NO: 6097 - DNA, 15 bp, Artificial Sequence
  dgRNA
  Pik3cd
actgtggcgatgctc

SEQ ID NO: 6098 - DNA, 15 bp, Artificial Sequence
  dgRNA
  Pik3cd
ctgtggcgatgctca

SEQ ID NO: 6099 - DNA, 15 bp, Artificial Sequence
  dgRNA
  Pik3cd
ctccagacctttatt

SEQ ID NO: 6100 - DNA, 15 bp, Artificial Sequence
  dgRNA
  Pik3cd
gtttttgaacagagc

SEQ ID NO: 6101 - DNA, 15 bp, Artificial Sequence
  dgRNA
  Olfr308
aagttaaccatttat

SEQ ID NO: 6102 - DNA, 15 bp, Artificial Sequence
  dgRNA
  Olfr308
aaccatttataggct

SEQ ID NO: 6103 - DNA, 15 bp, Artificial Sequence
  dgRNA
  Olfr308
gcttgggatggtatc

SEQ ID NO: 6104 - DNA, 15 bp, Artificial Sequence
  dgRNA
  Olfr308
atgatgtagttatta

SEQ ID NO: 6105 - DNA, 15 bp, Artificial Sequence
  dgRNA
  Gm28045
gcatttaagccagtc

SEQ ID NO: 6106 - DNA, 15 bp, Artificial Sequence
  dgRNA
  Gm28045
taagccagtccggag

SEQ ID NO: 6107 - DNA, 15 bp, Artificial Sequence
  dgRNA
  Gm28045
cccccgcgagagacg

SEQ ID NO: 6108 - DNA, 15 bp, Artificial Sequence
  dgRNA
  Gm28045
gcgagagacgcggcg

SEQ ID NO: 6109 - DNA, 15 bp, Artificial Sequence
  dgRNA
  Capg
gagacaactagtcag

SEQ ID NO: 6110 - DNA, 15 bp, Artificial Sequence
  dgRNA
  Capg
agacaactagtcagg

SEQ ID NO: 6111 - DNA, 15 bp, Artificial Sequence
  dgRNA
  Capg
caactagtcaggggg

SEQ ID NO: 6112 - DNA, 15 bp, Artificial Sequence
  dgRNA
  Capg
ggaaaaagtagtgta

SEQ ID NO: 6113 - DNA, 15 bp, Artificial Sequence
  dgRNA
  Utp14b
cgagggtcggggaaa

SEQ ID NO: 6114 - DNA, 15 bp, Artificial Sequence
  dgRNA
  Utp14b
agggtcggggaaacg

SEQ ID NO: 6115 - DNA, 15 bp, Artificial Sequence
  dgRNA
  Utp14b
gggtcggggaaacgg

SEQ ID NO: 6116 - DNA, 15 bp, Artificial Sequence
  dgRNA
  Utp14b
ggtgagtggcgagta

SEQ ID NO: 6117 - DNA, 15 bp, Artificial Sequence
  dgRNA
  Gpaa1
cgagaacctttaggc

SEQ ID NO: 6118 - DNA, 15 bp, Artificial Sequence
  dgRNA
  Gpaa1
tccagttccgcccac

SEQ ID NO: 6119 - DNA, 15 bp, Artificial Sequence
  dgRNA
  Gpaa1
gagcacgcgcagagc

SEQ ID NO: 6120 - DNA, 15 bp, Artificial Sequence
  dgRNA
  Gpaa1
ggagtgtaacgcagg

SEQ ID NO: 6121 - DNA, 15 bp, Artificial Sequence
  dgRNA
  Mlxipl
tcacaccacgctcac

SEQ ID NO: 6122 - DNA, 15 bp, Artificial Sequence
  dgRNA
  Mlxipl
atcacctgccaacta

SEQ ID NO: 6123 - DNA, 15 bp, Artificial Sequence
  dgRNA
  Mlxipl
tcacctgccaactaa

SEQ ID NO: 6124 - DNA, 15 bp, Artificial Sequence
  dgRNA
  Mlxipl
ccacaaggacctatc

SEQ ID NO: 6125 - DNA, 15 bp, Artificial Sequence
  dgRNA
  Ccdc85a
gaatgtcgctcattt

SEQ ID NO: 6126 - DNA, 15 bp, Artificial Sequence
  dgRNA
  Ccdc85a
ctcattttggtcagc

SEQ ID NO: 6127 - DNA, 15 bp, Artificial Sequence
  dgRNA
  Ccdc85a
cctatagtcacttgg

SEQ ID NO: 6128 - DNA, 15 bp, Artificial Sequence
  dgRNA
  Ccdc85a
agcctctcaacgccc

SEQ ID NO: 6129 - DNA, 15 bp, Artificial Sequence
  dgRNA
  Bicd2
cagtgagcgtaaaat

SEQ ID NO: 6130 - DNA, 15 bp, Artificial Sequence
  dgRNA
  Bicd2
gctttgcgtcacgtt

SEQ ID NO: 6131 - DNA, 15 bp, Artificial Sequence
  dgRNA
  Bicd2
gaccaatcacaagcg

SEQ ID NO: 6132 - DNA, 15 bp, Artificial Sequence
  dgRNA
  Bicd2
tcacaagcgcggacc

SEQ ID NO: 6133 - DNA, 15 bp, Artificial Sequence
  dgRNA
  Hspa1l
ctccccgccaagttt

SEQ ID NO: 6134 - DNA, 15 bp, Artificial Sequence
  dgRNA
  Hspa1l
aagtttaggagaccc

SEQ ID NO: 6135 - DNA, 15 bp, Artificial Sequence
  dgRNA
  Hspa1l
ccaatcgcgttacaa

SEQ ID NO: 6136 - DNA, 15 bp, Artificial Sequence
  dgRNA
  Hspa1l
ctcatggactaattt

SEQ ID NO: 6137 - DNA, 15 bp, Artificial Sequence
  dgRNA
  Naa30
cggtgacacggccgg

SEQ ID NO: 6138 - DNA, 15 bp, Artificial Sequence
  dgRNA
  Naa30
tgacacggccggcgg

SEQ ID NO: 6139 - DNA, 15 bp, Artificial Sequence
  dgRNA
  Naa30
gacacggccggcggc

SEQ ID NO: 6140 - DNA, 15 bp, Artificial Sequence
  dgRNA
  Naa30
acacggccggcggcg

SEQ ID NO: 6141 - DNA, 15 bp, Artificial Sequence
  dgRNA
  Olfr589
caagatttttccttg

SEQ ID NO: 6142 - DNA, 15 bp, Artificial Sequence
  dgRNA
  Olfr589
gcactgcataccaca

SEQ ID NO: 6143 - DNA, 15 bp, Artificial Sequence
  dgRNA
  Olfr589
taactggtagctctc

SEQ ID NO: 6144 - DNA, 15 bp, Artificial Sequence
  dgRNA
  Olfr589
gcatgctcatttaac

SEQ ID NO: 6145 - DNA, 15 bp, Artificial Sequence
  dgRNA
  Cabp4
tttcctagacccatc

SEQ ID NO: 6146 - DNA, 15 bp, Artificial Sequence
  dgRNA
  Cabp4
taatccgcctcactg

SEQ ID NO: 6147 - DNA, 15 bp, Artificial Sequence
  dgRNA
  Cabp4
atgaactcaagccta

SEQ ID NO: 6148 - DNA, 15 bp, Artificial Sequence
  dgRNA
  Cabp4
tgaactcaagcctag

SEQ ID NO: 6149 - DNA, 15 bp, Artificial Sequence
  dgRNA
  Setd1b
aaaaggccttccccc

SEQ ID NO: 6150 - DNA, 15 bp, Artificial Sequence
  dgRNA
  Setd1b
aaaggccttcccccc

SEQ ID NO: 6151 - DNA, 15 bp, Artificial Sequence
  dgRNA
  Setd1b
aaggccttccccccg

SEQ ID NO: 6152 - DNA, 15 bp, Artificial Sequence
  dgRNA
  Setd1b
ccttccccccgggga

SEQ ID NO: 6153 - DNA, 15 bp, Artificial Sequence
  dgRNA
  Espn
gggtcctgagtctta

SEQ ID NO: 6154 - DNA, 15 bp, Artificial Sequence
  dgRNA
  Espn
gtcttatggccttgg

SEQ ID NO: 6155 - DNA, 15 bp, Artificial Sequence
  dgRNA
  Espn
cagtccaagggtcac

SEQ ID NO: 6156 - DNA, 15 bp, Artificial Sequence
  dgRNA
  Espn
gagactccgcccttg

SEQ ID NO: 6157 - DNA, 15 bp, Artificial Sequence
  dgRNA
  Rab40c
gcgggccagtagcag

SEQ ID NO: 6158 - DNA, 15 bp, Artificial Sequence
  dgRNA
  Rab40c
agtagcagtggcgag

SEQ ID NO: 6159 - DNA, 15 bp, Artificial Sequence
  dgRNA
  Rab40c
gtagcagtggcgagt

SEQ ID NO: 6160 - DNA, 15 bp, Artificial Sequence
  dgRNA
  Rab40c
cagtggcgagtgggc

SEQ ID NO: 6161 - DNA, 15 bp, Artificial Sequence
  dgRNA
  Olfr577
aggcttaggattatt

SEQ ID NO: 6162 - DNA, 15 bp, Artificial Sequence
  dgRNA
  Olfr577
gtaaatggagtgaat

SEQ ID NO: 6163 - DNA, 15 bp, Artificial Sequence
  dgRNA
  Gm12169
gccgatgctatctag

SEQ ID NO: 6164 - DNA, 15 bp, Artificial Sequence
  dgRNA
  Gm12169
ccgatgctatctagt

SEQ ID NO: 6165 - DNA, 15 bp, Artificial Sequence
  dgRNA
  Gm12169
aagggttttgacacc

SEQ ID NO: 6166 - DNA, 15 bp, Artificial Sequence
  dgRNA
  Gm12169
cccactagatagcat

SEQ ID NO: 6167 - DNA, 15 bp, Artificial Sequence
  dgRNA
  Ccnl2
gcaggagttccggtt

SEQ ID NO: 6168 - DNA, 15 bp, Artificial Sequence
  dgRNA
  Ccnl2
caggagttccggttc

SEQ ID NO: 6169 - DNA, 15 bp, Artificial Sequence
  dgRNA
  Ccnl2
gttccggttcgggcc

SEQ ID NO: 6170 - DNA, 15 bp, Artificial Sequence
  dgRNA
  Ccnl2
gttcgggccaggccg

SEQ ID NO: 6171 - DNA, 15 bp, Artificial Sequence
  dgRNA
  Epb41l3
aggactgctcaacct

SEQ ID NO: 6172 - DNA, 15 bp, Artificial Sequence
  dgRNA
  Epb41l3
ctcccccgcgcggga

SEQ ID NO: 6173 - DNA, 15 bp, Artificial Sequence
  dgRNA
  Epb41l3
cgcgggagggaagcc

SEQ ID NO: 6174 - DNA, 15 bp, Artificial Sequence
  dgRNA
  Epb41l3
aagccaggacgaggt

SEQ ID NO: 6175 - DNA, 15 bp, Artificial Sequence
  dgRNA
  Rpl32
gaacactagtccact

SEQ ID NO: 6176 - DNA, 15 bp, Artificial Sequence
  dgRNA
  Rpl32
aacactagtccacta

SEQ ID NO: 6177 - DNA, 15 bp, Artificial Sequence
  dgRNA
  Rpl32
actacttaagaaatt

SEQ ID NO: 6178 - DNA, 15 bp, Artificial Sequence
  dgRNA
  Rpl32
aagcacttccggctc

SEQ ID NO: 6179 - DNA, 15 bp, Artificial Sequence
  dgRNA
  Il34
cccatattcaccctc

SEQ ID NO: 6180 - DNA, 15 bp, Artificial Sequence
  dgRNA
  Il34
ccatattcaccctca

SEQ ID NO: 6181 - DNA, 15 bp, Artificial Sequence
  dgRNA
  Il34
tgcccttgttagctc

SEQ ID NO: 6182 - DNA, 15 bp, Artificial Sequence
  dgRNA
  Il34
tgaactggtttttag

SEQ ID NO: 6183 - DNA, 15 bp, Artificial Sequence
  dgRNA
  Olfr1386
gggattgaaaaaacg

SEQ ID NO: 6184 - DNA, 15 bp, Artificial Sequence
  dgRNA
  Olfr1386
gacaagtggattagt

SEQ ID NO: 6185 - DNA, 15 bp, Artificial Sequence
  dgRNA
  Abi2
ctcccgcgcgcatcc

SEQ ID NO: 6186 - DNA, 15 bp, Artificial Sequence
  dgRNA
  Abi2
cgccctcccgtcgct

SEQ ID NO: 6187 - DNA, 15 bp, Artificial Sequence
  dgRNA
  Abi2
gtcgctaggagacgc

SEQ ID NO: 6188 - DNA, 15 bp, Artificial Sequence
  dgRNA
  Abi2
aggagacgccggaag

SEQ ID NO: 6189 - DNA, 15 bp, Artificial Sequence
  dgRNA
  Hdac7
ccaaccgctctgatt

SEQ ID NO: 6190 - DNA, 15 bp, Artificial Sequence
  dgRNA
  Hdac7
caaccgctctgattc

SEQ ID NO: 6191 - DNA, 15 bp, Artificial Sequence
  dgRNA
  Hdac7
ctctgattcgggata

SEQ ID NO: 6192 - DNA, 15 bp, Artificial Sequence
  dgRNA
  Hdac7
acaccccccgtatct

SEQ ID NO: 6193 - DNA, 15 bp, Artificial Sequence
  dgRNA
  Trim37
gcggtaaaatctgcg

SEQ ID NO: 6194 - DNA, 15 bp, Artificial Sequence
  dgRNA
  Trim37
aaatctgcgaggcga

SEQ ID NO: 6195 - DNA, 15 bp, Artificial Sequence
  dgRNA
  Trim37
aatctgcgaggcgaa

SEQ ID NO: 6196 - DNA, 15 bp, Artificial Sequence
  dgRNA
  Trim37
cgacacgcctccccg

SEQ ID NO: 6197 - DNA, 15 bp, Artificial Sequence
  dgRNA
  Itk
gtacccttagctata

SEQ ID NO: 6198 - DNA, 15 bp, Artificial Sequence
  dgRNA
  Itk
attcaccaagctggg

SEQ ID NO: 6199 - DNA, 15 bp, Artificial Sequence
  dgRNA
  Itk
tagagagtcgttcaa

SEQ ID NO: 6200 - DNA, 15 bp, Artificial Sequence
  dgRNA
  Wdr26
gccggcctcccacca

SEQ ID NO: 6201 - DNA, 15 bp, Artificial Sequence
  dgRNA
  Wdr26
cggcctctctcggcg

SEQ ID NO: 6202 - DNA, 15 bp, Artificial Sequence
  dgRNA
  Wdr26
tcggcgaggaaactc

SEQ ID NO: 6203 - DNA, 15 bp, Artificial Sequence
  dgRNA
  Wdr26
ctccgactcggacgc

SEQ ID NO: 6204 - DNA, 15 bp, Artificial Sequence
  dgRNA
  Psap
gcgttagataccgtt

SEQ ID NO: 6205 - DNA, 15 bp, Artificial Sequence
  dgRNA
  Psap
tacctttgcaatgtg

SEQ ID NO: 6206 - DNA, 15 bp, Artificial Sequence
  dgRNA
  Psap
aggtcaggcgccgaa

SEQ ID NO: 6207 - DNA, 15 bp, Artificial Sequence
  dgRNA
  Psap
gtggcgggaaggcgc

SEQ ID NO: 6208 - DNA, 15 bp, Artificial Sequence
  dgRNA
  Mmp2
tggtagcccccagtt

SEQ ID NO: 6209 - DNA, 15 bp, Artificial Sequence
  dgRNA
  Mmp2
ggtagcccccagtta

SEQ ID NO: 6210 - DNA, 15 bp, Artificial Sequence
  dgRNA
  Mmp2
cagcaccgggtggag

SEQ ID NO: 6211 - DNA, 15 bp, Artificial Sequence
  dgRNA
  Qrich2
gattaaagagcccaa

SEQ ID NO: 6212 - DNA, 15 bp, Artificial Sequence
  dgRNA
  Qrich2
cctactccctgatgc

SEQ ID NO: 6213 - DNA, 15 bp, Artificial Sequence
  dgRNA
  Qrich2
aaaagaccatacccc

SEQ ID NO: 6214 - DNA, 15 bp, Artificial Sequence
  dgRNA
  Qrich2
taaagacgttgaaca

SEQ ID NO: 6215 - DNA, 15 bp, Artificial Sequence
  dgRNA
  Il1rap
cgcggctcctcctcg

SEQ ID NO: 6216 - DNA, 15 bp, Artificial Sequence
  dgRNA
  Il1rap
ggctcctcctcgcgg

SEQ ID NO: 6217 - DNA, 15 bp, Artificial Sequence
  dgRNA
  Il1rap
gctcctcctcgcggc

SEQ ID NO: 6218 - DNA, 15 bp, Artificial Sequence
  dgRNA
  Il1rap
cctcctcgcggcggg

SEQ ID NO: 6219 - DNA, 15 bp, Artificial Sequence
  dgRNA
  Pla2g15
agctgggatgataag

SEQ ID NO: 6220 - DNA, 15 bp, Artificial Sequence
  dgRNA
  Pla2g15
ataagcggctcccat

SEQ ID NO: 6221 - DNA, 15 bp, Artificial Sequence
  dgRNA
  Pla2g15
gcggctcccatcggt

SEQ ID NO: 6222 - DNA, 15 bp, Artificial Sequence
  dgRNA
  Pla2g15
gtcgatcgatgcgtt

SEQ ID NO: 6223 - DNA, 15 bp, Artificial Sequence
  dgRNA
  Sos1
gcttcgcctgctcgc

SEQ ID NO: 6224 - DNA, 15 bp, Artificial Sequence
  dgRNA
  Sos1
caggttctcgggtcg

SEQ ID NO: 6225 - DNA, 15 bp, Artificial Sequence
  dgRNA
  Sos1
aggttctcgggtcgc

SEQ ID NO: 6226 - DNA, 15 bp, Artificial Sequence
  dgRNA
  Sos1
cgcgggttcgccttc

SEQ ID NO: 6227 - DNA, 15 bp, Artificial Sequence
  dgRNA
  Pgr15l
ctagacagcatctcg

SEQ ID NO: 6228 - DNA, 15 bp, Artificial Sequence
  dgRNA
  Pgr15l
agcatctcgtggtac

SEQ ID NO: 6229 - DNA, 15 bp, Artificial Sequence
  dgRNA
  Pgr15l
ctctgccagtcctcg

SEQ ID NO: 6230 - DNA, 15 bp, Artificial Sequence
  dgRNA
  Pgr15l
tctgccagtcctcgc

SEQ ID NO: 6231 - DNA, 15 bp, Artificial Sequence
  dgRNA
  Eif3j2
acctatgacacatgt

SEQ ID NO: 6232 - DNA, 15 bp, Artificial Sequence
  dgRNA
  Eif3j2
gtgtcataggttgaa

SEQ ID NO: 6233 - DNA, 15 bp, Artificial Sequence
  dgRNA
  Rprd1a
gctcccgcctccagg

SEQ ID NO: 6234 - DNA, 15 bp, Artificial Sequence
  dgRNA
  Rprd1a
cccgcctccaggcgg

SEQ ID NO: 6235 - DNA, 15 bp, Artificial Sequence
  dgRNA
  Rprd1a
ggcggctcctttccc

SEQ ID NO: 6236 - DNA, 15 bp, Artificial Sequence
  dgRNA
  Rprd1a
agggagagcagcgcg

SEQ ID NO: 6237 - DNA, 15 bp, Artificial Sequence
  dgRNA
  Olfr1299
aaataattacctacg

SEQ ID NO: 6238 - DNA, 15 bp, Artificial Sequence
  dgRNA
  Olfr1299
ttggacatctcttag

SEQ ID NO: 6239 - DNA, 15 bp, Artificial Sequence
  dgRNA
  Olfr1299
cgtaggtaattattt

SEQ ID NO: 6240 - DNA, 15 bp, Artificial Sequence
  dgRNA
  Olfr1299
aaaagagaaccccgt

SEQ ID NO: 6241 - DNA, 15 bp, Artificial Sequence
  dgRNA
  Pdp2
gccacgggtaacccc

SEQ ID NO: 6242 - DNA, 15 bp, Artificial Sequence
  dgRNA
  Pdp2
ccacgggtaacccca

SEQ ID NO: 6243 - DNA, 15 bp, Artificial Sequence
  dgRNA
  Pdp2
cacgggtaaccccag

SEQ ID NO: 6244 - DNA, 15 bp, Artificial Sequence
  dgRNA
  Pdp2
acgggtaaccccagg

SEQ ID NO: 6245 - DNA, 15 bp, Artificial Sequence
  dgRNA
  Ppil1
ggcatcacccaagtc

SEQ ID NO: 6246 - DNA, 15 bp, Artificial Sequence
  dgRNA
  Ppil1
gcatcacccaagtct

SEQ ID NO: 6247 - DNA, 15 bp, Artificial Sequence
  dgRNA
  Ppil1
gaccaatcactgttc

SEQ ID NO: 6248 - DNA, 15 bp, Artificial Sequence
  dgRNA
  Ppil1
cactgttccggagcg

SEQ ID NO: 6249 - DNA, 15 bp, Artificial Sequence
  dgRNA
  Apol7a
gtttcggtgctatga

SEQ ID NO: 6250 - DNA, 15 bp, Artificial Sequence
  dgRNA
  Apol7a
gctatgatggctgtt

SEQ ID NO: 6251 - DNA, 15 bp, Artificial Sequence
  dgRNA
  Apol7a
tgctgcgccacctag

SEQ ID NO: 6252 - DNA, 15 bp, Artificial Sequence
  dgRNA
  Ccpg1os
cgcaggcgtccgcag

SEQ ID NO: 6253 - DNA, 15 bp, Artificial Sequence
  dgRNA
  Ccpg1os
gcaggcgtccgcagc

SEQ ID NO: 6254 - DNA, 15 bp, Artificial Sequence
  dgRNA
  Ccpg1os
caggcgtccgcagcg

SEQ ID NO: 6255 - DNA, 15 bp, Artificial Sequence
  dgRNA
  Ccpg1os
tccgcagcggggaag

SEQ ID NO: 6256 - DNA, 15 bp, Artificial Sequence
  dgRNA
  Kdm5c
aaccacctccaaata

SEQ ID NO: 6257 - DNA, 15 bp, Artificial Sequence
  dgRNA
  Kdm5c
caacccgatttcttt

SEQ ID NO: 6258 - DNA, 15 bp, Artificial Sequence
  dgRNA
  Kdm5c
gtcatcacatgatga

SEQ ID NO: 6259 - DNA, 15 bp, Artificial Sequence
  dgRNA
  Kdm5c
aaagtaaacggaact

SEQ ID NO: 6260 - DNA, 15 bp, Artificial Sequence
  dgRNA
  Klhdc1
tgtcttcgcagcgcc

SEQ ID NO: 6261 - DNA, 15 bp, Artificial Sequence
  dgRNA
  Klhdc1
agcgcccggtgctcc

SEQ ID NO: 6262 - DNA, 15 bp, Artificial Sequence
  dgRNA
  Klhdc1
gcgcccggtgctccc

SEQ ID NO: 6263 - DNA, 15 bp, Artificial Sequence
  dgRNA
  Klhdc1
cggtgctcccgggag

SEQ ID NO: 6264 - DNA, 15 bp, Artificial Sequence
  dgRNA
  Erp44
agccccgcgcacaga

SEQ ID NO: 6265 - DNA, 15 bp, Artificial Sequence
  dgRNA
  Erp44
cgcgcacagatggct

SEQ ID NO: 6266 - DNA, 15 bp, Artificial Sequence
  dgRNA
  Erp44
atggcttggccgtcg

SEQ ID NO: 6267 - DNA, 15 bp, Artificial Sequence
  dgRNA
  Erp44
tggcttggccgtcgt

SEQ ID NO: 6268 - DNA, 15 bp, Artificial Sequence
  dgRNA
  Tmc8
ccacgccttctattc

SEQ ID NO: 6269 - DNA, 15 bp, Artificial Sequence
  dgRNA
  Tmc8
cacgccttctattct

SEQ ID NO: 6270 - DNA, 15 bp, Artificial Sequence
  dgRNA
  Tmc8
cccaaaccatccgga

SEQ ID NO: 6271 - DNA, 15 bp, Artificial Sequence
  dgRNA
  Tmc8
ccagaatagaaggcg

SEQ ID NO: 6272 - DNA, 15 bp, Artificial Sequence
  dgRNA
  Brsk2
cgcgctcttagagac

SEQ ID NO: 6273 - DNA, 15 bp, Artificial Sequence
  dgRNA
  Brsk2
tcttagagactggcg

SEQ ID NO: 6274 - DNA, 15 bp, Artificial Sequence
  dgRNA
  Brsk2
ctggcggggcggtcc

SEQ ID NO: 6275 - DNA, 15 bp, Artificial Sequence
  dgRNA
  Brsk2
gcggaagacgctgat

SEQ ID NO: 6276 - DNA, 15 bp, Artificial Sequence
  dgRNA
  Tenm3
ctgtgcacatcggtc

SEQ ID NO: 6277 - DNA, 15 bp, Artificial Sequence
  dgRNA
  Gpr161
atgtagccttgatta

SEQ ID NO: 6278 - DNA, 15 bp, Artificial Sequence
  dgRNA
  Casc4
cgagacaagaccgca

SEQ ID NO: 6279 - DNA, 15 bp, Artificial Sequence
  dgRNA
  Casc4
gagacaagaccgcaa

SEQ ID NO: 6280 - DNA, 15 bp, Artificial Sequence
  dgRNA
  Casc4
agacaagaccgcaag

SEQ ID NO: 6281 - DNA, 15 bp, Artificial Sequence
  dgRNA
  Casc4
ctatctcgcgagaag

SEQ ID NO: 6282 - DNA, 15 bp, Artificial Sequence
  dgRNA
  Tardbp
tacgcgttcagtcgc

SEQ ID NO: 6283 - DNA, 15 bp, Artificial Sequence
  dgRNA
  Tardbp
agtctcgcgcattct

SEQ ID NO: 6284 - DNA, 15 bp, Artificial Sequence
  dgRNA
  Tardbp
gcgagctcctcgact

SEQ ID NO: 6285 - DNA, 15 bp, Artificial Sequence
  dgRNA
  Tardbp
cgagctcctcgacta

SEQ ID NO: 6286 - DNA, 15 bp, Artificial Sequence
  dgRNA
  2310002L09Rik
attgttcatcagagg

SEQ ID NO: 6287 - DNA, 15 bp, Artificial Sequence
  dgRNA
  2310002L09Rik
attgggcaacgagga

SEQ ID NO: 6288 - DNA, 15 bp, Artificial Sequence
  dgRNA
  2310002L09Rik
cattgggcaacgagg

SEQ ID NO: 6289 - DNA, 15 bp, Artificial Sequence
  dgRNA
  2310002L09Rik
agacattgggcaacg

SEQ ID NO: 6290 - DNA, 15 bp, Artificial Sequence
  dgRNA
  Vps51
aggacaagcgcaaga

SEQ ID NO: 6291 - DNA, 15 bp, Artificial Sequence
  dgRNA
  Vps51
gaacgtttcacctga

SEQ ID NO: 6292 - DNA, 15 bp, Artificial Sequence
  dgRNA
  Vps51
acctgaaggaccgcc

SEQ ID NO: 6293 - DNA, 15 bp, Artificial Sequence
  dgRNA
  Vps51
gttgtagcaagtttc

SEQ ID NO: 6294 - DNA, 15 bp, Artificial Sequence
  dgRNA
  Clec11a
gtgtgggtagaccca

SEQ ID NO: 6295 - DNA, 15 bp, Artificial Sequence
  dgRNA
  Clec11a
tgggtagacccaagg

SEQ ID NO: 6296 - DNA, 15 bp, Artificial Sequence
  dgRNA
  Clec11a
gggtagacccaaggc

SEQ ID NO: 6297 - DNA, 15 bp, Artificial Sequence
  dgRNA
  Clec11a
acccaaggcgggatc

SEQ ID NO: 6298 - DNA, 15 bp, Artificial Sequence
  dgRNA
  Kcnma1
cgaggcgagttagcc

SEQ ID NO: 6299 - DNA, 15 bp, Artificial Sequence
  dgRNA
  Kcnma1
gggcgcgcgccgaag

SEQ ID NO: 6300 - DNA, 15 bp, Artificial Sequence
  dgRNA
  Kcnma1
cgcgccgaagaggct

SEQ ID NO: 6301 - DNA, 15 bp, Artificial Sequence
  dgRNA
  Kcnma1
gcgccgaagaggctc

SEQ ID NO: 6302 - DNA, 15 bp, Artificial Sequence
  dgRNA
  Ptpru
gggatgggcacgcca

SEQ ID NO: 6303 - DNA, 15 bp, Artificial Sequence
  dgRNA
  Ptpru
tgggcacgccaaggc

SEQ ID NO: 6304 - DNA, 15 bp, Artificial Sequence
  dgRNA
  Ptpru
gcacgccaaggccgg

SEQ ID NO: 6305 - DNA, 15 bp, Artificial Sequence
  dgRNA
  Ptpru
cacgccaaggccggc

SEQ ID NO: 6306 - DNA, 15 bp, Artificial Sequence
  dgRNA
  Hist2h2aa2
aaaagggtgaggcgt

SEQ ID NO: 6307 - DNA, 15 bp, Artificial Sequence
  dgRNA
  Sema6d
ctccagcggtgcccg

SEQ ID NO: 6308 - DNA, 15 bp, Artificial Sequence
  dgRNA
  Sema6d
ggtgcccgaggcgcc

SEQ ID NO: 6309 - DNA, 15 bp, Artificial Sequence
  dgRNA
  Sema6d
gtgcccgaggcgcca

SEQ ID NO: 6310 - DNA, 15 bp, Artificial Sequence
  dgRNA
  Sema6d
tgcccgaggcgccag

SEQ ID NO: 6311 - DNA, 15 bp, Artificial Sequence
  dgRNA
  Lypd6
acttggcctcaggtc

SEQ ID NO: 6312 - DNA, 15 bp, Artificial Sequence
  dgRNA
  Lypd6
gagagttgggcggcg

SEQ ID NO: 6313 - DNA, 15 bp, Artificial Sequence
  dgRNA
  Lypd6
agagttgggcggcgc

SEQ ID NO: 6314 - DNA, 15 bp, Artificial Sequence
  dgRNA
  Lypd6
gaacgcatcccgcag

SEQ ID NO: 6315 - DNA, 15 bp, Artificial Sequence
  dgRNA
  Dzip1
accacagctaggact

SEQ ID NO: 6316 - DNA, 15 bp, Artificial Sequence
  dgRNA
  Dzip1
ccccacgcatgtttt

SEQ ID NO: 6317 - DNA, 15 bp, Artificial Sequence
  dgRNA
  Dzip1
cccacgcatgtttta

SEQ ID NO: 6318 - DNA, 15 bp, Artificial Sequence
  dgRNA
  Dzip1
gttttagggactcag

SEQ ID NO: 6319 - DNA, 15 bp, Artificial Sequence
  dgRNA
  Serinc4
aattctgtccaatca

SEQ ID NO: 6320 - DNA, 15 bp, Artificial Sequence
  dgRNA
  Serinc4
tctgtccaatcaagg

SEQ ID NO: 6321 - DNA, 15 bp, Artificial Sequence
  dgRNA
  Serinc4
atccctagacctgat

SEQ ID NO: 6322 - DNA, 15 bp, Artificial Sequence
  dgRNA
  Serinc4
tgaacagatagtcga

SEQ ID NO: 6323 - DNA, 15 bp, Artificial Sequence
  dgRNA
  Gucy2c
cgggtgtatttttat

SEQ ID NO: 6324 - DNA, 15 bp, Artificial Sequence
  dgRNA
  Gucy2c
tattggatgaggccc

SEQ ID NO: 6325 - DNA, 15 bp, Artificial Sequence
  dgRNA
  Gucy2c
gtgcctgctaattac

SEQ ID NO: 6326 - DNA, 15 bp, Artificial Sequence
  dgRNA
  Gucy2c
acgacaggattacca

SEQ ID NO: 6327 - DNA, 15 bp, Artificial Sequence
  dgRNA
  Pgf
tagctccgaggggcc

SEQ ID NO: 6328 - DNA, 15 bp, Artificial Sequence
  dgRNA
  Pgf
ccaggagatctgcgc

SEQ ID NO: 6329 - DNA, 15 bp, Artificial Sequence
  dgRNA
  Pgf
cttcagcgccctgcg

SEQ ID NO: 6330 - DNA, 15 bp, Artificial Sequence
  dgRNA
  Pgf
gggtcacgcgcactc

SEQ ID NO: 6331 - DNA, 15 bp, Artificial Sequence
  dgRNA
  Gosr1
aacgaattgtccacc

SEQ ID NO: 6332 - DNA, 15 bp, Artificial Sequence
  dgRNA
  Gosr1
gaattgtccaccagg

SEQ ID NO: 6333 - DNA, 15 bp, Artificial Sequence
  dgRNA
  Gosr1
atcagcctcggcgct

SEQ ID NO: 6334 - DNA, 15 bp, Artificial Sequence
  dgRNA
  Gosr1
tcagcctcggcgctc

SEQ ID NO: 6335 - DNA, 15 bp, Artificial Sequence
  dgRNA
  Eif4h
gacagacaacgcccg

SEQ ID NO: 6336 - DNA, 15 bp, Artificial Sequence
  dgRNA
  Eif4h
acagacaacgcccga

SEQ ID NO: 6337 - DNA, 15 bp, Artificial Sequence
  dgRNA
  Eif4h
cagacaacgcccgag

SEQ ID NO: 6338 - DNA, 15 bp, Artificial Sequence
  dgRNA
  Eif4h
caacgcccgaggggt

SEQ ID NO: 6339 - DNA, 15 bp, Artificial Sequence
  dgRNA
  Klhl4
atcatcctgtcagta

SEQ ID NO: 6340 - DNA, 15 bp, Artificial Sequence
  dgRNA
  Klhl4
tcatcctgtcagtat

SEQ ID NO: 6341 - DNA, 15 bp, Artificial Sequence
  dgRNA
  Klhl4
cacctacactgttag

SEQ ID NO: 6342 - DNA, 15 bp, Artificial Sequence
  dgRNA
  Klhl4
ttagcggcagctttc

SEQ ID NO: 6343 - DNA, 15 bp, Artificial Sequence
  dgRNA
  Bhlhe41
gatgctggacgagcc

SEQ ID NO: 6344 - DNA, 15 bp, Artificial Sequence
  dgRNA
  Bhlhe41
atgctggacgagccg

SEQ ID NO: 6345 - DNA, 15 bp, Artificial Sequence
  dgRNA
  Bhlhe41
tgctggacgagccgg

SEQ ID NO: 6346 - DNA, 15 bp, Artificial Sequence
  dgRNA
  Bhlhe41
cgccctgcagcgcct

SEQ ID NO: 6347 - DNA, 15 bp, Artificial Sequence
  dgRNA
  Slc52a3
gatcgcaccctggag

SEQ ID NO: 6348 - DNA, 15 bp, Artificial Sequence
  dgRNA
  Slc52a3
cacctctgtagacgc

SEQ ID NO: 6349 - DNA, 15 bp, Artificial Sequence
  dgRNA
  Slc52a3
caggctttgcgcccc

SEQ ID NO: 6350 - DNA, 15 bp, Artificial Sequence
  dgRNA
  Slc52a3
gctttgcgcccctgg

SEQ ID NO: 6351 - DNA, 15 bp, Artificial Sequence
  dgRNA
  Ybey
ttcttgcgatctcca

SEQ ID NO: 6352 - DNA, 15 bp, Artificial Sequence
  dgRNA
  Ybey
gaacttgcgatgccc

SEQ ID NO: 6353 - DNA, 15 bp, Artificial Sequence
  dgRNA
  Ybey
cgatgcttaacactc

SEQ ID NO: 6354 - DNA, 15 bp, Artificial Sequence
  dgRNA
  Ybey
taacactccggaagc

SEQ ID NO: 6355 - DNA, 15 bp, Artificial Sequence
  dgRNA
  1110008L16Rik
ccgccacttctagcc

SEQ ID NO: 6356 - DNA, 15 bp, Artificial Sequence
  dgRNA
  1110008L16Rik
cgccacttctagcct

SEQ ID NO: 6357 - DNA, 15 bp, Artificial Sequence
  dgRNA
  1110008L16Rik
acttctagcctgggg

SEQ ID NO: 6358 - DNA, 15 bp, Artificial Sequence
  dgRNA
  1110008L16Rik
gggcgggctatctag

SEQ ID NO: 6359 - DNA, 15 bp, Artificial Sequence
  dgRNA
  Dym
tgccacgtggctatg

SEQ ID NO: 6360 - DNA, 15 bp, Artificial Sequence
  dgRNA
  Dym
gctatgtggttgccc

SEQ ID NO: 6361 - DNA, 15 bp, Artificial Sequence
  dgRNA
  Dym
tgcccgggagacgct

SEQ ID NO: 6362 - DNA, 15 bp, Artificial Sequence
  dgRNA
  Dym
ccgggagacgctagg

SEQ ID NO: 6363 - DNA, 15 bp, Artificial Sequence
  dgRNA
  Samd15
ggcctgacacgtgag

SEQ ID NO: 6364 - DNA, 15 bp, Artificial Sequence
  dgRNA
  Samd15
gcctgacacgtgaga

SEQ ID NO: 6365 - DNA, 15 bp, Artificial Sequence
  dgRNA
  Samd15
cctgacacgtgagag

SEQ ID NO: 6366 - DNA, 15 bp, Artificial Sequence
  dgRNA
  Samd15
gacacgtgagagggg

SEQ ID NO: 6367 - DNA, 15 bp, Artificial Sequence
  dgRNA
  Vopp1
ggtctcttccgagag

SEQ ID NO: 6368 - DNA, 15 bp, Artificial Sequence
  dgRNA
  Vopp1
gatggacccatcact

SEQ ID NO: 6369 - DNA, 15 bp, Artificial Sequence
  dgRNA
  Vopp1
ggatggacccatcac

SEQ ID NO: 6370 - DNA, 15 bp, Artificial Sequence
  dgRNA
  Vopp1
ccgggtttgggagct

SEQ ID NO: 6371 - DNA, 15 bp, Artificial Sequence
  dgRNA
  Mkl1
ctctcagttaccgat

SEQ ID NO: 6372 - DNA, 15 bp, Artificial Sequence
  dgRNA
  Mkl1
gaacgccccctaaat

SEQ ID NO: 6373 - DNA, 15 bp, Artificial Sequence
  dgRNA
  Mkl1
aacgccccctaaatc

SEQ ID NO: 6374 - DNA, 15 bp, Artificial Sequence
  dgRNA
  Mkl1
tcgggctagccctaa

SEQ ID NO: 6375 - DNA, 15 bp, Artificial Sequence
  dgRNA
  Pth2
cgacttgtgctctga

SEQ ID NO: 6376 - DNA, 15 bp, Artificial Sequence
  dgRNA
  Stk25
ctcgggcatatctca

SEQ ID NO: 6377 - DNA, 15 bp, Artificial Sequence
  dgRNA
  Stk25
gcatatctcaaggtt

SEQ ID NO: 6378 - DNA, 15 bp, Artificial Sequence
  dgRNA
  Stk25
ttcggatccaatctg

SEQ ID NO: 6379 - DNA, 15 bp, Artificial Sequence
  dgRNA
  Stk25
caccgcaagttctcc

SEQ ID NO: 6380 - DNA, 15 bp, Artificial Sequence
  dgRNA
  Slc25a1
cttagcgttgctgtc

SEQ ID NO: 6381 - DNA, 15 bp, Artificial Sequence
  dgRNA
  Slc25a1
gaccacgcctccggc

SEQ ID NO: 6382 - DNA, 15 bp, Artificial Sequence
  dgRNA
  Slc25a1
accacgcctccggcg

SEQ ID NO: 6383 - DNA, 15 bp, Artificial Sequence
  dgRNA
  Slc25a1
ggttctccgtctccc

SEQ ID NO: 6384 - DNA, 15 bp, Artificial Sequence
  dgRNA
  Gid4
ctccatgccgcgcca

SEQ ID NO: 6385 - DNA, 15 bp, Artificial Sequence
  dgRNA
  Gid4
tccatgccgcgccac

SEQ ID NO: 6386 - DNA, 15 bp, Artificial Sequence
  dgRNA
  Gid4
tctctgtccgccaat

SEQ ID NO: 6387 - DNA, 15 bp, Artificial Sequence
  dgRNA
  Gid4
ctgtccgccaatggg

SEQ ID NO: 6388 - DNA, 15 bp, Artificial Sequence
  dgRNA
  Kif3a
gcgggtcagatgtcc

SEQ ID NO: 6389 - DNA, 15 bp, Artificial Sequence
  dgRNA
  Kif3a
atggcagcaccccgc

SEQ ID NO: 6390 - DNA, 15 bp, Artificial Sequence
  dgRNA
  Kif3a
ccagtctagcgtcca

SEQ ID NO: 6391 - DNA, 15 bp, Artificial Sequence
  dgRNA
  Kif3a
tagcgtccatggaga

SEQ ID NO: 6392 - DNA, 15 bp, Artificial Sequence
  dgRNA
  Slc15a2
cccatgccttacctt

SEQ ID NO: 6393 - DNA, 15 bp, Artificial Sequence
  dgRNA
  Slc15a2
aacattatgccctgc

SEQ ID NO: 6394 - DNA, 15 bp, Artificial Sequence
  dgRNA
  Slc15a2
ctagagaatcgatta

SEQ ID NO: 6395 - DNA, 15 bp, Artificial Sequence
  dgRNA
  Slc15a2
gctagagaatcgatt

SEQ ID NO: 6396 - DNA, 15 bp, Artificial Sequence
  dgRNA
  Gm773
ccatgtgacaaccct

SEQ ID NO: 6397 - DNA, 15 bp, Artificial Sequence
  dgRNA
  Gm773
catgtgacaaccctt

SEQ ID NO: 6398 - DNA, 15 bp, Artificial Sequence
  dgRNA
  Gm773
gtcccatgacccccc

SEQ ID NO: 6399 - DNA, 15 bp, Artificial Sequence
  dgRNA
  Gm773
tcccatgacccccct

SEQ ID NO: 6400 - DNA, 15 bp, Artificial Sequence
  dgRNA
  Nmral1
cctcaggcgcccccc

SEQ ID NO: 6401 - DNA, 15 bp, Artificial Sequence
  dgRNA
  Nmral1
gcccccctggaagcg

SEQ ID NO: 6402 - DNA, 15 bp, Artificial Sequence
  dgRNA
  Nmral1
tggaagcgtggcaac

SEQ ID NO: 6403 - DNA, 15 bp, Artificial Sequence
  dgRNA
  Nmral1
agcgtggcaactggc

SEQ ID NO: 6404 - DNA, 15 bp, Artificial Sequence
  dgRNA
  Cd44
taactgagaggggcg

SEQ ID NO: 6405 - DNA, 15 bp, Artificial Sequence
  dgRNA
  Cd44
ggcagcgcttctcat

SEQ ID NO: 6406 - DNA, 15 bp, Artificial Sequence
  dgRNA
  Cd44
gcgcttctcataggc

SEQ ID NO: 6407 - DNA, 15 bp, Artificial Sequence
  dgRNA
  Cd44
ttctcataggctggt

SEQ ID NO: 6408 - DNA, 15 bp, Artificial Sequence
  dgRNA
  Gas2l3
cactctcctgaacga

SEQ ID NO: 6409 - DNA, 15 bp, Artificial Sequence
  dgRNA
  Gas2l3
actctcctgaacgac

SEQ ID NO: 6410 - DNA, 15 bp, Artificial Sequence
  dgRNA
  Gas2l3
aacgacgggacaaat

SEQ ID NO: 6411 - DNA, 15 bp, Artificial Sequence
  dgRNA
  Gas2l3
gacgggacaaatagg

SEQ ID NO: 6412 - DNA, 15 bp, Artificial Sequence
  dgRNA
  Ldoc1
ccgcagcgaagctcc

SEQ ID NO: 6413 - DNA, 15 bp, Artificial Sequence
  dgRNA
  Ldoc1
cgcagcgaagctcct

SEQ ID NO: 6414 - DNA, 15 bp, Artificial Sequence
  dgRNA
  Ldoc1
gccagttcttccacc

SEQ ID NO: 6415 - DNA, 15 bp, Artificial Sequence
  dgRNA
  Ldoc1
aggagcttcgctgcg

SEQ ID NO: 6416 - DNA, 15 bp, Artificial Sequence
  dgRNA
  Eif5a2
caaacagtcgactgc

SEQ ID NO: 6417 - DNA, 15 bp, Artificial Sequence
  dgRNA
  Eif5a2
ggcagctctgcacgc

SEQ ID NO: 6418 - DNA, 15 bp, Artificial Sequence
  dgRNA
  Eif5a2
ctaatccgcagcacg

SEQ ID NO: 6419 - DNA, 15 bp, Artificial Sequence
  dgRNA
  Eif5a2
taatccgcagcacgt

SEQ ID NO: 6420 - DNA, 15 bp, Artificial Sequence
  dgRNA
  Fam131c
ttggttagcgacaac

SEQ ID NO: 6421 - DNA, 15 bp, Artificial Sequence
  dgRNA
  Fam131c
cgacaacaggtacac

SEQ ID NO: 6422 - DNA, 15 bp, Artificial Sequence
  dgRNA
  Fam131c
ccctccgcgctcccc

SEQ ID NO: 6423 - DNA, 15 bp, Artificial Sequence
  dgRNA
  Fam131c
cgccgcggtgtcgcc

SEQ ID NO: 6424 - DNA, 15 bp, Artificial Sequence
  dgRNA
  Apbb1
tatccacaggacgtc

SEQ ID NO: 6425 - DNA, 15 bp, Artificial Sequence
  dgRNA
  Apbb1
atccacaggacgtca

SEQ ID NO: 6426 - DNA, 15 bp, Artificial Sequence
  dgRNA
  Apbb1
cttgaggcgcagcca

SEQ ID NO: 6427 - DNA, 15 bp, Artificial Sequence
  dgRNA
  Apbb1
cagactccgtgctct

SEQ ID NO: 6428 - DNA, 15 bp, Artificial Sequence
  dgRNA
  Nae1
ggtttatcagtgata

SEQ ID NO: 6429 - DNA, 15 bp, Artificial Sequence
  dgRNA
  Nae1
ctccacaattactgc

SEQ ID NO: 6430 - DNA, 15 bp, Artificial Sequence
  dgRNA
  Nae1
tgcgcagtgcagcgt

SEQ ID NO: 6431 - DNA, 15 bp, Artificial Sequence
  dgRNA
  Nae1
gtcggcgccccctac

SEQ ID NO: 6432 - DNA, 15 bp, Artificial Sequence
  dgRNA
  Tmem30b
ggcggagccagtccc

SEQ ID NO: 6433 - DNA, 15 bp, Artificial Sequence
  dgRNA
  Tmem30b
aactgagcagtcccg

SEQ ID NO: 6434 - DNA, 15 bp, Artificial Sequence
  dgRNA
  Tmem30b
agcgcgccccgcaat

SEQ ID NO: 6435 - DNA, 15 bp, Artificial Sequence
  dgRNA
  Tmem30b
tcggcctcacctgcg

SEQ ID NO: 6436 - DNA, 15 bp, Artificial Sequence
  dgRNA
  Capn3
gttgcccctagacca

SEQ ID NO: 6437 - DNA, 15 bp, Artificial Sequence
  dgRNA
  Capn3
ttgcccctagaccat

SEQ ID NO: 6438 - DNA, 15 bp, Artificial Sequence
  dgRNA
  Capn3
gtggaggagctatat

SEQ ID NO: 6439 - DNA, 15 bp, Artificial Sequence
  dgRNA
  Capn3
gagctatataggctc

SEQ ID NO: 6440 - DNA, 15 bp, Artificial Sequence
  dgRNA
  Raet1e
gcattccctggcgcg

SEQ ID NO: 6441 - DNA, 15 bp, Artificial Sequence
  dgRNA
  Raet1e
cattccctggcgcga

SEQ ID NO: 6442 - DNA, 15 bp, Artificial Sequence
  dgRNA
  Raet1e
attccctggcgcgag

SEQ ID NO: 6443 - DNA, 15 bp, Artificial Sequence
  dgRNA
  Raet1e
ttccctggcgcgagg

SEQ ID NO: 6444 - DNA, 15 bp, Artificial Sequence
  dgRNA
  Eftud1
agcgtccccctccgc

SEQ ID NO: 6445 - DNA, 15 bp, Artificial Sequence
  dgRNA
  Eftud1
cccctccgcaggctt

SEQ ID NO: 6446 - DNA, 15 bp, Artificial Sequence
  dgRNA
  Eftud1
tccgcaggcttaggc

SEQ ID NO: 6447 - DNA, 15 bp, Artificial Sequence
  dgRNA
  Eftud1
cgtccgccgtcgtca

SEQ ID NO: 6448 - DNA, 15 bp, Artificial Sequence
  dgRNA
  Gm14459
gatctcggggtgaaa

SEQ ID NO: 6449 - DNA, 15 bp, Artificial Sequence
  dgRNA
  Gm14459
atctcggggtgaaaa

SEQ ID NO: 6450 - DNA, 15 bp, Artificial Sequence
  dgRNA
  Gm14459
cttgattatgtctat

SEQ ID NO: 6451 - DNA, 15 bp, Artificial Sequence
  dgRNA
  Src
cccggctcgcacagc

SEQ ID NO: 6452 - DNA, 15 bp, Artificial Sequence
  dgRNA
  Src
ggtctcccgggtcgc

SEQ ID NO: 6453 - DNA, 15 bp, Artificial Sequence
  dgRNA
  Src
ctcccgggtcgccgg

SEQ ID NO: 6454 - DNA, 15 bp, Artificial Sequence
  dgRNA
  Src
cccgggtcgccggcg

SEQ ID NO: 6455 - DNA, 15 bp, Artificial Sequence
  dgRNA
  Sdccag3
tcctcgcaccgagac

SEQ ID NO: 6456 - DNA, 15 bp, Artificial Sequence
  dgRNA
  Sdccag3
caccgagacaggcct

SEQ ID NO: 6457 - DNA, 15 bp, Artificial Sequence
  dgRNA
  Sdccag3
aggcctcggctcacc

SEQ ID NO: 6458 - DNA, 15 bp, Artificial Sequence
  dgRNA
  Sdccag3
ggcctcggctcacct

SEQ ID NO: 6459 - DNA, 15 bp, Artificial Sequence
  dgRNA
  P2ry4
aaacagtaatctcgc

SEQ ID NO: 6460 - DNA, 15 bp, Artificial Sequence
  dgRNA
  P2ry4
aacagtaatctcgct

SEQ ID NO: 6461 - DNA, 15 bp, Artificial Sequence
  dgRNA
  P2ry4
accagataacctcca

SEQ ID NO: 6462 - DNA, 15 bp, Artificial Sequence
  dgRNA
  P2ry4
ccagataacctccaa

SEQ ID NO: 6463 - DNA, 15 bp, Artificial Sequence
  dgRNA
  Kif5b
ccttccgatgctctg

SEQ ID NO: 6464 - DNA, 15 bp, Artificial Sequence
  dgRNA
  Kif5b
attctgcagcggcct

SEQ ID NO: 6465 - DNA, 15 bp, Artificial Sequence
  dgRNA
  Kif5b
cgctactcaacttgc

SEQ ID NO: 6466 - DNA, 15 bp, Artificial Sequence
  dgRNA
  Kif5b
gcaaagcctgcggcc

SEQ ID NO: 6467 - DNA, 15 bp, Artificial Sequence
  dgRNA
  Stk39
aaaccgacgccgtgt

SEQ ID NO: 6468 - DNA, 15 bp, Artificial Sequence
  dgRNA
  Stk39
cgacgccgtgtaggt

SEQ ID NO: 6469 - DNA, 15 bp, Artificial Sequence
  dgRNA
  Stk39
gttctttcgctcgct

SEQ ID NO: 6470 - DNA, 15 bp, Artificial Sequence
  dgRNA
  Stk39
ttctttcgctcgctc

SEQ ID NO: 6471 - DNA, 15 bp, Artificial Sequence
  dgRNA
  Smarcc2
cgtcctgcgagaccc

SEQ ID NO: 6472 - DNA, 15 bp, Artificial Sequence
  dgRNA
  Smarcc2
gtcctgcgagacccg

SEQ ID NO: 6473 - DNA, 15 bp, Artificial Sequence
  dgRNA
  Smarcc2
gccgggctgccgctg

SEQ ID NO: 6474 - DNA, 15 bp, Artificial Sequence
  dgRNA
  Smarcc2
ccgggctgccgctgc

SEQ ID NO: 6475 - DNA, 15 bp, Artificial Sequence
  dgRNA
  B3gnt9
cctatcaaaaatact

SEQ ID NO: 6476 - DNA, 15 bp, Artificial Sequence
  dgRNA
  B3gnt9
agagtctcccgtgag

SEQ ID NO: 6477 - DNA, 15 bp, Artificial Sequence
  dgRNA
  B3gnt9
gtgagaggccctctc

SEQ ID NO: 6478 - DNA, 15 bp, Artificial Sequence
  dgRNA
  B3gnt9
gagctccagatgtcg

SEQ ID NO: 6479 - DNA, 15 bp, Artificial Sequence
  dgRNA
  Hist2h2be
aggcgctcctagggg

SEQ ID NO: 6480 - DNA, 15 bp, Artificial Sequence
  dgRNA
  Hist2h2be
ggcgctcctaggggt

SEQ ID NO: 6481 - DNA, 15 bp, Artificial Sequence
  dgRNA
  Hist2h2be
gcgctcctaggggtg

SEQ ID NO: 6482 - DNA, 15 bp, Artificial Sequence
  dgRNA
  Hist2h2be
cgcaagtttcgcgta

SEQ ID NO: 6483 - DNA, 15 bp, Artificial Sequence
  dgRNA
  Lrrc30
cttgtgctgcacgga

SEQ ID NO: 6484 - DNA, 15 bp, Artificial Sequence
  dgRNA
  Lrrc30
agagtattactgacc

SEQ ID NO: 6485 - DNA, 15 bp, Artificial Sequence
  dgRNA
  Lrrc30
ctctgagtggacggc

SEQ ID NO: 6486 - DNA, 15 bp, Artificial Sequence
  dgRNA
  Lrrc30
ggtcggaaacctaca

SEQ ID NO: 6487 - DNA, 15 bp, Artificial Sequence
  dgRNA
  Zfp957
aataactccatcaga

SEQ ID NO: 6488 - DNA, 15 bp, Artificial Sequence
  dgRNA
  Zfp957
ctgtaagcgcatctg

SEQ ID NO: 6489 - DNA, 15 bp, Artificial Sequence
  dgRNA
  Zfp957
tgtaagcgcatctgt

SEQ ID NO: 6490 - DNA, 15 bp, Artificial Sequence
  dgRNA
  Zfp957
gtaagcgcatctgtg

SEQ ID NO: 6491 - DNA, 15 bp, Artificial Sequence
  dgRNA
  Rufy1
caaaacgttaaaata

SEQ ID NO: 6492 - DNA, 15 bp, Artificial Sequence
  dgRNA
  Rufy1
aataaggcgcattcc

SEQ ID NO: 6493 - DNA, 15 bp, Artificial Sequence
  dgRNA
  Rufy1
ataaggcgcattccc

SEQ ID NO: 6494 - DNA, 15 bp, Artificial Sequence
  dgRNA
  Rufy1
taaggcgcattcccg

SEQ ID NO: 6495 - DNA, 15 bp, Artificial Sequence
  dgRNA
  Rras2
cgccgtccatcttcc

SEQ ID NO: 6496 - DNA, 15 bp, Artificial Sequence
  dgRNA
  Rras2
ctcccggtgctctga

SEQ ID NO: 6497 - DNA, 15 bp, Artificial Sequence
  dgRNA
  Rras2
cggtgctctgagggc

SEQ ID NO: 6498 - DNA, 15 bp, Artificial Sequence
  dgRNA
  Rras2
tccagagtctccgcc

SEQ ID NO: 6499 - DNA, 15 bp, Artificial Sequence
  dgRNA
  Ccr9
gttaatccttaaccc

SEQ ID NO: 6500 - DNA, 15 bp, Artificial Sequence
  dgRNA
  Ccr9
aatccttaaccctgg

SEQ ID NO: 6501 - DNA, 15 bp, Artificial Sequence
  dgRNA
  Ccr9
actagaatctgcagc

SEQ ID NO: 6502 - DNA, 15 bp, Artificial Sequence
  dgRNA
  Ccr9
cgccagtgacaacac

SEQ ID NO: 6503 - DNA, 15 bp, Artificial Sequence
  dgRNA
  2810408A11Rik
ctccctggtgttgcg

SEQ ID NO: 6504 - DNA, 15 bp, Artificial Sequence
  dgRNA
  2810408A11Rik
aaggctcctcaccgc

SEQ ID NO: 6505 - DNA, 15 bp, Artificial Sequence
  dgRNA
  2810408A11Rik
ccccttgactgtgat

SEQ ID NO: 6506 - DNA, 15 bp, Artificial Sequence
  dgRNA
  2810408A11Rik
tggttgattcggaga

SEQ ID NO: 6507 - DNA, 15 bp, Artificial Sequence
  dgRNA
  Ezh2
cactcgcgcacgcgc

SEQ ID NO: 6508 - DNA, 15 bp, Artificial Sequence
  dgRNA
  Ezh2
agcctcgcgctccca

SEQ ID NO: 6509 - DNA, 15 bp, Artificial Sequence
  dgRNA
  Ezh2
tcgcgctcccagggc

SEQ ID NO: 6510 - DNA, 15 bp, Artificial Sequence
  dgRNA
  Ezh2
tggagctcgctccga

SEQ ID NO: 6511 - DNA, 15 bp, Artificial Sequence
  dgRNA
  Mapre2
aagctgacgagttag

SEQ ID NO: 6512 - DNA, 15 bp, Artificial Sequence
  dgRNA
  Mapre2
agctgacgagttagc

SEQ ID NO: 6513 - DNA, 15 bp, Artificial Sequence
  dgRNA
  Mapre2
gttagcgggttgcta

SEQ ID NO: 6514 - DNA, 15 bp, Artificial Sequence
  dgRNA
  Mapre2
gcaggcgccctgacg

SEQ ID NO: 6515 - DNA, 15 bp, Artificial Sequence
  dgRNA
  Scgb1b29
tccaagatgtgtaaa

SEQ ID NO: 6516 - DNA, 15 bp, Artificial Sequence
  dgRNA
  Ccdc110
ttttatcaagtgtac

SEQ ID NO: 6517 - DNA, 15 bp, Artificial Sequence
  dgRNA
  Ccdc110
catcagctccggaaa

SEQ ID NO: 6518 - DNA, 15 bp, Artificial Sequence
  dgRNA
  Ccdc110
agctccggaaaaggg

SEQ ID NO: 6519 - DNA, 15 bp, Artificial Sequence
  dgRNA
  Ccdc110
ggcgggtgcttcccc

SEQ ID NO: 6520 - DNA, 15 bp, Artificial Sequence
  dgRNA
  Kcna5
tgttcctcgctcctc

SEQ ID NO: 6521 - DNA, 15 bp, Artificial Sequence
  dgRNA
  Kcna5
tgactccgtccccag

SEQ ID NO: 6522 - DNA, 15 bp, Artificial Sequence
  dgRNA
  Kcna5
ggaacaggttgtacc

SEQ ID NO: 6523 - DNA, 15 bp, Artificial Sequence
  dgRNA
  Kcna5
tctggagggttcagc

SEQ ID NO: 6524 - DNA, 15 bp, Artificial Sequence
  dgRNA
  Myo18a
cagtagcactccaca

SEQ ID NO: 6525 - DNA, 15 bp, Artificial Sequence
  dgRNA
  Myo18a
gtagcactccacaag

SEQ ID NO: 6526 - DNA, 15 bp, Artificial Sequence
  dgRNA
  Myo18a
tccacaaggggtgac

SEQ ID NO: 6527 - DNA, 15 bp, Artificial Sequence
  dgRNA
  Myo18a
cttgcagctacaagg

SEQ ID NO: 6528 - DNA, 15 bp, Artificial Sequence
  dgRNA
  Rnf112
atcccggcctccgcc

SEQ ID NO: 6529 - DNA, 15 bp, Artificial Sequence
  dgRNA
  Rnf112
tcccggcctccgcca

SEQ ID NO: 6530 - DNA, 15 bp, Artificial Sequence
  dgRNA
  Rnf112
tccatggagacgaaa

SEQ ID NO: 6531 - DNA, 15 bp, Artificial Sequence
  dgRNA
  Rnf112
ggcggtgaatctcca

SEQ ID NO: 6532 - DNA, 15 bp, Artificial Sequence
  dgRNA
  Pax4
aagctctggaccccc

SEQ ID NO: 6533 - DNA, 15 bp, Artificial Sequence
  dgRNA
  Pax4
tctggaccccctggc

SEQ ID NO: 6534 - DNA, 15 bp, Artificial Sequence
  dgRNA
  Themis3
ccaaccaaaagagtc

SEQ ID NO: 6535 - DNA, 15 bp, Artificial Sequence
  dgRNA
  Themis3
ttcccctgtgacacg

SEQ ID NO: 6536 - DNA, 15 bp, Artificial Sequence
  dgRNA
  Themis3
gccagagtcatgatc

SEQ ID NO: 6537 - DNA, 15 bp, Artificial Sequence
  dgRNA
  Themis3
agagtcatgatcagg

SEQ ID NO: 6538 - DNA, 15 bp, Artificial Sequence
  dgRNA
  Pomgnt1
ttggctatcaagaag

SEQ ID NO: 6539 - DNA, 15 bp, Artificial Sequence
  dgRNA
  Pomgnt1
ctcctcagggcccgc

SEQ ID NO: 6540 - DNA, 15 bp, Artificial Sequence
  dgRNA
  Pomgnt1
gcttttgggacacgt

SEQ ID NO: 6541 - DNA, 15 bp, Artificial Sequence
  dgRNA
  Pomgnt1
gttagagtaaagtta

SEQ ID NO: 6542 - DNA, 15 bp, Artificial Sequence
  dgRNA
  Prlhr
gcgagcgtccattgt

SEQ ID NO: 6543 - DNA, 15 bp, Artificial Sequence
  dgRNA
  Prlhr
ccccggtctgccttc

SEQ ID NO: 6544 - DNA, 15 bp, Artificial Sequence
  dgRNA
  Prlhr
ccggtctgccttccg

SEQ ID NO: 6545 - DNA, 15 bp, Artificial Sequence
  dgRNA
  Prlhr
gctctcttctactaa

SEQ ID NO: 6546 - DNA, 15 bp, Artificial Sequence
  dgRNA
  Fam53c
acctcatcctgctgg

SEQ ID NO: 6547 - DNA, 15 bp, Artificial Sequence
  dgRNA
  Fam53c
gcggtaaggaggaaa

SEQ ID NO: 6548 - DNA, 15 bp, Artificial Sequence
  dgRNA
  Fam53c
tgcggggtgtatggg

SEQ ID NO: 6549 - DNA, 15 bp, Artificial Sequence
  dgRNA
  Fam53c
ttgcggggtgtatgg

SEQ ID NO: 6550 - DNA, 15 bp, Artificial Sequence
  dgRNA
  Sv2b
ttatcttgggtagtt

SEQ ID NO: 6551 - DNA, 15 bp, Artificial Sequence
  dgRNA
  Sv2b
ggatggcataatccg

SEQ ID NO: 6552 - DNA, 15 bp, Artificial Sequence
  dgRNA
  Sv2b
tccaagaccgagctt

SEQ ID NO: 6553 - DNA, 15 bp, Artificial Sequence
  dgRNA
  Sv2b
ccaagaccgagcttg

SEQ ID NO: 6554 - DNA, 15 bp, Artificial Sequence
  dgRNA
  Nr1i3
ctaaagctcacccac

SEQ ID NO: 6555 - DNA, 15 bp, Artificial Sequence
  dgRNA
  Nr1i3
ccaaccaacacttct

SEQ ID NO: 6556 - DNA, 15 bp, Artificial Sequence
  dgRNA
  Nr1i3
caaccaacacttctc

SEQ ID NO: 6557 - DNA, 15 bp, Artificial Sequence
  dgRNA
  Nr1i3
cttctcgggcatgct

SEQ ID NO: 6558 - DNA, 15 bp, Artificial Sequence
  dgRNA
  Ralgapb
ttgacgctgcccact

SEQ ID NO: 6559 - DNA, 15 bp, Artificial Sequence
  dgRNA
  Ralgapb
tcccttcagaagtcg

SEQ ID NO: 6560 - DNA, 15 bp, Artificial Sequence
  dgRNA
  Ralgapb
cccttcagaagtcgc

SEQ ID NO: 6561 - DNA, 15 bp, Artificial Sequence
  dgRNA
  Ralgapb
tcagcagcgccgcgc

SEQ ID NO: 6562 - DNA, 15 bp, Artificial Sequence
  dgRNA
  Rtn1
agcccgcgcccgccg

SEQ ID NO: 6563 - DNA, 15 bp, Artificial Sequence
  dgRNA
  Rtn1
tccacgcgcgcgcgc

SEQ ID NO: 6564 - DNA, 15 bp, Artificial Sequence
  dgRNA
  Rtn1
acgcgcgcgcgccgg

SEQ ID NO: 6565 - DNA, 15 bp, Artificial Sequence
  dgRNA
  Rtn1
gcgcgccggcggctc

SEQ ID NO: 6566 - DNA, 15 bp, Artificial Sequence
  dgRNA
  Serpina1b
tcagtgtccaaccga

SEQ ID NO: 6567 - DNA, 15 bp, Artificial Sequence
  dgRNA
  Serpina1b
atcggttggacactg

SEQ ID NO: 6568 - DNA, 15 bp, Artificial Sequence
  dgRNA
  Serpina1b
gctaagtccatcggt

SEQ ID NO: 6569 - DNA, 15 bp, Artificial Sequence
  dgRNA
  Cks1brt
gacgtctgtatgacc

SEQ ID NO: 6570 - DNA, 15 bp, Artificial Sequence
  dgRNA
  Cks1brt
agtttgaacacaata

SEQ ID NO: 6571 - DNA, 15 bp, Artificial Sequence
  dgRNA
  Cks1brt
atacagacgtccgaa

SEQ ID NO: 6572 - DNA, 15 bp, Artificial Sequence
  dgRNA
  Cks1brt
catacagacgtccga

SEQ ID NO: 6573 - DNA, 15 bp, Artificial Sequence
  dgRNA
  Mical1
cagcgtgggtaccac

SEQ ID NO: 6574 - DNA, 15 bp, Artificial Sequence
  dgRNA
  Mical1
agcgtgggtaccacc

SEQ ID NO: 6575 - DNA, 15 bp, Artificial Sequence
  dgRNA
  Mical1
gcgtgggtaccaccg

SEQ ID NO: 6576 - DNA, 15 bp, Artificial Sequence
  dgRNA
  Mical1
tgggtaccaccgggg

SEQ ID NO: 6577 - DNA, 15 bp, Artificial Sequence
  dgRNA
  Sfi1
agcgcagaaacttca

SEQ ID NO: 6578 - DNA, 15 bp, Artificial Sequence
  dgRNA
  Sfi1
gggcaagaaaaccgt

SEQ ID NO: 6579 - DNA, 15 bp, Artificial Sequence
  dgRNA
  Sfi1
cagagcgcactaagc

SEQ ID NO: 6580 - DNA, 15 bp, Artificial Sequence
  dgRNA
  Sfi1
agcagcttccggcgc

SEQ ID NO: 6581 - DNA, 15 bp, Artificial Sequence
  dgRNA
  Asf1b
tcgcgcgccaccgtt

SEQ ID NO: 6582 - DNA, 15 bp, Artificial Sequence
  dgRNA
  Asf1b
ccaccgttcggccgt

SEQ ID NO: 6583 - DNA, 15 bp, Artificial Sequence
  dgRNA
  Asf1b
ccgttcggccgttgg

SEQ ID NO: 6584 - DNA, 15 bp, Artificial Sequence
  dgRNA
  Asf1b
gtgaggtgcgtctac

SEQ ID NO: 6585 - DNA, 15 bp, Artificial Sequence
  dgRNA
  Pde1c
cccttccttggggcg

SEQ ID NO: 6586 - DNA, 15 bp, Artificial Sequence
  dgRNA
  Pde1c
ccgcgccccaaggaa

SEQ ID NO: 6587 - DNA, 15 bp, Artificial Sequence
  dgRNA
  Pde1c
tccgcgccccaagga

SEQ ID NO: 6588 - DNA, 15 bp, Artificial Sequence
  dgRNA
  Pde1c
gggctccgcgcccca

SEQ ID NO: 6589 - DNA, 15 bp, Artificial Sequence
  dgRNA
  Foxl1
ggacaaagcgcgcag

SEQ ID NO: 6590 - DNA, 15 bp, Artificial Sequence
  dgRNA
  Foxl1
aaagcgcgcagcggc

SEQ ID NO: 6591 - DNA, 15 bp, Artificial Sequence
  dgRNA
  Foxl1
aagcgcgcagcggct

SEQ ID NO: 6592 - DNA, 15 bp, Artificial Sequence
  dgRNA
  Foxl1
agcgcgcagcggctg

SEQ ID NO: 6593 - DNA, 15 bp, Artificial Sequence
  dgRNA
  Mrpl14
gactcggctccgact

SEQ ID NO: 6594 - DNA, 15 bp, Artificial Sequence
  dgRNA
  Mrpl14
ccgactcgggagccc

SEQ ID NO: 6595 - DNA, 15 bp, Artificial Sequence
  dgRNA
  Mrpl14
cgggagccccggctc

SEQ ID NO: 6596 - DNA, 15 bp, Artificial Sequence
  dgRNA
  Mrpl14
agccccggctccggg

SEQ ID NO: 6597 - DNA, 15 bp, Artificial Sequence
  dgRNA
  H6pd
gttcttaatggaatt

SEQ ID NO: 6598 - DNA, 15 bp, Artificial Sequence
  dgRNA
  H6pd
tgtttaacaaccagc

SEQ ID NO: 6599 - DNA, 15 bp, Artificial Sequence
  dgRNA
  H6pd
tttgagtgctcctcc

SEQ ID NO: 6600 - DNA, 15 bp, Artificial Sequence
  dgRNA
  H6pd
cccagttatctttag

SEQ ID NO: 6601 - DNA, 15 bp, Artificial Sequence
  dgRNA
  Mpv17l
tttttattgcggtag

SEQ ID NO: 6602 - DNA, 15 bp, Artificial Sequence
  dgRNA
  Mpv17l
ttttattgcggtagt

SEQ ID NO: 6603 - DNA, 15 bp, Artificial Sequence
  dgRNA
  Mpv17l
tttattgcggtagtg

SEQ ID NO: 6604 - DNA, 15 bp, Artificial Sequence
  dgRNA
  Mpv17l
aaccgatgccatgct

SEQ ID NO: 6605 - DNA, 15 bp, Artificial Sequence
  dgRNA
  Tro
aacagggacacgtat

SEQ ID NO: 6606 - DNA, 15 bp, Artificial Sequence
  dgRNA
  Tro
acagggacacgtatt

SEQ ID NO: 6607 - DNA, 15 bp, Artificial Sequence
  dgRNA
  Tro
cagggacacgtattg

SEQ ID NO: 6608 - DNA, 15 bp, Artificial Sequence
  dgRNA
  Tro
agatgcgccacactg

SEQ ID NO: 6609 - DNA, 15 bp, Artificial Sequence
  dgRNA
  St8sia4
gccgccagtaacgca

SEQ ID NO: 6610 - DNA, 15 bp, Artificial Sequence
  dgRNA
  St8sia4
tccgccccctcagca

SEQ ID NO: 6611 - DNA, 15 bp, Artificial Sequence
  dgRNA
  St8sia4
cctcagcacggtgat

SEQ ID NO: 6612 - DNA, 15 bp, Artificial Sequence
  dgRNA
  St8sia4
agcacggtgattggc

SEQ ID NO: 6613 - DNA, 15 bp, Artificial Sequence
  dgRNA
  Fblim1
ctccccggtgcaccg

SEQ ID NO: 6614 - DNA, 15 bp, Artificial Sequence
  dgRNA
  Fblim1
tccccggtgcaccgt

SEQ ID NO: 6615 - DNA, 15 bp, Artificial Sequence
  dgRNA
  Fblim1
ccccggtgcaccgtg

SEQ ID NO: 6616 - DNA, 15 bp, Artificial Sequence
  dgRNA
  Fblim1
ggtgcaccgtggggg

SEQ ID NO: 6617 - DNA, 15 bp, Artificial Sequence
  dgRNA
  Polr3k
tggtgccagcattat

SEQ ID NO: 6618 - DNA, 15 bp, Artificial Sequence
  dgRNA
  Polr3k
tcggtccagtcctct

SEQ ID NO: 6619 - DNA, 15 bp, Artificial Sequence
  dgRNA
  Polr3k
acgcgcagaaacgac

SEQ ID NO: 6620 - DNA, 15 bp, Artificial Sequence
  dgRNA
  Polr3k
cgcgcagaaacgaca

SEQ ID NO: 6621 - DNA, 15 bp, Artificial Sequence
  dgRNA
  Mut
atccgcccaaacaac

SEQ ID NO: 6622 - DNA, 15 bp, Artificial Sequence
  dgRNA
  Mut
aacaaccggaaaaga

SEQ ID NO: 6623 - DNA, 15 bp, Artificial Sequence
  dgRNA
  Mut
agacggagaacttcc

SEQ ID NO: 6624 - DNA, 15 bp, Artificial Sequence
  dgRNA
  Mut
ccggaagcgtcagtg

SEQ ID NO: 6625 - DNA, 15 bp, Artificial Sequence
  dgRNA
  Nkiras1
cgccgccctacctga

SEQ ID NO: 6626 - DNA, 15 bp, Artificial Sequence
  dgRNA
  Nkiras1
cggcgaccctccttc

SEQ ID NO: 6627 - DNA, 15 bp, Artificial Sequence
  dgRNA
  Nkiras1
cgaccctccttccgg

SEQ ID NO: 6628 - DNA, 15 bp, Artificial Sequence
  dgRNA
  Nkiras1
gaccctccttccggt

SEQ ID NO: 6629 - DNA, 15 bp, Artificial Sequence
  dgRNA
  Kank4
gcggcggcgaggatc

SEQ ID NO: 6630 - DNA, 15 bp, Artificial Sequence
  dgRNA
  Kank4
tcccagtcccgcagc

SEQ ID NO: 6631 - DNA, 15 bp, Artificial Sequence
  dgRNA
  Kank4
gtcccgcagctggcg

SEQ ID NO: 6632 - DNA, 15 bp, Artificial Sequence
  dgRNA
  Kank4
acagctagtgcgtcc

SEQ ID NO: 6633 - DNA, 15 bp, Artificial Sequence
  dgRNA
  Paqr3
ttgactggctggcga

SEQ ID NO: 6634 - DNA, 15 bp, Artificial Sequence
  dgRNA
  Paqr3
actggctggcgaagg

SEQ ID NO: 6635 - DNA, 15 bp, Artificial Sequence
  dgRNA
  Paqr3
gcgaaggaggaacta

SEQ ID NO: 6636 - DNA, 15 bp, Artificial Sequence
  dgRNA
  Paqr3
cgaaggaggaactag

SEQ ID NO: 6637 - DNA, 15 bp, Artificial Sequence
  dgRNA
  Osbpl2
tctccaaggggtgat

SEQ ID NO: 6638 - DNA, 15 bp, Artificial Sequence
  dgRNA
  Osbpl2
aaggggtgattggct

SEQ ID NO: 6639 - DNA, 15 bp, Artificial Sequence
  dgRNA
  Osbpl2
ctcccccgtgtgagc

SEQ ID NO: 6640 - DNA, 15 bp, Artificial Sequence
  dgRNA
  Osbpl2
gagccggattatgat

SEQ ID NO: 6641 - DNA, 15 bp, Artificial Sequence
  dgRNA
  Slc5a4b
gaacaggactaacaa

SEQ ID NO: 6642 - DNA, 15 bp, Artificial Sequence
  dgRNA
  Slc5a4b
ctaacaaagggccga

SEQ ID NO: 6643 - DNA, 15 bp, Artificial Sequence
  dgRNA
  Slc5a4b
taacaaagggccgaa

SEQ ID NO: 6644 - DNA, 15 bp, Artificial Sequence
  dgRNA
  Slc5a4b
agggccgaagggcca

SEQ ID NO: 6645 - DNA, 15 bp, Artificial Sequence
  dgRNA
  Hbb-bt
gtaacaccctggcat

SEQ ID NO: 6646 - DNA, 15 bp, Artificial Sequence
  dgRNA
  Hbb-bt
tacacagggtggcta

SEQ ID NO: 6647 - DNA, 15 bp, Artificial Sequence
  dgRNA
  Hbb-bt
aaccatatctacaca

SEQ ID NO: 6648 - DNA, 15 bp, Artificial Sequence
  dgRNA
  Hbb-bt
gggtgttaccctgca

SEQ ID NO: 6649 - DNA, 15 bp, Artificial Sequence
  dgRNA
  Itgax
ttacatatatccatc

SEQ ID NO: 6650 - DNA, 15 bp, Artificial Sequence
  dgRNA
  Itgax
catccgggcaagaat

SEQ ID NO: 6651 - DNA, 15 bp, Artificial Sequence
  dgRNA
  Itgax
atccgggcaagaatt

SEQ ID NO: 6652 - DNA, 15 bp, Artificial Sequence
  dgRNA
  Itgax
tccgggcaagaattg

SEQ ID NO: 6653 - DNA, 15 bp, Artificial Sequence
  dgRNA
  Serpinb6b
aacactcatgtagtg

SEQ ID NO: 6654 - DNA, 15 bp, Artificial Sequence
  dgRNA
  Serpinb6b
agggtgtccactagg

SEQ ID NO: 6655 - DNA, 15 bp, Artificial Sequence
  dgRNA
  Serpinb6b
aagggtgtccactag

SEQ ID NO: 6656 - DNA, 15 bp, Artificial Sequence
  dgRNA
  Serpinb6b
gaagggtgtccacta

SEQ ID NO: 6657 - DNA, 15 bp, Artificial Sequence
  dgRNA
  Olfr768
tcagggtgtattgtg

SEQ ID NO: 6658 - DNA, 15 bp, Artificial Sequence
  dgRNA
  Olfr768
catgagggatcatta

SEQ ID NO: 6659 - DNA, 15 bp, Artificial Sequence
  dgRNA
  Olfr768
gcatgagggatcatt

SEQ ID NO: 6660 - DNA, 15 bp, Artificial Sequence
  dgRNA
  Olfr768
ggattgtcagcatga

SEQ ID NO: 6661 - DNA, 15 bp, Artificial Sequence
  dgRNA
  Chuk
gaaccgcacgcacga

SEQ ID NO: 6662 - DNA, 15 bp, Artificial Sequence
  dgRNA
  Chuk
cacgatggtcctcgc

SEQ ID NO: 6663 - DNA, 15 bp, Artificial Sequence
  dgRNA
  Chuk
atggtcctcgcaggt

SEQ ID NO: 6664 - DNA, 15 bp, Artificial Sequence
  dgRNA
  Chuk
ggttggaagttgccc

SEQ ID NO: 6665 - DNA, 15 bp, Artificial Sequence
  dgRNA
  Olfr547
gtggatgtcactcat

SEQ ID NO: 6666 - DNA, 15 bp, Artificial Sequence
  dgRNA
  Olfr547
aggtttgatattgac

SEQ ID NO: 6667 - DNA, 15 bp, Artificial Sequence
  dgRNA
  Olfr547
ggtttgatattgaca

SEQ ID NO: 6668 - DNA, 15 bp, Artificial Sequence
  dgRNA
  Olfr547
tttggtgctatcact

SEQ ID NO: 6669 - DNA, 15 bp, Artificial Sequence
  dgRNA
  BC017643
atatcctgcttaact

SEQ ID NO: 6670 - DNA, 15 bp, Artificial Sequence
  dgRNA
  BC017643
tcttggttggccaag

SEQ ID NO: 6671 - DNA, 15 bp, Artificial Sequence
  dgRNA
  BC017643
caaggggctaaattc

SEQ ID NO: 6672 - DNA, 15 bp, Artificial Sequence
  dgRNA
  BC017643
cgtggtttagaagcc

SEQ ID NO: 6673 - DNA, 15 bp, Artificial Sequence
  dgRNA
  AW554918
tcgttcccgcgaccc

SEQ ID NO: 6674 - DNA, 15 bp, Artificial Sequence
  dgRNA
  AW554918
cccgcgaccctggcc

SEQ ID NO: 6675 - DNA, 15 bp, Artificial Sequence
  dgRNA
  AW554918
ccgcgaccctggccc

SEQ ID NO: 6676 - DNA, 15 bp, Artificial Sequence
  dgRNA
  AW554918
gaccccgcctcgcct

SEQ ID NO: 6677 - DNA, 15 bp, Artificial Sequence
  dgRNA
  Zfp59
ctccgtcttctctac

SEQ ID NO: 6678 - DNA, 15 bp, Artificial Sequence
  dgRNA
  Zfp59
agaaaatcagttacg

SEQ ID NO: 6679 - DNA, 15 bp, Artificial Sequence
  dgRNA
  Zfp59
agttacgcggagaac

SEQ ID NO: 6680 - DNA, 15 bp, Artificial Sequence
  dgRNA
  Zfp59
gtaccttttgctcaa

SEQ ID NO: 6681 - DNA, 15 bp, Artificial Sequence
  dgRNA
  Ap5b1
acagttactcagacc

SEQ ID NO: 6682 - DNA, 15 bp, Artificial Sequence
  dgRNA
  Ap5b1
cagacctggcgaaac

SEQ ID NO: 6683 - DNA, 15 bp, Artificial Sequence
  dgRNA
  Ap5b1
gcgaaaccggcgagt

SEQ ID NO: 6684 - DNA, 15 bp, Artificial Sequence
  dgRNA
  Ap5b1
cgagtcggcacctgc

SEQ ID NO: 6685 - DNA, 15 bp, Artificial Sequence
  dgRNA
  Olfr549
ccaagagacctgtta

SEQ ID NO: 6686 - DNA, 15 bp, Artificial Sequence
  dgRNA
  Olfr549
aagagacctgttatg

SEQ ID NO: 6687 - DNA, 15 bp, Artificial Sequence
  dgRNA
  Olfr549
acaaatgacctggcc

SEQ ID NO: 6688 - DNA, 15 bp, Artificial Sequence
  dgRNA
  Olfr549
ccataacaggtctct

SEQ ID NO: 6689 - DNA, 15 bp, Artificial Sequence
  dgRNA
  Mup10
ttcctcttcccgtat

SEQ ID NO: 6690 - DNA, 15 bp, Artificial Sequence
  dgRNA
  Mup10
gttcctcttcccgta

SEQ ID NO: 6691 - DNA, 15 bp, Artificial Sequence
  dgRNA
  D16Ertd472e
caagaggatgcgcac

SEQ ID NO: 6692 - DNA, 15 bp, Artificial Sequence
  dgRNA
  D16Ertd472e
aagaggatgcgcacg

SEQ ID NO: 6693 - DNA, 15 bp, Artificial Sequence
  dgRNA
  D16Ertd472e
agaggatgcgcacgg

SEQ ID NO: 6694 - DNA, 15 bp, Artificial Sequence
  dgRNA
  D16Ertd472e
atgcgcacgggggcg

SEQ ID NO: 6695 - DNA, 15 bp, Artificial Sequence
  dgRNA
  Sulf2
gtttagaggcgagcg

SEQ ID NO: 6696 - DNA, 15 bp, Artificial Sequence
  dgRNA
  Sulf2
tttagaggcgagcgc

SEQ ID NO: 6697 - DNA, 15 bp, Artificial Sequence
  dgRNA
  Sulf2
ttagaggcgagcgcg

SEQ ID NO: 6698 - DNA, 15 bp, Artificial Sequence
  dgRNA
  Sulf2
cggggctttcagcta

SEQ ID NO: 6699 - DNA, 15 bp, Artificial Sequence
  dgRNA
  Eif4h
gccgcagagcgcgcc

SEQ ID NO: 6700 - DNA, 15 bp, Artificial Sequence
  dgRNA
  Eif4h
ccgcagagcgcgccg

SEQ ID NO: 6701 - DNA, 15 bp, Artificial Sequence
  dgRNA
  Eif4h
cgccggggccagcag

SEQ ID NO: 6702 - DNA, 15 bp, Artificial Sequence
  dgRNA
  Eif4h
agcagcgggccccgt

SEQ ID NO: 6703 - DNA, 15 bp, Artificial Sequence
  dgRNA
  Tnk2
atttcctgctccgtt

SEQ ID NO: 6704 - DNA, 15 bp, Artificial Sequence
  dgRNA
  Tnk2
gagcctatgttccct

SEQ ID NO: 6705 - DNA, 15 bp, Artificial Sequence
  dgRNA
  Tnk2
agcctatgttccctc

SEQ ID NO: 6706 - DNA, 15 bp, Artificial Sequence
  dgRNA
  Tnk2
gcctatgttccctcg

SEQ ID NO: 6707 - DNA, 15 bp, Artificial Sequence
  dgRNA
  Pbdc1
tatcacctaggctag

SEQ ID NO: 6708 - DNA, 15 bp, Artificial Sequence
  dgRNA
  Pbdc1
acaacacgcgttcgc

SEQ ID NO: 6709 - DNA, 15 bp, Artificial Sequence
  dgRNA
  Pbdc1
tcgctggcgcctgcg

SEQ ID NO: 6710 - DNA, 15 bp, Artificial Sequence
  dgRNA
  Pbdc1
ggcgcctgcgtggcc

SEQ ID NO: 6711 - DNA, 15 bp, Artificial Sequence
  dgRNA
  Egr3
ccacggatcgcctct

SEQ ID NO: 6712 - DNA, 15 bp, Artificial Sequence
  dgRNA
  Egr3
cggatgccgctcgcc

SEQ ID NO: 6713 - DNA, 15 bp, Artificial Sequence
  dgRNA
  Egr3
agctgcgttaggaac

SEQ ID NO: 6714 - DNA, 15 bp, Artificial Sequence
  dgRNA
  Egr3
tgcgttaggaacagg

SEQ ID NO: 6715 - DNA, 15 bp, Artificial Sequence
  dgRNA
  Olfr1378
tcagttagactactc

SEQ ID NO: 6716 - DNA, 15 bp, Artificial Sequence
  dgRNA
  Olfr1378
aaatccaatcatacc

SEQ ID NO: 6717 - DNA, 15 bp, Artificial Sequence
  dgRNA
  Olfr1378
attgccaggtatgat

SEQ ID NO: 6718 - DNA, 15 bp, Artificial Sequence
  dgRNA
  Olfr1378
gaaagttccattgcc

SEQ ID NO: 6719 - DNA, 15 bp, Artificial Sequence
  dgRNA
  Paqr9
ggtcgcagcccgaga

SEQ ID NO: 6720 - DNA, 15 bp, Artificial Sequence
  dgRNA
  Paqr9
gtcgcagcccgagaa

SEQ ID NO: 6721 - DNA, 15 bp, Artificial Sequence
  dgRNA
  Paqr9
tcgcagcccgagaag

SEQ ID NO: 6722 - DNA, 15 bp, Artificial Sequence
  dgRNA
  Paqr9
cgcagcccgagaagg

SEQ ID NO: 6723 - DNA, 15 bp, Artificial Sequence
  dgRNA
  Hpgds
tggacgcgggtgaga

SEQ ID NO: 6724 - DNA, 15 bp, Artificial Sequence
  dgRNA
  Hpgds
cgggtgagaaggcac

SEQ ID NO: 6725 - DNA, 15 bp, Artificial Sequence
  dgRNA
  Hpgds
gaaggcacggggcaa

SEQ ID NO: 6726 - DNA, 15 bp, Artificial Sequence
  dgRNA
  Hpgds
ggcaaaggcgtctcc

SEQ ID NO: 6727 - DNA, 15 bp, Artificial Sequence
  dgRNA
  Suv420h2
agcgacccgagccat

SEQ ID NO: 6728 - DNA, 15 bp, Artificial Sequence
  dgRNA
  Suv420h2
ttggctgtagttcgc

SEQ ID NO: 6729 - DNA, 15 bp, Artificial Sequence
  dgRNA
  Suv420h2
ttgacagagtgggcg

SEQ ID NO: 6730 - DNA, 15 bp, Artificial Sequence
  dgRNA
  Suv420h2
tggaggggttttgtc

SEQ ID NO: 6731 - DNA, 15 bp, Artificial Sequence
  dgRNA
  Fastkd2
ctccgtgttttccta

SEQ ID NO: 6732 - DNA, 15 bp, Artificial Sequence
  dgRNA
  Fastkd2
ctccctatttgcaca

SEQ ID NO: 6733 - DNA, 15 bp, Artificial Sequence
  dgRNA
  Fastkd2
atctattgttgttta

SEQ ID NO: 6734 - DNA, 15 bp, Artificial Sequence
  dgRNA
  Fastkd2
agaagcgagagcctt

SEQ ID NO: 6735 - DNA, 15 bp, Artificial Sequence
  dgRNA
  Suds3
ccgccccttccgccg

SEQ ID NO: 6736 - DNA, 15 bp, Artificial Sequence
  dgRNA
  Suds3
cgccgtggccgatcg

SEQ ID NO: 6737 - DNA, 15 bp, Artificial Sequence
  dgRNA
  Suds3
acagtgacgccgccg

SEQ ID NO: 6738 - DNA, 15 bp, Artificial Sequence
  dgRNA
  Suds3
ccgtgtcagaaaccg

SEQ ID NO: 6739 - DNA, 15 bp, Artificial Sequence
  dgRNA
  Bdkrb2
tgctgctgatcccgg

SEQ ID NO: 6740 - DNA, 15 bp, Artificial Sequence
  dgRNA
  Bdkrb2
atcccggagggagcc

SEQ ID NO: 6741 - DNA, 15 bp, Artificial Sequence
  dgRNA
  Bdkrb2
gctgatctggactag

SEQ ID NO: 6742 - DNA, 15 bp, Artificial Sequence
  dgRNA
  Bdkrb2
ccagcttcgctcctc

SEQ ID NO: 6743 - DNA, 15 bp, Artificial Sequence
  dgRNA
  Cyp2d10
cctttataaggcagc

SEQ ID NO: 6744 - DNA, 15 bp, Artificial Sequence
  dgRNA
  Cyp2d10
taggcagatatctcg

SEQ ID NO: 6745 - DNA, 15 bp, Artificial Sequence
  dgRNA
  Cyp2d10
tgtccacctgtaggg

SEQ ID NO: 6746 - DNA, 15 bp, Artificial Sequence
  dgRNA
  Cyp2d10
cctgctgccttataa

SEQ ID NO: 6747 - DNA, 15 bp, Artificial Sequence
  dgRNA
  Nop9
tgattcttgccacgt

SEQ ID NO: 6748 - DNA, 15 bp, Artificial Sequence
  dgRNA
  Nop9
gttggagtgcgtgcc

SEQ ID NO: 6749 - DNA, 15 bp, Artificial Sequence
  dgRNA
  Nop9
cggataacgatgata

SEQ ID NO: 6750 - DNA, 15 bp, Artificial Sequence
  dgRNA
  Nop9
agggtcagacccagt

SEQ ID NO: 6751 - DNA, 15 bp, Artificial Sequence
  dgRNA
  B020004C17Rik
cctaaacatacaggt

SEQ ID NO: 6752 - DNA, 15 bp, Artificial Sequence
  dgRNA
  B020004C17Rik
aacatacaggtcggg

SEQ ID NO: 6753 - DNA, 15 bp, Artificial Sequence
  dgRNA
  B020004C17Rik
accgagctcataagc

SEQ ID NO: 6754 - DNA, 15 bp, Artificial Sequence
  dgRNA
  B020004C17Rik
gctcaattatcaacc

SEQ ID NO: 6755 - DNA, 15 bp, Artificial Sequence
  dgRNA
  Mlc1
gttgctgtaattgcc

SEQ ID NO: 6756 - DNA, 15 bp, Artificial Sequence
  dgRNA
  Mlc1
ggtgccaatgtctcc

SEQ ID NO: 6757 - DNA, 15 bp, Artificial Sequence
  dgRNA
  Mlc1
ccttggggctgccat

SEQ ID NO: 6758 - DNA, 15 bp, Artificial Sequence
  dgRNA
  Mlc1
gagacattggcaccc

SEQ ID NO: 6759 - DNA, 15 bp, Artificial Sequence
  dgRNA
  Cecr2
tgttgtggtgcgcgc

SEQ ID NO: 6760 - DNA, 15 bp, Artificial Sequence
  dgRNA
  Cecr2
ccccctcctcgtggg

SEQ ID NO: 6761 - DNA, 15 bp, Artificial Sequence
  dgRNA
  Cecr2
gtggattatattgta

SEQ ID NO: 6762 - DNA, 15 bp, Artificial Sequence
  dgRNA
  Cecr2
tatattgtatgggat

SEQ ID NO: 6763 - DNA, 15 bp, Artificial Sequence
  dgRNA
  Tgfa
ccgccgcctacagcc

SEQ ID NO: 6764 - DNA, 15 bp, Artificial Sequence
  dgRNA
  Tgfa
cctacagcctggacg

SEQ ID NO: 6765 - DNA, 15 bp, Artificial Sequence
  dgRNA
  Tgfa
acgcggctactacgc

SEQ ID NO: 6766 - DNA, 15 bp, Artificial Sequence
  dgRNA
  Tgfa
cgcggctactacgca

SEQ ID NO: 6767 - DNA, 15 bp, Artificial Sequence
  dgRNA
  Cyp4f13
ccatccctttaaggt

SEQ ID NO: 6768 - DNA, 15 bp, Artificial Sequence
  dgRNA
  Cyp4f13
tggacccgcccccac

SEQ ID NO: 6769 - DNA, 15 bp, Artificial Sequence
  dgRNA
  Cyp4f13
cgcccccactggcct

SEQ ID NO: 6770 - DNA, 15 bp, Artificial Sequence
  dgRNA
  Cyp4f13
gtcataggcttaggt

SEQ ID NO: 6771 - DNA, 15 bp, Artificial Sequence
  dgRNA
  Map2k7
cacgcatgcgcactg

SEQ ID NO: 6772 - DNA, 15 bp, Artificial Sequence
  dgRNA
  Map2k7
catgcgcactgcgga

SEQ ID NO: 6773 - DNA, 15 bp, Artificial Sequence
  dgRNA
  Map2k7
gcggaaggcagcgat

SEQ ID NO: 6774 - DNA, 15 bp, Artificial Sequence
  dgRNA
  Map2k7
ccatgacaatgcatg

SEQ ID NO: 6775 - DNA, 15 bp, Artificial Sequence
  dgRNA
  Nhlh2
aagtgactcgtgtcc

SEQ ID NO: 6776 - DNA, 15 bp, Artificial Sequence
  dgRNA
  Nhlh2
cacgagtcacttaat

SEQ ID NO: 6777 - DNA, 15 bp, Artificial Sequence
  dgRNA
  Nhlh2
gataaaggcttaaga

SEQ ID NO: 6778 - DNA, 15 bp, Artificial Sequence
  dgRNA
  Fat3
gtattgatgctttaa

SEQ ID NO: 6779 - DNA, 15 bp, Artificial Sequence
  dgRNA
  Fat3
atcacatgtccgtcc

SEQ ID NO: 6780 - DNA, 15 bp, Artificial Sequence
  dgRNA
  Zkscan14
atgactgtcatgacg

SEQ ID NO: 6781 - DNA, 15 bp, Artificial Sequence
  dgRNA
  Zkscan14
tcatgacgtggcctg

SEQ ID NO: 6782 - DNA, 15 bp, Artificial Sequence
  dgRNA
  Zkscan14
gcatcttagtcctcc

SEQ ID NO: 6783 - DNA, 15 bp, Artificial Sequence
  dgRNA
  Zkscan14
agaaagaccttacgc

SEQ ID NO: 6784 - DNA, 15 bp, Artificial Sequence
  dgRNA
  Ulk2
gttcctaagcagccg

SEQ ID NO: 6785 - DNA, 15 bp, Artificial Sequence
  dgRNA
  Ulk2
actgcagactcgccc

SEQ ID NO: 6786 - DNA, 15 bp, Artificial Sequence
  dgRNA
  Ulk2
actcgccccggtgcc

SEQ ID NO: 6787 - DNA, 15 bp, Artificial Sequence
  dgRNA
  Ulk2
cctggcgccgcgtcc

SEQ ID NO: 6788 - DNA, 15 bp, Artificial Sequence
  dgRNA
  Glis1
gagtcgcggcccgag

SEQ ID NO: 6789 - DNA, 15 bp, Artificial Sequence
  dgRNA
  Glis1
cggcccgagcggctg

SEQ ID NO: 6790 - DNA, 15 bp, Artificial Sequence
  dgRNA
  Glis1
ggggtgtcgccccgt

SEQ ID NO: 6791 - DNA, 15 bp, Artificial Sequence
  dgRNA
  Glis1
tcgccccgtaggacg

SEQ ID NO: 6792 - DNA, 15 bp, Artificial Sequence
  dgRNA
  Cxcl1
cccctttgggacttt

SEQ ID NO: 6793 - DNA, 15 bp, Artificial Sequence
  dgRNA
  Cxcl1
tctaatccttgggag

SEQ ID NO: 6794 - DNA, 15 bp, Artificial Sequence
  dgRNA
  Cxcl1
gagcgatgtcctttc

SEQ ID NO: 6795 - DNA, 15 bp, Artificial Sequence
  dgRNA
  Cxcl1
gtcctttccggttgc

SEQ ID NO: 6796 - DNA, 15 bp, Artificial Sequence
  dgRNA
  Cdkal1
atctcttaactgtgc

SEQ ID NO: 6797 - DNA, 15 bp, Artificial Sequence
  dgRNA
  Cdkal1
gcaggacaagttata

SEQ ID NO: 6798 - DNA, 15 bp, Artificial Sequence
  dgRNA
  Cdkal1
taagctaacataatg

SEQ ID NO: 6799 - DNA, 15 bp, Artificial Sequence
  dgRNA
  Cdkal1
ctaacataatgaggt

SEQ ID NO: 6800 - DNA, 15 bp, Artificial Sequence
  dgRNA
  Olfr362
tggcatcattgaatt

SEQ ID NO: 6801 - DNA, 15 bp, Artificial Sequence
  dgRNA
  I830077J02Rik
agtatcattcacagc

SEQ ID NO: 6802 - DNA, 15 bp, Artificial Sequence
  dgRNA
  I830077J02Rik
ccattggcctcaaag

SEQ ID NO: 6803 - DNA, 15 bp, Artificial Sequence
  dgRNA
  I830077J02Rik
ttgcgacacagcctg

SEQ ID NO: 6804 - DNA, 15 bp, Artificial Sequence
  dgRNA
  I830077J02Rik
tgcgacacagcctga

SEQ ID NO: 6805 - DNA, 15 bp, Artificial Sequence
  dgRNA
  Fbxo9
tcagcatcaaacagg

SEQ ID NO: 6806 - DNA, 15 bp, Artificial Sequence
  dgRNA
  Fbxo9
gcttagctccaccga

SEQ ID NO: 6807 - DNA, 15 bp, Artificial Sequence
  dgRNA
  Fbxo9
caccctagctcgcga

SEQ ID NO: 6808 - DNA, 15 bp, Artificial Sequence
  dgRNA
  Fbxo9
accctagctcgcgac

SEQ ID NO: 6809 - DNA, 15 bp, Artificial Sequence
  dgRNA
  Tas2r139
gtcataggagttgtc

SEQ ID NO: 6810 - DNA, 15 bp, Artificial Sequence
  dgRNA
  Uroc1
catacccatctaact

SEQ ID NO: 6811 - DNA, 15 bp, Artificial Sequence
  dgRNA
  Uroc1
atacccatctaactt

SEQ ID NO: 6812 - DNA, 15 bp, Artificial Sequence
  dgRNA
  Uroc1
ttgggtatgacccca

SEQ ID NO: 6813 - DNA, 15 bp, Artificial Sequence
  dgRNA
  Uroc1
tggcaagtaacactc

SEQ ID NO: 6814 - DNA, 15 bp, Artificial Sequence
  dgRNA
  Cyp2a22
tccctgggcgtataa

SEQ ID NO: 6815 - DNA, 15 bp, Artificial Sequence
  dgRNA
  Cyp2a22
gcttaaagccttgct

SEQ ID NO: 6816 - DNA, 15 bp, Artificial Sequence
  dgRNA
  Cyp2a22
acctttatacgccca

SEQ ID NO: 6817 - DNA, 15 bp, Artificial Sequence
  dgRNA
  Cyp2a22
tacctttatacgccc

SEQ ID NO: 6818 - DNA, 15 bp, Artificial Sequence
  dgRNA
  Zzef1
gcagaggcggctaga

SEQ ID NO: 6819 - DNA, 15 bp, Artificial Sequence
  dgRNA
  Zzef1
agacggatacgttaa

SEQ ID NO: 6820 - DNA, 15 bp, Artificial Sequence
  dgRNA
  Zzef1
ggatacgttaacggg

SEQ ID NO: 6821 - DNA, 15 bp, Artificial Sequence
  dgRNA
  Zzef1
gatacgttaacgggt

SEQ ID NO: 6822 - DNA, 15 bp, Artificial Sequence
  dgRNA
  Vash1
gccctaaaaaaagag

SEQ ID NO: 6823 - DNA, 15 bp, Artificial Sequence
  dgRNA
  Vash1
caataacttgtagct

SEQ ID NO: 6824 - DNA, 15 bp, Artificial Sequence
  dgRNA
  Vash1
ataacttgtagctag

SEQ ID NO: 6825 - DNA, 15 bp, Artificial Sequence
  dgRNA
  Vash1
tgtagctaggggctt

SEQ ID NO: 6826 - DNA, 15 bp, Artificial Sequence
  dgRNA
  Celf3
ttgttgaggagagcg

SEQ ID NO: 6827 - DNA, 15 bp, Artificial Sequence
  dgRNA
  Celf3
tgaggagagcgcggc

SEQ ID NO: 6828 - DNA, 15 bp, Artificial Sequence
  dgRNA
  Celf3
cgggacccaggtgac

SEQ ID NO: 6829 - DNA, 15 bp, Artificial Sequence
  dgRNA
  Celf3
ggtgaccgggaaagc

SEQ ID NO: 6830 - DNA, 15 bp, Artificial Sequence
  dgRNA
  Pgs1
gtgagttgagggcgt

SEQ ID NO: 6831 - DNA, 15 bp, Artificial Sequence
  dgRNA
  Pgs1
tgagttgagggcgta

SEQ ID NO: 6832 - DNA, 15 bp, Artificial Sequence
  dgRNA
  Pgs1
gagggcgtagggctc

SEQ ID NO: 6833 - DNA, 15 bp, Artificial Sequence
  dgRNA
  Pgs1
tgagtttaatgcgca

SEQ ID NO: 6834 - DNA, 15 bp, Artificial Sequence
  dgRNA
  Cpsf4
agaaccgaaagaaac

SEQ ID NO: 6835 - DNA, 15 bp, Artificial Sequence
  dgRNA
  Cpsf4
aaacaggcgatcggt

SEQ ID NO: 6836 - DNA, 15 bp, Artificial Sequence
  dgRNA
  Cpsf4
caggcgatcggtcgg

SEQ ID NO: 6837 - DNA, 15 bp, Artificial Sequence
  dgRNA
  Cpsf4
ggtcggcggctagtc

SEQ ID NO: 6838 - DNA, 15 bp, Artificial Sequence
  dgRNA
  Spp1
aggtgggccgggtag

SEQ ID NO: 6839 - DNA, 15 bp, Artificial Sequence
  dgRNA
  Spp1
actccacctcctgat

SEQ ID NO: 6840 - DNA, 15 bp, Artificial Sequence
  dgRNA
  Spp1
gtttttgccactacc

SEQ ID NO: 6841 - DNA, 15 bp, Artificial Sequence
  dgRNA
  Spp1
tctccaccaatcagg

SEQ ID NO: 6842 - DNA, 15 bp, Artificial Sequence
  dgRNA
  Olfr1195
attagctttaccaca

SEQ ID NO: 6843 - DNA, 15 bp, Artificial Sequence
  dgRNA
  Cad
cagctcactacgctt

SEQ ID NO: 6844 - DNA, 15 bp, Artificial Sequence
  dgRNA
  Cad
agctcactacgctta

SEQ ID NO: 6845 - DNA, 15 bp, Artificial Sequence
  dgRNA
  Cad
ctacgcttagggctc

SEQ ID NO: 6846 - DNA, 15 bp, Artificial Sequence
  dgRNA
  Cad
gcgcagcgagccacg

SEQ ID NO: 6847 - DNA, 15 bp, Artificial Sequence
  dgRNA
  Myo15
ctataatcaccagga

SEQ ID NO: 6848 - DNA, 15 bp, Artificial Sequence
  dgRNA
  Myo15
tatacattgggcccc

SEQ ID NO: 6849 - DNA, 15 bp, Artificial Sequence
  dgRNA
  Myo15
acattgggccccagg

SEQ ID NO: 6850 - DNA, 15 bp, Artificial Sequence
  dgRNA
  Myo15
cacattgaccgcctg

SEQ ID NO: 6851 - DNA, 15 bp, Artificial Sequence
  dgRNA
  St6galnac6
gtgatctccgcgttt

SEQ ID NO: 6852 - DNA, 15 bp, Artificial Sequence
  dgRNA
  St6galnac6
cggattccccatccg

SEQ ID NO: 6853 - DNA, 15 bp, Artificial Sequence
  dgRNA
  St6galnac6
ccccatccgaggtcc

SEQ ID NO: 6854 - DNA, 15 bp, Artificial Sequence
  dgRNA
  St6galnac6
tttgggatggggcgc

SEQ ID NO: 6855 - DNA, 15 bp, Artificial Sequence
  dgRNA
  Crcp
atgagccagtatgac

SEQ ID NO: 6856 - DNA, 15 bp, Artificial Sequence
  dgRNA
  Crcp
cagtatgaccggttt

SEQ ID NO: 6857 - DNA, 15 bp, Artificial Sequence
  dgRNA
  Crcp
agtatgaccggttta

SEQ ID NO: 6858 - DNA, 15 bp, Artificial Sequence
  dgRNA
  Crcp
attttaatgcggcca

SEQ ID NO: 6859 - DNA, 15 bp, Artificial Sequence
  dgRNA
  Adad2
agacctgccctcgcg

SEQ ID NO: 6860 - DNA, 15 bp, Artificial Sequence
  dgRNA
  Adad2
ctcgcgcggtacagt

SEQ ID NO: 6861 - DNA, 15 bp, Artificial Sequence
  dgRNA
  Adad2
gcgcggtacagttgg

SEQ ID NO: 6862 - DNA, 15 bp, Artificial Sequence
  dgRNA
  Adad2
cgcggtacagttggc

SEQ ID NO: 6863 - DNA, 15 bp, Artificial Sequence
  dgRNA
  Mrpl38
cccgcgcgatccaac

SEQ ID NO: 6864 - DNA, 15 bp, Artificial Sequence
  dgRNA
  Mrpl38
tagactttgcgccaa

SEQ ID NO: 6865 - DNA, 15 bp, Artificial Sequence
  dgRNA
  Mrpl38
agactttgcgccaat

SEQ ID NO: 6866 - DNA, 15 bp, Artificial Sequence
  dgRNA
  Mrpl38
tttgcgccaatggga

SEQ ID NO: 6867 - DNA, 15 bp, Artificial Sequence
  dgRNA
  Copg2
ttgttgtctcagacc

SEQ ID NO: 6868 - DNA, 15 bp, Artificial Sequence
  dgRNA
  Copg2
agagtttgtgaagcg

SEQ ID NO: 6869 - DNA, 15 bp, Artificial Sequence
  dgRNA
  Copg2
ttgtgaagcggggcg

SEQ ID NO: 6870 - DNA, 15 bp, Artificial Sequence
  dgRNA
  Copg2
ggcgtggtgagcctc

SEQ ID NO: 6871 - DNA, 15 bp, Artificial Sequence
  dgRNA
  Spink2
cctcgctcccttctt

SEQ ID NO: 6872 - DNA, 15 bp, Artificial Sequence
  dgRNA
  Spink2
cttcgcactcccgcg

SEQ ID NO: 6873 - DNA, 15 bp, Artificial Sequence
  dgRNA
  Spink2
cccgcgcggtgccag

SEQ ID NO: 6874 - DNA, 15 bp, Artificial Sequence
  dgRNA
  Spink2
ccgcgcggtgccagc

SEQ ID NO: 6875 - DNA, 15 bp, Artificial Sequence
  dgRNA
  Map1s
ctcccaaagcctagc

SEQ ID NO: 6876 - DNA, 15 bp, Artificial Sequence
  dgRNA
  Map1s
agcgggcattgacag

SEQ ID NO: 6877 - DNA, 15 bp, Artificial Sequence
  dgRNA
  Map1s
gcgggcattgacaga

SEQ ID NO: 6878 - DNA, 15 bp, Artificial Sequence
  dgRNA
  Map1s
aggagggggcgcttc

SEQ ID NO: 6879 - DNA, 15 bp, Artificial Sequence
  dgRNA
  Ache
gtctgaatctaccac

SEQ ID NO: 6880 - DNA, 15 bp, Artificial Sequence
  dgRNA
  Ache
tgggctcccgctccc

SEQ ID NO: 6881 - DNA, 15 bp, Artificial Sequence
  dgRNA
  Ache
gggctcccgctcccc

SEQ ID NO: 6882 - DNA, 15 bp, Artificial Sequence
  dgRNA
  Ache
cgctccccggggtct

SEQ ID NO: 6883 - DNA, 15 bp, Artificial Sequence
  dgRNA
  Usp45
taatcagttggctgc

SEQ ID NO: 6884 - DNA, 15 bp, Artificial Sequence
  dgRNA
  Usp45
aatcagttggctgca

SEQ ID NO: 6885 - DNA, 15 bp, Artificial Sequence
  dgRNA
  Usp45
cctccaagccgccaa

SEQ ID NO: 6886 - DNA, 15 bp, Artificial Sequence
  dgRNA
  Usp45
tcaaagtcccgcctt

SEQ ID NO: 6887 - DNA, 15 bp, Artificial Sequence
  dgRNA
  Dhh
gctagatcccccgcc

SEQ ID NO: 6888 - DNA, 15 bp, Artificial Sequence
  dgRNA
  Dhh
ctagatcccccgccc

SEQ ID NO: 6889 - DNA, 15 bp, Artificial Sequence
  dgRNA
  Dhh
gatcccccgcccggg

SEQ ID NO: 6890 - DNA, 15 bp, Artificial Sequence
  dgRNA
  Dhh
atcccccgcccgggt

SEQ ID NO: 6891 - DNA, 15 bp, Artificial Sequence
  dgRNA
  Sertad2
gaggcgggtccggac

SEQ ID NO: 6892 - DNA, 15 bp, Artificial Sequence
  dgRNA
  Sertad2
gtccggaccggctgg

SEQ ID NO: 6893 - DNA, 15 bp, Artificial Sequence
  dgRNA
  Sertad2
ggaccggctggaggc

SEQ ID NO: 6894 - DNA, 15 bp, Artificial Sequence
  dgRNA
  Sertad2
gaccggctggaggcg

SEQ ID NO: 6895 - DNA, 15 bp, Artificial Sequence
  dgRNA
  Alpl
gccaggatgagccgc

SEQ ID NO: 6896 - DNA, 15 bp, Artificial Sequence
  dgRNA
  Alpl
ccaggatgagccgca

SEQ ID NO: 6897 - DNA, 15 bp, Artificial Sequence
  dgRNA
  Alpl
cctgttgcagcccta

SEQ ID NO: 6898 - DNA, 15 bp, Artificial Sequence
  dgRNA
  Alpl
tgcagccctacgggc

SEQ ID NO: 6899 - DNA, 15 bp, Artificial Sequence
  dgRNA
  Jakmip1
atgtgtcccccaagc

SEQ ID NO: 6900 - DNA, 15 bp, Artificial Sequence
  dgRNA
  Jakmip1
ggaacaggtgcttta

SEQ ID NO: 6901 - DNA, 15 bp, Artificial Sequence
  dgRNA
  Poc5
cccgtagtagtcctc

SEQ ID NO: 6902 - DNA, 15 bp, Artificial Sequence
  dgRNA
  Poc5
gcatgcgctctgttc

SEQ ID NO: 6903 - DNA, 15 bp, Artificial Sequence
  dgRNA
  Poc5
catgcgctctgttct

SEQ ID NO: 6904 - DNA, 15 bp, Artificial Sequence
  dgRNA
  Poc5
taaatctcctacttc

SEQ ID NO: 6905 - DNA, 15 bp, Artificial Sequence
  dgRNA
  Ftsj1
actagccgagaactc

SEQ ID NO: 6906 - DNA, 15 bp, Artificial Sequence
  dgRNA
  Ftsj1
ccggatcgcagctat

SEQ ID NO: 6907 - DNA, 15 bp, Artificial Sequence
  dgRNA
  Ftsj1
gcagctataggaccc

SEQ ID NO: 6908 - DNA, 15 bp, Artificial Sequence
  dgRNA
  Ftsj1
gccttgcaaaactat

SEQ ID NO: 6909 - DNA, 15 bp, Artificial Sequence
  dgRNA
  Vmn2r48
acgtgtttattatat

SEQ ID NO: 6910 - DNA, 15 bp, Artificial Sequence
  dgRNA
  Hyal4
tcagcgaatttaagt

SEQ ID NO: 6911 - DNA, 15 bp, Artificial Sequence
  dgRNA
  Hyal4
gcttccgggagcagt

SEQ ID NO: 6912 - DNA, 15 bp, Artificial Sequence
  dgRNA
  Hyal4
gattgggattccagt

SEQ ID NO: 6913 - DNA, 15 bp, Artificial Sequence
  dgRNA
  Hyal4
aagcctgtcattaca

SEQ ID NO: 6914 - DNA, 15 bp, Artificial Sequence
  dgRNA
  Olfr313
caatgccatttacat

SEQ ID NO: 6915 - DNA, 15 bp, Artificial Sequence
  dgRNA
  Olfr313
cctctgtagtcaacg

SEQ ID NO: 6916 - DNA, 15 bp, Artificial Sequence
  dgRNA
  Olfr313
ccacgttgactacag

SEQ ID NO: 6917 - DNA, 15 bp, Artificial Sequence
  dgRNA
  Dtymk
cacagtccttaagat

SEQ ID NO: 6918 - DNA, 15 bp, Artificial Sequence
  dgRNA
  Dtymk
aagattggtgctctt

SEQ ID NO: 6919 - DNA, 15 bp, Artificial Sequence
  dgRNA
  Dtymk
ggtgctcttcgggag

SEQ ID NO: 6920 - DNA, 15 bp, Artificial Sequence
  dgRNA
  Dtymk
ttcgggagcggcgaa

SEQ ID NO: 6921 - DNA, 15 bp, Artificial Sequence
  dgRNA
  Mapkapk2
cccgggttaagaact

SEQ ID NO: 6922 - DNA, 15 bp, Artificial Sequence
  dgRNA
  Mapkapk2
aagctctcccgccac

SEQ ID NO: 6923 - DNA, 15 bp, Artificial Sequence
  dgRNA
  Mapkapk2
acttcctccccttta

SEQ ID NO: 6924 - DNA, 15 bp, Artificial Sequence
  dgRNA
  Mapkapk2
tttaaggactagccc

SEQ ID NO: 6925 - DNA, 15 bp, Artificial Sequence
  dgRNA
  Adam23
cagcgcggcccatgc

SEQ ID NO: 6926 - DNA, 15 bp, Artificial Sequence
  dgRNA
  Adam23
acccgaaaccccgtt

SEQ ID NO: 6927 - DNA, 15 bp, Artificial Sequence
  dgRNA
  Adam23
cccgaaaccccgttc

SEQ ID NO: 6928 - DNA, 15 bp, Artificial Sequence
  dgRNA
  Adam23
gttcgggcgcgctcc

SEQ ID NO: 6929 - DNA, 15 bp, Artificial Sequence
  dgRNA
  Als2cl
aggcgaaagacagcc

SEQ ID NO: 6930 - DNA, 15 bp, Artificial Sequence
  dgRNA
  Als2cl
gccagggtgcgatcc

SEQ ID NO: 6931 - DNA, 15 bp, Artificial Sequence
  dgRNA
  Als2cl
ccagggtgcgatcct

SEQ ID NO: 6932 - DNA, 15 bp, Artificial Sequence
  dgRNA
  Als2cl
cagggtgcgatcctg

SEQ ID NO: 6933 - DNA, 15 bp, Artificial Sequence
  dgRNA
  Pex5
aatcctggcgttcta

SEQ ID NO: 6934 - DNA, 15 bp, Artificial Sequence
  dgRNA
  Pex5
tctagggactactgc

SEQ ID NO: 6935 - DNA, 15 bp, Artificial Sequence
  dgRNA
  Pex5
ccaatccaactgtcc

SEQ ID NO: 6936 - DNA, 15 bp, Artificial Sequence
  dgRNA
  Pex5
cgctgcgcaagcttg

SEQ ID NO: 6937 - DNA, 15 bp, Artificial Sequence
  dgRNA
  Tbce
gtacgcaaaatcgac

SEQ ID NO: 6938 - DNA, 15 bp, Artificial Sequence
  dgRNA
  Tbce
tcccacagtccttcg

SEQ ID NO: 6939 - DNA, 15 bp, Artificial Sequence
  dgRNA
  Tbce
tcggggttgcagttc

SEQ ID NO: 6940 - DNA, 15 bp, Artificial Sequence
  dgRNA
  Tbce
gcacttcgcgacaat

SEQ ID NO: 6941 - DNA, 15 bp, Artificial Sequence
  dgRNA
  Fchsd2
ttcccgggccgggcg

SEQ ID NO: 6942 - DNA, 15 bp, Artificial Sequence
  dgRNA
  Fchsd2
ccgggcgggggcgtt

SEQ ID NO: 6943 - DNA, 15 bp, Artificial Sequence
  dgRNA
  Fchsd2
gcgttgggcaccgcg

SEQ ID NO: 6944 - DNA, 15 bp, Artificial Sequence
  dgRNA
  Fchsd2
cgttgggcaccgcga

SEQ ID NO: 6945 - DNA, 15 bp, Artificial Sequence
  dgRNA
  Iapp
cgcatcaggggccgt

SEQ ID NO: 6946 - DNA, 15 bp, Artificial Sequence
  dgRNA
  Iapp
gtgatggcgcatcag

SEQ ID NO: 6947 - DNA, 15 bp, Artificial Sequence
  dgRNA
  Iapp
ggtgatggcgcatca

SEQ ID NO: 6948 - DNA, 15 bp, Artificial Sequence
  dgRNA
  Iapp
gggtgatggcgcatc

SEQ ID NO: 6949 - DNA, 15 bp, Artificial Sequence
  dgRNA
  Dusp18
gacctaaaaccatgg

SEQ ID NO: 6950 - DNA, 15 bp, Artificial Sequence
  dgRNA
  Dusp18
agcaactatctacac

SEQ ID NO: 6951 - DNA, 15 bp, Artificial Sequence
  dgRNA
  Dusp18
ctggagtgcgttgcc

SEQ ID NO: 6952 - DNA, 15 bp, Artificial Sequence
  dgRNA
  Dusp18
tggagtgcgttgcct

SEQ ID NO: 6953 - DNA, 15 bp, Artificial Sequence
  dgRNA
  Tada1
cctgcagtcagggcg

SEQ ID NO: 6954 - DNA, 15 bp, Artificial Sequence
  dgRNA
  Tada1
cggggcctggccgga

SEQ ID NO: 6955 - DNA, 15 bp, Artificial Sequence
  dgRNA
  Tada1
gtcaagttcgcgccc

SEQ ID NO: 6956 - DNA, 15 bp, Artificial Sequence
  dgRNA
  Tada1
tcaagttcgcgcccc

SEQ ID NO: 6957 - DNA, 15 bp, Artificial Sequence
  dgRNA
  Zfp646
attctagtcccagtt

SEQ ID NO: 6958 - DNA, 15 bp, Artificial Sequence
  dgRNA
  Zfp646
ccagtttgggaagcg

SEQ ID NO: 6959 - DNA, 15 bp, Artificial Sequence
  dgRNA
  Zfp646
ctcgcttcccaaact

SEQ ID NO: 6960 - DNA, 15 bp, Artificial Sequence
  dgRNA
  Zfp646
cctcgcttcccaaac

SEQ ID NO: 6961 - DNA, 15 bp, Artificial Sequence
  dgRNA
  Cog4
tcaacctcccccgcg

SEQ ID NO: 6962 - DNA, 15 bp, Artificial Sequence
  dgRNA
  Cog4
acctcccccgcgtgg

SEQ ID NO: 6963 - DNA, 15 bp, Artificial Sequence
  dgRNA
  Cog4
actcgcaagccttaa

SEQ ID NO: 6964 - DNA, 15 bp, Artificial Sequence
  dgRNA
  Cog4
ggcgaagagtccacg

SEQ ID NO: 6965 - DNA, 15 bp, Artificial Sequence
  dgRNA
  Alkbh1
tgcgagtttgtacat

SEQ ID NO: 6966 - DNA, 15 bp, Artificial Sequence
  dgRNA
  Alkbh1
actcactcgctgccg

SEQ ID NO: 6967 - DNA, 15 bp, Artificial Sequence
  dgRNA
  Alkbh1
cgctgccgcggtcca

SEQ ID NO: 6968 - DNA, 15 bp, Artificial Sequence
  dgRNA
  Alkbh1
tctgacaaacgcaat

SEQ ID NO: 6969 - DNA, 15 bp, Artificial Sequence
  dgRNA
  Vsig10l
ccaccatatcatgcc

SEQ ID NO: 6970 - DNA, 15 bp, Artificial Sequence
  dgRNA
  Vsig10l
tggacttgtcagacc

SEQ ID NO: 6971 - DNA, 15 bp, Artificial Sequence
  dgRNA
  Vsig10l
ggacttgtcagacct

SEQ ID NO: 6972 - DNA, 15 bp, Artificial Sequence
  dgRNA
  Vsig10l
gtgtagtgtcctctc

SEQ ID NO: 6973 - DNA, 15 bp, Artificial Sequence
  dgRNA
  2310022B05Rik
ccggaaagcgtccta

SEQ ID NO: 6974 - DNA, 15 bp, Artificial Sequence
  dgRNA
  2310022B05Rik
gaaagcgtcctatgg

SEQ ID NO: 6975 - DNA, 15 bp, Artificial Sequence
  dgRNA
  2310022B05Rik
ttgaagggccataac

SEQ ID NO: 6976 - DNA, 15 bp, Artificial Sequence
  dgRNA
  2310022B05Rik
aagggccataacagg

SEQ ID NO: 6977 - DNA, 15 bp, Artificial Sequence
  dgRNA
  Napsa
agtaaaatccataga

SEQ ID NO: 6978 - DNA, 15 bp, Artificial Sequence
  dgRNA
  Napsa
gtaaaatccatagag

SEQ ID NO: 6979 - DNA, 15 bp, Artificial Sequence
  dgRNA
  Napsa
aatccatagaggggc

SEQ ID NO: 6980 - DNA, 15 bp, Artificial Sequence
  dgRNA
  Napsa
actcagttacaatag

SEQ ID NO: 6981 - DNA, 15 bp, Artificial Sequence
  dgRNA
  Lamp5
cagaattcggagctc

SEQ ID NO: 6982 - DNA, 15 bp, Artificial Sequence
  dgRNA
  Lamp5
aattcggagctccgg

SEQ ID NO: 6983 - DNA, 15 bp, Artificial Sequence
  dgRNA
  Lamp5
catactggctgtacc

SEQ ID NO: 6984 - DNA, 15 bp, Artificial Sequence
  dgRNA
  Lamp5
tagatataacaccac

SEQ ID NO: 6985 - DNA, 15 bp, Artificial Sequence
  dgRNA
  Men1
gatgaccaatcgttg

SEQ ID NO: 6986 - DNA, 15 bp, Artificial Sequence
  dgRNA
  Men1
tcagcttacccgccc

SEQ ID NO: 6987 - DNA, 15 bp, Artificial Sequence
  dgRNA
  Men1
ttccataagccattg

SEQ ID NO: 6988 - DNA, 15 bp, Artificial Sequence
  dgRNA
  Men1
tccataagccattgc

SEQ ID NO: 6989 - DNA, 15 bp, Artificial Sequence
  dgRNA
  Il1f5
ggtggagatttgctt

SEQ ID NO: 6990 - DNA, 15 bp, Artificial Sequence
  dgRNA
  Rpl8
gtaagactcttgagt

SEQ ID NO: 6991 - DNA, 15 bp, Artificial Sequence
  dgRNA
  Rpl8
cttggttcagcaatt

SEQ ID NO: 6992 - DNA, 15 bp, Artificial Sequence
  dgRNA
  Rpl8
atttggtagacacac

SEQ ID NO: 6993 - DNA, 15 bp, Artificial Sequence
  dgRNA
  Rpl8
actacaagacccgac

SEQ ID NO: 6994 - DNA, 15 bp, Artificial Sequence
  dgRNA
  Arhgap36
aatgttagctcccag

SEQ ID NO: 6995 - DNA, 15 bp, Artificial Sequence
  dgRNA
  Arhgap36
agagctgctctagac

SEQ ID NO: 6996 - DNA, 15 bp, Artificial Sequence
  dgRNA
  Arhgap36
ggactccctttgcgt

SEQ ID NO: 6997 - DNA, 15 bp, Artificial Sequence
  dgRNA
  Arhgap36
gactccctttgcgtt

SEQ ID NO: 6998 - DNA, 15 bp, Artificial Sequence
  dgRNA
  Crhr2
acccccatgaatcct

SEQ ID NO: 6999 - DNA, 15 bp, Artificial Sequence
  dgRNA
  Crhr2
atcctcgggccctcc

SEQ ID NO: 7000 - DNA, 15 bp, Artificial Sequence
  dgRNA
  Crhr2
cccagcaatactggt

SEQ ID NO: 7001 - DNA, 15 bp, Artificial Sequence
  dgRNA
  Crhr2
cactaagccctgctc

SEQ ID NO: 7002 - DNA, 15 bp, Artificial Sequence
  dgRNA
  Gm6812
gaccctaggaagcta

SEQ ID NO: 7003 - DNA, 15 bp, Artificial Sequence
  dgRNA
  Gm6812
tgttggccctgtagg

SEQ ID NO: 7004 - DNA, 15 bp, Artificial Sequence
  dgRNA
  Ddx24
cgctccctagcgtcc

SEQ ID NO: 7005 - DNA, 15 bp, Artificial Sequence
  dgRNA
  Ddx24
gacgcttccgcacag

SEQ ID NO: 7006 - DNA, 15 bp, Artificial Sequence
  dgRNA
  Ddx24
gcttccgcacagagg

SEQ ID NO: 7007 - DNA, 15 bp, Artificial Sequence
  dgRNA
  Ddx24
ggagcgcaagcgccc

SEQ ID NO: 7008 - DNA, 15 bp, Artificial Sequence
  dgRNA
  Ccl28
aaggacctcatcagc

SEQ ID NO: 7009 - DNA, 15 bp, Artificial Sequence
  dgRNA
  Ccl28
aagtgagcacacggc

SEQ ID NO: 7010 - DNA, 15 bp, Artificial Sequence
  dgRNA
  Ccl28
gaggtccttaagagt

SEQ ID NO: 7011 - DNA, 15 bp, Artificial Sequence
  dgRNA
  Ccl28
tgccaggttccgggc

SEQ ID NO: 7012 - DNA, 15 bp, Artificial Sequence
  dgRNA
  Slc22a1
cgtgtatccctgccc

SEQ ID NO: 7013 - DNA, 15 bp, Artificial Sequence
  dgRNA
  Slc22a1
gggcagggatacacg

SEQ ID NO: 7014 - DNA, 15 bp, Artificial Sequence
  dgRNA
  Atxn7
agcaggggctcgatg

SEQ ID NO: 7015 - DNA, 15 bp, Artificial Sequence
  dgRNA
  Atxn7
ctcgatgcggacgcc

SEQ ID NO: 7016 - DNA, 15 bp, Artificial Sequence
  dgRNA
  Atxn7
tcgatgcggacgcct

SEQ ID NO: 7017 - DNA, 15 bp, Artificial Sequence
  dgRNA
  Atxn7
gggctaacacctggg

SEQ ID NO: 7018 - DNA, 15 bp, Artificial Sequence
  dgRNA
  Ift88
gggatggctgcctcg

SEQ ID NO: 7019 - DNA, 15 bp, Artificial Sequence
  dgRNA
  Ift88
gggttcactcgacct

SEQ ID NO: 7020 - DNA, 15 bp, Artificial Sequence
  dgRNA
  Ift88
acctgtagcatctcc

SEQ ID NO: 7021 - DNA, 15 bp, Artificial Sequence
  dgRNA
  Ift88
gaccaccataaacat

SEQ ID NO: 7022 - DNA, 15 bp, Artificial Sequence
  dgRNA
  6-Mar
ccttcgccaccagtc

SEQ ID NO: 7023 - DNA, 15 bp, Artificial Sequence
  dgRNA
  6-Mar
cgcgagcgcgagcga

SEQ ID NO: 7024 - DNA, 15 bp, Artificial Sequence
  dgRNA
  6-Mar
agcgaaggcgcgcgc

SEQ ID NO: 7025 - DNA, 15 bp, Artificial Sequence
  dgRNA
  6-Mar
tgacgcgcagcgctc

SEQ ID NO: 7026 - DNA, 15 bp, Artificial Sequence
  dgRNA
  Tmem241
tccagcagaaacgct

SEQ ID NO: 7027 - DNA, 15 bp, Artificial Sequence
  dgRNA
  Tmem241
gagccctcaagcgcg

SEQ ID NO: 7028 - DNA, 15 bp, Artificial Sequence
  dgRNA
  Tmem241
cgcgtggccccttta

SEQ ID NO: 7029 - DNA, 15 bp, Artificial Sequence
  dgRNA
  Tmem241
gtggcccctttaagg

SEQ ID NO: 7030 - DNA, 15 bp, Artificial Sequence
  dgRNA
  Txlng
tcctatccggattca

SEQ ID NO: 7031 - DNA, 15 bp, Artificial Sequence
  dgRNA
  Txlng
atccggattcatggc

SEQ ID NO: 7032 - DNA, 15 bp, Artificial Sequence
  dgRNA
  Txlng
tcatggctggacgcc

SEQ ID NO: 7033 - DNA, 15 bp, Artificial Sequence
  dgRNA
  Txlng
catggctggacgccg

SEQ ID NO: 7034 - DNA, 15 bp, Artificial Sequence
  dgRNA
  Rfc3
aaatccagcgactgt

SEQ ID NO: 7035 - DNA, 15 bp, Artificial Sequence
  dgRNA
  Rfc3
cgactgttggtgcag

SEQ ID NO: 7036 - DNA, 15 bp, Artificial Sequence
  dgRNA
  Rfc3
cgactgctccactcc

SEQ ID NO: 7037 - DNA, 15 bp, Artificial Sequence
  dgRNA
  Rfc3
caatctgagttctta

SEQ ID NO: 7038 - DNA, 15 bp, Artificial Sequence
  dgRNA
  Pard6b
ccgcgcgagccccgc

SEQ ID NO: 7039 - DNA, 15 bp, Artificial Sequence
  dgRNA
  Pard6b
aggctgcgtgccgat

SEQ ID NO: 7040 - DNA, 15 bp, Artificial Sequence
  dgRNA
  Pard6b
gattggctgacgccg

SEQ ID NO: 7041 - DNA, 15 bp, Artificial Sequence
  dgRNA
  Pard6b
attggctgacgccgc

SEQ ID NO: 7042 - DNA, 15 bp, Artificial Sequence
  dgRNA
  Gprin1
gggcggactccccgt

SEQ ID NO: 7043 - DNA, 15 bp, Artificial Sequence
  dgRNA
  Gprin1
ggcggactccccgtc

SEQ ID NO: 7044 - DNA, 15 bp, Artificial Sequence
  dgRNA
  Gprin1
gcggactccccgtcg

SEQ ID NO: 7045 - DNA, 15 bp, Artificial Sequence
  dgRNA
  Gprin1
gactccccgtcgggg

SEQ ID NO: 7046 - DNA, 15 bp, Artificial Sequence
  dgRNA
  Myct1
gggcacttagcaacg

SEQ ID NO: 7047 - DNA, 15 bp, Artificial Sequence
  dgRNA
  Myct1
ggcacttagcaacga

SEQ ID NO: 7048 - DNA, 15 bp, Artificial Sequence
  dgRNA
  Myct1
acttagcaacgaggg

SEQ ID NO: 7049 - DNA, 15 bp, Artificial Sequence
  dgRNA
  Myct1
ttcgagtataaaagc

SEQ ID NO: 7050 - DNA, 15 bp, Artificial Sequence
  dgRNA
  2700062C07Rik
atgttgtaatggtgt

SEQ ID NO: 7051 - DNA, 15 bp, Artificial Sequence
  dgRNA
  2700062C07Rik
tgttgtaatggtgtt

SEQ ID NO: 7052 - DNA, 15 bp, Artificial Sequence
  dgRNA
  2700062C07Rik
actccatacacgaca

SEQ ID NO: 7053 - DNA, 15 bp, Artificial Sequence
  dgRNA
  2700062C07Rik
ccatacacgacacgg

SEQ ID NO: 7054 - DNA, 15 bp, Artificial Sequence
  dgRNA
  Ssx2ip
gcggccgggtgaccc

SEQ ID NO: 7055 - DNA, 15 bp, Artificial Sequence
  dgRNA
  Ssx2ip
cggccgggtgacccc

SEQ ID NO: 7056 - DNA, 15 bp, Artificial Sequence
  dgRNA
  Ssx2ip
gaccccgggtgtaac

SEQ ID NO: 7057 - DNA, 15 bp, Artificial Sequence
  dgRNA
  Ssx2ip
cgggtgtaacaggtg

SEQ ID NO: 7058 - DNA, 15 bp, Artificial Sequence
  dgRNA
  Ntf3
cagaccgccagtgac

SEQ ID NO: 7059 - DNA, 15 bp, Artificial Sequence
  dgRNA
  Ntf3
agaccgccagtgacc

SEQ ID NO: 7060 - DNA, 15 bp, Artificial Sequence
  dgRNA
  Ntf3
gaccgccagtgaccg

SEQ ID NO: 7061 - DNA, 15 bp, Artificial Sequence
  dgRNA
  Ntf3
tgaccggggagcagc

SEQ ID NO: 7062 - DNA, 15 bp, Artificial Sequence
  dgRNA
  Olfr177
gatggtaatgattta

SEQ ID NO: 7063 - DNA, 15 bp, Artificial Sequence
  dgRNA
  Olfr177
actgtcaaaatcctt

SEQ ID NO: 7064 - DNA, 15 bp, Artificial Sequence
  dgRNA
  Prr5l
ttaggaccacgacct

SEQ ID NO: 7065 - DNA, 15 bp, Artificial Sequence
  dgRNA
  Prr5l
aatgaatttaagcgc

SEQ ID NO: 7066 - DNA, 15 bp, Artificial Sequence
  dgRNA
  Prr5l
atgaatttaagcgca

SEQ ID NO: 7067 - DNA, 15 bp, Artificial Sequence
  dgRNA
  Prr5l
gcctactcttgttgt

SEQ ID NO: 7068 - DNA, 15 bp, Artificial Sequence
  dgRNA
  0610010K14Rik
cgggcccgggctgga

SEQ ID NO: 7069 - DNA, 15 bp, Artificial Sequence
  dgRNA
  0610010K14Rik
gggcccgggctggaa

SEQ ID NO: 7070 - DNA, 15 bp, Artificial Sequence
  dgRNA
  0610010K14Rik
ggcccgggctggaag

SEQ ID NO: 7071 - DNA, 15 bp, Artificial Sequence
  dgRNA
  0610010K14Rik
agaccggcctcatcg

SEQ ID NO: 7072 - DNA, 15 bp, Artificial Sequence
  dgRNA
  Bcas1
taggcacctgaatac

SEQ ID NO: 7073 - DNA, 15 bp, Artificial Sequence
  dgRNA
  Bcas1
gagacgcgtttccat

SEQ ID NO: 7074 - DNA, 15 bp, Artificial Sequence
  dgRNA
  Bcas1
agacgcgtttccata

SEQ ID NO: 7075 - DNA, 15 bp, Artificial Sequence
  dgRNA
  Bcas1
gcgtttccatagggc

SEQ ID NO: 7076 - DNA, 15 bp, Artificial Sequence
  dgRNA
  Gm8439
tttgccgggcttaac

SEQ ID NO: 7077 - DNA, 15 bp, Artificial Sequence
  dgRNA
  Gm8439
tgactacattacctc

SEQ ID NO: 7078 - DNA, 15 bp, Artificial Sequence
  dgRNA
  Gm8439
attacctcaggcccc

SEQ ID NO: 7079 - DNA, 15 bp, Artificial Sequence
  dgRNA
  Gm8439
catcttgtaaccagg

SEQ ID NO: 7080 - DNA, 15 bp, Artificial Sequence
  dgRNA
  Myt1
aatatacagcatgat

SEQ ID NO: 7081 - DNA, 15 bp, Artificial Sequence
  dgRNA
  Myt1
gatctgccaagttga

SEQ ID NO: 7082 - DNA, 15 bp, Artificial Sequence
  dgRNA
  Zfp574
acccctccgctctat

SEQ ID NO: 7083 - DNA, 15 bp, Artificial Sequence
  dgRNA
  Zfp574
ccgctctattggtcg

SEQ ID NO: 7084 - DNA, 15 bp, Artificial Sequence
  dgRNA
  Zfp574
attggtcgaggcttc

SEQ ID NO: 7085 - DNA, 15 bp, Artificial Sequence
  dgRNA
  Zfp574
aacctgagcatcgat

SEQ ID NO: 7086 - DNA, 15 bp, Artificial Sequence
  dgRNA
  Pglyrp1
tcacggccccacctc

SEQ ID NO: 7087 - DNA, 15 bp, Artificial Sequence
  dgRNA
  Pglyrp1
cccacctctggttaa

SEQ ID NO: 7088 - DNA, 15 bp, Artificial Sequence
  dgRNA
  Pglyrp1
acctctggttaaagg

SEQ ID NO: 7089 - DNA, 15 bp, Artificial Sequence
  dgRNA
  Pglyrp1
cggaaagtcccgccc

SEQ ID NO: 7090 - DNA, 15 bp, Artificial Sequence
  dgRNA
  Prlr
aataagggatatcag

SEQ ID NO: 7091 - DNA, 15 bp, Artificial Sequence
  dgRNA
  Prlr
ataagggatatcaga

SEQ ID NO: 7092 - DNA, 15 bp, Artificial Sequence
  dgRNA
  Prlr
gcacctggacaattt

SEQ ID NO: 7093 - DNA, 15 bp, Artificial Sequence
  dgRNA
  Prlr
gagtggctgttctag

SEQ ID NO: 7094 - DNA, 15 bp, Artificial Sequence
  dgRNA
  Clta
gggtggcacttccgc

SEQ ID NO: 7095 - DNA, 15 bp, Artificial Sequence
  dgRNA
  Clta
tcacgagttgtcccc

SEQ ID NO: 7096 - DNA, 15 bp, Artificial Sequence
  dgRNA
  Clta
cacgagttgtcccca

SEQ ID NO: 7097 - DNA, 15 bp, Artificial Sequence
  dgRNA
  Clta
ctcccgtcttctgat

SEQ ID NO: 7098 - DNA, 15 bp, Artificial Sequence
  dgRNA
  Zfx
ggtaggtgtccccga

SEQ ID NO: 7099 - DNA, 15 bp, Artificial Sequence
  dgRNA
  Zfx
gtccccgaaggcccc

SEQ ID NO: 7100 - DNA, 15 bp, Artificial Sequence
  dgRNA
  Zfx
tccccgaaggccccc

SEQ ID NO: 7101 - DNA, 15 bp, Artificial Sequence
  dgRNA
  Zfx
ccccgaaggcccccg

SEQ ID NO: 7102 - DNA, 15 bp, Artificial Sequence
  dgRNA
  Cobll1
caagcactgcgggcg

SEQ ID NO: 7103 - DNA, 15 bp, Artificial Sequence
  dgRNA
  Cobll1
cgaccgtcccgcgcc

SEQ ID NO: 7104 - DNA, 15 bp, Artificial Sequence
  dgRNA
  Cobll1
cgccgccccttcgcc

SEQ ID NO: 7105 - DNA, 15 bp, Artificial Sequence
  dgRNA
  Cobll1
gccgccccttcgccc

SEQ ID NO: 7106 - DNA, 15 bp, Artificial Sequence
  dgRNA
  Ebf1
ctcccctgcgccaca

SEQ ID NO: 7107 - DNA, 15 bp, Artificial Sequence
  dgRNA
  Ebf1
tgcgccacaaggaga

SEQ ID NO: 7108 - DNA, 15 bp, Artificial Sequence
  dgRNA
  Ebf1
ctcgggagctgcgat

SEQ ID NO: 7109 - DNA, 15 bp, Artificial Sequence
  dgRNA
  Ebf1
cgattggctgtgata

SEQ ID NO: 7110 - DNA, 15 bp, Artificial Sequence
  dgRNA
  Zfp768
cacttcctgtgcggg

SEQ ID NO: 7111 - DNA, 15 bp, Artificial Sequence
  dgRNA
  Zfp768
tcctgtgcgggggga

SEQ ID NO: 7112 - DNA, 15 bp, Artificial Sequence
  dgRNA
  Zfp768
aggggcgcagtagcc

SEQ ID NO: 7113 - DNA, 15 bp, Artificial Sequence
  dgRNA
  Zfp768
gcgcagtagcccggc

SEQ ID NO: 7114 - DNA, 15 bp, Artificial Sequence
  dgRNA
  Fbxw20
tcaactgagtgcatc

SEQ ID NO: 7115 - DNA, 15 bp, Artificial Sequence
  dgRNA
  Fkbp8
agcccctccacctag

SEQ ID NO: 7116 - DNA, 15 bp, Artificial Sequence
  dgRNA
  Fkbp8
ttaagaaacggccag

SEQ ID NO: 7117 - DNA, 15 bp, Artificial Sequence
  dgRNA
  Fkbp8
ccagcggagcttacc

SEQ ID NO: 7118 - DNA, 15 bp, Artificial Sequence
  dgRNA
  Fkbp8
cggagcttaccagga

SEQ ID NO: 7119 - DNA, 15 bp, Artificial Sequence
  dgRNA
  Cntn5
gcgacggtgacagcg

SEQ ID NO: 7120 - DNA, 15 bp, Artificial Sequence
  dgRNA
  Cntn5
ggtgacagcgcggag

SEQ ID NO: 7121 - DNA, 15 bp, Artificial Sequence
  dgRNA
  Cntn5
gtgacagcgcggagc

SEQ ID NO: 7122 - DNA, 15 bp, Artificial Sequence
  dgRNA
  Cntn5
acagcgcggagcggg

SEQ ID NO: 7123 - DNA, 15 bp, Artificial Sequence
  dgRNA
  Il18bp
gcggaagtgccttcc

SEQ ID NO: 7124 - DNA, 15 bp, Artificial Sequence
  dgRNA
  Il18bp
gccttcctggctatt

SEQ ID NO: 7125 - DNA, 15 bp, Artificial Sequence
  dgRNA
  Il18bp
gggtcagctctcgct

SEQ ID NO: 7126 - DNA, 15 bp, Artificial Sequence
  dgRNA
  Il18bp
cagctctcgcttggc

SEQ ID NO: 7127 - DNA, 15 bp, Artificial Sequence
  dgRNA
  Vamp4
gcggctctgcgcctt

SEQ ID NO: 7128 - DNA, 15 bp, Artificial Sequence
  dgRNA
  Vamp4
ctgccgggagcccat

SEQ ID NO: 7129 - DNA, 15 bp, Artificial Sequence
  dgRNA
  Vamp4
cccatcggagaccgc

SEQ ID NO: 7130 - DNA, 15 bp, Artificial Sequence
  dgRNA
  Vamp4
ccggcgcgcctgagc

SEQ ID NO: 7131 - DNA, 15 bp, Artificial Sequence
  dgRNA
  Postn
gccatcgcaagcttc

SEQ ID NO: 7132 - DNA, 15 bp, Artificial Sequence
  dgRNA
  Postn
tcgcaagcttcaggt

SEQ ID NO: 7133 - DNA, 15 bp, Artificial Sequence
  dgRNA
  Postn
acctgaagcttgcga

SEQ ID NO: 7134 - DNA, 15 bp, Artificial Sequence
  dgRNA
  Sgk3
ccgtcagctgagcgc

SEQ ID NO: 7135 - DNA, 15 bp, Artificial Sequence
  dgRNA
  Sgk3
ctgagcgcaggagtc

SEQ ID NO: 7136 - DNA, 15 bp, Artificial Sequence
  dgRNA
  Sgk3
agcgcaggagtccgg

SEQ ID NO: 7137 - DNA, 15 bp, Artificial Sequence
  dgRNA
  Sgk3
ttgcaccccgcgtga

SEQ ID NO: 7138 - DNA, 15 bp, Artificial Sequence
  dgRNA
  Aunip
gacctacacatgcag

SEQ ID NO: 7139 - DNA, 15 bp, Artificial Sequence
  dgRNA
  Aunip
ctcccgggaaccgcc

SEQ ID NO: 7140 - DNA, 15 bp, Artificial Sequence
  dgRNA
  Aunip
gcttccttagcgcac

SEQ ID NO: 7141 - DNA, 15 bp, Artificial Sequence
  dgRNA
  Aunip
cttccttagcgcact

SEQ ID NO: 7142 - DNA, 15 bp, Artificial Sequence
  dgRNA
  Olfr1410
tcatatctgctcatc

SEQ ID NO: 7143 - DNA, 15 bp, Artificial Sequence
  dgRNA
  Olfr1410
catatctgctcatct

SEQ ID NO: 7144 - DNA, 15 bp, Artificial Sequence
  dgRNA
  Olfr1410
ggttccgcacactga

SEQ ID NO: 7145 - DNA, 15 bp, Artificial Sequence
  dgRNA
  Atp4a
caatgggctttgaac

SEQ ID NO: 7146 - DNA, 15 bp, Artificial Sequence
  dgRNA
  Atp4a
gggctttgaacaggt

SEQ ID NO: 7147 - DNA, 15 bp, Artificial Sequence
  dgRNA
  Atp4a
tcagctgcaatcagc

SEQ ID NO: 7148 - DNA, 15 bp, Artificial Sequence
  dgRNA
  Atp4a
tgggtatatcaagcc

SEQ ID NO: 7149 - DNA, 15 bp, Artificial Sequence
  dgRNA
  Rell2
cctttgccagacgtg

SEQ ID NO: 7150 - DNA, 15 bp, Artificial Sequence
  dgRNA
  Rell2
ctttgccagacgtga

SEQ ID NO: 7151 - DNA, 15 bp, Artificial Sequence
  dgRNA
  Rell2
acgtgagggctagac

SEQ ID NO: 7152 - DNA, 15 bp, Artificial Sequence
  dgRNA
  Rell2
tgcacatcccctccg

SEQ ID NO: 7153 - DNA, 15 bp, Artificial Sequence
  dgRNA
  Adgrg1
aggtccccacttgcc

SEQ ID NO: 7154 - DNA, 15 bp, Artificial Sequence
  dgRNA
  Adgrg1
cacgggcatccctta

SEQ ID NO: 7155 - DNA, 15 bp, Artificial Sequence
  dgRNA
  Adgrg1
ggatgcccgtgactc

SEQ ID NO: 7156 - DNA, 15 bp, Artificial Sequence
  dgRNA
  Adgrg1
aggcggggaccctaa

SEQ ID NO: 7157 - DNA, 15 bp, Artificial Sequence
  dgRNA
  Brms1l
attcccgacagacag

SEQ ID NO: 7158 - DNA, 15 bp, Artificial Sequence
  dgRNA
  Brms1l
ccgacagacagcgga

SEQ ID NO: 7159 - DNA, 15 bp, Artificial Sequence
  dgRNA
  Brms1l
ccgcgccgtaatcac

SEQ ID NO: 7160 - DNA, 15 bp, Artificial Sequence
  dgRNA
  Brms1l
ccacgcctctagctc

SEQ ID NO: 7161 - DNA, 15 bp, Artificial Sequence
  dgRNA
  Fam78b
ccctgccctccgccg

SEQ ID NO: 7162 - DNA, 15 bp, Artificial Sequence
  dgRNA
  Fam78b
ccctccgccggggca

SEQ ID NO: 7163 - DNA, 15 bp, Artificial Sequence
  dgRNA
  Fam78b
cctccgccggggcac

SEQ ID NO: 7164 - DNA, 15 bp, Artificial Sequence
  dgRNA
  Fam78b
ccggggcacgggagc

SEQ ID NO: 7165 - DNA, 15 bp, Artificial Sequence
  dgRNA
  Plekha6
gttgtcacttgctca

SEQ ID NO: 7166 - DNA, 15 bp, Artificial Sequence
  dgRNA
  Plekha6
ctcagggttagtcaa

SEQ ID NO: 7167 - DNA, 15 bp, Artificial Sequence
  dgRNA
  Plekha6
tcagggttagtcaaa

SEQ ID NO: 7168 - DNA, 15 bp, Artificial Sequence
  dgRNA
  Plekha6
cagggttagtcaaag

SEQ ID NO: 7169 - DNA, 15 bp, Artificial Sequence
  dgRNA
  Olfr140
gtaactgaacttcct

SEQ ID NO: 7170 - DNA, 15 bp, Artificial Sequence
  dgRNA
  Olfr140
ctagttagttatttc

SEQ ID NO: 7171 - DNA, 15 bp, Artificial Sequence
  dgRNA
  Tmem91
tgggacccccagaat

SEQ ID NO: 7172 - DNA, 15 bp, Artificial Sequence
  dgRNA
  Tmem91
gacccccagaatcgg

SEQ ID NO: 7173 - DNA, 15 bp, Artificial Sequence
  dgRNA
  Tmem91
tcggaggccccctcc

SEQ ID NO: 7174 - DNA, 15 bp, Artificial Sequence
  dgRNA
  Tmem91
cggaggccccctccc

SEQ ID NO: 7175 - DNA, 15 bp, Artificial Sequence
  dgRNA
  Ccdc3
ggagtcccagggcgc

SEQ ID NO: 7176 - DNA, 15 bp, Artificial Sequence
  dgRNA
  Ccdc3
gagtcccagggcgca

SEQ ID NO: 7177 - DNA, 15 bp, Artificial Sequence
  dgRNA
  Ccdc3
cccgggagttctgca

SEQ ID NO: 7178 - DNA, 15 bp, Artificial Sequence
  dgRNA
  Ccdc3
ccgggagttctgcac

SEQ ID NO: 7179 - DNA, 15 bp, Artificial Sequence
  dgRNA
  Il3ra
cccgcgtgactcccg

SEQ ID NO: 7180 - DNA, 15 bp, Artificial Sequence
  dgRNA
  Il3ra
gaagttgctcaatct

SEQ ID NO: 7181 - DNA, 15 bp, Artificial Sequence
  dgRNA
  Il3ra
aagttgctcaatctc

SEQ ID NO: 7182 - DNA, 15 bp, Artificial Sequence
  dgRNA
  Il3ra
tcaatctcgggacca

SEQ ID NO: 7183 - DNA, 15 bp, Artificial Sequence
  dgRNA
  Zfp444
ggactcatcacagta

SEQ ID NO: 7184 - DNA, 15 bp, Artificial Sequence
  dgRNA
  Zfp444
tgtcgcgatgtttct

SEQ ID NO: 7185 - DNA, 15 bp, Artificial Sequence
  dgRNA
  Zfp444
gtcgcgatgtttctt

SEQ ID NO: 7186 - DNA, 15 bp, Artificial Sequence
  dgRNA
  Zfp444
gagtgaggggacgtg

SEQ ID NO: 7187 - DNA, 15 bp, Artificial Sequence
  dgRNA
  Ankrd34a
aagattggaggcgct

SEQ ID NO: 7188 - DNA, 15 bp, Artificial Sequence
  dgRNA
  Ankrd34a
ggagcggcttggtgc

SEQ ID NO: 7189 - DNA, 15 bp, Artificial Sequence
  dgRNA
  Ankrd34a
ccacccgcagagact

SEQ ID NO: 7190 - DNA, 15 bp, Artificial Sequence
  dgRNA
  Ankrd34a
agccggcgctgtgcc

SEQ ID NO: 7191 - DNA, 15 bp, Artificial Sequence
  dgRNA
  Dnmt3b
cccgcaaggcatagg

SEQ ID NO: 7192 - DNA, 15 bp, Artificial Sequence
  dgRNA
  Dnmt3b
aggcatagggggccc

SEQ ID NO: 7193 - DNA, 15 bp, Artificial Sequence
  dgRNA
  Dnmt3b
ggcatagggggccca

SEQ ID NO: 7194 - DNA, 15 bp, Artificial Sequence
  dgRNA
  Dnmt3b
gcatagggggcccag

SEQ ID NO: 7195 - DNA, 15 bp, Artificial Sequence
  dgRNA
  Sepn1
attttggaagcggcg

SEQ ID NO: 7196 - DNA, 15 bp, Artificial Sequence
  dgRNA
  Sepn1
gaagcggcgaggtag

SEQ ID NO: 7197 - DNA, 15 bp, Artificial Sequence
  dgRNA
  Sepn1
aagcggcgaggtaga

SEQ ID NO: 7198 - DNA, 15 bp, Artificial Sequence
  dgRNA
  Sepn1
gaggtagagggccta

SEQ ID NO: 7199 - DNA, 15 bp, Artificial Sequence
  dgRNA
  Hexim2
tttttttggcgttcc

SEQ ID NO: 7200 - DNA, 15 bp, Artificial Sequence
  dgRNA
  Hexim2
tggttgttgacgtaa

SEQ ID NO: 7201 - DNA, 15 bp, Artificial Sequence
  dgRNA
  Hexim2
ggttgttgacgtaat

SEQ ID NO: 7202 - DNA, 15 bp, Artificial Sequence
  dgRNA
  Hexim2
agcttgaaagtatcc

SEQ ID NO: 7203 - DNA, 15 bp, Artificial Sequence
  dgRNA
  Cggbp1
gcccccagttttcac

SEQ ID NO: 7204 - DNA, 15 bp, Artificial Sequence
  dgRNA
  Cggbp1
gacaccgccaatcat

SEQ ID NO: 7205 - DNA, 15 bp, Artificial Sequence
  dgRNA
  Cggbp1
gccctaccttcctat

SEQ ID NO: 7206 - DNA, 15 bp, Artificial Sequence
  dgRNA
  Cggbp1
agccgtctgtttgcc

SEQ ID NO: 7207 - DNA, 15 bp, Artificial Sequence
  dgRNA
  Pif1
aagacgaagaaacgc

SEQ ID NO: 7208 - DNA, 15 bp, Artificial Sequence
  dgRNA
  Pif1
gaccaggccggtgat

SEQ ID NO: 7209 - DNA, 15 bp, Artificial Sequence
  dgRNA
  Pif1
accaggccggtgata

SEQ ID NO: 7210 - DNA, 15 bp, Artificial Sequence
  dgRNA
  Pif1
aggccggtgataggg

SEQ ID NO: 7211 - DNA, 15 bp, Artificial Sequence
  dgRNA
  Rufy3
cgctccggagcccag

SEQ ID NO: 7212 - DNA, 15 bp, Artificial Sequence
  dgRNA
  Rufy3
ccggagcccagcgga

SEQ ID NO: 7213 - DNA, 15 bp, Artificial Sequence
  dgRNA
  Rufy3
ccagcggaaggtgcg

SEQ ID NO: 7214 - DNA, 15 bp, Artificial Sequence
  dgRNA
  Rufy3
gcggaaggtgcgcgg

SEQ ID NO: 7215 - DNA, 15 bp, Artificial Sequence
  dgRNA
  Gjb1
tccattgggacctca

SEQ ID NO: 7216 - DNA, 15 bp, Artificial Sequence
  dgRNA
  Gjb1
attgtgtgtggaacg

SEQ ID NO: 7217 - DNA, 15 bp, Artificial Sequence
  dgRNA
  Gjb1
ttgtgtgtggaacgg

SEQ ID NO: 7218 - DNA, 15 bp, Artificial Sequence
  dgRNA
  Gjb1
gtcaagctccggtcc

SEQ ID NO: 7219 - DNA, 15 bp, Artificial Sequence
  dgRNA
  Ddx54
acccgcatcccttgc

SEQ ID NO: 7220 - DNA, 15 bp, Artificial Sequence
  dgRNA
  Ddx54
cccgcatcccttgct

SEQ ID NO: 7221 - DNA, 15 bp, Artificial Sequence
  dgRNA
  Ddx54
ccgccctcgcgctga

SEQ ID NO: 7222 - DNA, 15 bp, Artificial Sequence
  dgRNA
  Ddx54
gatggtacgttccac

SEQ ID NO: 7223 - DNA, 15 bp, Artificial Sequence
  dgRNA
  Serpinb1b
aagtagagcatagcc

SEQ ID NO: 7224 - DNA, 15 bp, Artificial Sequence
  dgRNA
  Serpinb1b
ttttaagtactcacc

SEQ ID NO: 7225 - DNA, 15 bp, Artificial Sequence
  dgRNA
  Serpinb1b
tttaagtactcacca

SEQ ID NO: 7226 - DNA, 15 bp, Artificial Sequence
  dgRNA
  Serpinb1b
ttaagtactcaccag

SEQ ID NO: 7227 - DNA, 15 bp, Artificial Sequence
  dgRNA
  Zfp959
gcctgagcggaggcc

SEQ ID NO: 7228 - DNA, 15 bp, Artificial Sequence
  dgRNA
  Zfp959
atcacggcctccaga

SEQ ID NO: 7229 - DNA, 15 bp, Artificial Sequence
  dgRNA
  Zfp959
agcggatccatctgg

SEQ ID NO: 7230 - DNA, 15 bp, Artificial Sequence
  dgRNA
  Zfp959
gctagcggatccatc

SEQ ID NO: 7231 - DNA, 15 bp, Artificial Sequence
  dgRNA
  Dtna
tacacacgaggatac

SEQ ID NO: 7232 - DNA, 15 bp, Artificial Sequence
  dgRNA
  Dtna
cgaggatacaggtaa

SEQ ID NO: 7233 - DNA, 15 bp, Artificial Sequence
  dgRNA
  Dtna
gggcggaagctccct

SEQ ID NO: 7234 - DNA, 15 bp, Artificial Sequence
  dgRNA
  Dtna
atcctcgtgtgtaaa

SEQ ID NO: 7235 - DNA, 15 bp, Artificial Sequence
  dgRNA
  Scamp2
ttattcgtgagaccc

SEQ ID NO: 7236 - DNA, 15 bp, Artificial Sequence
  dgRNA
  Scamp2
ccttcgctttctaat

SEQ ID NO: 7237 - DNA, 15 bp, Artificial Sequence
  dgRNA
  Scamp2
cgctttctaataggc

SEQ ID NO: 7238 - DNA, 15 bp, Artificial Sequence
  dgRNA
  Scamp2
gctttctaataggct

SEQ ID NO: 7239 - DNA, 15 bp, Artificial Sequence
  dgRNA
  Ubash3b
gcgacttctggaaaa

SEQ ID NO: 7240 - DNA, 15 bp, Artificial Sequence
  dgRNA
  Usp8
gacgcgcgaggacac

SEQ ID NO: 7241 - DNA, 15 bp, Artificial Sequence
  dgRNA
  Usp8
ttccgacgcatgctc

SEQ ID NO: 7242 - DNA, 15 bp, Artificial Sequence
  dgRNA
  Usp8
gacgcatgctcaggc

SEQ ID NO: 7243 - DNA, 15 bp, Artificial Sequence
  dgRNA
  Usp8
atgctcaggccggtt

SEQ ID NO: 7244 - DNA, 15 bp, Artificial Sequence
  dgRNA
  Abcc6
ggcccggcacttttc

SEQ ID NO: 7245 - DNA, 15 bp, Artificial Sequence
  dgRNA
  Abcc6
gcccggcacttttca

SEQ ID NO: 7246 - DNA, 15 bp, Artificial Sequence
  dgRNA
  Abcc6
cccggcacttttcag

SEQ ID NO: 7247 - DNA, 15 bp, Artificial Sequence
  dgRNA
  Abcc6
cctgtcaaacctgcc

SEQ ID NO: 7248 - DNA, 15 bp, Artificial Sequence
  dgRNA
  Galnt6
ggatgcgggtggcct

SEQ ID NO: 7249 - DNA, 15 bp, Artificial Sequence
  dgRNA
  Galnt6
gatgcgggtggcctt

SEQ ID NO: 7250 - DNA, 15 bp, Artificial Sequence
  dgRNA
  Galnt6
gcgggtggccttggg

SEQ ID NO: 7251 - DNA, 15 bp, Artificial Sequence
  dgRNA
  Galnt6
ggtggcggtgacatg

SEQ ID NO: 7252 - DNA, 15 bp, Artificial Sequence
  dgRNA
  Slc19a2
gaggttggctccggc

SEQ ID NO: 7253 - DNA, 15 bp, Artificial Sequence
  dgRNA
  Slc19a2
aggttggctccggcc

SEQ ID NO: 7254 - DNA, 15 bp, Artificial Sequence
  dgRNA
  Slc19a2
ttggctccggccggg

SEQ ID NO: 7255 - DNA, 15 bp, Artificial Sequence
  dgRNA
  Slc19a2
ccggccgggaggcat

SEQ ID NO: 7256 - DNA, 15 bp, Artificial Sequence
  dgRNA
  Cdkn2d
atggaggtcgggctc

SEQ ID NO: 7257 - DNA, 15 bp, Artificial Sequence
  dgRNA
  Cdkn2d
aaaacaagggcgctc

SEQ ID NO: 7258 - DNA, 15 bp, Artificial Sequence
  dgRNA
  Cdkn2d
aaacaagggcgctct

SEQ ID NO: 7259 - DNA, 15 bp, Artificial Sequence
  dgRNA
  Cdkn2d
caagggcgctctggg

SEQ ID NO: 7260 - DNA, 15 bp, Artificial Sequence
  dgRNA
  Gfm2
cgttcctaggcagat

SEQ ID NO: 7261 - DNA, 15 bp, Artificial Sequence
  dgRNA
  Gfm2
gcggaaattgacagc

SEQ ID NO: 7262 - DNA, 15 bp, Artificial Sequence
  dgRNA
  Gfm2
actcggccttcttaa

SEQ ID NO: 7263 - DNA, 15 bp, Artificial Sequence
  dgRNA
  Gfm2
cgcttgcgctccact

SEQ ID NO: 7264 - DNA, 15 bp, Artificial Sequence
  dgRNA
  Ilk
atagagcgtagccgc

SEQ ID NO: 7265 - DNA, 15 bp, Artificial Sequence
  dgRNA
  Ilk
gctggcgagctagag

SEQ ID NO: 7266 - DNA, 15 bp, Artificial Sequence
  dgRNA
  Ilk
cagtaggaggtcgga

SEQ ID NO: 7267 - DNA, 15 bp, Artificial Sequence
  dgRNA
  Ilk
agtaggaggtcggaa

SEQ ID NO: 7268 - DNA, 15 bp, Artificial Sequence
  dgRNA
  Endov
tggaggcgccaggta

SEQ ID NO: 7269 - DNA, 15 bp, Artificial Sequence
  dgRNA
  Endov
ggtaaggcgcagagc

SEQ ID NO: 7270 - DNA, 15 bp, Artificial Sequence
  dgRNA
  Endov
gtaaggcgcagagct

SEQ ID NO: 7271 - DNA, 15 bp, Artificial Sequence
  dgRNA
  Endov
gcgccaacccaccta

SEQ ID NO: 7272 - DNA, 15 bp, Artificial Sequence
  dgRNA
  Edem1
ggcctatagagccgg

SEQ ID NO: 7273 - DNA, 15 bp, Artificial Sequence
  dgRNA
  Edem1
gcctatagagccgga

SEQ ID NO: 7274 - DNA, 15 bp, Artificial Sequence
  dgRNA
  Edem1
gccggagggagtccc

SEQ ID NO: 7275 - DNA, 15 bp, Artificial Sequence
  dgRNA
  Edem1
cggccgcgcccctcg

SEQ ID NO: 7276 - DNA, 15 bp, Artificial Sequence
  dgRNA
  Anks6
gaggtcggattcagt

SEQ ID NO: 7277 - DNA, 15 bp, Artificial Sequence
  dgRNA
  Anks6
tcagtaggaacgaac

SEQ ID NO: 7278 - DNA, 15 bp, Artificial Sequence
  dgRNA
  Anks6
tgaccgcacagtcac

SEQ ID NO: 7279 - DNA, 15 bp, Artificial Sequence
  dgRNA
  Anks6
accctccaaggcggg

SEQ ID NO: 7280 - DNA, 15 bp, Artificial Sequence
  dgRNA
  Arhgap40
ttttggctaagggcc

SEQ ID NO: 7281 - DNA, 15 bp, Artificial Sequence
  dgRNA
  Arhgap40
gcctgtgggcggttc

SEQ ID NO: 7282 - DNA, 15 bp, Artificial Sequence
  dgRNA
  Arhgap40
agcctcacctcaata

SEQ ID NO: 7283 - DNA, 15 bp, Artificial Sequence
  dgRNA
  Arhgap40
gcctcacctcaatat

SEQ ID NO: 7284 - DNA, 15 bp, Artificial Sequence
  dgRNA
  Tmem39a
ttaacggagacgggc

SEQ ID NO: 7285 - DNA, 15 bp, Artificial Sequence
  dgRNA
  Tmem39a
gctatttaaggggca

SEQ ID NO: 7286 - DNA, 15 bp, Artificial Sequence
  dgRNA
  Tmem39a
ctatttaaggggcaa

SEQ ID NO: 7287 - DNA, 15 bp, Artificial Sequence
  dgRNA
  Tmem39a
gcacagatgctaata

SEQ ID NO: 7288 - DNA, 15 bp, Artificial Sequence
  dgRNA
  Rras
gagactcgtgtcctc

SEQ ID NO: 7289 - DNA, 15 bp, Artificial Sequence
  dgRNA
  Rras
gcataacccacccct

SEQ ID NO: 7290 - DNA, 15 bp, Artificial Sequence
  dgRNA
  Rras
ctgactccccctagg

SEQ ID NO: 7291 - DNA, 15 bp, Artificial Sequence
  dgRNA
  Rras
ccccctaggcggtag

SEQ ID NO: 7292 - DNA, 15 bp, Artificial Sequence
  dgRNA
  Ccdc138
ggcgggtaaaagact

SEQ ID NO: 7293 - DNA, 15 bp, Artificial Sequence
  dgRNA
  Ccdc138
ggggcaaccgagaac

SEQ ID NO: 7294 - DNA, 15 bp, Artificial Sequence
  dgRNA
  Ccdc138
gggcaaccgagaact

SEQ ID NO: 7295 - DNA, 15 bp, Artificial Sequence
  dgRNA
  Ccdc138
cctcctaccggcttc

SEQ ID NO: 7296 - DNA, 15 bp, Artificial Sequence
  dgRNA
  Vrk1
catggagcaagcgta

SEQ ID NO: 7297 - DNA, 15 bp, Artificial Sequence
  dgRNA
  Vrk1
aaggaccacaattcc

SEQ ID NO: 7298 - DNA, 15 bp, Artificial Sequence
  dgRNA
  Vrk1
aattcccggcatgtc

SEQ ID NO: 7299 - DNA, 15 bp, Artificial Sequence
  dgRNA
  Vrk1
ccggcatgtccggag

SEQ ID NO: 7300 - DNA, 15 bp, Artificial Sequence
  dgRNA
  Dpy19l4
gctcagcaaggagcg

SEQ ID NO: 7301 - DNA, 15 bp, Artificial Sequence
  dgRNA
  Dpy19l4
ctcagcaaggagcga

SEQ ID NO: 7302 - DNA, 15 bp, Artificial Sequence
  dgRNA
  Dpy19l4
agcattgccatcccg

SEQ ID NO: 7303 - DNA, 15 bp, Artificial Sequence
  dgRNA
  Dpy19l4
atcccgtggccatcg

SEQ ID NO: 7304 - DNA, 15 bp, Artificial Sequence
  dgRNA
  Tdp2
gcacgcgcaaccttc

SEQ ID NO: 7305 - DNA, 15 bp, Artificial Sequence
  dgRNA
  Tdp2
ccatctgcgcctcgc

SEQ ID NO: 7306 - DNA, 15 bp, Artificial Sequence
  dgRNA
  Tdp2
gcgcctcgctggccg

SEQ ID NO: 7307 - DNA, 15 bp, Artificial Sequence
  dgRNA
  Tdp2
ctcgctggccgcgga

SEQ ID NO: 7308 - DNA, 15 bp, Artificial Sequence
  dgRNA
  Prpf39
attacgatattttag

SEQ ID NO: 7309 - DNA, 15 bp, Artificial Sequence
  dgRNA
  Prpf39
gctgcttagcacaac

SEQ ID NO: 7310 - DNA, 15 bp, Artificial Sequence
  dgRNA
  Prpf39
caaccggcttcgcta

SEQ ID NO: 7311 - DNA, 15 bp, Artificial Sequence
  dgRNA
  Prpf39
ggcttcgctatggtt

SEQ ID NO: 7312 - DNA, 15 bp, Artificial Sequence
  dgRNA
  Satb1
cgccccaggcacgca

SEQ ID NO: 7313 - DNA, 15 bp, Artificial Sequence
  dgRNA
  Satb1
ggcacgcacggcccc

SEQ ID NO: 7314 - DNA, 15 bp, Artificial Sequence
  dgRNA
  Satb1
gcccccggccagcgt

SEQ ID NO: 7315 - DNA, 15 bp, Artificial Sequence
  dgRNA
  Satb1
cccccggccagcgtc

SEQ ID NO: 7316 - DNA, 15 bp, Artificial Sequence
  dgRNA
  Dydc2
attatcagtcaaggg

SEQ ID NO: 7317 - DNA, 15 bp, Artificial Sequence
  dgRNA
  Dydc2
cacattatcagtcaa

SEQ ID NO: 7318 - DNA, 15 bp, Artificial Sequence
  dgRNA
  Dydc2
gcacattatcagtca

SEQ ID NO: 7319 - DNA, 15 bp, Artificial Sequence
  dgRNA
  Yme1l1
tgactgagactcgga

SEQ ID NO: 7320 - DNA, 15 bp, Artificial Sequence
  dgRNA
  Yme1l1
atcttgactgagact

SEQ ID NO: 7321 - DNA, 15 bp, Artificial Sequence
  dgRNA
  Yme1l1
gctcatgcggaggga

SEQ ID NO: 7322 - DNA, 15 bp, Artificial Sequence
  dgRNA
  Yme1l1
agctcatgcggaggg

SEQ ID NO: 7323 - DNA, 15 bp, Artificial Sequence
  dgRNA
  Krtap19-1
cgtagaatgacacaa

SEQ ID NO: 7324 - DNA, 15 bp, Artificial Sequence
  dgRNA
  Krtap19-1
ggccaacatctgtta

SEQ ID NO: 7325 - DNA, 15 bp, Artificial Sequence
  dgRNA
  Krtap19-1
atatactctgggccg

SEQ ID NO: 7326 - DNA, 15 bp, Artificial Sequence
  dgRNA
  3300002I08Rik
ctccccggacctagg

SEQ ID NO: 7327 - DNA, 15 bp, Artificial Sequence
  dgRNA
  3300002I08Rik
tccccggacctaggt

SEQ ID NO: 7328 - DNA, 15 bp, Artificial Sequence
  dgRNA
  3300002I08Rik
cacctaggtccgggg

SEQ ID NO: 7329 - DNA, 15 bp, Artificial Sequence
  dgRNA
  3300002I08Rik
tcccacctaggtccg

SEQ ID NO: 7330 - DNA, 15 bp, Artificial Sequence
  dgRNA
  Dhx34
gagcgctttgtgcga

SEQ ID NO: 7331 - DNA, 15 bp, Artificial Sequence
  dgRNA
  Dhx34
agcgctttgtgcgat

SEQ ID NO: 7332 - DNA, 15 bp, Artificial Sequence
  dgRNA
  Dhx34
ttgtgcgatgggcat

SEQ ID NO: 7333 - DNA, 15 bp, Artificial Sequence
  dgRNA
  Dhx34
cccgctactccctat

SEQ ID NO: 7334 - DNA, 15 bp, Artificial Sequence
  dgRNA
  Wipi1
agggctagagccgag

SEQ ID NO: 7335 - DNA, 15 bp, Artificial Sequence
  dgRNA
  Wipi1
gggctagagccgaga

SEQ ID NO: 7336 - DNA, 15 bp, Artificial Sequence
  dgRNA
  Wipi1
ggctagagccgagag

SEQ ID NO: 7337 - DNA, 15 bp, Artificial Sequence
  dgRNA
  Wipi1
tagagccgagagggg

SEQ ID NO: 7338 - DNA, 15 bp, Artificial Sequence
  dgRNA
  Olfr690
agccttgcctaccat

SEQ ID NO: 7339 - DNA, 15 bp, Artificial Sequence
  dgRNA
  Olfr690
taccataggaggaac

SEQ ID NO: 7340 - DNA, 15 bp, Artificial Sequence
  dgRNA
  Olfr690
tgagttatcaaagcc

SEQ ID NO: 7341 - DNA, 15 bp, Artificial Sequence
  dgRNA
  Olfr690
tctgcagtgctaacg

SEQ ID NO: 7342 - DNA, 15 bp, Artificial Sequence
  dgRNA
  Aqp4
gtgtctataatgatc

SEQ ID NO: 7343 - DNA, 15 bp, Artificial Sequence
  dgRNA
  Aqp4
ataatgatcaggtac

SEQ ID NO: 7344 - DNA, 15 bp, Artificial Sequence
  dgRNA
  Aqp4
agattctgcaccatg

SEQ ID NO: 7345 - DNA, 15 bp, Artificial Sequence
  dgRNA
  Aqp4
ggtttttggagagta

SEQ ID NO: 7346 - DNA, 15 bp, Artificial Sequence
  dgRNA
  Begain
cgccattcatgcgcg

SEQ ID NO: 7347 - DNA, 15 bp, Artificial Sequence
  dgRNA
  Begain
gccattcatgcgcgc

SEQ ID NO: 7348 - DNA, 15 bp, Artificial Sequence
  dgRNA
  Begain
cacgtgcgccctgcc

SEQ ID NO: 7349 - DNA, 15 bp, Artificial Sequence
  dgRNA
  Begain
tgcccggcgcggcgc

SEQ ID NO: 7350 - DNA, 15 bp, Artificial Sequence
  dgRNA
  Bard1
agcggcaagctcctg

SEQ ID NO: 7351 - DNA, 15 bp, Artificial Sequence
  dgRNA
  Bard1
gccccgcctctttga

SEQ ID NO: 7352 - DNA, 15 bp, Artificial Sequence
  dgRNA
  Bard1
gcctctttgaaggcg

SEQ ID NO: 7353 - DNA, 15 bp, Artificial Sequence
  dgRNA
  Bard1
gccttcaaagaggcg

SEQ ID NO: 7354 - DNA, 15 bp, Artificial Sequence
  dgRNA
  Pdx1
acaaaaaacatagcg

SEQ ID NO: 7355 - DNA, 15 bp, Artificial Sequence
  dgRNA
  Pdx1
caaaaaacatagcga

SEQ ID NO: 7356 - DNA, 15 bp, Artificial Sequence
  dgRNA
  Pdx1
aaaaaacatagcgag

SEQ ID NO: 7357 - DNA, 15 bp, Artificial Sequence
  dgRNA
  Pdx1
aaaaacatagcgagg

SEQ ID NO: 7358 - DNA, 15 bp, Artificial Sequence
  dgRNA
  1810043G02Rik
ccgcgcacgcaaaca

SEQ ID NO: 7359 - DNA, 15 bp, Artificial Sequence
  dgRNA
  1810043G02Rik
cgcgcacgcaaacac

SEQ ID NO: 7360 - DNA, 15 bp, Artificial Sequence
  dgRNA
  1810043G02Rik
agaccagcggtcccc

SEQ ID NO: 7361 - DNA, 15 bp, Artificial Sequence
  dgRNA
  1810043G02Rik
gcctcgtgcatgcgc

SEQ ID NO: 7362 - DNA, 15 bp, Artificial Sequence
  dgRNA
  Mitf
tgacgtcaagccagc

SEQ ID NO: 7363 - DNA, 15 bp, Artificial Sequence
  dgRNA
  Mitf
gacgtcaagccagca

SEQ ID NO: 7364 - DNA, 15 bp, Artificial Sequence
  dgRNA
  Mitf
taagaccaaactagt

SEQ ID NO: 7365 - DNA, 15 bp, Artificial Sequence
  dgRNA
  Mitf
ctgtgataacgtctc

SEQ ID NO: 7366 - DNA, 15 bp, Artificial Sequence
  dgRNA
  Lmo2
gccgccgccgctatt

SEQ ID NO: 7367 - DNA, 15 bp, Artificial Sequence
  dgRNA
  Lmo2
ggattgctaatcccc

SEQ ID NO: 7368 - DNA, 15 bp, Artificial Sequence
  dgRNA
  Lmo2
atttgaatcgtgatc

SEQ ID NO: 7369 - DNA, 15 bp, Artificial Sequence
  dgRNA
  Lmo2
tcgtgatcaggaaaa

SEQ ID NO: 7370 - DNA, 15 bp, Artificial Sequence
  dgRNA
  Adamts18
tcggctctagcgcgc

SEQ ID NO: 7371 - DNA, 15 bp, Artificial Sequence
  dgRNA
  Adamts18
cggctctagcgcgct

SEQ ID NO: 7372 - DNA, 15 bp, Artificial Sequence
  dgRNA
  Adamts18
ggctctagcgcgctg

SEQ ID NO: 7373 - DNA, 15 bp, Artificial Sequence
  dgRNA
  Adamts18
gctctagcgcgctgg

SEQ ID NO: 7374 - DNA, 15 bp, Artificial Sequence
  dgRNA
  Pcsk5
ggaggcgctaggacc

SEQ ID NO: 7375 - DNA, 15 bp, Artificial Sequence
  dgRNA
  Pcsk5
gaggcgctaggacct

SEQ ID NO: 7376 - DNA, 15 bp, Artificial Sequence
  dgRNA
  Pcsk5
gcgctaggacctggg

SEQ ID NO: 7377 - DNA, 15 bp, Artificial Sequence
  dgRNA
  Pcsk5
gaggccccgctcgtg

SEQ ID NO: 7378 - DNA, 15 bp, Artificial Sequence
  dgRNA
  Pkd1
cagcggtgcagaagg

SEQ ID NO: 7379 - DNA, 15 bp, Artificial Sequence
  dgRNA
  Pkd1
gcggtgcagaaggcg

SEQ ID NO: 7380 - DNA, 15 bp, Artificial Sequence
  dgRNA
  Pkd1
aggcggggcctccgg

SEQ ID NO: 7381 - DNA, 15 bp, Artificial Sequence
  dgRNA
  Pkd1
aaggctcacgctcac

SEQ ID NO: 7382 - DNA, 15 bp, Artificial Sequence
  dgRNA
  BC051019
ccatagctacctgct

SEQ ID NO: 7383 - DNA, 15 bp, Artificial Sequence
  dgRNA
  BC051019
gcttggcaacttgcc

SEQ ID NO: 7384 - DNA, 15 bp, Artificial Sequence
  dgRNA
  BC051019
agagttgttagacca

SEQ ID NO: 7385 - DNA, 15 bp, Artificial Sequence
  dgRNA
  BC051019
gctccaactgtcagg

SEQ ID NO: 7386 - DNA, 15 bp, Artificial Sequence
  dgRNA
  5-Sep
ttccggacgaagccg

SEQ ID NO: 7387 - DNA, 15 bp, Artificial Sequence
  dgRNA
  5-Sep
tccggacgaagccgt

SEQ ID NO: 7388 - DNA, 15 bp, Artificial Sequence
  dgRNA
  5-Sep
gccgtgggaatagcc

SEQ ID NO: 7389 - DNA, 15 bp, Artificial Sequence
  dgRNA
  5-Sep
ccggctgcactcgcg

SEQ ID NO: 7390 - DNA, 15 bp, Artificial Sequence
  dgRNA
  Rnf146
tttattctagattcg

SEQ ID NO: 7391 - DNA, 15 bp, Artificial Sequence
  dgRNA
  Rnf146
ttattctagattcgc

SEQ ID NO: 7392 - DNA, 15 bp, Artificial Sequence
  dgRNA
  Rnf146
cttcctatgctgtta

SEQ ID NO: 7393 - DNA, 15 bp, Artificial Sequence
  dgRNA
  Rnf146
ctcccattacatatc

SEQ ID NO: 7394 - DNA, 15 bp, Artificial Sequence
  dgRNA
  Cd200r1
aaatttacaagcacg

SEQ ID NO: 7395 - DNA, 15 bp, Artificial Sequence
  dgRNA
  Cd200r1
ataaactgtacagta

SEQ ID NO: 7396 - DNA, 15 bp, Artificial Sequence
  dgRNA
  Cd200r1
ttactttcagcccat

SEQ ID NO: 7397 - DNA, 15 bp, Artificial Sequence
  dgRNA
  Klhl15
cgggcccctagcccg

SEQ ID NO: 7398 - DNA, 15 bp, Artificial Sequence
  dgRNA
  Klhl15
gggcccctagcccgt

SEQ ID NO: 7399 - DNA, 15 bp, Artificial Sequence
  dgRNA
  Klhl15
cccctgggcgggccc

SEQ ID NO: 7400 - DNA, 15 bp, Artificial Sequence
  dgRNA
  Klhl15
tgggcgggccccggg

SEQ ID NO: 7401 - DNA, 15 bp, Artificial Sequence
  dgRNA
  Shank3
ccgccgctgcgcctg

SEQ ID NO: 7402 - DNA, 15 bp, Artificial Sequence
  dgRNA
  Shank3
cgcctgcggagcccc

SEQ ID NO: 7403 - DNA, 15 bp, Artificial Sequence
  dgRNA
  Shank3
cgctgtcccccgcgc

SEQ ID NO: 7404 - DNA, 15 bp, Artificial Sequence
  dgRNA
  Shank3
cccccgcgctggccc

SEQ ID NO: 7405 - DNA, 15 bp, Artificial Sequence
  dgRNA
  Abhd4
aggagcctacttttg

SEQ ID NO: 7406 - DNA, 15 bp, Artificial Sequence
  dgRNA
  Abhd4
ggagcctacttttgt

SEQ ID NO: 7407 - DNA, 15 bp, Artificial Sequence
  dgRNA
  Abhd4
ccgtagtgttcagcc

SEQ ID NO: 7408 - DNA, 15 bp, Artificial Sequence
  dgRNA
  Abhd4
gttcagcctggacgc

SEQ ID NO: 7409 - DNA, 15 bp, Artificial Sequence
  dgRNA
  Rps29
gagcgctgagagcga

SEQ ID NO: 7410 - DNA, 15 bp, Artificial Sequence
  dgRNA
  Rps29
agcgctgagagcgac

SEQ ID NO: 7411 - DNA, 15 bp, Artificial Sequence
  dgRNA
  Rps29
atactagagctgcgg

SEQ ID NO: 7412 - DNA, 15 bp, Artificial Sequence
  dgRNA
  Rps29
tactagagctgcggc

SEQ ID NO: 7413 - DNA, 15 bp, Artificial Sequence
  dgRNA
  Gm42742
caaggtactgctttc

SEQ ID NO: 7414 - DNA, 15 bp, Artificial Sequence
  dgRNA
  Gm42742
gcaggccctactgaa

SEQ ID NO: 7415 - DNA, 15 bp, Artificial Sequence
  dgRNA
  Gm42742
catgcgctgccgcag

SEQ ID NO: 7416 - DNA, 15 bp, Artificial Sequence
  dgRNA
  Gm42742
tggccatctttagta

SEQ ID NO: 7417 - DNA, 15 bp, Artificial Sequence
  dgRNA
  Gm4871
acttaacagtcctcg

SEQ ID NO: 7418 - DNA, 15 bp, Artificial Sequence
  dgRNA
  Vnn1
aagcttttaccagac

SEQ ID NO: 7419 - DNA, 15 bp, Artificial Sequence
  dgRNA
  Vnn1
agcttttaccagaca

SEQ ID NO: 7420 - DNA, 15 bp, Artificial Sequence
  dgRNA
  Vnn1
tcacgtgtgacctcc

SEQ ID NO: 7421 - DNA, 15 bp, Artificial Sequence
  dgRNA
  Vnn1
ggtgggggctcactt

SEQ ID NO: 7422 - DNA, 15 bp, Artificial Sequence
  dgRNA
  Tmem44
tgcatcttttcaacc

SEQ ID NO: 7423 - DNA, 15 bp, Artificial Sequence
  dgRNA
  Tmem44
gcatcttttcaacca

SEQ ID NO: 7424 - DNA, 15 bp, Artificial Sequence
  dgRNA
  Tmem44
agggacaacgctcct

SEQ ID NO: 7425 - DNA, 15 bp, Artificial Sequence
  dgRNA
  Tmem44
gggacaacgctcctc

SEQ ID NO: 7426 - DNA, 15 bp, Artificial Sequence
  dgRNA
  St3gal3
gctatagcccgggga

SEQ ID NO: 7427 - DNA, 15 bp, Artificial Sequence
  dgRNA
  St3gal3
ctatagcccggggat

SEQ ID NO: 7428 - DNA, 15 bp, Artificial Sequence
  dgRNA
  St3gal3
tatagcccggggatg

SEQ ID NO: 7429 - DNA, 15 bp, Artificial Sequence
  dgRNA
  St3gal3
gatggattcggcctc

SEQ ID NO: 7430 - DNA, 15 bp, Artificial Sequence
  dgRNA
  Cnpy1
gtccatacacatctg

SEQ ID NO: 7431 - DNA, 15 bp, Artificial Sequence
  dgRNA
  Cnpy1
ggagctctgtgccgg

SEQ ID NO: 7432 - DNA, 15 bp, Artificial Sequence
  dgRNA
  Cnpy1
gagctctgtgccggg

SEQ ID NO: 7433 - DNA, 15 bp, Artificial Sequence
  dgRNA
  Cnpy1
agctctgtgccgggg

SEQ ID NO: 7434 - DNA, 15 bp, Artificial Sequence
  dgRNA
  Aarsd1
ccacctttatgccac

SEQ ID NO: 7435 - DNA, 15 bp, Artificial Sequence
  dgRNA
  Aarsd1
gctggccaaatcaca

SEQ ID NO: 7436 - DNA, 15 bp, Artificial Sequence
  dgRNA
  Gfm2
tagctgagacgccac

SEQ ID NO: 7437 - DNA, 15 bp, Artificial Sequence
  dgRNA
  Gfm2
tctaagcagttccgg

SEQ ID NO: 7438 - DNA, 15 bp, Artificial Sequence
  dgRNA
  Ankrd9
caccccgccacctcg

SEQ ID NO: 7439 - DNA, 15 bp, Artificial Sequence
  dgRNA
  Ankrd9
ctccgaagttttccg

SEQ ID NO: 7440 - DNA, 15 bp, Artificial Sequence
  dgRNA
  Ankrd9
tccgaagttttccgc

SEQ ID NO: 7441 - DNA, 15 bp, Artificial Sequence
  dgRNA
  Ankrd9
gagagtcccgccccc

SEQ ID NO: 7442 - DNA, 15 bp, Artificial Sequence
  dgRNA
  Ubap1
ccccttagggtccgc

SEQ ID NO: 7443 - DNA, 15 bp, Artificial Sequence
  dgRNA
  Ubap1
cccttagggtccgca

SEQ ID NO: 7444 - DNA, 15 bp, Artificial Sequence
  dgRNA
  Ubap1
gaagctcccggttgc

SEQ ID NO: 7445 - DNA, 15 bp, Artificial Sequence
  dgRNA
  Ubap1
gtcggctcctcccat

SEQ ID NO: 7446 - DNA, 15 bp, Artificial Sequence
  dgRNA
  E330009J07Rik
ggcgctgaacccgtg

SEQ ID NO: 7447 - DNA, 15 bp, Artificial Sequence
  dgRNA
  E330009J07Rik
gcgctgaacccgtgc

SEQ ID NO: 7448 - DNA, 15 bp, Artificial Sequence
  dgRNA
  E330009J07Rik
accaagcaagtgcgc

SEQ ID NO: 7449 - DNA, 15 bp, Artificial Sequence
  dgRNA
  E330009J07Rik
cgctggtgtccgagc

SEQ ID NO: 7450 - DNA, 15 bp, Artificial Sequence
  dgRNA
  Ezr
cgcgcgccccccttc

SEQ ID NO: 7451 - DNA, 15 bp, Artificial Sequence
  dgRNA
  Ezr
aagatcccggaattg

SEQ ID NO: 7452 - DNA, 15 bp, Artificial Sequence
  dgRNA
  Ezr
cccggaattgcggtt

SEQ ID NO: 7453 - DNA, 15 bp, Artificial Sequence
  dgRNA
  Ezr
attgcggtttggctc

SEQ ID NO: 7454 - DNA, 15 bp, Artificial Sequence
  dgRNA
  Impdh2
ttttcaacaagctac

SEQ ID NO: 7455 - DNA, 15 bp, Artificial Sequence
  dgRNA
  Impdh2
gaacgtgtctttatt

SEQ ID NO: 7456 - DNA, 15 bp, Artificial Sequence
  dgRNA
  Impdh2
aacgtgtctttattt

SEQ ID NO: 7457 - DNA, 15 bp, Artificial Sequence
  dgRNA
  Impdh2
acgtgtctttatttg

SEQ ID NO: 7458 - DNA, 15 bp, Artificial Sequence
  dgRNA
  Vmn2r61
tatccatcagtccta

SEQ ID NO: 7459 - DNA, 15 bp, Artificial Sequence
  dgRNA
  Vmn2r61
atcagtcctatggct

SEQ ID NO: 7460 - DNA, 15 bp, Artificial Sequence
  dgRNA
  Rufy3
gggcaagcaattccc

SEQ ID NO: 7461 - DNA, 15 bp, Artificial Sequence
  dgRNA
  CAAA01093181.2
ggaatctccagaact

SEQ ID NO: 7462 - DNA, 15 bp, Artificial Sequence
  dgRNA
  CAAA01093181.2
ccctttgtaaagacc

SEQ ID NO: 7463 - DNA, 15 bp, Artificial Sequence
  dgRNA
  Scgb1a1
gagctcagtttcaat

SEQ ID NO: 7464 - DNA, 15 bp, Artificial Sequence
  dgRNA
  Scgb1a1
atgcaatctcctaag

SEQ ID NO: 7465 - DNA, 15 bp, Artificial Sequence
  dgRNA
  Scgb1a1
acttgtggagtattc

SEQ ID NO: 7466 - DNA, 15 bp, Artificial Sequence
  dgRNA
  Scgb1a1
tggtcatcttctccg

SEQ ID NO: 7467 - DNA, 15 bp, Artificial Sequence
  dgRNA
  Lgalsl
cctgttcccggttct

SEQ ID NO: 7468 - DNA, 15 bp, Artificial Sequence
  dgRNA
  Lgalsl
caggccaacgcactg

SEQ ID NO: 7469 - DNA, 15 bp, Artificial Sequence
  dgRNA
  Lgalsl
gcggccgcgccagcc

SEQ ID NO: 7470 - DNA, 15 bp, Artificial Sequence
  dgRNA
  Lgalsl
cggccgcgccagcct

SEQ ID NO: 7471 - DNA, 15 bp, Artificial Sequence
  dgRNA
  Styx
cctgtcgcagccgct

SEQ ID NO: 7472 - DNA, 15 bp, Artificial Sequence
  dgRNA
  Styx
cgacaggaaggcgga

SEQ ID NO: 7473 - DNA, 15 bp, Artificial Sequence
  dgRNA
  Styx
gcgacaggaaggcgg

SEQ ID NO: 7474 - DNA, 15 bp, Artificial Sequence
  dgRNA
  Styx
gcggctgcgacagga

SEQ ID NO: 7475 - DNA, 15 bp, Artificial Sequence
  dgRNA
  Eif6
cttgacccttgccac

SEQ ID NO: 7476 - DNA, 15 bp, Artificial Sequence
  dgRNA
  Eif6
ccacttccgtccgcg

SEQ ID NO: 7477 - DNA, 15 bp, Artificial Sequence
  dgRNA
  Eif6
ttccgtccgcgtggc

SEQ ID NO: 7478 - DNA, 15 bp, Artificial Sequence
  dgRNA
  Eif6
tccgtccgcgtggcc

SEQ ID NO: 7479 - DNA, 15 bp, Artificial Sequence
  dgRNA
  Olfr1164
ccccgtgacgtctct

SEQ ID NO: 7480 - DNA, 15 bp, Artificial Sequence
  dgRNA
  Olfr1164
cgtgacgtctcttgg

SEQ ID NO: 7481 - DNA, 15 bp, Artificial Sequence
  dgRNA
  Olfr1164
agtcatgtatcagat

SEQ ID NO: 7482 - DNA, 15 bp, Artificial Sequence
  dgRNA
  Olfr1164
aagtcatgtatcaga

SEQ ID NO: 7483 - DNA, 15 bp, Artificial Sequence
  dgRNA
  Rbm4
ggcctctcaggtaat

SEQ ID NO: 7484 - DNA, 15 bp, Artificial Sequence
  dgRNA
  Rbm4
aggtaattggcgttc

SEQ ID NO: 7485 - DNA, 15 bp, Artificial Sequence
  dgRNA
  Rbm4
ggtaattggcgttcc

SEQ ID NO: 7486 - DNA, 15 bp, Artificial Sequence
  dgRNA
  Rbm4
tccgggtaaccaatc

SEQ ID NO: 7487 - DNA, 15 bp, Artificial Sequence
  dgRNA
  Mras
taggcaaatccaccg

SEQ ID NO: 7488 - DNA, 15 bp, Artificial Sequence
  dgRNA
  Mras
cgcgtagccacacct

SEQ ID NO: 7489 - DNA, 15 bp, Artificial Sequence
  dgRNA
  Mras
cagactggatgcacg

SEQ ID NO: 7490 - DNA, 15 bp, Artificial Sequence
  dgRNA
  Mras
acggtgtgtgcagac

SEQ ID NO: 7491 - DNA, 15 bp, Artificial Sequence
  dgRNA
  Pf4
actagtcaagacagc

SEQ ID NO: 7492 - DNA, 15 bp, Artificial Sequence
  dgRNA
  Pf4
ctagtagctggcagc

SEQ ID NO: 7493 - DNA, 15 bp, Artificial Sequence
  dgRNA
  Pf4
gtcttgactagtagc

SEQ ID NO: 7494 - DNA, 15 bp, Artificial Sequence
  dgRNA
  Pf4
acagtaattgggatc

SEQ ID NO: 7495 - DNA, 15 bp, Artificial Sequence
  dgRNA
  Ppef2
gggggggtgatcccg

SEQ ID NO: 7496 - DNA, 15 bp, Artificial Sequence
  dgRNA
  Ppef2
ggggggtgatcccgt

SEQ ID NO: 7497 - DNA, 15 bp, Artificial Sequence
  dgRNA
  Ppef2
ggggtgatcccgtgg

SEQ ID NO: 7498 - DNA, 15 bp, Artificial Sequence
  dgRNA
  Ppef2
acccctccgttccct

SEQ ID NO: 7499 - DNA, 15 bp, Artificial Sequence
  dgRNA
  Olfr1328
agtagtcatatcccc

SEQ ID NO: 7500 - DNA, 15 bp, Artificial Sequence
  dgRNA
  Olfr1328
acatgccagcaatag

SEQ ID NO: 7501 - DNA, 15 bp, Artificial Sequence
  dgRNA
  Hpse2
gggcgaaagagaata

SEQ ID NO: 7502 - DNA, 15 bp, Artificial Sequence
  dgRNA
  Hpse2
gcgaaagagaatagg

SEQ ID NO: 7503 - DNA, 15 bp, Artificial Sequence
  dgRNA
  Hpse2
ccatcgagacccagt

SEQ ID NO: 7504 - DNA, 15 bp, Artificial Sequence
  dgRNA
  Hpse2
catcgagacccagta

SEQ ID NO: 7505 - DNA, 15 bp, Artificial Sequence
  dgRNA
  Swsap1
ttttaatcgatcaca

SEQ ID NO: 7506 - DNA, 15 bp, Artificial Sequence
  dgRNA
  Swsap1
ccgtgttttgatcat

SEQ ID NO: 7507 - DNA, 15 bp, Artificial Sequence
  dgRNA
  Swsap1
gaactatagccaatg

SEQ ID NO: 7508 - DNA, 15 bp, Artificial Sequence
  dgRNA
  Swsap1
gatatcgcttttgat

SEQ ID NO: 7509 - DNA, 15 bp, Artificial Sequence
  dgRNA
  Ndst3
actcactcgttttga

SEQ ID NO: 7510 - DNA, 15 bp, Artificial Sequence
  dgRNA
  Ndst3
ctcactcgttttgat

SEQ ID NO: 7511 - DNA, 15 bp, Artificial Sequence
  dgRNA
  Ndst3
ccagatatgctgcaa

SEQ ID NO: 7512 - DNA, 15 bp, Artificial Sequence
  dgRNA
  Ndst3
agatcagttggtgta

SEQ ID NO: 7513 - DNA, 15 bp, Artificial Sequence
  dgRNA
  Cdh22
ggcgctcccttcgcg

SEQ ID NO: 7514 - DNA, 15 bp, Artificial Sequence
  dgRNA
  Cdh22
cccttcgcgcggatc

SEQ ID NO: 7515 - DNA, 15 bp, Artificial Sequence
  dgRNA
  Cdh22
ccttcgcgcggatct

SEQ ID NO: 7516 - DNA, 15 bp, Artificial Sequence
  dgRNA
  Cdh22
cgcgcggatctgggc

SEQ ID NO: 7517 - DNA, 15 bp, Artificial Sequence
  dgRNA
  Gtf2i
cgcggcgcttcgcct

SEQ ID NO: 7518 - DNA, 15 bp, Artificial Sequence
  dgRNA
  Gtf2i
ttcgcctcggcctag

SEQ ID NO: 7519 - DNA, 15 bp, Artificial Sequence
  dgRNA
  Gtf2i
tcgcctcggcctaga

SEQ ID NO: 7520 - DNA, 15 bp, Artificial Sequence
  dgRNA
  Gtf2i
cgcctcggcctagag

SEQ ID NO: 7521 - DNA, 15 bp, Artificial Sequence
  dgRNA
  Ifit1bl2
gactgtcacaccaac

SEQ ID NO: 7522 - DNA, 15 bp, Artificial Sequence
  dgRNA
  Ifit1bl2
gcctgcagtttatcc

SEQ ID NO: 7523 - DNA, 15 bp, Artificial Sequence
  dgRNA
  Ifit1bl2
cctgcagtttatcca

SEQ ID NO: 7524 - DNA, 15 bp, Artificial Sequence
  dgRNA
  Ifit1bl2
cagggagacgcactg

SEQ ID NO: 7525 - DNA, 15 bp, Artificial Sequence
  dgRNA
  Catsper4
tggttagaggctggt

SEQ ID NO: 7526 - DNA, 15 bp, Artificial Sequence
  dgRNA
  Catsper4
caagggcttcaggat

SEQ ID NO: 7527 - DNA, 15 bp, Artificial Sequence
  dgRNA
  Usp5
caggattggtccttt

SEQ ID NO: 7528 - DNA, 15 bp, Artificial Sequence
  dgRNA
  Usp5
catcagttgtacccg

SEQ ID NO: 7529 - DNA, 15 bp, Artificial Sequence
  dgRNA
  Usp5
cgcggcgctttttat

SEQ ID NO: 7530 - DNA, 15 bp, Artificial Sequence
  dgRNA
  Usp5
ttggtattcgctgag

SEQ ID NO: 7531 - DNA, 15 bp, Artificial Sequence
  dgRNA
  Olfm1
agcctgcctcctcgc

SEQ ID NO: 7532 - DNA, 15 bp, Artificial Sequence
  dgRNA
  Olfm1
ttccccgggcaagca

SEQ ID NO: 7533 - DNA, 15 bp, Artificial Sequence
  dgRNA
  Olfm1
ggcaagcaaggcgca

SEQ ID NO: 7534 - DNA, 15 bp, Artificial Sequence
  dgRNA
  Olfm1
gcaagcaaggcgcac

SEQ ID NO: 7535 - DNA, 15 bp, Artificial Sequence
  dgRNA
  Nsfl1c
gactacttcatcctg

SEQ ID NO: 7536 - DNA, 15 bp, Artificial Sequence
  dgRNA
  Nsfl1c
ggtgaggctcacata

SEQ ID NO: 7537 - DNA, 15 bp, Artificial Sequence
  dgRNA
  Nsfl1c
gctaggtttcccaca

SEQ ID NO: 7538 - DNA, 15 bp, Artificial Sequence
  dgRNA
  Nsfl1c
aggtttcccacacgg

SEQ ID NO: 7539 - DNA, 15 bp, Artificial Sequence
  dgRNA
  Dlc1
tttccacgagccctg

SEQ ID NO: 7540 - DNA, 15 bp, Artificial Sequence
  dgRNA
  Dlc1
ttccacgagccctgt

SEQ ID NO: 7541 - DNA, 15 bp, Artificial Sequence
  dgRNA
  Dlc1
ttgacaaactcactt

SEQ ID NO: 7542 - DNA, 15 bp, Artificial Sequence
  dgRNA
  Dlc1
agagcttcaacgccc

SEQ ID NO: 7543 - DNA, 15 bp, Artificial Sequence
  dgRNA
  Abcg5
cctattgtcgagata

SEQ ID NO: 7544 - DNA, 15 bp, Artificial Sequence
  dgRNA
  Abcg5
ggacactctggctaa

SEQ ID NO: 7545 - DNA, 15 bp, Artificial Sequence
  dgRNA
  Abcg5
aggtacatcagataa

SEQ ID NO: 7546 - DNA, 15 bp, Artificial Sequence
  dgRNA
  Abcg5
agataatggcatcgt

SEQ ID NO: 7547 - DNA, 15 bp, Artificial Sequence
  dgRNA
  Odf3l1
gccataccacagttc

SEQ ID NO: 7548 - DNA, 15 bp, Artificial Sequence
  dgRNA
  Odf3l1
caggcaccacggcaa

SEQ ID NO: 7549 - DNA, 15 bp, Artificial Sequence
  dgRNA
  Odf3l1
aggcaccacggcaac

SEQ ID NO: 7550 - DNA, 15 bp, Artificial Sequence
  dgRNA
  Odf3l1
caggctgaatgccct

SEQ ID NO: 7551 - DNA, 15 bp, Artificial Sequence
  dgRNA
  Zfp93
gagcgacctaccaaa

SEQ ID NO: 7552 - DNA, 15 bp, Artificial Sequence
  dgRNA
  Zfp93
gaagctttgccattc

SEQ ID NO: 7553 - DNA, 15 bp, Artificial Sequence
  dgRNA
  Zfp93
agctttgccattccg

SEQ ID NO: 7554 - DNA, 15 bp, Artificial Sequence
  dgRNA
  Zfp93
ttccaacgccagtag

SEQ ID NO: 7555 - DNA, 15 bp, Artificial Sequence
  dgRNA
  Syde2
ggccggggcggttgg

SEQ ID NO: 7556 - DNA, 15 bp, Artificial Sequence
  dgRNA
  Syde2
gccggggcggttggc

SEQ ID NO: 7557 - DNA, 15 bp, Artificial Sequence
  dgRNA
  Syde2
ccggggcggttggcg

SEQ ID NO: 7558 - DNA, 15 bp, Artificial Sequence
  dgRNA
  Syde2
tctctgcagccgcgc

SEQ ID NO: 7559 - DNA, 15 bp, Artificial Sequence
  dgRNA
  Mavs
cactggccctgcgac

SEQ ID NO: 7560 - DNA, 15 bp, Artificial Sequence
  dgRNA
  Mavs
gagcggctggtctag

SEQ ID NO: 7561 - DNA, 15 bp, Artificial Sequence
  dgRNA
  Mavs
atgttccggagcggc

SEQ ID NO: 7562 - DNA, 15 bp, Artificial Sequence
  dgRNA
  Mavs
cctgatgttccggag

SEQ ID NO: 7563 - DNA, 15 bp, Artificial Sequence
  dgRNA
  Hepacam2
cgcagaacatataac

SEQ ID NO: 7564 - DNA, 15 bp, Artificial Sequence
  dgRNA
  Hepacam2
gatactctctttgcg

SEQ ID NO: 7565 - DNA, 15 bp, Artificial Sequence
  dgRNA
  Hepacam2
ttctgcgagaacaca

SEQ ID NO: 7566 - DNA, 15 bp, Artificial Sequence
  dgRNA
  Hepacam2
gttctgcgagaacac

SEQ ID NO: 7567 - DNA, 15 bp, Artificial Sequence
  dgRNA
  Peg10
tgctgcccctagcgg

SEQ ID NO: 7568 - DNA, 15 bp, Artificial Sequence
  dgRNA
  Peg10
gctgcccctagcggc

SEQ ID NO: 7569 - DNA, 15 bp, Artificial Sequence
  dgRNA
  Peg10
acggttggcttaggc

SEQ ID NO: 7570 - DNA, 15 bp, Artificial Sequence
  dgRNA
  Peg10
gaggacggttggctt

SEQ ID NO: 7571 - DNA, 15 bp, Artificial Sequence
  dgRNA
  Klhl25
gtccctttaagaatc

SEQ ID NO: 7572 - DNA, 15 bp, Artificial Sequence
  dgRNA
  Klhl25
ccgccccgccttccg

SEQ ID NO: 7573 - DNA, 15 bp, Artificial Sequence
  dgRNA
  Klhl25
cttccgcggcaccga

SEQ ID NO: 7574 - DNA, 15 bp, Artificial Sequence
  dgRNA
  Klhl25
gcggcaccgatggcc

SEQ ID NO: 7575 - DNA, 15 bp, Artificial Sequence
  dgRNA
  Olfr287
aacctgcgagtgtgt

SEQ ID NO: 7576 - DNA, 15 bp, Artificial Sequence
  dgRNA
  Olfr287
acctgcgagtgtgtt

SEQ ID NO: 7577 - DNA, 15 bp, Artificial Sequence
  dgRNA
  Olfr287
gatcgttttactttc

SEQ ID NO: 7578 - DNA, 15 bp, Artificial Sequence
  dgRNA
  Zmat3
ctccgaggagccatc

SEQ ID NO: 7579 - DNA, 15 bp, Artificial Sequence
  dgRNA
  Zmat3
tccgaggagccatca

SEQ ID NO: 7580 - DNA, 15 bp, Artificial Sequence
  dgRNA
  Zmat3
tgttccgcacctgct

SEQ ID NO: 7581 - DNA, 15 bp, Artificial Sequence
  dgRNA
  Zmat3
acctgctcggcgtcc

SEQ ID NO: 7582 - DNA, 15 bp, Artificial Sequence
  dgRNA
  Pramef6
taactttggcctgag

SEQ ID NO: 7583 - DNA, 15 bp, Artificial Sequence
  dgRNA
  Pramef6
ttgaactgtcgtcta

SEQ ID NO: 7584 - DNA, 15 bp, Artificial Sequence
  dgRNA
  Gpc5
agcgtctcagcctca

SEQ ID NO: 7585 - DNA, 15 bp, Artificial Sequence
  dgRNA
  Gpc5
aagcggagctcttgc

SEQ ID NO: 7586 - DNA, 15 bp, Artificial Sequence
  dgRNA
  Gpc5
ttgcaggtgaagccg

SEQ ID NO: 7587 - DNA, 15 bp, Artificial Sequence
  dgRNA
  Gpc5
gccgcggtcccttcg

SEQ ID NO: 7588 - DNA, 15 bp, Artificial Sequence
  dgRNA
  Slc35d3
atccgctgcaactcg

SEQ ID NO: 7589 - DNA, 15 bp, Artificial Sequence
  dgRNA
  Slc35d3
tccgctgcaactcgc

SEQ ID NO: 7590 - DNA, 15 bp, Artificial Sequence
  dgRNA
  Slc35d3
caactcgcgggccac

SEQ ID NO: 7591 - DNA, 15 bp, Artificial Sequence
  dgRNA
  Slc35d3
aactcgcgggccacc

SEQ ID NO: 7592 - DNA, 15 bp, Artificial Sequence
  dgRNA
  Zic4
tgtggaaaatccacc

SEQ ID NO: 7593 - DNA, 15 bp, Artificial Sequence
  dgRNA
  Zic4
gtggaaaatccaccg

SEQ ID NO: 7594 - DNA, 15 bp, Artificial Sequence
  dgRNA
  Zic4
cggggacgttgacag

SEQ ID NO: 7595 - DNA, 15 bp, Artificial Sequence
  dgRNA
  Zic4
ggggacgttgacaga

SEQ ID NO: 7596 - DNA, 15 bp, Artificial Sequence
  dgRNA
  E130308A19Rik
gctcgcgtcgctgac

SEQ ID NO: 7597 - DNA, 15 bp, Artificial Sequence
  dgRNA
  E130308A19Rik
gcccgcgccccctca

SEQ ID NO: 7598 - DNA, 15 bp, Artificial Sequence
  dgRNA
  E130308A19Rik
gggcagcgagcgccg

SEQ ID NO: 7599 - DNA, 15 bp, Artificial Sequence
  dgRNA
  E130308A19Rik
ggcagcgagcgccgc

SEQ ID NO: 7600 - DNA, 15 bp, Artificial Sequence
  dgRNA
  Olfr228
ataaattcgagtgtt

SEQ ID NO: 7601 - DNA, 15 bp, Artificial Sequence
  dgRNA
  Leng8
ggtacttgtccccac

SEQ ID NO: 7602 - DNA, 15 bp, Artificial Sequence
  dgRNA
  Leng8
gtacttgtccccacg

SEQ ID NO: 7603 - DNA, 15 bp, Artificial Sequence
  dgRNA
  Leng8
acggggccaccgtct

SEQ ID NO: 7604 - DNA, 15 bp, Artificial Sequence
  dgRNA
  Leng8
cggggccaccgtcta

SEQ ID NO: 7605 - DNA, 15 bp, Artificial Sequence
  dgRNA
  Vmn2r1
atttccactcaatca

SEQ ID NO: 7606 - DNA, 15 bp, Artificial Sequence
  dgRNA
  Vmn2r1
tttgtggatctggac

SEQ ID NO: 7607 - DNA, 15 bp, Artificial Sequence
  dgRNA
  Vmn2r1
tcatgtctcaatcag

SEQ ID NO: 7608 - DNA, 15 bp, Artificial Sequence
  dgRNA
  Vmn2r1
tttcatgtctcaatc

SEQ ID NO: 7609 - DNA, 15 bp, Artificial Sequence
  dgRNA
  Scara3
aaccacgctttcccc

SEQ ID NO: 7610 - DNA, 15 bp, Artificial Sequence
  dgRNA
  Scara3
accacgctttccccc

SEQ ID NO: 7611 - DNA, 15 bp, Artificial Sequence
  dgRNA
  Scara3
ccacgctttcccccg

SEQ ID NO: 7612 - DNA, 15 bp, Artificial Sequence
  dgRNA
  Scara3
cgctttcccccgggg

SEQ ID NO: 7613 - DNA, 15 bp, Artificial Sequence
  dgRNA
  Syt7
ggcccagtgagcgcc

SEQ ID NO: 7614 - DNA, 15 bp, Artificial Sequence
  dgRNA
  Syt7
gcccagtgagcgcct

SEQ ID NO: 7615 - DNA, 15 bp, Artificial Sequence
  dgRNA
  Syt7
gcgcctggggtgcgc

SEQ ID NO: 7616 - DNA, 15 bp, Artificial Sequence
  dgRNA
  Syt7
cgcctggggtgcgcg

SEQ ID NO: 7617 - DNA, 15 bp, Artificial Sequence
  dgRNA
  Spats2
gggagagcgcctgag

SEQ ID NO: 7618 - DNA, 15 bp, Artificial Sequence
  dgRNA
  Spats2
agaggagcggtaacc

SEQ ID NO: 7619 - DNA, 15 bp, Artificial Sequence
  dgRNA
  Spats2
gcgccccggtcccct

SEQ ID NO: 7620 - DNA, 15 bp, Artificial Sequence
  dgRNA
  Spats2
ccggtctcccgcgtg

SEQ ID NO: 7621 - DNA, 15 bp, Artificial Sequence
  dgRNA
  Basp1
tgggggaccccctcc

SEQ ID NO: 7622 - DNA, 15 bp, Artificial Sequence
  dgRNA
  Basp1
gggggaccccctcct

SEQ ID NO: 7623 - DNA, 15 bp, Artificial Sequence
  dgRNA
  Basp1
ggaccccctcctggg

SEQ ID NO: 7624 - DNA, 15 bp, Artificial Sequence
  dgRNA
  Basp1
gtggcggggcgcgaa

SEQ ID NO: 7625 - DNA, 15 bp, Artificial Sequence
  dgRNA
  Bend5
actgcaatcgcactc

SEQ ID NO: 7626 - DNA, 15 bp, Artificial Sequence
  dgRNA
  Bend5
cggctgtgattgctc

SEQ ID NO: 7627 - DNA, 15 bp, Artificial Sequence
  dgRNA
  Bend5
gtctgacttcgcaag

SEQ ID NO: 7628 - DNA, 15 bp, Artificial Sequence
  dgRNA
  Bend5
tgacttcgcaagtgg

SEQ ID NO: 7629 - DNA, 15 bp, Artificial Sequence
  dgRNA
  Hcrt
agggcggccattctt

SEQ ID NO: 7630 - DNA, 15 bp, Artificial Sequence
  dgRNA
  Hcrt
gggcggccattcttt

SEQ ID NO: 7631 - DNA, 15 bp, Artificial Sequence
  dgRNA
  Hcrt
tctttgggtccaacc

SEQ ID NO: 7632 - DNA, 15 bp, Artificial Sequence
  dgRNA
  Hcrt
agcattataaacccc

SEQ ID NO: 7633 - DNA, 15 bp, Artificial Sequence
  dgRNA
  Ubl5
tcgcaaatcctagcc

SEQ ID NO: 7634 - DNA, 15 bp, Artificial Sequence
  dgRNA
  Ubl5
tcctagcccggaacc

SEQ ID NO: 7635 - DNA, 15 bp, Artificial Sequence
  dgRNA
  Ubl5
acccggaagcaccta

SEQ ID NO: 7636 - DNA, 15 bp, Artificial Sequence
  dgRNA
  Ubl5
cccggaagcacctaa

SEQ ID NO: 7637 - DNA, 15 bp, Artificial Sequence
  dgRNA
  Slc22a18
caaggggaccaaccc

SEQ ID NO: 7638 - DNA, 15 bp, Artificial Sequence
  dgRNA
  Slc22a18
aatatcactcacatg

SEQ ID NO: 7639 - DNA, 15 bp, Artificial Sequence
  dgRNA
  Slc22a18
gtaaaattgcccttc

SEQ ID NO: 7640 - DNA, 15 bp, Artificial Sequence
  dgRNA
  Krtap6-2
ttaagcaaaccatta

SEQ ID NO: 7641 - DNA, 15 bp, Artificial Sequence
  dgRNA
  Krtap6-2
gttgtcaacagtgac

SEQ ID NO: 7642 - DNA, 15 bp, Artificial Sequence
  dgRNA
  Krtap6-2
ttgttagttaagtca

SEQ ID NO: 7643 - DNA, 15 bp, Artificial Sequence
  dgRNA
  Krtap6-2
tgctctgacaattac

SEQ ID NO: 7644 - DNA, 15 bp, Artificial Sequence
  dgRNA
  Senp5
atcgtacatcagctg

SEQ ID NO: 7645 - DNA, 15 bp, Artificial Sequence
  dgRNA
  Senp5
ctgatgaccggaagt

SEQ ID NO: 7646 - DNA, 15 bp, Artificial Sequence
  dgRNA
  Senp5
cggaaacctgctttg

SEQ ID NO: 7647 - DNA, 15 bp, Artificial Sequence
  dgRNA
  Senp5
ctgctttgtggcgcc

SEQ ID NO: 7648 - DNA, 15 bp, Artificial Sequence
  dgRNA
  Serpina3g
tttccgaacaggaaa

SEQ ID NO: 7649 - DNA, 15 bp, Artificial Sequence
  dgRNA
  Serpina3g
ggaactataacttat

SEQ ID NO: 7650 - DNA, 15 bp, Artificial Sequence
  dgRNA
  Serpina3g
gaccgggtgatttct

SEQ ID NO: 7651 - DNA, 15 bp, Artificial Sequence
  dgRNA
  Serpina3g
agaccgggtgatttc

SEQ ID NO: 7652 - DNA, 15 bp, Artificial Sequence
  dgRNA
  2610524H06Rik
cccccaaagttggtc

SEQ ID NO: 7653 - DNA, 15 bp, Artificial Sequence
  dgRNA
  2610524H06Rik
ccggtcctgtttccg

SEQ ID NO: 7654 - DNA, 15 bp, Artificial Sequence
  dgRNA
  2610524H06Rik
cggagtgggcggacc

SEQ ID NO: 7655 - DNA, 15 bp, Artificial Sequence
  dgRNA
  2610524H06Rik
gagtgggcggacctg

SEQ ID NO: 7656 - DNA, 15 bp, Artificial Sequence
  dgRNA
  Mfn1
cgccttcagccctga

SEQ ID NO: 7657 - DNA, 15 bp, Artificial Sequence
  dgRNA
  Mfn1
caatatatgcagttc

SEQ ID NO: 7658 - DNA, 15 bp, Artificial Sequence
  dgRNA
  Mfn1
gaagcgtcagccaat

SEQ ID NO: 7659 - DNA, 15 bp, Artificial Sequence
  dgRNA
  Mfn1
ggagatccgaagcgc

SEQ ID NO: 7660 - DNA, 15 bp, Artificial Sequence
  dgRNA
  Olfr887
aactcccgtaagata

SEQ ID NO: 7661 - DNA, 15 bp, Artificial Sequence
  dgRNA
  Olfr887
ctgtccatatcttac

SEQ ID NO: 7662 - DNA, 15 bp, Artificial Sequence
  dgRNA
  Olfr887
gctgtccatatctta

SEQ ID NO: 7663 - DNA, 15 bp, Artificial Sequence
  dgRNA
  Bcas2
cagcacgtgatgctt

SEQ ID NO: 7664 - DNA, 15 bp, Artificial Sequence
  dgRNA
  Bcas2
agacttcggaagagg

SEQ ID NO: 7665 - DNA, 15 bp, Artificial Sequence
  dgRNA
  Bcas2
ggcagacttcggaag

SEQ ID NO: 7666 - DNA, 15 bp, Artificial Sequence
  dgRNA
  Bcas2
cgtgctggcgtgccg

SEQ ID NO: 7667 - DNA, 15 bp, Artificial Sequence
  dgRNA
  Ssrp1
cactgtgccgtcgcg

SEQ ID NO: 7668 - DNA, 15 bp, Artificial Sequence
  dgRNA
  Ssrp1
ggtggtcgcgatccc

SEQ ID NO: 7669 - DNA, 15 bp, Artificial Sequence
  dgRNA
  Ssrp1
gtggtcgcgatccct

SEQ ID NO: 7670 - DNA, 15 bp, Artificial Sequence
  dgRNA
  Ssrp1
gcccctggtgtgcat

SEQ ID NO: 7671 - DNA, 15 bp, Artificial Sequence
  dgRNA
  Lrrc42
tacattgcattgcct

SEQ ID NO: 7672 - DNA, 15 bp, Artificial Sequence
  dgRNA
  Lrrc42
cattgcattgcctcg

SEQ ID NO: 7673 - DNA, 15 bp, Artificial Sequence
  dgRNA
  Lrrc42
tgcattgcctcgggg

SEQ ID NO: 7674 - DNA, 15 bp, Artificial Sequence
  dgRNA
  Lrrc42
attgcctcggggagg

SEQ ID NO: 7675 - DNA, 15 bp, Artificial Sequence
  dgRNA
  Adam24
gttctatagtctaag

SEQ ID NO: 7676 - DNA, 15 bp, Artificial Sequence
  dgRNA
  Adam24
tagtctaagaggctc

SEQ ID NO: 7677 - DNA, 15 bp, Artificial Sequence
  dgRNA
  Adam24
atagaaccttgtagt

SEQ ID NO: 7678 - DNA, 15 bp, Artificial Sequence
  dgRNA
  Ggt6
ctatagctatagtgt

SEQ ID NO: 7679 - DNA, 15 bp, Artificial Sequence
  dgRNA
  Ggt6
aattgtgactctgta

SEQ ID NO: 7680 - DNA, 15 bp, Artificial Sequence
  dgRNA
  Ggt6
ccccgagtcctaacg

SEQ ID NO: 7681 - DNA, 15 bp, Artificial Sequence
  dgRNA
  Ggt6
gagtcctaacgaggc

SEQ ID NO: 7682 - DNA, 15 bp, Artificial Sequence
  dgRNA
  Smcp
aactttaaccagcag

SEQ ID NO: 7683 - DNA, 15 bp, Artificial Sequence
  dgRNA
  Smcp
actttaaccagcagt

SEQ ID NO: 7684 - DNA, 15 bp, Artificial Sequence
  dgRNA
  Smcp
caaaggtgaaccagc

SEQ ID NO: 7685 - DNA, 15 bp, Artificial Sequence
  dgRNA
  Smcp
gtcagagaatcttgg

SEQ ID NO: 7686 - DNA, 15 bp, Artificial Sequence
  dgRNA
  Fabp4
tgatctggcccccat

SEQ ID NO: 7687 - DNA, 15 bp, Artificial Sequence
  dgRNA
  Fabp4
tacagtcacatggtc

SEQ ID NO: 7688 - DNA, 15 bp, Artificial Sequence
  dgRNA
  Fabp4
cctggcaatgatcac

SEQ ID NO: 7689 - DNA, 15 bp, Artificial Sequence
  dgRNA
  Fabp4
aggagtgaccaatgg

SEQ ID NO: 7690 - DNA, 15 bp, Artificial Sequence
  dgRNA
  Kdm2b
cgcggcctccctcca

SEQ ID NO: 7691 - DNA, 15 bp, Artificial Sequence
  dgRNA
  Kdm2b
gcggcctccctccac

SEQ ID NO: 7692 - DNA, 15 bp, Artificial Sequence
  dgRNA
  Kdm2b
cccccgtgtcaccac

SEQ ID NO: 7693 - DNA, 15 bp, Artificial Sequence
  dgRNA
  Kdm2b
cggggccgagcaccg

SEQ ID NO: 7694 - DNA, 15 bp, Artificial Sequence
  dgRNA
  Dgcr8
gccgttagaagtgcc

SEQ ID NO: 7695 - DNA, 15 bp, Artificial Sequence
  dgRNA
  Dgcr8
tgccaggcttgcggc

SEQ ID NO: 7696 - DNA, 15 bp, Artificial Sequence
  dgRNA
  Dgcr8
tggtcccgcccatcc

SEQ ID NO: 7697 - DNA, 15 bp, Artificial Sequence
  dgRNA
  Dgcr8
atagcgcctcgcaat

SEQ ID NO: 7698 - DNA, 15 bp, Artificial Sequence
  dgRNA
  Gpx3
tattatttgcactaa

SEQ ID NO: 7699 - DNA, 15 bp, Artificial Sequence
  dgRNA
  Gpx3
attatttgcactaac

SEQ ID NO: 7700 - DNA, 15 bp, Artificial Sequence
  dgRNA
  Gpx3
ctatgttaagtcctc

SEQ ID NO: 7701 - DNA, 15 bp, Artificial Sequence
  dgRNA
  Gpx3
tatgttaagtcctcg

SEQ ID NO: 7702 - DNA, 15 bp, Artificial Sequence
  dgRNA
  Slc4a10
caagtatccaggtgt

SEQ ID NO: 7703 - DNA, 15 bp, Artificial Sequence
  dgRNA
  Slc4a10
tgtgggcagtgattc

SEQ ID NO: 7704 - DNA, 15 bp, Artificial Sequence
  dgRNA
  Slc4a10
ggggatctctcttac

SEQ ID NO: 7705 - DNA, 15 bp, Artificial Sequence
  dgRNA
  Slc4a10
tctcttaccggccca

SEQ ID NO: 7706 - DNA, 15 bp, Artificial Sequence
  dgRNA
  Th
cggagggtgattcag

SEQ ID NO: 7707 - DNA, 15 bp, Artificial Sequence
  dgRNA
  Th
aggtgcctgcgacag

SEQ ID NO: 7708 - DNA, 15 bp, Artificial Sequence
  dgRNA
  Th
tgcaattagatctaa

SEQ ID NO: 7709 - DNA, 15 bp, Artificial Sequence
  dgRNA
  Th
gcaattagatctaat

SEQ ID NO: 7710 - DNA, 15 bp, Artificial Sequence
  dgRNA
  Nanos1
aatcagcgtcccgac

SEQ ID NO: 7711 - DNA, 15 bp, Artificial Sequence
  dgRNA
  Nanos1
cccgaccggcgcccg

SEQ ID NO: 7712 - DNA, 15 bp, Artificial Sequence
  dgRNA
  Nanos1
ggcgcccgcggagtc

SEQ ID NO: 7713 - DNA, 15 bp, Artificial Sequence
  dgRNA
  Nanos1
cagccattgagcgcc

SEQ ID NO: 7714 - DNA, 15 bp, Artificial Sequence
  dgRNA
  1700057G04Rik
tacatctccacattc

SEQ ID NO: 7715 - DNA, 15 bp, Artificial Sequence
  dgRNA
  Cfhr1
gtgtaaaatgcctat

SEQ ID NO: 7716 - DNA, 15 bp, Artificial Sequence
  dgRNA
  Cfhr1
ccctttcttataggc

SEQ ID NO: 7717 - DNA, 15 bp, Artificial Sequence
  dgRNA
  Cfhr1
taaacaatgtccaat

SEQ ID NO: 7718 - DNA, 15 bp, Artificial Sequence
  dgRNA
  Lrrfip1
ggccgcaccccagct

SEQ ID NO: 7719 - DNA, 15 bp, Artificial Sequence
  dgRNA
  Lrrfip1
gccgcaccccagcta

SEQ ID NO: 7720 - DNA, 15 bp, Artificial Sequence
  dgRNA
  Lrrfip1
agggaacctcggagt

SEQ ID NO: 7721 - DNA, 15 bp, Artificial Sequence
  dgRNA
  Lrrfip1
cgagcgtgtgcgccc

SEQ ID NO: 7722 - DNA, 15 bp, Artificial Sequence
  dgRNA
  Ndufa6
cgacgctgcgcctcc

SEQ ID NO: 7723 - DNA, 15 bp, Artificial Sequence
  dgRNA
  Ndufa6
cgctgcgcctcctgg

SEQ ID NO: 7724 - DNA, 15 bp, Artificial Sequence
  dgRNA
  Ndufa6
tgaacgagccaaccc

SEQ ID NO: 7725 - DNA, 15 bp, Artificial Sequence
  dgRNA
  Ndufa6
gagccaaccccggat

SEQ ID NO: 7726 - DNA, 15 bp, Artificial Sequence
  dgRNA
  Npr2
gcccgatcagctgtg

SEQ ID NO: 7727 - DNA, 15 bp, Artificial Sequence
  dgRNA
  Npr2
cctcccttctcggct

SEQ ID NO: 7728 - DNA, 15 bp, Artificial Sequence
  dgRNA
  Npr2
cggcttggaattgtc

SEQ ID NO: 7729 - DNA, 15 bp, Artificial Sequence
  dgRNA
  Npr2
cctcatcccggtcgc

SEQ ID NO: 7730 - DNA, 15 bp, Artificial Sequence
  dgRNA
  Amd2
cctaatctcgagaat

SEQ ID NO: 7731 - DNA, 15 bp, Artificial Sequence
  dgRNA
  Amd2
cctattctcgagatt

SEQ ID NO: 7732 - DNA, 15 bp, Artificial Sequence
  dgRNA
  Cpne1
agctactaaaatacc

SEQ ID NO: 7733 - DNA, 15 bp, Artificial Sequence
  dgRNA
  Cpne1
cctgcgtctcccatc

SEQ ID NO: 7734 - DNA, 15 bp, Artificial Sequence
  dgRNA
  Cpne1
cccatcaggtgacgt

SEQ ID NO: 7735 - DNA, 15 bp, Artificial Sequence
  dgRNA
  Cpne1
aggtgacgtcggcag

SEQ ID NO: 7736 - DNA, 15 bp, Artificial Sequence
  dgRNA
  Polr1d
acccacagtatcgtc

SEQ ID NO: 7737 - DNA, 15 bp, Artificial Sequence
  dgRNA
  Polr1d
aaggtgccccatgaa

SEQ ID NO: 7738 - DNA, 15 bp, Artificial Sequence
  dgRNA
  Polr1d
gaggactcaagtcct

SEQ ID NO: 7739 - DNA, 15 bp, Artificial Sequence
  dgRNA
  Polr1d
gggaatagccagccc

SEQ ID NO: 7740 - DNA, 15 bp, Artificial Sequence
  dgRNA
  Cdk13
gggtggtgcgcggcg

SEQ ID NO: 7741 - DNA, 15 bp, Artificial Sequence
  dgRNA
  Cdk13
ggtggtgcgcggcga

SEQ ID NO: 7742 - DNA, 15 bp, Artificial Sequence
  dgRNA
  Cdk13
tgcgcggcgagggct

SEQ ID NO: 7743 - DNA, 15 bp, Artificial Sequence
  dgRNA
  Cdk13
gcgtcgccgtcccgc

SEQ ID NO: 7744 - DNA, 15 bp, Artificial Sequence
  dgRNA
  Synj1
agtaagcgccctgct

SEQ ID NO: 7745 - DNA, 15 bp, Artificial Sequence
  dgRNA
  Synj1
cagcacggtcccgcg

SEQ ID NO: 7746 - DNA, 15 bp, Artificial Sequence
  dgRNA
  Synj1
agcacggtcccgcgt

SEQ ID NO: 7747 - DNA, 15 bp, Artificial Sequence
  dgRNA
  Synj1
acggtcccgcgtggg

SEQ ID NO: 7748 - DNA, 15 bp, Artificial Sequence
  dgRNA
  Pdcd6ip
tttaatcatcgcagt

SEQ ID NO: 7749 - DNA, 15 bp, Artificial Sequence
  dgRNA
  Pdcd6ip
ctgatcccaccacgc

SEQ ID NO: 7750 - DNA, 15 bp, Artificial Sequence
  dgRNA
  Pdcd6ip
cgcacaggcgagccc

SEQ ID NO: 7751 - DNA, 15 bp, Artificial Sequence
  dgRNA
  Pdcd6ip
aggtgagcgacgctt

SEQ ID NO: 7752 - DNA, 15 bp, Artificial Sequence
  dgRNA
  Prkcd
gacggctaacagatc

SEQ ID NO: 7753 - DNA, 15 bp, Artificial Sequence
  dgRNA
  Prkcd
acggctaacagatct

SEQ ID NO: 7754 - DNA, 15 bp, Artificial Sequence
  dgRNA
  Prkcd
cggctaacagatctg

SEQ ID NO: 7755 - DNA, 15 bp, Artificial Sequence
  dgRNA
  Prkcd
acttgcaactcaaag

SEQ ID NO: 7756 - DNA, 15 bp, Artificial Sequence
  dgRNA
  Tnfaip8l2
gtgatgatgaaccgg

SEQ ID NO: 7757 - DNA, 15 bp, Artificial Sequence
  dgRNA
  Tnfaip8l2
atgatgaaccggagg

SEQ ID NO: 7758 - DNA, 15 bp, Artificial Sequence
  dgRNA
  Tnfaip8l2
gagagtagataggcg

SEQ ID NO: 7759 - DNA, 15 bp, Artificial Sequence
  dgRNA
  Tnfaip8l2
tagataggcggggcc

SEQ ID NO: 7760 - DNA, 15 bp, Artificial Sequence
  dgRNA
  Sost
acccccgtgaggagg

SEQ ID NO: 7761 - DNA, 15 bp, Artificial Sequence
  dgRNA
  Sost
cccccgtgaggagga

SEQ ID NO: 7762 - DNA, 15 bp, Artificial Sequence
  dgRNA
  Sost
ccagcccgtccttat

SEQ ID NO: 7763 - DNA, 15 bp, Artificial Sequence
  dgRNA
  Sost
cccgtccttattggc

SEQ ID NO: 7764 - DNA, 15 bp, Artificial Sequence
  dgRNA
  Cdh6
gagagcgaactgctc

SEQ ID NO: 7765 - DNA, 15 bp, Artificial Sequence
  dgRNA
  Cdh6
ccggacttcaaacac

SEQ ID NO: 7766 - DNA, 15 bp, Artificial Sequence
  dgRNA
  Cdh6
ggagtcattctgtca

SEQ ID NO: 7767 - DNA, 15 bp, Artificial Sequence
  dgRNA
  Cdh6
cattctgtcaagggg

SEQ ID NO: 7768 - DNA, 15 bp, Artificial Sequence
  dgRNA
  Nudt6
gcggggcgtgctccc

SEQ ID NO: 7769 - DNA, 15 bp, Artificial Sequence
  dgRNA
  Nudt6
gggcgtgctccctgg

SEQ ID NO: 7770 - DNA, 15 bp, Artificial Sequence
  dgRNA
  Nudt6
agacaaggctacgtc

SEQ ID NO: 7771 - DNA, 15 bp, Artificial Sequence
  dgRNA
  Nudt6
gcggggcgtgcgccc

SEQ ID NO: 7772 - DNA, 15 bp, Artificial Sequence
  dgRNA
  Zfp384
tttacctcgggcgag

SEQ ID NO: 7773 - DNA, 15 bp, Artificial Sequence
  dgRNA
  Zfp384
ttacctcgggcgagt

SEQ ID NO: 7774 - DNA, 15 bp, Artificial Sequence
  dgRNA
  Zfp384
tacctcgggcgagtg

SEQ ID NO: 7775 - DNA, 15 bp, Artificial Sequence
  dgRNA
  Zfp384
ctcgggcgagtgggg

SEQ ID NO: 7776 - DNA, 15 bp, Artificial Sequence
  dgRNA
  Edil3
cgcccaaagccagct

SEQ ID NO: 7777 - DNA, 15 bp, Artificial Sequence
  dgRNA
  Edil3
agccgtagtcactgc

SEQ ID NO: 7778 - DNA, 15 bp, Artificial Sequence
  dgRNA
  Edil3
tttgggcgcccccgg

SEQ ID NO: 7779 - DNA, 15 bp, Artificial Sequence
  dgRNA
  Edil3
ggctttgggcgcccc

SEQ ID NO: 7780 - DNA, 15 bp, Artificial Sequence
  dgRNA
  Lamtor3
atcatcttccgttgt

SEQ ID NO: 7781 - DNA, 15 bp, Artificial Sequence
  dgRNA
  Lamtor3
ccgttgtaggtgagt

SEQ ID NO: 7782 - DNA, 15 bp, Artificial Sequence
  dgRNA
  Lamtor3
gttggatggaaatta

SEQ ID NO: 7783 - DNA, 15 bp, Artificial Sequence
  dgRNA
  Lamtor3
caacccagctgctcg

SEQ ID NO: 7784 - DNA, 15 bp, Artificial Sequence
  dgRNA
  Mybl1
cctcctgacatgtcc

SEQ ID NO: 7785 - DNA, 15 bp, Artificial Sequence
  dgRNA
  Mybl1
atccctggccgggcc

SEQ ID NO: 7786 - DNA, 15 bp, Artificial Sequence
  dgRNA
  Mybl1
ggcccggccgcggct

SEQ ID NO: 7787 - DNA, 15 bp, Artificial Sequence
  dgRNA
  Mybl1
cgcggctaggagcag

SEQ ID NO: 7788 - DNA, 15 bp, Artificial Sequence
  dgRNA
  Tex13a
cctctgatcaagaac

SEQ ID NO: 7789 - DNA, 15 bp, Artificial Sequence
  dgRNA
  Tex13a
atgacataatagttg

SEQ ID NO: 7790 - DNA, 15 bp, Artificial Sequence
  dgRNA
  Tex13a
tgacataatagttgg

SEQ ID NO: 7791 - DNA, 15 bp, Artificial Sequence
  dgRNA
  Tex13a
gacataatagttggg

SEQ ID NO: 7792 - DNA, 15 bp, Artificial Sequence
  dgRNA
  St7
acgcgcacgttccca

SEQ ID NO: 7793 - DNA, 15 bp, Artificial Sequence
  dgRNA
  St7
gcacgttcccaaggc

SEQ ID NO: 7794 - DNA, 15 bp, Artificial Sequence
  dgRNA
  St7
tagtgaagcctgcct

SEQ ID NO: 7795 - DNA, 15 bp, Artificial Sequence
  dgRNA
  Sema4a
gaggcactcggagac

SEQ ID NO: 7796 - DNA, 15 bp, Artificial Sequence
  dgRNA
  Sema4a
ggaaagctgagcgcc

SEQ ID NO: 7797 - DNA, 15 bp, Artificial Sequence
  dgRNA
  Sema4a
gcgcctggcattcca

SEQ ID NO: 7798 - DNA, 15 bp, Artificial Sequence
  dgRNA
  Sema4a
cgcctggcattccag

SEQ ID NO: 7799 - DNA, 15 bp, Artificial Sequence
  dgRNA
  Slc35c2
acagagggaccgtgt

SEQ ID NO: 7800 - DNA, 15 bp, Artificial Sequence
  dgRNA
  Slc35c2
cagagggaccgtgtt

SEQ ID NO: 7801 - DNA, 15 bp, Artificial Sequence
  dgRNA
  Slc35c2
gccttagagatgctc

SEQ ID NO: 7802 - DNA, 15 bp, Artificial Sequence
  dgRNA
  Slc35c2
caccccaccgacttc

SEQ ID NO: 7803 - DNA, 15 bp, Artificial Sequence
  dgRNA
  Cyp3a11
gaacttttacccatc

SEQ ID NO: 7804 - DNA, 15 bp, Artificial Sequence
  dgRNA
  Cyp3a11
atgttagctcaaagt

SEQ ID NO: 7805 - DNA, 15 bp, Artificial Sequence
  dgRNA
  Cyp3a11
aaagtaggtcaagtt

SEQ ID NO: 7806 - DNA, 15 bp, Artificial Sequence
  dgRNA
  Cyp3a11
aataccctctcacca

SEQ ID NO: 7807 - DNA, 15 bp, Artificial Sequence
  dgRNA
  Hn1
taaattgcccaatgg

SEQ ID NO: 7808 - DNA, 15 bp, Artificial Sequence
  dgRNA
  Hn1
cccaatggcggcatg

SEQ ID NO: 7809 - DNA, 15 bp, Artificial Sequence
  dgRNA
  Hn1
aatggcggcatgtgg

SEQ ID NO: 7810 - DNA, 15 bp, Artificial Sequence
  dgRNA
  Hn1
gcggcatgtggaggg

SEQ ID NO: 7811 - DNA, 15 bp, Artificial Sequence
  dgRNA
  Bag1
tcctccttccggaga

SEQ ID NO: 7812 - DNA, 15 bp, Artificial Sequence
  dgRNA
  Bag1
tccggagaaggagcg

SEQ ID NO: 7813 - DNA, 15 bp, Artificial Sequence
  dgRNA
  Bag1
ggagcgcggagctct

SEQ ID NO: 7814 - DNA, 15 bp, Artificial Sequence
  dgRNA
  Bag1
cttatgaggagggat

SEQ ID NO: 7815 - DNA, 15 bp, Artificial Sequence
  dgRNA
  Copa
cgaggcatgcgagaa

SEQ ID NO: 7816 - DNA, 15 bp, Artificial Sequence
  dgRNA
  Copa
gaggaacttatgtca

SEQ ID NO: 7817 - DNA, 15 bp, Artificial Sequence
  dgRNA
  Copa
aggatttccagggcg

SEQ ID NO: 7818 - DNA, 15 bp, Artificial Sequence
  dgRNA
  Copa
ggatttccagggcgg

SEQ ID NO: 7819 - DNA, 15 bp, Artificial Sequence
  dgRNA
  Ms4a2
tgatatcaatcagcc

SEQ ID NO: 7820 - DNA, 15 bp, Artificial Sequence
  dgRNA
  Ms4a2
acttatctgacaagt

SEQ ID NO: 7821 - DNA, 15 bp, Artificial Sequence
  dgRNA
  Ms4a2
gtcagataagtctcc

SEQ ID NO: 7822 - DNA, 15 bp, Artificial Sequence
  dgRNA
  Ms4a2
atgggcagttaagat

SEQ ID NO: 7823 - DNA, 15 bp, Artificial Sequence
  dgRNA
  Kbtbd13
gccctctgggctcgg

SEQ ID NO: 7824 - DNA, 15 bp, Artificial Sequence
  dgRNA
  Kbtbd13
gctatccaagcctgc

SEQ ID NO: 7825 - DNA, 15 bp, Artificial Sequence
  dgRNA
  Kbtbd13
atcctatctttagcc

SEQ ID NO: 7826 - DNA, 15 bp, Artificial Sequence
  dgRNA
  Kbtbd13
tatttataaccccca

SEQ ID NO: 7827 - DNA, 15 bp, Artificial Sequence
  dgRNA
  H2afx
tcttccccgggtaaa

SEQ ID NO: 7828 - DNA, 15 bp, Artificial Sequence
  dgRNA
  H2afx
attggaccaatcact

SEQ ID NO: 7829 - DNA, 15 bp, Artificial Sequence
  dgRNA
  H2afx
aaggcgcgtcaccga

SEQ ID NO: 7830 - DNA, 15 bp, Artificial Sequence
  dgRNA
  H2afx
aggcgcgtcaccgaa

SEQ ID NO: 7831 - DNA, 15 bp, Artificial Sequence
  dgRNA
  H2-DMb1
tatgcactatctcct

SEQ ID NO: 7832 - DNA, 15 bp, Artificial Sequence
  dgRNA
  H2-DMb1
aggcaacgtcccttt

SEQ ID NO: 7833 - DNA, 15 bp, Artificial Sequence
  dgRNA
  H2-DMb1
acgtcccttttggag

SEQ ID NO: 7834 - DNA, 15 bp, Artificial Sequence
  dgRNA
  H2-DMb1
atagttttctcgaag

SEQ ID NO: 7835 - DNA, 15 bp, Artificial Sequence
  dgRNA
  Sntg2
atggtctcagcaagg

SEQ ID NO: 7836 - DNA, 15 bp, Artificial Sequence
  dgRNA
  Sntg2
cccctcactgacagg

SEQ ID NO: 7837 - DNA, 15 bp, Artificial Sequence
  dgRNA
  Sntg2
gatgggcggggttac

SEQ ID NO: 7838 - DNA, 15 bp, Artificial Sequence
  dgRNA
  Sntg2
gggttaccgggcatg

SEQ ID NO: 7839 - DNA, 15 bp, Artificial Sequence
  dgRNA
  Sfpq
ttcttatccgtttat

SEQ ID NO: 7840 - DNA, 15 bp, Artificial Sequence
  dgRNA
  Sfpq
cgtttattggtcaaa

SEQ ID NO: 7841 - DNA, 15 bp, Artificial Sequence
  dgRNA
  Sfpq
tcccgcctctcacta

SEQ ID NO: 7842 - DNA, 15 bp, Artificial Sequence
  dgRNA
  Sfpq
cactagggagccaat

SEQ ID NO: 7843 - DNA, 15 bp, Artificial Sequence
  dgRNA
  Usp8
cgtctcgaaacgtca

SEQ ID NO: 7844 - DNA, 15 bp, Artificial Sequence
  dgRNA
  Olfr1167
ttggtaaacactgac

SEQ ID NO: 7845 - DNA, 15 bp, Artificial Sequence
  dgRNA
  Olfr1167
tgaaaaccgaaaacg

SEQ ID NO: 7846 - DNA, 15 bp, Artificial Sequence
  dgRNA
  Olfr1167
tcctcatgtttaatc

SEQ ID NO: 7847 - DNA, 15 bp, Artificial Sequence
  dgRNA
  Olfr1167
gtgtttaccaaagtt

SEQ ID NO: 7848 - DNA, 15 bp, Artificial Sequence
  dgRNA
  Cttnbp2
ctcgacaccagcgcg

SEQ ID NO: 7849 - DNA, 15 bp, Artificial Sequence
  dgRNA
  Cttnbp2
gaggccgcgcatctc

SEQ ID NO: 7850 - DNA, 15 bp, Artificial Sequence
  dgRNA
  Cttnbp2
gcgcatctctggtgc

SEQ ID NO: 7851 - DNA, 15 bp, Artificial Sequence
  dgRNA
  Cttnbp2
tggttcttggtcccg

SEQ ID NO: 7852 - DNA, 15 bp, Artificial Sequence
  dgRNA
  Dppa3
tggctgggattgcgc

SEQ ID NO: 7853 - DNA, 15 bp, Artificial Sequence
  dgRNA
  Dppa3
ggctgggattgcgca

SEQ ID NO: 7854 - DNA, 15 bp, Artificial Sequence
  dgRNA
  Dppa3
agttttaaccgagag

SEQ ID NO: 7855 - DNA, 15 bp, Artificial Sequence
  dgRNA
  Dppa3
ttttaaccgagagcg

SEQ ID NO: 7856 - DNA, 15 bp, Artificial Sequence
  dgRNA
  Plekhb1
gaaagatgcggttgc

SEQ ID NO: 7857 - DNA, 15 bp, Artificial Sequence
  dgRNA
  Plekhb1
aaagatgcggttgct

SEQ ID NO: 7858 - DNA, 15 bp, Artificial Sequence
  dgRNA
  Plekhb1
aagatgcggttgctg

SEQ ID NO: 7859 - DNA, 15 bp, Artificial Sequence
  dgRNA
  Plekhb1
gaggggatgagctac

SEQ ID NO: 7860 - DNA, 15 bp, Artificial Sequence
  dgRNA
  Stxbp1
cctggcgcgagcgtg

SEQ ID NO: 7861 - DNA, 15 bp, Artificial Sequence
  dgRNA
  Stxbp1
gcgagcgtgaggcgc

SEQ ID NO: 7862 - DNA, 15 bp, Artificial Sequence
  dgRNA
  Stxbp1
cgagcgtgaggcgca

SEQ ID NO: 7863 - DNA, 15 bp, Artificial Sequence
  dgRNA
  Stxbp1
gagcgtgaggcgcag

SEQ ID NO: 7864 - DNA, 15 bp, Artificial Sequence
  dgRNA
  Kif1b
cgcggtgtagtcaga

SEQ ID NO: 7865 - DNA, 15 bp, Artificial Sequence
  dgRNA
  Kif1b
gtagtcagacggcag

SEQ ID NO: 7866 - DNA, 15 bp, Artificial Sequence
  dgRNA
  Kif1b
agacggcagtggtcc

SEQ ID NO: 7867 - DNA, 15 bp, Artificial Sequence
  dgRNA
  Kif1b
gcgacagctcggatc

SEQ ID NO: 7868 - DNA, 15 bp, Artificial Sequence
  dgRNA
  Steap1
ccaaggattcgcccc

SEQ ID NO: 7869 - DNA, 15 bp, Artificial Sequence
  dgRNA
  Steap1
gcgacgcccctccca

SEQ ID NO: 7870 - DNA, 15 bp, Artificial Sequence
  dgRNA
  Steap1
acgcccctcccacgg

SEQ ID NO: 7871 - DNA, 15 bp, Artificial Sequence
  dgRNA
  Steap1
ccgcagcgaagcccc

SEQ ID NO: 7872 - DNA, 15 bp, Artificial Sequence
  dgRNA
  Gpr45
taggaaagtgggcgc

SEQ ID NO: 7873 - DNA, 15 bp, Artificial Sequence
  dgRNA
  Gpr45
gtgggcgcgggttgc

SEQ ID NO: 7874 - DNA, 15 bp, Artificial Sequence
  dgRNA
  Gpr45
tgggcgcgggttgct

SEQ ID NO: 7875 - DNA, 15 bp, Artificial Sequence
  dgRNA
  Gpr45
ggagccgcgcagttg

SEQ ID NO: 7876 - DNA, 15 bp, Artificial Sequence
  dgRNA
  Bpi
gccttacatgaggcg

SEQ ID NO: 7877 - DNA, 15 bp, Artificial Sequence
  dgRNA
  Bpi
ttacatgaggcgagg

SEQ ID NO: 7878 - DNA, 15 bp, Artificial Sequence
  dgRNA
  Bpi
ccgtcccagagccac

SEQ ID NO: 7879 - DNA, 15 bp, Artificial Sequence
  dgRNA
  Bpi
gccacaggtctcaac

SEQ ID NO: 7880 - DNA, 15 bp, Artificial Sequence
  dgRNA
  Stk19
atccgccctcagcgt

SEQ ID NO: 7881 - DNA, 15 bp, Artificial Sequence
  dgRNA
  Stk19
ccctcagcgtcggag

SEQ ID NO: 7882 - DNA, 15 bp, Artificial Sequence
  dgRNA
  Stk19
cctcagcgtcggagt

SEQ ID NO: 7883 - DNA, 15 bp, Artificial Sequence
  dgRNA
  Stk19
gcgtcggagtgggcg

SEQ ID NO: 7884 - DNA, 15 bp, Artificial Sequence
  dgRNA
  Phyhd1
agagttaaatccttc

SEQ ID NO: 7885 - DNA, 15 bp, Artificial Sequence
  dgRNA
  Phyhd1
gcctccagttaatcc

SEQ ID NO: 7886 - DNA, 15 bp, Artificial Sequence
  dgRNA
  Tnrc6a
gctcgtggggaacct

SEQ ID NO: 7887 - DNA, 15 bp, Artificial Sequence
  dgRNA
  Tnrc6a
gttccccgacagctc

SEQ ID NO: 7888 - DNA, 15 bp, Artificial Sequence
  dgRNA
  Tnrc6a
gctccggcgaagtcc

SEQ ID NO: 7889 - DNA, 15 bp, Artificial Sequence
  dgRNA
  Tnrc6a
gctgcctcgtccggc

SEQ ID NO: 7890 - DNA, 15 bp, Artificial Sequence
  dgRNA
  Olfr196
actgcgtttcatttc

SEQ ID NO: 7891 - DNA, 15 bp, Artificial Sequence
  dgRNA
  Zbtb8a
taagtgcttcgtcaa

SEQ ID NO: 7892 - DNA, 15 bp, Artificial Sequence
  dgRNA
  Zbtb8a
aagtgcttcgtcaaa

SEQ ID NO: 7893 - DNA, 15 bp, Artificial Sequence
  dgRNA
  Zbtb8a
caaagggcgattttg

SEQ ID NO: 7894 - DNA, 15 bp, Artificial Sequence
  dgRNA
  Zbtb8a
ttagcgacgtaaaat

SEQ ID NO: 7895 - DNA, 15 bp, Artificial Sequence
  dgRNA
  Sez6l2
ctccgagataagccc

SEQ ID NO: 7896 - DNA, 15 bp, Artificial Sequence
  dgRNA
  Sez6l2
cggttgaacctcata

SEQ ID NO: 7897 - DNA, 15 bp, Artificial Sequence
  dgRNA
  Sez6l2
ggttgaacctcataa

SEQ ID NO: 7898 - DNA, 15 bp, Artificial Sequence
  dgRNA
  Sez6l2
ctcataagggccctc

SEQ ID NO: 7899 - DNA, 15 bp, Artificial Sequence
  dgRNA
  Eif2d
gaatagactgcaatc

SEQ ID NO: 7900 - DNA, 15 bp, Artificial Sequence
  dgRNA
  Eif2d
acgccgtatctaaag

SEQ ID NO: 7901 - DNA, 15 bp, Artificial Sequence
  dgRNA
  Eif2d
cgtatctaaagcgga

SEQ ID NO: 7902 - DNA, 15 bp, Artificial Sequence
  dgRNA
  Eif2d
cgttgtttgcacaac

SEQ ID NO: 7903 - DNA, 15 bp, Artificial Sequence
  dgRNA
  Lcp1
ctcttgggtgcaacc

SEQ ID NO: 7904 - DNA, 15 bp, Artificial Sequence
  dgRNA
  Lcp1
gaaccgagagctgta

SEQ ID NO: 7905 - DNA, 15 bp, Artificial Sequence
  dgRNA
  Lcp1
caaaatgagtaacgg

SEQ ID NO: 7906 - DNA, 15 bp, Artificial Sequence
  dgRNA
  Lcp1
gcgatttggagacaa

SEQ ID NO: 7907 - DNA, 15 bp, Artificial Sequence
  dgRNA
  Pth2r
agagactaaccctac

SEQ ID NO: 7908 - DNA, 15 bp, Artificial Sequence
  dgRNA
  Pth2r
aaccctacaggtctc

SEQ ID NO: 7909 - DNA, 15 bp, Artificial Sequence
  dgRNA
  Pth2r
tggtcagtgcgcatc

SEQ ID NO: 7910 - DNA, 15 bp, Artificial Sequence
  dgRNA
  Pth2r
ggtcagtgcgcatct

SEQ ID NO: 7911 - DNA, 15 bp, Artificial Sequence
  dgRNA
  Olfr826
agagtccatattagc

SEQ ID NO: 7912 - DNA, 15 bp, Artificial Sequence
  dgRNA
  Olfr826
ttcaaccagctaata

SEQ ID NO: 7913 - DNA, 15 bp, Artificial Sequence
  dgRNA
  Olfr826
gttgatacagtacaa

SEQ ID NO: 7914 - DNA, 15 bp, Artificial Sequence
  dgRNA
  Olfr826
tgttgatacagtaca

SEQ ID NO: 7915 - DNA, 15 bp, Artificial Sequence
  dgRNA
  Tfap2d
acttctatattacca

SEQ ID NO: 7916 - DNA, 15 bp, Artificial Sequence
  dgRNA
  Tfap2d
ctaataaggaactgg

SEQ ID NO: 7917 - DNA, 15 bp, Artificial Sequence
  dgRNA
  Tfap2d
cctaataaggaactg

SEQ ID NO: 7918 - DNA, 15 bp, Artificial Sequence
  dgRNA
  Tfap2d
gcctaataaggaact

SEQ ID NO: 7919 - DNA, 15 bp, Artificial Sequence
  dgRNA
  Slc39a14
acaccttggagttta

SEQ ID NO: 7920 - DNA, 15 bp, Artificial Sequence
  dgRNA
  Slc39a14
agagtctgctaactc

SEQ ID NO: 7921 - DNA, 15 bp, Artificial Sequence
  dgRNA
  Slc39a14
tgacagccgccagcc

SEQ ID NO: 7922 - DNA, 15 bp, Artificial Sequence
  dgRNA
  Ints7
gcccccaagttccac

SEQ ID NO: 7923 - DNA, 15 bp, Artificial Sequence
  dgRNA
  Ints7
gcaccctccacaacg

SEQ ID NO: 7924 - DNA, 15 bp, Artificial Sequence
  dgRNA
  Ints7
ctccacaacgcggcg

SEQ ID NO: 7925 - DNA, 15 bp, Artificial Sequence
  dgRNA
  Ints7
cgccactaagagccc

SEQ ID NO: 7926 - DNA, 15 bp, Artificial Sequence
  dgRNA
  Bcdin3d
aggttcaactcaagt

SEQ ID NO: 7927 - DNA, 15 bp, Artificial Sequence
  dgRNA
  Bcdin3d
ggttcaactcaagtt

SEQ ID NO: 7928 - DNA, 15 bp, Artificial Sequence
  dgRNA
  Bcdin3d
agtccgttaagtaag

SEQ ID NO: 7929 - DNA, 15 bp, Artificial Sequence
  dgRNA
  Bcdin3d
gtccgttaagtaaga

SEQ ID NO: 7930 - DNA, 15 bp, Artificial Sequence
  dgRNA
  Zfp1
cagttactccaaatc

SEQ ID NO: 7931 - DNA, 15 bp, Artificial Sequence
  dgRNA
  Zfp1
agttactccaaatcc

SEQ ID NO: 7932 - DNA, 15 bp, Artificial Sequence
  dgRNA
  Zfp1
ggtttttaacagcac

SEQ ID NO: 7933 - DNA, 15 bp, Artificial Sequence
  dgRNA
  Zfp1
accagactgttaact

SEQ ID NO: 7934 - DNA, 15 bp, Artificial Sequence
  dgRNA
  Lyz1
gcacagatcaaatgt

SEQ ID NO: 7935 - DNA, 15 bp, Artificial Sequence
  dgRNA
  Lyz1
cagatcaaatgtagg

SEQ ID NO: 7936 - DNA, 15 bp, Artificial Sequence
  dgRNA
  Lyz1
gaggccgcaagctgt

SEQ ID NO: 7937 - DNA, 15 bp, Artificial Sequence
  dgRNA
  Lyz1
aattgcttaaagatt

SEQ ID NO: 7938 - DNA, 15 bp, Artificial Sequence
  dgRNA
  Clec4a2
agagtgttttacaac

SEQ ID NO: 7939 - DNA, 15 bp, Artificial Sequence
  dgRNA
  Clec4a2
gagtgttttacaaca

SEQ ID NO: 7940 - DNA, 15 bp, Artificial Sequence
  dgRNA
  Clec4a2
ggttctctaatagca

SEQ ID NO: 7941 - DNA, 15 bp, Artificial Sequence
  dgRNA
  Clec4a2
tgattttgactgaac

SEQ ID NO: 7942 - DNA, 15 bp, Artificial Sequence
  dgRNA
  Cux1
actgccccgccggcg

SEQ ID NO: 7943 - DNA, 15 bp, Artificial Sequence
  dgRNA
  Cux1
gccccgccggcgcgg

SEQ ID NO: 7944 - DNA, 15 bp, Artificial Sequence
  dgRNA
  Cux1
ccggcgcggcggagc

SEQ ID NO: 7945 - DNA, 15 bp, Artificial Sequence
  dgRNA
  Cux1
gcgctgtggtgccgc

SEQ ID NO: 7946 - DNA, 15 bp, Artificial Sequence
  dgRNA
  Olfr870
acactacagtctcta

SEQ ID NO: 7947 - DNA, 15 bp, Artificial Sequence
  dgRNA
  Olfr870
aagctagacacctac

SEQ ID NO: 7948 - DNA, 15 bp, Artificial Sequence
  dgRNA
  Cdkn1a
aatagcccaggtgtg

SEQ ID NO: 7949 - DNA, 15 bp, Artificial Sequence
  dgRNA
  Cdkn1a
cctcttaacgcgcgc

SEQ ID NO: 7950 - DNA, 15 bp, Artificial Sequence
  dgRNA
  Cdkn1a
ccggttctagctgtc

SEQ ID NO: 7951 - DNA, 15 bp, Artificial Sequence
  dgRNA
  Cdkn1a
tctagctgtctggcg

SEQ ID NO: 7952 - DNA, 15 bp, Artificial Sequence
  dgRNA
  Ly6g5c
attttacggagcacc

SEQ ID NO: 7953 - DNA, 15 bp, Artificial Sequence
  dgRNA
  Ly6g5c
tacggagcaccagga

SEQ ID NO: 7954 - DNA, 15 bp, Artificial Sequence
  dgRNA
  Ly6g5c
tccagccaggatatt

SEQ ID NO: 7955 - DNA, 15 bp, Artificial Sequence
  dgRNA
  Ly6g5c
aggatattaggccca

SEQ ID NO: 7956 - DNA, 15 bp, Artificial Sequence
  dgRNA
  Dph1
gcaagggggaccact

SEQ ID NO: 7957 - DNA, 15 bp, Artificial Sequence
  dgRNA
  Dph1
ctaggagacgctgag

SEQ ID NO: 7958 - DNA, 15 bp, Artificial Sequence
  dgRNA
  Dph1
accttttgtaccaac

SEQ ID NO: 7959 - DNA, 15 bp, Artificial Sequence
  dgRNA
  Dph1
tagaatctccgccct

SEQ ID NO: 7960 - DNA, 15 bp, Artificial Sequence
  dgRNA
  Stmn4
tcactcaggcaaccc

SEQ ID NO: 7961 - DNA, 15 bp, Artificial Sequence
  dgRNA
  Stmn4
ccccggctccaccaa

SEQ ID NO: 7962 - DNA, 15 bp, Artificial Sequence
  dgRNA
  Stmn4
caccgctagccaatc

SEQ ID NO: 7963 - DNA, 15 bp, Artificial Sequence
  dgRNA
  Stmn4
accgctagccaatca

SEQ ID NO: 7964 - DNA, 15 bp, Artificial Sequence
  dgRNA
  Madd
cactcccacgacgaa

SEQ ID NO: 7965 - DNA, 15 bp, Artificial Sequence
  dgRNA
  Madd
aggtgtgagcgtcgc

SEQ ID NO: 7966 - DNA, 15 bp, Artificial Sequence
  dgRNA
  Madd
ggtgtgagcgtcgcc

SEQ ID NO: 7967 - DNA, 15 bp, Artificial Sequence
  dgRNA
  Madd
tcgccgggctccgct

SEQ ID NO: 7968 - DNA, 15 bp, Artificial Sequence
  dgRNA
  Def6
gactatctgtgctga

SEQ ID NO: 7969 - DNA, 15 bp, Artificial Sequence
  dgRNA
  Def6
cgtggcgagagcagc

SEQ ID NO: 7970 - DNA, 15 bp, Artificial Sequence
  dgRNA
  Def6
gctccgctctgcacc

SEQ ID NO: 7971 - DNA, 15 bp, Artificial Sequence
  dgRNA
  Def6
ctccgctctgcacca

SEQ ID NO: 7972 - DNA, 15 bp, Artificial Sequence
  dgRNA
  Ank
ccgagccgtgcgcag

SEQ ID NO: 7973 - DNA, 15 bp, Artificial Sequence
  dgRNA
  Ank
ccgtgcgcagcggag

SEQ ID NO: 7974 - DNA, 15 bp, Artificial Sequence
  dgRNA
  Ank
cgtgcgcagcggagc

SEQ ID NO: 7975 - DNA, 15 bp, Artificial Sequence
  dgRNA
  Ank
gtgcgcagcggagcg

SEQ ID NO: 7976 - DNA, 15 bp, Artificial Sequence
  dgRNA
  Morc4
tcgcgctttcccgct

SEQ ID NO: 7977 - DNA, 15 bp, Artificial Sequence
  dgRNA
  Morc4
tcccgctcggccgcc

SEQ ID NO: 7978 - DNA, 15 bp, Artificial Sequence
  dgRNA
  Morc4
cggccgcctggccta

SEQ ID NO: 7979 - DNA, 15 bp, Artificial Sequence
  dgRNA
  Morc4
cgccaagaattaatt

SEQ ID NO: 7980 - DNA, 15 bp, Artificial Sequence
  dgRNA
  Tulp2
attccatgctagcac

SEQ ID NO: 7981 - DNA, 15 bp, Artificial Sequence
  dgRNA
  Tulp2
gttgttacgcattgc

SEQ ID NO: 7982 - DNA, 15 bp, Artificial Sequence
  dgRNA
  Tulp2
acgcattgcaggatt

SEQ ID NO: 7983 - DNA, 15 bp, Artificial Sequence
  dgRNA
  Tulp2
cgcattgcaggattt

SEQ ID NO: 7984 - DNA, 15 bp, Artificial Sequence
  dgRNA
  Lrfn3
tgcgttgcgatgccc

SEQ ID NO: 7985 - DNA, 15 bp, Artificial Sequence
  dgRNA
  Lrfn3
gcccgggtccccgcg

SEQ ID NO: 7986 - DNA, 15 bp, Artificial Sequence
  dgRNA
  Lrfn3
cgtctgtccgcgctc

SEQ ID NO: 7987 - DNA, 15 bp, Artificial Sequence
  dgRNA
  Lrfn3
agaccccctctttct

SEQ ID NO: 7988 - DNA, 15 bp, Artificial Sequence
  dgRNA
  Lrrc58
gagccccgcgacgcc

SEQ ID NO: 7989 - DNA, 15 bp, Artificial Sequence
  dgRNA
  Lrrc58
agccccgcgacgccc

SEQ ID NO: 7990 - DNA, 15 bp, Artificial Sequence
  dgRNA
  Lrrc58
ccctcacacggttcc

SEQ ID NO: 7991 - DNA, 15 bp, Artificial Sequence
  dgRNA
  Lrrc58
cctcacacggttccc

SEQ ID NO: 7992 - DNA, 15 bp, Artificial Sequence
  dgRNA
  Rnf166
ccgcgtaatcctcac

SEQ ID NO: 7993 - DNA, 15 bp, Artificial Sequence
  dgRNA
  Rnf166
caccggcctgacaca

SEQ ID NO: 7994 - DNA, 15 bp, Artificial Sequence
  dgRNA
  Rnf166
cggcctgacacatgg

SEQ ID NO: 7995 - DNA, 15 bp, Artificial Sequence
  dgRNA
  Rnf166
ggtgggtcccgactg

SEQ ID NO: 7996 - DNA, 15 bp, Artificial Sequence
  dgRNA
  Pgk2
caatggctattgtgc

SEQ ID NO: 7997 - DNA, 15 bp, Artificial Sequence
  dgRNA
  Pgk2
tcacaaagaaaggcg

SEQ ID NO: 7998 - DNA, 15 bp, Artificial Sequence
  dgRNA
  Pgk2
aaaacggagagcttg

SEQ ID NO: 7999 - DNA, 15 bp, Artificial Sequence
  dgRNA
  Pgk2
taaaacggagagctt

SEQ ID NO: 8000 - DNA, 15 bp, Artificial Sequence
  dgRNA
  Trim2
cgaaagaaatgctgc

SEQ ID NO: 8001 - DNA, 15 bp, Artificial Sequence
  dgRNA
  Trim2
tttttgacgattctt

SEQ ID NO: 8002 - DNA, 15 bp, Artificial Sequence
  dgRNA
  Trim2
gtgcaatctttactg

SEQ ID NO: 8003 - DNA, 15 bp, Artificial Sequence
  dgRNA
  Trim2
gcacaaggcgccgac

SEQ ID NO: 8004 - DNA, 15 bp, Artificial Sequence
  dgRNA
  4931428F04Rik
ccggcaagcagtaaa

SEQ ID NO: 8005 - DNA, 15 bp, Artificial Sequence
  dgRNA
  4931428F04Rik
gtcgctttagaagcg

SEQ ID NO: 8006 - DNA, 15 bp, Artificial Sequence
  dgRNA
  4931428F04Rik
cgcggaagtttgaag

SEQ ID NO: 8007 - DNA, 15 bp, Artificial Sequence
  dgRNA
  4931428F04Rik
gcggaagtttgaaga

SEQ ID NO: 8008 - DNA, 15 bp, Artificial Sequence
  dgRNA
  Bcl6b
acggagaccccgccc

SEQ ID NO: 8009 - DNA, 15 bp, Artificial Sequence
  dgRNA
  Bcl6b
cggagaccccgcccc

SEQ ID NO: 8010 - DNA, 15 bp, Artificial Sequence
  dgRNA
  Bcl6b
cccgggctcaccatc

SEQ ID NO: 8011 - DNA, 15 bp, Artificial Sequence
  dgRNA
  Bcl6b
ccgcccccgccatcc

SEQ ID NO: 8012 - DNA, 15 bp, Artificial Sequence
  dgRNA
  Vmn1r229
ctatgttgtacacaa

SEQ ID NO: 8013 - DNA, 15 bp, Artificial Sequence
  dgRNA
  Vmn1r229
cgtcaatacatgatt

SEQ ID NO: 8014 - DNA, 15 bp, Artificial Sequence
  dgRNA
  Vmn1r229
ctaagttgggatgtg

SEQ ID NO: 8015 - DNA, 15 bp, Artificial Sequence
  dgRNA
  Vmn1r229
gacgttttctaagtt

SEQ ID NO: 8016 - DNA, 15 bp, Artificial Sequence
  dgRNA
  Slc29a1
gaacgctcaaatctg

SEQ ID NO: 8017 - DNA, 15 bp, Artificial Sequence
  dgRNA
  Slc29a1
ctagcagtaaaacgg

SEQ ID NO: 8018 - DNA, 15 bp, Artificial Sequence
  dgRNA
  Slc29a1
gtgtgaataatggcg

SEQ ID NO: 8019 - DNA, 15 bp, Artificial Sequence
  dgRNA
  Slc29a1
tgtgaataatggcgt

SEQ ID NO: 8020 - DNA, 15 bp, Artificial Sequence
  dgRNA
  Ppp2r3a
ctttatcctcaaacc

SEQ ID NO: 8021 - DNA, 15 bp, Artificial Sequence
  dgRNA
  Evi2a
ccctccccattcagg

SEQ ID NO: 8022 - DNA, 15 bp, Artificial Sequence
  dgRNA
  Evi2a
tccccattcaggggg

SEQ ID NO: 8023 - DNA, 15 bp, Artificial Sequence
  dgRNA
  Evi2a
ccccctgaatgggga

SEQ ID NO: 8024 - DNA, 15 bp, Artificial Sequence
  dgRNA
  Evi2a
accccctgaatgggg

SEQ ID NO: 8025 - DNA, 15 bp, Artificial Sequence
  dgRNA
  Rsad1
gccaagaggctggcg

SEQ ID NO: 8026 - DNA, 15 bp, Artificial Sequence
  dgRNA
  Rsad1
ggcattctgcgtcct

SEQ ID NO: 8027 - DNA, 15 bp, Artificial Sequence
  dgRNA
  Rsad1
tccttgagaacgaat

SEQ ID NO: 8028 - DNA, 15 bp, Artificial Sequence
  dgRNA
  Rsad1
ggcgccgcagacacg

SEQ ID NO: 8029 - DNA, 15 bp, Artificial Sequence
  dgRNA
  Zc3h18
tgcgcacgcgccgcc

SEQ ID NO: 8030 - DNA, 15 bp, Artificial Sequence
  dgRNA
  Zc3h18
gcacgcgccgccagg

SEQ ID NO: 8031 - DNA, 15 bp, Artificial Sequence
  dgRNA
  Zc3h18
caggaggcccgctag

SEQ ID NO: 8032 - DNA, 15 bp, Artificial Sequence
  dgRNA
  Zc3h18
aggaggcccgctaga

SEQ ID NO: 8033 - DNA, 15 bp, Artificial Sequence
  dgRNA
  Zim1
gcgagcgcatcttgc

SEQ ID NO: 8034 - DNA, 15 bp, Artificial Sequence
  dgRNA
  Zim1
cgagcgcatcttgct

SEQ ID NO: 8035 - DNA, 15 bp, Artificial Sequence
  dgRNA
  Zim1
gagcgcatcttgctg

SEQ ID NO: 8036 - DNA, 15 bp, Artificial Sequence
  dgRNA
  Zim1
cccagcgcgctgtgc

SEQ ID NO: 8037 - DNA, 15 bp, Artificial Sequence
  dgRNA
  AF251705
tcagtagtgtaaacc

SEQ ID NO: 8038 - DNA, 15 bp, Artificial Sequence
  dgRNA
  AF251705
gttctagggacgcca

SEQ ID NO: 8039 - DNA, 15 bp, Artificial Sequence
  dgRNA
  AF251705
cttttcaatccactc

SEQ ID NO: 8040 - DNA, 15 bp, Artificial Sequence
  dgRNA
  AF251705
aagtgtgtgtcgcag

SEQ ID NO: 8041 - DNA, 15 bp, Artificial Sequence
  dgRNA
  Stk35
cgagtgcgggcgtag

SEQ ID NO: 8042 - DNA, 15 bp, Artificial Sequence
  dgRNA
  Stk35
gtagaggtacgatgc

SEQ ID NO: 8043 - DNA, 15 bp, Artificial Sequence
  dgRNA
  Stk35
gatgcaggtcaagtc

SEQ ID NO: 8044 - DNA, 15 bp, Artificial Sequence
  dgRNA
  Stk35
aggtcaagtccggaa

SEQ ID NO: 8045 - DNA, 15 bp, Artificial Sequence
  dgRNA
  Megf8
cctggagatccgggc

SEQ ID NO: 8046 - DNA, 15 bp, Artificial Sequence
  dgRNA
  Megf8
ctggagatccgggcc

SEQ ID NO: 8047 - DNA, 15 bp, Artificial Sequence
  dgRNA
  Megf8
gggccgggaccccga

SEQ ID NO: 8048 - DNA, 15 bp, Artificial Sequence
  dgRNA
  Megf8
cccgcccccgtctgg

SEQ ID NO: 8049 - DNA, 15 bp, Artificial Sequence
  dgRNA
  Lpgat1
tagaccgtaatgcct

SEQ ID NO: 8050 - DNA, 15 bp, Artificial Sequence
  dgRNA
  Lpgat1
agaccgtaatgcctt

SEQ ID NO: 8051 - DNA, 15 bp, Artificial Sequence
  dgRNA
  Lpgat1
gaccgtaatgccttg

SEQ ID NO: 8052 - DNA, 15 bp, Artificial Sequence
  dgRNA
  Lpgat1
cgtaatgccttgggg

SEQ ID NO: 8053 - DNA, 15 bp, Artificial Sequence
  dgRNA
  1700021F07Rik
tggtgctaagtctag

SEQ ID NO: 8054 - DNA, 15 bp, Artificial Sequence
  dgRNA
  1700021F07Rik
accctcatccccttc

SEQ ID NO: 8055 - DNA, 15 bp, Artificial Sequence
  dgRNA
  1700021F07Rik
tcctctttcgatact

SEQ ID NO: 8056 - DNA, 15 bp, Artificial Sequence
  dgRNA
  1700021F07Rik
ctcctctttcgatac

SEQ ID NO: 8057 - DNA, 15 bp, Artificial Sequence
  dgRNA
  Nfib
aaaggcttttccgcc

SEQ ID NO: 8058 - DNA, 15 bp, Artificial Sequence
  dgRNA
  Nfib
aaggcttttccgccc

SEQ ID NO: 8059 - DNA, 15 bp, Artificial Sequence
  dgRNA
  Nfib
cctcgcgcacacacg

SEQ ID NO: 8060 - DNA, 15 bp, Artificial Sequence
  dgRNA
  Nfib
gcgcacacacgtggt

SEQ ID NO: 8061 - DNA, 15 bp, Artificial Sequence
  dgRNA
  Ntng2
acaagctcccactat

SEQ ID NO: 8062 - DNA, 15 bp, Artificial Sequence
  dgRNA
  Ntng2
ccagacaccaccgcc

SEQ ID NO: 8063 - DNA, 15 bp, Artificial Sequence
  dgRNA
  Ntng2
tctccagtgccgctc

SEQ ID NO: 8064 - DNA, 15 bp, Artificial Sequence
  dgRNA
  Ntng2
tgggccccacccatt

SEQ ID NO: 8065 - DNA, 15 bp, Artificial Sequence
  dgRNA
  Gspt2
gactgagaactaacg

SEQ ID NO: 8066 - DNA, 15 bp, Artificial Sequence
  dgRNA
  Gspt2
acggggacaaaccta

SEQ ID NO: 8067 - DNA, 15 bp, Artificial Sequence
  dgRNA
  Gspt2
ggacaaacctacgga

SEQ ID NO: 8068 - DNA, 15 bp, Artificial Sequence
  dgRNA
  Gspt2
ctacggatggcagcg

SEQ ID NO: 8069 - DNA, 15 bp, Artificial Sequence
  dgRNA
  Fam120c
cccgcacccagtctg

SEQ ID NO: 8070 - DNA, 15 bp, Artificial Sequence
  dgRNA
  Fam120c
cgcccctaccccccg

SEQ ID NO: 8071 - DNA, 15 bp, Artificial Sequence
  dgRNA
  Fam120c
gaacgtgggcgggga

SEQ ID NO: 8072 - DNA, 15 bp, Artificial Sequence
  dgRNA
  Fam120c
cgagggaacgtgggc

SEQ ID NO: 8073 - DNA, 15 bp, Artificial Sequence
  dgRNA
  Hnmt
taaagggattaacac

SEQ ID NO: 8074 - DNA, 15 bp, Artificial Sequence
  dgRNA
  Hnmt
tcctagtctcataaa

SEQ ID NO: 8075 - DNA, 15 bp, Artificial Sequence
  dgRNA
  Hnmt
ttcctagtctcataa

SEQ ID NO: 8076 - DNA, 15 bp, Artificial Sequence
  dgRNA
  Hnmt
attaaggaggagccc

SEQ ID NO: 8077 - DNA, 15 bp, Artificial Sequence
  dgRNA
  Fam159b
aaacagtcggagttc

SEQ ID NO: 8078 - DNA, 15 bp, Artificial Sequence
  dgRNA
  Fam159b
gtcggagttccggag

SEQ ID NO: 8079 - DNA, 15 bp, Artificial Sequence
  dgRNA
  Fam159b
tcggagttccggaga

SEQ ID NO: 8080 - DNA, 15 bp, Artificial Sequence
  dgRNA
  Fam159b
gggtgcagtttacac

SEQ ID NO: 8081 - DNA, 15 bp, Artificial Sequence
  dgRNA
  Psmd7
tcaagatggcgcccc

SEQ ID NO: 8082 - DNA, 15 bp, Artificial Sequence
  dgRNA
  Psmd7
ggcgcccctggcgac

SEQ ID NO: 8083 - DNA, 15 bp, Artificial Sequence
  dgRNA
  Psmd7
gcgcccctggcgaca

SEQ ID NO: 8084 - DNA, 15 bp, Artificial Sequence
  dgRNA
  Psmd7
cccctggcgacaggg

SEQ ID NO: 8085 - DNA, 15 bp, Artificial Sequence
  dgRNA
  Eif4g1
cagagggggtcggcc

SEQ ID NO: 8086 - DNA, 15 bp, Artificial Sequence
  dgRNA
  Eif4g1
agagggggtcggcct

SEQ ID NO: 8087 - DNA, 15 bp, Artificial Sequence
  dgRNA
  Eif4g1
gttccaaagttcggg

SEQ ID NO: 8088 - DNA, 15 bp, Artificial Sequence
  dgRNA
  Eif4g1
ttccaaagttcggga

SEQ ID NO: 8089 - DNA, 15 bp, Artificial Sequence
  dgRNA
  Tomm40
gatacacgagccaat

SEQ ID NO: 8090 - DNA, 15 bp, Artificial Sequence
  dgRNA
  Tomm40
cacgagccaatagga

SEQ ID NO: 8091 - DNA, 15 bp, Artificial Sequence
  dgRNA
  Tomm40
tgactgatttcgact

SEQ ID NO: 8092 - DNA, 15 bp, Artificial Sequence
  dgRNA
  Tomm40
cgactaggaaccaat

SEQ ID NO: 8093 - DNA, 15 bp, Artificial Sequence
  dgRNA
  Prr27
gacagggatcattta

SEQ ID NO: 8094 - DNA, 15 bp, Artificial Sequence
  dgRNA
  Prr27
aactatggtaggagg

SEQ ID NO: 8095 - DNA, 15 bp, Artificial Sequence
  dgRNA
  Prr27
gaactatggtaggag

SEQ ID NO: 8096 - DNA, 15 bp, Artificial Sequence
  dgRNA
  Prr27
tgaactatggtagga

SEQ ID NO: 8097 - DNA, 15 bp, Artificial Sequence
  dgRNA
  Fkbp6
taacattgagaccaa

SEQ ID NO: 8098 - DNA, 15 bp, Artificial Sequence
  dgRNA
  Fkbp6
gtccgaagccctccc

SEQ ID NO: 8099 - DNA, 15 bp, Artificial Sequence
  dgRNA
  Fkbp6
tccgaagccctccca

SEQ ID NO: 8100 - DNA, 15 bp, Artificial Sequence
  dgRNA
  Fkbp6
gtgtgcagcgcgtgc

SEQ ID NO: 8101 - DNA, 15 bp, Artificial Sequence
  dgRNA
  Pgbd1
ttagctgctgggcgc

SEQ ID NO: 8102 - DNA, 15 bp, Artificial Sequence
  dgRNA
  Pgbd1
attttagcgtagatc

SEQ ID NO: 8103 - DNA, 15 bp, Artificial Sequence
  dgRNA
  Pgbd1
ttttagcgtagatct

SEQ ID NO: 8104 - DNA, 15 bp, Artificial Sequence
  dgRNA
  Pgbd1
agcgtagatctgggc

SEQ ID NO: 8105 - DNA, 15 bp, Artificial Sequence
  dgRNA
  Hipk2
cggctcccgccctcg

SEQ ID NO: 8106 - DNA, 15 bp, Artificial Sequence
  dgRNA
  Hipk2
cctcgcggacccgcc

SEQ ID NO: 8107 - DNA, 15 bp, Artificial Sequence
  dgRNA
  Hipk2
cccggcccttggcct

SEQ ID NO: 8108 - DNA, 15 bp, Artificial Sequence
  dgRNA
  Hipk2
gcgccttagccgccc

SEQ ID NO: 8109 - DNA, 15 bp, Artificial Sequence
  dgRNA
  Fbxo43
agctgcgaagggatg

SEQ ID NO: 8110 - DNA, 15 bp, Artificial Sequence
  dgRNA
  Fbxo43
gctgcgaagggatga

SEQ ID NO: 8111 - DNA, 15 bp, Artificial Sequence
  dgRNA
  Fbxo43
gggcgagcgctcaga

SEQ ID NO: 8112 - DNA, 15 bp, Artificial Sequence
  dgRNA
  Fbxo43
gagcgctcagacgga

SEQ ID NO: 8113 - DNA, 15 bp, Artificial Sequence
  dgRNA
  Rsbn1l
aaatgaaggtccgct

SEQ ID NO: 8114 - DNA, 15 bp, Artificial Sequence
  dgRNA
  Rsbn1l
gtgaccccaccccga

SEQ ID NO: 8115 - DNA, 15 bp, Artificial Sequence
  dgRNA
  Rsbn1l
gtccgcgtctttgat

SEQ ID NO: 8116 - DNA, 15 bp, Artificial Sequence
  dgRNA
  Rsbn1l
gtttagcgcgcccaa

SEQ ID NO: 8117 - DNA, 15 bp, Artificial Sequence
  dgRNA
  Dmbx1
ccctagttcctctaa

SEQ ID NO: 8118 - DNA, 15 bp, Artificial Sequence
  dgRNA
  Dmbx1
tctaaaggtttgacc

SEQ ID NO: 8119 - DNA, 15 bp, Artificial Sequence
  dgRNA
  Dmbx1
ctaaaggtttgaccc

SEQ ID NO: 8120 - DNA, 15 bp, Artificial Sequence
  dgRNA
  Dmbx1
tgacccgggctgcct

SEQ ID NO: 8121 - DNA, 15 bp, Artificial Sequence
  dgRNA
  P2rx4
gatcgtccctttgag

SEQ ID NO: 8122 - DNA, 15 bp, Artificial Sequence
  dgRNA
  P2rx4
atcgtccctttgaga

SEQ ID NO: 8123 - DNA, 15 bp, Artificial Sequence
  dgRNA
  P2rx4
gagagggtcacgagt

SEQ ID NO: 8124 - DNA, 15 bp, Artificial Sequence
  dgRNA
  P2rx4
agagggtcacgagtt

SEQ ID NO: 8125 - DNA, 15 bp, Artificial Sequence
  dgRNA
  Klhl12
gcgcactgtcacacg

SEQ ID NO: 8126 - DNA, 15 bp, Artificial Sequence
  dgRNA
  Klhl12
cgtctacccactctc

SEQ ID NO: 8127 - DNA, 15 bp, Artificial Sequence
  dgRNA
  Klhl12
aaggtgacgtaaccc

SEQ ID NO: 8128 - DNA, 15 bp, Artificial Sequence
  dgRNA
  Klhl12
gacgtaacccaggag

SEQ ID NO: 8129 - DNA, 15 bp, Artificial Sequence
  dgRNA
  Pmf1
tgagcccctaaactc

SEQ ID NO: 8130 - DNA, 15 bp, Artificial Sequence
  dgRNA
  Pmf1
ctaattcctcgtcct

SEQ ID NO: 8131 - DNA, 15 bp, Artificial Sequence
  dgRNA
  Pmf1
ctgccccgccccatc

SEQ ID NO: 8132 - DNA, 15 bp, Artificial Sequence
  dgRNA
  Pmf1
catccggctccgtga

SEQ ID NO: 8133 - DNA, 15 bp, Artificial Sequence
  dgRNA
  Olfr631
gtatagctgatgaat

SEQ ID NO: 8134 - DNA, 15 bp, Artificial Sequence
  dgRNA
  Olfr631
ggattgaggttatga

SEQ ID NO: 8135 - DNA, 15 bp, Artificial Sequence
  dgRNA
  Olfr631
gattgaggttatgaa

SEQ ID NO: 8136 - DNA, 15 bp, Artificial Sequence
  dgRNA
  Gmnn
tggagccggaagcgg

SEQ ID NO: 8137 - DNA, 15 bp, Artificial Sequence
  dgRNA
  Gmnn
ggagccggaagcgga

SEQ ID NO: 8138 - DNA, 15 bp, Artificial Sequence
  dgRNA
  Gmnn
gagggtcagacggca

SEQ ID NO: 8139 - DNA, 15 bp, Artificial Sequence
  dgRNA
  Gmnn
gacggcaaggtcaga

SEQ ID NO: 8140 - DNA, 15 bp, Artificial Sequence
  dgRNA
  Myocd
ggctgttaagactcc

SEQ ID NO: 8141 - DNA, 15 bp, Artificial Sequence
  dgRNA
  Myocd
gctgttaagactcct

SEQ ID NO: 8142 - DNA, 15 bp, Artificial Sequence
  dgRNA
  Myocd
ctgttaagactcctg

SEQ ID NO: 8143 - DNA, 15 bp, Artificial Sequence
  dgRNA
  Myocd
tcctggggccgcgtc

SEQ ID NO: 8144 - DNA, 15 bp, Artificial Sequence
  dgRNA
  Zfhx3
actgggggtggccga

SEQ ID NO: 8145 - DNA, 15 bp, Artificial Sequence
  dgRNA
  Zfhx3
gcgtccgtttcttcc

SEQ ID NO: 8146 - DNA, 15 bp, Artificial Sequence
  dgRNA
  Zfhx3
ttttgatgagcggtg

SEQ ID NO: 8147 - DNA, 15 bp, Artificial Sequence
  dgRNA
  Zfhx3
gcggtcagtgcctcg

SEQ ID NO: 8148 - DNA, 15 bp, Artificial Sequence
  dgRNA
  Akap8
acgcgtgcgcggacc

SEQ ID NO: 8149 - DNA, 15 bp, Artificial Sequence
  dgRNA
  Akap8
actagcttacccttg

SEQ ID NO: 8150 - DNA, 15 bp, Artificial Sequence
  dgRNA
  Akap8
tgtagatttgcaacc

SEQ ID NO: 8151 - DNA, 15 bp, Artificial Sequence
  dgRNA
  Akap8
gatttgcaacccgga

SEQ ID NO: 8152 - DNA, 15 bp, Artificial Sequence
  dgRNA
  Chd8
ttgaagttccgggga

SEQ ID NO: 8153 - DNA, 15 bp, Artificial Sequence
  dgRNA
  Chd8
gttgaagttccgggg

SEQ ID NO: 8154 - DNA, 15 bp, Artificial Sequence
  dgRNA
  Chd8
tttgttgaagttccg

SEQ ID NO: 8155 - DNA, 15 bp, Artificial Sequence
  dgRNA
  Cited1
ctgcgtcgtgccccc

SEQ ID NO: 8156 - DNA, 15 bp, Artificial Sequence
  dgRNA
  Cited1
tgcgtcgtgccccca

SEQ ID NO: 8157 - DNA, 15 bp, Artificial Sequence
  dgRNA
  Cited1
ctcgagcgcctttaa

SEQ ID NO: 8158 - DNA, 15 bp, Artificial Sequence
  dgRNA
  Cited1
tcgagcgcctttaaa

SEQ ID NO: 8159 - DNA, 15 bp, Artificial Sequence
  dgRNA
  Mrps28
agtgctgagtaacga

SEQ ID NO: 8160 - DNA, 15 bp, Artificial Sequence
  dgRNA
  Mrps28
gagtaacgaaggcac

SEQ ID NO: 8161 - DNA, 15 bp, Artificial Sequence
  dgRNA
  Mrps28
gcttccaactctaac

SEQ ID NO: 8162 - DNA, 15 bp, Artificial Sequence
  dgRNA
  Mrps28
ctaacaggataacga

SEQ ID NO: 8163 - DNA, 15 bp, Artificial Sequence
  dgRNA
  Pianp
tgcacccatgcattt

SEQ ID NO: 8164 - DNA, 15 bp, Artificial Sequence
  dgRNA
  Pianp
cccgcttgtctgaaa

SEQ ID NO: 8165 - DNA, 15 bp, Artificial Sequence
  dgRNA
  Pianp
gagaatctagatggt

SEQ ID NO: 8166 - DNA, 15 bp, Artificial Sequence
  dgRNA
  Pianp
ccggggaaaagtcct

SEQ ID NO: 8167 - DNA, 15 bp, Artificial Sequence
  dgRNA
  Mroh7
cgtgccttagtgtag

SEQ ID NO: 8168 - DNA, 15 bp, Artificial Sequence
  dgRNA
  Mroh7
gagcaggagtcttat

SEQ ID NO: 8169 - DNA, 15 bp, Artificial Sequence
  dgRNA
  Mroh7
aggagtcttattggc

SEQ ID NO: 8170 - DNA, 15 bp, Artificial Sequence
  dgRNA
  Mroh7
ggagtcttattggct

SEQ ID NO: 8171 - DNA, 15 bp, Artificial Sequence
  dgRNA
  Slc39a5
actccgccccagagc

SEQ ID NO: 8172 - DNA, 15 bp, Artificial Sequence
  dgRNA
  Slc39a5
cgccccagagcaggt

SEQ ID NO: 8173 - DNA, 15 bp, Artificial Sequence
  dgRNA
  Slc39a5
gccctccttgtgacg

SEQ ID NO: 8174 - DNA, 15 bp, Artificial Sequence
  dgRNA
  Slc39a5
tgcagggccttgact

SEQ ID NO: 8175 - DNA, 15 bp, Artificial Sequence
  dgRNA
  Tsfm
tcgcgccacgcgttc

SEQ ID NO: 8176 - DNA, 15 bp, Artificial Sequence
  dgRNA
  Tsfm
cgcgccacgcgttct

SEQ ID NO: 8177 - DNA, 15 bp, Artificial Sequence
  dgRNA
  Tsfm
gccacgcgttctggg

SEQ ID NO: 8178 - DNA, 15 bp, Artificial Sequence
  dgRNA
  Tsfm
caacacaagacatgt

SEQ ID NO: 8179 - DNA, 15 bp, Artificial Sequence
  dgRNA
  Zscan5b
atcatgaccacgccc

SEQ ID NO: 8180 - DNA, 15 bp, Artificial Sequence
  dgRNA
  Zscan5b
cataaatctattcgc

SEQ ID NO: 8181 - DNA, 15 bp, Artificial Sequence
  dgRNA
  Zscan5b
ataaatctattcgcc

SEQ ID NO: 8182 - DNA, 15 bp, Artificial Sequence
  dgRNA
  Zscan5b
tgacatccaatctct

SEQ ID NO: 8183 - DNA, 15 bp, Artificial Sequence
  dgRNA
  Fam160a2
gagccgctcctttct

SEQ ID NO: 8184 - DNA, 15 bp, Artificial Sequence
  dgRNA
  Fam160a2
ttcttggaatgcgga

SEQ ID NO: 8185 - DNA, 15 bp, Artificial Sequence
  dgRNA
  Fam160a2
ccccgcccctgcgct

SEQ ID NO: 8186 - DNA, 15 bp, Artificial Sequence
  dgRNA
  Fam160a2
cgctcggccgttgcc

SEQ ID NO: 8187 - DNA, 15 bp, Artificial Sequence
  dgRNA
  Dmpk
ccttaagcatagaac

SEQ ID NO: 8188 - DNA, 15 bp, Artificial Sequence
  dgRNA
  Dmpk
acccaagggatagtc

SEQ ID NO: 8189 - DNA, 15 bp, Artificial Sequence
  dgRNA
  Dmpk
cccaagggatagtca

SEQ ID NO: 8190 - DNA, 15 bp, Artificial Sequence
  dgRNA
  Dmpk
ccagttctatgctta

SEQ ID NO: 8191 - DNA, 15 bp, Artificial Sequence
  dgRNA
  Slc2a9
agtagggcctagaac

SEQ ID NO: 8192 - DNA, 15 bp, Artificial Sequence
  dgRNA
  Slc2a9
agttctaggccctac

SEQ ID NO: 8193 - DNA, 15 bp, Artificial Sequence
  dgRNA
  Asph
agctgcgtcttcatt

SEQ ID NO: 8194 - DNA, 15 bp, Artificial Sequence
  dgRNA
  Asph
ggcatccatactgag

SEQ ID NO: 8195 - DNA, 15 bp, Artificial Sequence
  dgRNA
  Asph
agggcgcagattgtc

SEQ ID NO: 8196 - DNA, 15 bp, Artificial Sequence
  dgRNA
  Asph
gcgattagcagcatg

SEQ ID NO: 8197 - DNA, 15 bp, Artificial Sequence
  dgRNA
  Man1a2
ggaatgagccggcgc

SEQ ID NO: 8198 - DNA, 15 bp, Artificial Sequence
  dgRNA
  Man1a2
agccggcgccggccc

SEQ ID NO: 8199 - DNA, 15 bp, Artificial Sequence
  dgRNA
  Man1a2
ccggccccgggctgt

SEQ ID NO: 8200 - DNA, 15 bp, Artificial Sequence
  dgRNA
  Man1a2
cgggctgtcggtctg

SEQ ID NO: 8201 - DNA, 15 bp, Artificial Sequence
  dgRNA
  Nedd9
tcgcctctcagcaac

SEQ ID NO: 8202 - DNA, 15 bp, Artificial Sequence
  dgRNA
  Nedd9
ctctcagcaaccgga

SEQ ID NO: 8203 - DNA, 15 bp, Artificial Sequence
  dgRNA
  Nedd9
gccacgaacatccga

SEQ ID NO: 8204 - DNA, 15 bp, Artificial Sequence
  dgRNA
  Nedd9
ccacgaacatccgac

SEQ ID NO: 8205 - DNA, 15 bp, Artificial Sequence
  dgRNA
  Gpank1
cgccccctacctccg

SEQ ID NO: 8206 - DNA, 15 bp, Artificial Sequence
  dgRNA
  Gpank1
tacctccgtggacgc

SEQ ID NO: 8207 - DNA, 15 bp, Artificial Sequence
  dgRNA
  Gpank1
acctccgtggacgcc

SEQ ID NO: 8208 - DNA, 15 bp, Artificial Sequence
  dgRNA
  Gpank1
gagatgtagtcccgt

SEQ ID NO: 8209 - DNA, 15 bp, Artificial Sequence
  dgRNA
  St3gal5
cacctacttctcggc

SEQ ID NO: 8210 - DNA, 15 bp, Artificial Sequence
  dgRNA
  St3gal5
cgcactagcagtcgg

SEQ ID NO: 8211 - DNA, 15 bp, Artificial Sequence
  dgRNA
  St3gal5
gcactagcagtcgga

SEQ ID NO: 8212 - DNA, 15 bp, Artificial Sequence
  dgRNA
  St3gal5
cactagcagtcggag

SEQ ID NO: 8213 - DNA, 15 bp, Artificial Sequence
  dgRNA
  Nhsl2
attaacgcttgatcc

SEQ ID NO: 8214 - DNA, 15 bp, Artificial Sequence
  dgRNA
  Nhsl2
gattaacgcttgatc

SEQ ID NO: 8215 - DNA, 15 bp, Artificial Sequence
  dgRNA
  Pik3c2g
ttgtgttactaatcc

SEQ ID NO: 8216 - DNA, 15 bp, Artificial Sequence
  dgRNA
  6030458C11Rik
gccccgggaattaaa

SEQ ID NO: 8217 - DNA, 15 bp, Artificial Sequence
  dgRNA
  6030458C11Rik
caaaccggagaaatc

SEQ ID NO: 8218 - DNA, 15 bp, Artificial Sequence
  dgRNA
  6030458C11Rik
ggagaaatccggacc

SEQ ID NO: 8219 - DNA, 15 bp, Artificial Sequence
  dgRNA
  6030458C11Rik
gagaaatccggacct

SEQ ID NO: 8220 - DNA, 15 bp, Artificial Sequence
  dgRNA
  Tmem167b
tcggtctaattagac

SEQ ID NO: 8221 - DNA, 15 bp, Artificial Sequence
  dgRNA
  Tmem167b
tcctcccactacgta

SEQ ID NO: 8222 - DNA, 15 bp, Artificial Sequence
  dgRNA
  Tmem167b
acgcagacgctacgc

SEQ ID NO: 8223 - DNA, 15 bp, Artificial Sequence
  dgRNA
  Tmem167b
agacgctacgcaggc

SEQ ID NO: 8224 - DNA, 15 bp, Artificial Sequence
  dgRNA
  Sgcz
tcacctagtagattc

SEQ ID NO: 8225 - DNA, 15 bp, Artificial Sequence
  dgRNA
  Sgcz
gtagattccggacag

SEQ ID NO: 8226 - DNA, 15 bp, Artificial Sequence
  dgRNA
  Sgcz
tagattccggacaga

SEQ ID NO: 8227 - DNA, 15 bp, Artificial Sequence
  dgRNA
  Sgcz
aaatccccttagtgc

SEQ ID NO: 8228 - DNA, 15 bp, Artificial Sequence
  dgRNA
  Ccnf
ccgtcccccgcccag

SEQ ID NO: 8229 - DNA, 15 bp, Artificial Sequence
  dgRNA
  Ccnf
cccgcccagcggaga

SEQ ID NO: 8230 - DNA, 15 bp, Artificial Sequence
  dgRNA
  Ccnf
tttgaattcgcgtcc

SEQ ID NO: 8231 - DNA, 15 bp, Artificial Sequence
  dgRNA
  Ccnf
gagaggctagtgatc

SEQ ID NO: 8232 - DNA, 15 bp, Artificial Sequence
  dgRNA
  Tbc1d8b
tcacttaactggtgg

SEQ ID NO: 8233 - DNA, 15 bp, Artificial Sequence
  dgRNA
  Tbc1d8b
cacttaactggtggc

SEQ ID NO: 8234 - DNA, 15 bp, Artificial Sequence
  dgRNA
  Tbc1d8b
gcgggagcgcctcaa

SEQ ID NO: 8235 - DNA, 15 bp, Artificial Sequence
  dgRNA
  Tbc1d8b
agggctatattagac

SEQ ID NO: 8236 - DNA, 15 bp, Artificial Sequence
  dgRNA
  Msh4
gttgagtcatcgtga

SEQ ID NO: 8237 - DNA, 15 bp, Artificial Sequence
  dgRNA
  Msh4
tgagctttggccgac

SEQ ID NO: 8238 - DNA, 15 bp, Artificial Sequence
  dgRNA
  Msh4
cgggttttactcttt

SEQ ID NO: 8239 - DNA, 15 bp, Artificial Sequence
  dgRNA
  Msh4
gactcagaccttagt

SEQ ID NO: 8240 - DNA, 15 bp, Artificial Sequence
  dgRNA
  Clec2e
gacaagtgatgtgct

SEQ ID NO: 8241 - DNA, 15 bp, Artificial Sequence
  dgRNA
  Clec2e
tgctcgggactgaga

SEQ ID NO: 8242 - DNA, 15 bp, Artificial Sequence
  dgRNA
  Clec2e
agtgaatcacctgtc

SEQ ID NO: 8243 - DNA, 15 bp, Artificial Sequence
  dgRNA
  Clec2e
gtgaatcacctgtct

SEQ ID NO: 8244 - DNA, 15 bp, Artificial Sequence
  dgRNA
  Prpf18
ggagggttccgctag

SEQ ID NO: 8245 - DNA, 15 bp, Artificial Sequence
  dgRNA
  Prpf18
gagggttccgctagg

SEQ ID NO: 8246 - DNA, 15 bp, Artificial Sequence
  dgRNA
  Prpf18
ggcaacaatactcag

SEQ ID NO: 8247 - DNA, 15 bp, Artificial Sequence
  dgRNA
  Prpf18
aatactcagcggttt

SEQ ID NO: 8248 - DNA, 15 bp, Artificial Sequence
  dgRNA
  Cbln4
ccccagtgggttccg

SEQ ID NO: 8249 - DNA, 15 bp, Artificial Sequence
  dgRNA
  Cbln4
gcccccgggcttttc

SEQ ID NO: 8250 - DNA, 15 bp, Artificial Sequence
  dgRNA
  Cbln4
cccccgggcttttct

SEQ ID NO: 8251 - DNA, 15 bp, Artificial Sequence
  dgRNA
  Cbln4
ggctctccaggctcg

SEQ ID NO: 8252 - DNA, 15 bp, Artificial Sequence
  dgRNA
  Lmtk3
ggcagccaatgcaac

SEQ ID NO: 8253 - DNA, 15 bp, Artificial Sequence
  dgRNA
  Lmtk3
gcagccaatgcaacc

SEQ ID NO: 8254 - DNA, 15 bp, Artificial Sequence
  dgRNA
  Lmtk3
aatcccgattgtcct

SEQ ID NO: 8255 - DNA, 15 bp, Artificial Sequence
  dgRNA
  Lmtk3
atcccgattgtcctc

SEQ ID NO: 8256 - DNA, 15 bp, Artificial Sequence
  dgRNA
  Slc41a3
actgaaccccatgcg

SEQ ID NO: 8257 - DNA, 15 bp, Artificial Sequence
  dgRNA
  Slc41a3
ctgaaccccatgcgt

SEQ ID NO: 8258 - DNA, 15 bp, Artificial Sequence
  dgRNA
  Slc41a3
ccccatgcgtgggcc

SEQ ID NO: 8259 - DNA, 15 bp, Artificial Sequence
  dgRNA
  Slc41a3
cccatgcgtgggcct

SEQ ID NO: 8260 - DNA, 15 bp, Artificial Sequence
  dgRNA
  Dnal1
gaggttggaggaccg

SEQ ID NO: 8261 - DNA, 15 bp, Artificial Sequence
  dgRNA
  Dnal1
ggttggaggaccggg

SEQ ID NO: 8262 - DNA, 15 bp, Artificial Sequence
  dgRNA
  Dnal1
ctagcgccacccaaa

SEQ ID NO: 8263 - DNA, 15 bp, Artificial Sequence
  dgRNA
  Dnal1
gcgccacccaaaagg

SEQ ID NO: 8264 - DNA, 15 bp, Artificial Sequence
  dgRNA
  Myl7
ctaggatgttacact

SEQ ID NO: 8265 - DNA, 15 bp, Artificial Sequence
  dgRNA
  Myl7
taggatgttacactt

SEQ ID NO: 8266 - DNA, 15 bp, Artificial Sequence
  dgRNA
  Myl7
aggatgttacacttg

SEQ ID NO: 8267 - DNA, 15 bp, Artificial Sequence
  dgRNA
  Myl7
ggatgttacacttgg

SEQ ID NO: 8268 - DNA, 15 bp, Artificial Sequence
  dgRNA
  1700092M07Rik
ggtgctctccaaaga

SEQ ID NO: 8269 - DNA, 15 bp, Artificial Sequence
  dgRNA
  1700092M07Rik
cgcgcgtactgatcc

SEQ ID NO: 8270 - DNA, 15 bp, Artificial Sequence
  dgRNA
  1700092M07Rik
tggaccttttgtgat

SEQ ID NO: 8271 - DNA, 15 bp, Artificial Sequence
  dgRNA
  1700092M07Rik
ggagaaacgccttgt

SEQ ID NO: 8272 - DNA, 15 bp, Artificial Sequence
  dgRNA
  Aftph
tgcccgcaaccaaaa

SEQ ID NO: 8273 - DNA, 15 bp, Artificial Sequence
  dgRNA
  Aftph
cgtcgttccacacga

SEQ ID NO: 8274 - DNA, 15 bp, Artificial Sequence
  dgRNA
  Aftph
tgacactaattcccc

SEQ ID NO: 8275 - DNA, 15 bp, Artificial Sequence
  dgRNA
  Aftph
gcacccaccagcgcc

SEQ ID NO: 8276 - DNA, 15 bp, Artificial Sequence
  dgRNA
  Gm20498
cttgagaacagtgcg

SEQ ID NO: 8277 - DNA, 15 bp, Artificial Sequence
  dgRNA
  Gm20498
aacagtgcgaggtac

SEQ ID NO: 8278 - DNA, 15 bp, Artificial Sequence
  dgRNA
  Gm20498
ggtaccggaaaacgc

SEQ ID NO: 8279 - DNA, 15 bp, Artificial Sequence
  dgRNA
  Gm20498
accggaaaacgctgg

SEQ ID NO: 8280 - DNA, 15 bp, Artificial Sequence
  dgRNA
  Col10a1
gtacgcctgcccgtt

SEQ ID NO: 8281 - DNA, 15 bp, Artificial Sequence
  dgRNA
  Col10a1
gaggagcttcggctc

SEQ ID NO: 8282 - DNA, 15 bp, Artificial Sequence
  dgRNA
  Col10a1
aggagcttcggctca

SEQ ID NO: 8283 - DNA, 15 bp, Artificial Sequence
  dgRNA
  Col10a1
ggagcttcggctcag

SEQ ID NO: 8284 - DNA, 15 bp, Artificial Sequence
  dgRNA
  Bhlhb9
gtctgcagacgccta

SEQ ID NO: 8285 - DNA, 15 bp, Artificial Sequence
  dgRNA
  Bhlhb9
tctgcagacgcctac

SEQ ID NO: 8286 - DNA, 15 bp, Artificial Sequence
  dgRNA
  Bhlhb9
gtgggttgcacccgt

SEQ ID NO: 8287 - DNA, 15 bp, Artificial Sequence
  dgRNA
  Cct6b
gattcgatcctcttc

SEQ ID NO: 8288 - DNA, 15 bp, Artificial Sequence
  dgRNA
  Cct6b
cgatcctcttccggt

SEQ ID NO: 8289 - DNA, 15 bp, Artificial Sequence
  dgRNA
  Cct6b
ttccggttggtgctc

SEQ ID NO: 8290 - DNA, 15 bp, Artificial Sequence
  dgRNA
  Cct6b
ccggagtccgagtag

SEQ ID NO: 8291 - DNA, 15 bp, Artificial Sequence
  dgRNA
  Lhfpl1
agcctccagcgtagt

SEQ ID NO: 8292 - DNA, 15 bp, Artificial Sequence
  dgRNA
  Lhfpl1
taattcccattaagc

SEQ ID NO: 8293 - DNA, 15 bp, Artificial Sequence
  dgRNA
  Lhfpl1
caccctctgacatgc

SEQ ID NO: 8294 - DNA, 15 bp, Artificial Sequence
  dgRNA
  Lhfpl1
ctccaactacgctgg

SEQ ID NO: 8295 - DNA, 15 bp, Artificial Sequence
  dgRNA
  Olfr1385
atcacgaatcttaac

SEQ ID NO: 8296 - DNA, 15 bp, Artificial Sequence
  dgRNA
  Sult1e1
actaaacacaactgc

SEQ ID NO: 8297 - DNA, 15 bp, Artificial Sequence
  dgRNA
  Sult1e1
ctatgatgtaatgga

SEQ ID NO: 8298 - DNA, 15 bp, Artificial Sequence
  dgRNA
  Sult1e1
tggactatgatgtaa

SEQ ID NO: 8299 - DNA, 15 bp, Artificial Sequence
  dgRNA
  Sox17
cggatcctgtgcaat

SEQ ID NO: 8300 - DNA, 15 bp, Artificial Sequence
  dgRNA
  Sox17
tcctttaacaggcct

SEQ ID NO: 8301 - DNA, 15 bp, Artificial Sequence
  dgRNA
  Sox17
ctcgctgtagaagag

SEQ ID NO: 8302 - DNA, 15 bp, Artificial Sequence
  dgRNA
  Sox17
cggaaaagggagcgt

SEQ ID NO: 8303 - DNA, 15 bp, Artificial Sequence
  dgRNA
  Actr3b
gcaggatagatgcat

SEQ ID NO: 8304 - DNA, 15 bp, Artificial Sequence
  dgRNA
  Actr3b
ataggctaaaacgcc

SEQ ID NO: 8305 - DNA, 15 bp, Artificial Sequence
  dgRNA
  Actr3b
gggctgccagcacta

SEQ ID NO: 8306 - DNA, 15 bp, Artificial Sequence
  dgRNA
  Actr3b
gtgcgcgtccccgat

SEQ ID NO: 8307 - DNA, 15 bp, Artificial Sequence
  dgRNA
  Wrn
acggcagacagcgcg

SEQ ID NO: 8308 - DNA, 15 bp, Artificial Sequence
  dgRNA
  Wrn
cggcagacagcgcgc

SEQ ID NO: 8309 - DNA, 15 bp, Artificial Sequence
  dgRNA
  Wrn
ggcagacagcgcgcg

SEQ ID NO: 8310 - DNA, 15 bp, Artificial Sequence
  dgRNA
  Wrn
cagcgcgcggggacc

SEQ ID NO: 8311 - DNA, 15 bp, Artificial Sequence
  dgRNA
  Pfkfb2
gcagctgtatacgtg

SEQ ID NO: 8312 - DNA, 15 bp, Artificial Sequence
  dgRNA
  Pfkfb2
tatacgtgaggagtc

SEQ ID NO: 8313 - DNA, 15 bp, Artificial Sequence
  dgRNA
  Pfkfb2
aggtatccctaaaaa

SEQ ID NO: 8314 - DNA, 15 bp, Artificial Sequence
  dgRNA
  Ampd2
tagccaccatcagac

SEQ ID NO: 8315 - DNA, 15 bp, Artificial Sequence
  dgRNA
  Ampd2
gggcactctaaagac

SEQ ID NO: 8316 - DNA, 15 bp, Artificial Sequence
  dgRNA
  Ampd2
aggccccactccccg

SEQ ID NO: 8317 - DNA, 15 bp, Artificial Sequence
  dgRNA
  Ampd2
caacatcagaaatcg

SEQ ID NO: 8318 - DNA, 15 bp, Artificial Sequence
  dgRNA
  Wdr63
agtggacgcaaggca

SEQ ID NO: 8319 - DNA, 15 bp, Artificial Sequence
  dgRNA
  Wdr63
tggacctaagtcaag

SEQ ID NO: 8320 - DNA, 15 bp, Artificial Sequence
  dgRNA
  Wdr63
ggacctaagtcaaga

SEQ ID NO: 8321 - DNA, 15 bp, Artificial Sequence
  dgRNA
  Wdr63
gacctaagtcaagag

SEQ ID NO: 8322 - DNA, 15 bp, Artificial Sequence
  dgRNA
  Ubald1
gatgcaaataaaccg

SEQ ID NO: 8323 - DNA, 15 bp, Artificial Sequence
  dgRNA
  Ubald1
taaaccggggcattg

SEQ ID NO: 8324 - DNA, 15 bp, Artificial Sequence
  dgRNA
  Ubald1
aaaccggggcattgt

SEQ ID NO: 8325 - DNA, 15 bp, Artificial Sequence
  dgRNA
  Ubald1
tgggaatggcagtcg

SEQ ID NO: 8326 - DNA, 15 bp, Artificial Sequence
  dgRNA
  Tnks1bp1
cactcccagccgtgg

SEQ ID NO: 8327 - DNA, 15 bp, Artificial Sequence
  dgRNA
  Tnks1bp1
actcccagccgtgga

SEQ ID NO: 8328 - DNA, 15 bp, Artificial Sequence
  dgRNA
  Tnks1bp1
aggggggccggctgt

SEQ ID NO: 8329 - DNA, 15 bp, Artificial Sequence
  dgRNA
  Tnks1bp1
ggggggccggctgtg

SEQ ID NO: 8330 - DNA, 15 bp, Artificial Sequence
  dgRNA
  Ddt
gagccacctgccgac

SEQ ID NO: 8331 - DNA, 15 bp, Artificial Sequence
  dgRNA
  Ddt
agccacctgccgact

SEQ ID NO: 8332 - DNA, 15 bp, Artificial Sequence
  dgRNA
  Ddt
cacctgccgactggg

SEQ ID NO: 8333 - DNA, 15 bp, Artificial Sequence
  dgRNA
  Ddt
acctgccgactggga

SEQ ID NO: 8334 - DNA, 15 bp, Artificial Sequence
  dgRNA
  Eif3g
gatctcagcgctttg

SEQ ID NO: 8335 - DNA, 15 bp, Artificial Sequence
  dgRNA
  Eif3g
tccacctttgtccgc

SEQ ID NO: 8336 - DNA, 15 bp, Artificial Sequence
  dgRNA
  Eif3g
ccacctttgtccgca

SEQ ID NO: 8337 - DNA, 15 bp, Artificial Sequence
  dgRNA
  Eif3g
cctttgtccgcaggg

SEQ ID NO: 8338 - DNA, 15 bp, Artificial Sequence
  dgRNA
  Ahsa2
gggcgaagtcggggg

SEQ ID NO: 8339 - DNA, 15 bp, Artificial Sequence
  dgRNA
  Ahsa2
ggcgaagtcgggggt

SEQ ID NO: 8340 - DNA, 15 bp, Artificial Sequence
  dgRNA
  Ahsa2
gagggcggcgcccag

SEQ ID NO: 8341 - DNA, 15 bp, Artificial Sequence
  dgRNA
  Ahsa2
cggcgcccagaggtg

SEQ ID NO: 8342 - DNA, 15 bp, Artificial Sequence
  dgRNA
  Arf1
caagcgccatccgtg

SEQ ID NO: 8343 - DNA, 15 bp, Artificial Sequence
  dgRNA
  Arf1
aagcgccatccgtgt

SEQ ID NO: 8344 - DNA, 15 bp, Artificial Sequence
  dgRNA
  Arf1
agcgccatccgtgtg

SEQ ID NO: 8345 - DNA, 15 bp, Artificial Sequence
  dgRNA
  Arf1
gcgccatccgtgtgg

SEQ ID NO: 8346 - DNA, 15 bp, Artificial Sequence
  dgRNA
  Egr4
cggcagcaacgtcac

SEQ ID NO: 8347 - DNA, 15 bp, Artificial Sequence
  dgRNA
  Egr4
cttttcgggagtccc

SEQ ID NO: 8348 - DNA, 15 bp, Artificial Sequence
  dgRNA
  Egr4
tggtcatttacgtca

SEQ ID NO: 8349 - DNA, 15 bp, Artificial Sequence
  dgRNA
  Egr4
ttacgtcacggcgcc

SEQ ID NO: 8350 - DNA, 15 bp, Artificial Sequence
  dgRNA
  Vps54
ggcgctgcggacccg

SEQ ID NO: 8351 - DNA, 15 bp, Artificial Sequence
  dgRNA
  Vps54
cccgggggagactgc

SEQ ID NO: 8352 - DNA, 15 bp, Artificial Sequence
  dgRNA
  Vps54
cccgggcgagacgtg

SEQ ID NO: 8353 - DNA, 15 bp, Artificial Sequence
  dgRNA
  Vps54
ccgggcgagacgtga

SEQ ID NO: 8354 - DNA, 15 bp, Artificial Sequence
  dgRNA
  P3h4
actttgcctacgcaa

SEQ ID NO: 8355 - DNA, 15 bp, Artificial Sequence
  dgRNA
  P3h4
ctacgcaaaggacag

SEQ ID NO: 8356 - DNA, 15 bp, Artificial Sequence
  dgRNA
  P3h4
gaggtggcacttaag

SEQ ID NO: 8357 - DNA, 15 bp, Artificial Sequence
  dgRNA
  P3h4
gtggcacttaagggg

SEQ ID NO: 8358 - DNA, 15 bp, Artificial Sequence
  dgRNA
  Kdm3b
tcccctcccgatcgc

SEQ ID NO: 8359 - DNA, 15 bp, Artificial Sequence
  dgRNA
  Kdm3b
cccctcccgatcgca

SEQ ID NO: 8360 - DNA, 15 bp, Artificial Sequence
  dgRNA
  Kdm3b
ccctcccgatcgcag

SEQ ID NO: 8361 - DNA, 15 bp, Artificial Sequence
  dgRNA
  Kdm3b
cctcccgatcgcagg

SEQ ID NO: 8362 - DNA, 15 bp, Artificial Sequence
  dgRNA
  Pkd2l1
aactataaggggaac

SEQ ID NO: 8363 - DNA, 15 bp, Artificial Sequence
  dgRNA
  Pkd2l1
ggaatggaactataa

SEQ ID NO: 8364 - DNA, 15 bp, Artificial Sequence
  dgRNA
  Cd160
gtagctgttcccccg

SEQ ID NO: 8365 - DNA, 15 bp, Artificial Sequence
  dgRNA
  Cd160
tgttcccccgtggcc

SEQ ID NO: 8366 - DNA, 15 bp, Artificial Sequence
  dgRNA
  Cd160
ctggcgttgctgaac

SEQ ID NO: 8367 - DNA, 15 bp, Artificial Sequence
  dgRNA
  Cd160
caaaccatcctcacc

SEQ ID NO: 8368 - DNA, 15 bp, Artificial Sequence
  dgRNA
  Sdc1
gtgggcttcgatcct

SEQ ID NO: 8369 - DNA, 15 bp, Artificial Sequence
  dgRNA
  Sdc1
ggcttcgatcctagg

SEQ ID NO: 8370 - DNA, 15 bp, Artificial Sequence
  dgRNA
  Sdc1
cgatcctaggaggcg

SEQ ID NO: 8371 - DNA, 15 bp, Artificial Sequence
  dgRNA
  Sdc1
cctaggaggcgtgga

SEQ ID NO: 8372 - DNA, 15 bp, Artificial Sequence
  dgRNA
  Ube2g1
cgacgcttccgcagc

SEQ ID NO: 8373 - DNA, 15 bp, Artificial Sequence
  dgRNA
  Ube2g1
gacgcttccgcagct

SEQ ID NO: 8374 - DNA, 15 bp, Artificial Sequence
  dgRNA
  Ube2g1
cttccgcagctgggc

SEQ ID NO: 8375 - DNA, 15 bp, Artificial Sequence
  dgRNA
  Ube2g1
cttcccaagatggcg

SEQ ID NO: 8376 - DNA, 15 bp, Artificial Sequence
  dgRNA
  Stra6
tgcaccgtctttgtg

SEQ ID NO: 8377 - DNA, 15 bp, Artificial Sequence
  dgRNA
  Stra6
cgtctttgtgaggtg

SEQ ID NO: 8378 - DNA, 15 bp, Artificial Sequence
  dgRNA
  Stra6
cccgccccatgacca

SEQ ID NO: 8379 - DNA, 15 bp, Artificial Sequence
  dgRNA
  Stra6
ggccctcagcgcagc

SEQ ID NO: 8380 - DNA, 15 bp, Artificial Sequence
  dgRNA
  1700011I03Rik
ccttggcattagacc

SEQ ID NO: 8381 - DNA, 15 bp, Artificial Sequence
  dgRNA
  1700011I03Rik
cttggcattagacct

SEQ ID NO: 8382 - DNA, 15 bp, Artificial Sequence
  dgRNA
  1700011I03Rik
tgtccccctgctgtc

SEQ ID NO: 8383 - DNA, 15 bp, Artificial Sequence
  dgRNA
  1700011I03Rik
ggtctaatgccaagg

SEQ ID NO: 8384 - DNA, 15 bp, Artificial Sequence
  dgRNA
  Spata17
aacatcaacgacacc

SEQ ID NO: 8385 - DNA, 15 bp, Artificial Sequence
  dgRNA
  Spata17
acatcaacgacaccc

SEQ ID NO: 8386 - DNA, 15 bp, Artificial Sequence
  dgRNA
  Spata17
cgacacccgggagcg

SEQ ID NO: 8387 - DNA, 15 bp, Artificial Sequence
  dgRNA
  Spata17
gggagcgcggcctcg

SEQ ID NO: 8388 - DNA, 15 bp, Artificial Sequence
  dgRNA
  Pla1a
gggtgaggttcccta

SEQ ID NO: 8389 - DNA, 15 bp, Artificial Sequence
  dgRNA
  Pla1a
agttttgtaaccact

SEQ ID NO: 8390 - DNA, 15 bp, Artificial Sequence
  dgRNA
  Pla1a
acttttggatcccta

SEQ ID NO: 8391 - DNA, 15 bp, Artificial Sequence
  dgRNA
  Pla1a
gacatatttgtccct

SEQ ID NO: 8392 - DNA, 15 bp, Artificial Sequence
  dgRNA
  Dcaf13
ggcaaagcggggagt

SEQ ID NO: 8393 - DNA, 15 bp, Artificial Sequence
  dgRNA
  Dcaf13
gcgcgcgctcgccct

SEQ ID NO: 8394 - DNA, 15 bp, Artificial Sequence
  dgRNA
  Dcaf13
cgcgcgctcgccctc

SEQ ID NO: 8395 - DNA, 15 bp, Artificial Sequence
  dgRNA
  Dcaf13
gcgagcgacagctga

SEQ ID NO: 8396 - DNA, 15 bp, Artificial Sequence
  dgRNA
  Purg
gggatgctgtgtgcg

SEQ ID NO: 8397 - DNA, 15 bp, Artificial Sequence
  dgRNA
  Purg
gctgtgtgcgcggtg

SEQ ID NO: 8398 - DNA, 15 bp, Artificial Sequence
  dgRNA
  Purg
tgcgcggtgcggagc

SEQ ID NO: 8399 - DNA, 15 bp, Artificial Sequence
  dgRNA
  Purg
gtgcggagccggccg

SEQ ID NO: 8400 - DNA, 15 bp, Artificial Sequence
  dgRNA
  Rsrc2
accgagcatccattc

SEQ ID NO: 8401 - DNA, 15 bp, Artificial Sequence
  dgRNA
  Rsrc2
ccgagcatccattct

SEQ ID NO: 8402 - DNA, 15 bp, Artificial Sequence
  dgRNA
  Rsrc2
ccccacccacttcgt

SEQ ID NO: 8403 - DNA, 15 bp, Artificial Sequence
  dgRNA
  Rsrc2
agcaagctgcgcgcc

SEQ ID NO: 8404 - DNA, 15 bp, Artificial Sequence
  dgRNA
  Usp15
accacgccgtgctgc

SEQ ID NO: 8405 - DNA, 15 bp, Artificial Sequence
  dgRNA
  Usp15
ccacgccgtgctgcg

SEQ ID NO: 8406 - DNA, 15 bp, Artificial Sequence
  dgRNA
  Usp15
gtgctgcggggcgtg

SEQ ID NO: 8407 - DNA, 15 bp, Artificial Sequence
  dgRNA
  Usp15
tgctgcggggcgtgc

SEQ ID NO: 8408 - DNA, 15 bp, Artificial Sequence
  dgRNA
  Ankrd12
cgcgctccgctcctc

SEQ ID NO: 8409 - DNA, 15 bp, Artificial Sequence
  dgRNA
  Ankrd12
gcgctccgctcctcc

SEQ ID NO: 8410 - DNA, 15 bp, Artificial Sequence
  dgRNA
  Ankrd12
cgctccgctcctccg

SEQ ID NO: 8411 - DNA, 15 bp, Artificial Sequence
  dgRNA
  Ankrd12
cctccggggagccca

SEQ ID NO: 8412 - DNA, 15 bp, Artificial Sequence
  dgRNA
  Sf3b4
ctcaagtctaggccg

SEQ ID NO: 8413 - DNA, 15 bp, Artificial Sequence
  dgRNA
  Sf3b4
tcaagtctaggccga

SEQ ID NO: 8414 - DNA, 15 bp, Artificial Sequence
  dgRNA
  Sf3b4
tctgcacgagcgtcg

SEQ ID NO: 8415 - DNA, 15 bp, Artificial Sequence
  dgRNA
  Sf3b4
ataggtcgctccaga

SEQ ID NO: 8416 - DNA, 15 bp, Artificial Sequence
  dgRNA
  Rd3
acatcggccaatagc

SEQ ID NO: 8417 - DNA, 15 bp, Artificial Sequence
  dgRNA
  Rd3
tagcatcaaaccaga

SEQ ID NO: 8418 - DNA, 15 bp, Artificial Sequence
  dgRNA
  Rd3
ggttcagttgccttc

SEQ ID NO: 8419 - DNA, 15 bp, Artificial Sequence
  dgRNA
  Rd3
agctaatactgcttc

SEQ ID NO: 8420 - DNA, 15 bp, Artificial Sequence
  dgRNA
  Folr1
tcactcttgcaatag

SEQ ID NO: 8421 - DNA, 15 bp, Artificial Sequence
  dgRNA
  Folr1
tgaggtttgccccct

SEQ ID NO: 8422 - DNA, 15 bp, Artificial Sequence
  dgRNA
  Folr1
gtgaggtttgccccc

SEQ ID NO: 8423 - DNA, 15 bp, Artificial Sequence
  dgRNA
  Folr1
tctattgcaagagtg

SEQ ID NO: 8424 - DNA, 15 bp, Artificial Sequence
  dgRNA
  Cspg5
gtaccaaattggtgc

SEQ ID NO: 8425 - DNA, 15 bp, Artificial Sequence
  dgRNA
  Cspg5
tatccagcaccaatt

SEQ ID NO: 8426 - DNA, 15 bp, Artificial Sequence
  dgRNA
  Tmprss11c
gcacgcccccccaaa

SEQ ID NO: 8427 - DNA, 15 bp, Artificial Sequence
  dgRNA
  Tmprss11c
cacgcccccccaaat

SEQ ID NO: 8428 - DNA, 15 bp, Artificial Sequence
  dgRNA
  Tmprss11c
atcagcccatttggg

SEQ ID NO: 8429 - DNA, 15 bp, Artificial Sequence
  dgRNA
  Tmprss11c
tatcagcccatttgg

SEQ ID NO: 8430 - DNA, 15 bp, Artificial Sequence
  dgRNA
  Sync
cctcaccatgcaacc

SEQ ID NO: 8431 - DNA, 15 bp, Artificial Sequence
  dgRNA
  Sync
ttcgcgaagtgccgc

SEQ ID NO: 8432 - DNA, 15 bp, Artificial Sequence
  dgRNA
  Sync
tcgcgaagtgccgct

SEQ ID NO: 8433 - DNA, 15 bp, Artificial Sequence
  dgRNA
  Sync
cgcccccagggccgc

SEQ ID NO: 8434 - DNA, 15 bp, Artificial Sequence
  dgRNA
  Rnase2b
gctggttgcacaagc

SEQ ID NO: 8435 - DNA, 15 bp, Artificial Sequence
  dgRNA
  Arhgap30
cccacctagagattt

SEQ ID NO: 8436 - DNA, 15 bp, Artificial Sequence
  dgRNA
  Arhgap30
ttcggtctctagaaa

SEQ ID NO: 8437 - DNA, 15 bp, Artificial Sequence
  dgRNA
  Arhgap30
ccgaaatctctaggt

SEQ ID NO: 8438 - DNA, 15 bp, Artificial Sequence
  dgRNA
  Arhgap30
accgaaatctctagg

SEQ ID NO: 8439 - DNA, 15 bp, Artificial Sequence
  dgRNA
  Rnf133
tacccataaccacac

SEQ ID NO: 8440 - DNA, 15 bp, Artificial Sequence
  dgRNA
  Rnf133
agctaattggctgct

SEQ ID NO: 8441 - DNA, 15 bp, Artificial Sequence
  dgRNA
  Rnf133
tggagccatataaaa

SEQ ID NO: 8442 - DNA, 15 bp, Artificial Sequence
  dgRNA
  Shroom1
cataagtcttgcctg

SEQ ID NO: 8443 - DNA, 15 bp, Artificial Sequence
  dgRNA
  Shroom1
ggatccggcagtgct

SEQ ID NO: 8444 - DNA, 15 bp, Artificial Sequence
  dgRNA
  Shroom1
tccggcagtgcttgg

SEQ ID NO: 8445 - DNA, 15 bp, Artificial Sequence
  dgRNA
  Shroom1
atttcgatcgccctc

SEQ ID NO: 8446 - DNA, 15 bp, Artificial Sequence
  dgRNA
  Isg20
tttggacctaataat

SEQ ID NO: 8447 - DNA, 15 bp, Artificial Sequence
  dgRNA
  Isg20
ataggtatcactcta

SEQ ID NO: 8448 - DNA, 15 bp, Artificial Sequence
  dgRNA
  Isg20
gcccgcagctcaagc

SEQ ID NO: 8449 - DNA, 15 bp, Artificial Sequence
  dgRNA
  Isg20
gccccctgaaataaa

SEQ ID NO: 8450 - DNA, 15 bp, Artificial Sequence
  dgRNA
  Lrrtm4
tataatttatactac

SEQ ID NO: 8451 - DNA, 15 bp, Artificial Sequence
  dgRNA
  Lrrtm4
tttatactactggag

SEQ ID NO: 8452 - DNA, 15 bp, Artificial Sequence
  dgRNA
  Lrrtm4
atactactggagcgg

SEQ ID NO: 8453 - DNA, 15 bp, Artificial Sequence
  dgRNA
  Lrrtm4
tactactggagcggc

SEQ ID NO: 8454 - DNA, 15 bp, Artificial Sequence
  dgRNA
  Drap1
aacacagtcacgggg

SEQ ID NO: 8455 - DNA, 15 bp, Artificial Sequence
  dgRNA
  Drap1
cggaaccagaaggct

SEQ ID NO: 8456 - DNA, 15 bp, Artificial Sequence
  dgRNA
  Drap1
gggcgggcagcgtcc

SEQ ID NO: 8457 - DNA, 15 bp, Artificial Sequence
  dgRNA
  Drap1
ggcgggcagcgtcca

SEQ ID NO: 8458 - DNA, 15 bp, Artificial Sequence
  dgRNA
  Ifi204
atgaacgaaactggg

SEQ ID NO: 8459 - DNA, 15 bp, Artificial Sequence
  dgRNA
  Ifi204
agtgctgaatcagcc

SEQ ID NO: 8460 - DNA, 15 bp, Artificial Sequence
  dgRNA
  Aes
caggctgcgagtctg

SEQ ID NO: 8461 - DNA, 15 bp, Artificial Sequence
  dgRNA
  Aes
tggggttccgggccg

SEQ ID NO: 8462 - DNA, 15 bp, Artificial Sequence
  dgRNA
  Aes
ggttccgggccgtgg

SEQ ID NO: 8463 - DNA, 15 bp, Artificial Sequence
  dgRNA
  Aes
gttccgggccgtggc

SEQ ID NO: 8464 - DNA, 15 bp, Artificial Sequence
  dgRNA
  Ddx39b
gcgaaagcctgcttc

SEQ ID NO: 8465 - DNA, 15 bp, Artificial Sequence
  dgRNA
  Ddx39b
cttgcgcgtgcgccc

SEQ ID NO: 8466 - DNA, 15 bp, Artificial Sequence
  dgRNA
  Ddx39b
gcgcgtgcgccctgg

SEQ ID NO: 8467 - DNA, 15 bp, Artificial Sequence
  dgRNA
  Ddx39b
gtgcgccctggcggc

SEQ ID NO: 8468 - DNA, 15 bp, Artificial Sequence
  dgRNA
  Gpt2
agtctggcctgcgcc

SEQ ID NO: 8469 - DNA, 15 bp, Artificial Sequence
  dgRNA
  Gpt2
tgcgccaggctttag

SEQ ID NO: 8470 - DNA, 15 bp, Artificial Sequence
  dgRNA
  Gpt2
actgcagtgttgata

SEQ ID NO: 8471 - DNA, 15 bp, Artificial Sequence
  dgRNA
  Gpt2
cagaagtcagcgcgc

SEQ ID NO: 8472 - DNA, 15 bp, Artificial Sequence
  dgRNA
  Lgr6
aaactttctacgctg

SEQ ID NO: 8473 - DNA, 15 bp, Artificial Sequence
  dgRNA
  Lgr6
acggtgcagtcagag

SEQ ID NO: 8474 - DNA, 15 bp, Artificial Sequence
  dgRNA
  Lgr6
gcttgggcgcggcgg

SEQ ID NO: 8475 - DNA, 15 bp, Artificial Sequence
  dgRNA
  Olfr676
tggggcagttcatcc

SEQ ID NO: 8476 - DNA, 15 bp, Artificial Sequence
  dgRNA
  Olfr676
gattgctagcttcta

SEQ ID NO: 8477 - DNA, 15 bp, Artificial Sequence
  dgRNA
  AF529169
aagcaaaccccgggg

SEQ ID NO: 8478 - DNA, 15 bp, Artificial Sequence
  dgRNA
  AF529169
accccggggtggatc

SEQ ID NO: 8479 - DNA, 15 bp, Artificial Sequence
  dgRNA
  AF529169
ggtggatctggcccg

SEQ ID NO: 8480 - DNA, 15 bp, Artificial Sequence
  dgRNA
  AF529169
ttgcccggtctcagc

SEQ ID NO: 8481 - DNA, 15 bp, Artificial Sequence
  dgRNA
  Fndc7
ctacatgactatacc

SEQ ID NO: 8482 - DNA, 15 bp, Artificial Sequence
  dgRNA
  Rpl37
ggcgggccgctgggg

SEQ ID NO: 8483 - DNA, 15 bp, Artificial Sequence
  dgRNA
  Rpl37
aggcacgccccctac

SEQ ID NO: 8484 - DNA, 15 bp, Artificial Sequence
  dgRNA
  Rpl37
gtgttgcagcccaat

SEQ ID NO: 8485 - DNA, 15 bp, Artificial Sequence
  dgRNA
  Rpl37
gcccaatcggctccc

SEQ ID NO: 8486 - DNA, 15 bp, Artificial Sequence
  dgRNA
  Taz
acgcagcactgctta

SEQ ID NO: 8487 - DNA, 15 bp, Artificial Sequence
  dgRNA
  Taz
ctgcttaaggcggtt

SEQ ID NO: 8488 - DNA, 15 bp, Artificial Sequence
  dgRNA
  Taz
agccaaaaccttgac

SEQ ID NO: 8489 - DNA, 15 bp, Artificial Sequence
  dgRNA
  Taz
gccaaaaccttgacg

SEQ ID NO: 8490 - DNA, 15 bp, Artificial Sequence
  dgRNA
  Gpr160
ttaccctgagcagtc

SEQ ID NO: 8491 - DNA, 15 bp, Artificial Sequence
  dgRNA
  Gpr160
gaggtgagcctcgcg

SEQ ID NO: 8492 - DNA, 15 bp, Artificial Sequence
  dgRNA
  Gpr160
cgaggggactcacct

SEQ ID NO: 8493 - DNA, 15 bp, Artificial Sequence
  dgRNA
  Gpr160
tcacctggggcgggc

SEQ ID NO: 8494 - DNA, 15 bp, Artificial Sequence
  dgRNA
  Usp14
cgcacctccccgcgg

SEQ ID NO: 8495 - DNA, 15 bp, Artificial Sequence
  dgRNA
  Usp14
cccgcggtggcttct

SEQ ID NO: 8496 - DNA, 15 bp, Artificial Sequence
  dgRNA
  Usp14
ccgcggtggcttctt

SEQ ID NO: 8497 - DNA, 15 bp, Artificial Sequence
  dgRNA
  Usp14
tgggcgaacagcgtg

SEQ ID NO: 8498 - DNA, 15 bp, Artificial Sequence
  dgRNA
  Dnajc19
ttggacttgcaagtc

SEQ ID NO: 8499 - DNA, 15 bp, Artificial Sequence
  dgRNA
  Dnajc19
aggaatcccgggcag

SEQ ID NO: 8500 - DNA, 15 bp, Artificial Sequence
  dgRNA
  Dnajc19
ggaatcccgggcaga

SEQ ID NO: 8501 - DNA, 15 bp, Artificial Sequence
  dgRNA
  Dnajc19
gacctctccgtcaac

SEQ ID NO: 8502 - DNA, 15 bp, Artificial Sequence
  dgRNA
  Spock3
gcctactgcatcctc

SEQ ID NO: 8503 - DNA, 15 bp, Artificial Sequence
  dgRNA
  Spock3
gccaggcttcgcatc

SEQ ID NO: 8504 - DNA, 15 bp, Artificial Sequence
  dgRNA
  Spock3
gaacttgctgcagct

SEQ ID NO: 8505 - DNA, 15 bp, Artificial Sequence
  dgRNA
  Spock3
gatgcgaagcctggc

SEQ ID NO: 8506 - DNA, 15 bp, Artificial Sequence
  dgRNA
  Trp53bp1
tccttttcttacgct

SEQ ID NO: 8507 - DNA, 15 bp, Artificial Sequence
  dgRNA
  Trp53bp1
ccttttcttacgctg

SEQ ID NO: 8508 - DNA, 15 bp, Artificial Sequence
  dgRNA
  Trp53bp1
cttttcttacgctgg

SEQ ID NO: 8509 - DNA, 15 bp, Artificial Sequence
  dgRNA
  Trp53bp1
ttcttacgctggggg

SEQ ID NO: 8510 - DNA, 15 bp, Artificial Sequence
  dgRNA
  Cldn34b1
gaagtaaaactagtc

SEQ ID NO: 8511 - DNA, 15 bp, Artificial Sequence
  dgRNA
  Cldn34b1
aagtaaaactagtcc

SEQ ID NO: 8512 - DNA, 15 bp, Artificial Sequence
  dgRNA
  Birc5
cccgccacgcccaca

SEQ ID NO: 8513 - DNA, 15 bp, Artificial Sequence
  dgRNA
  Birc5
cacgcccacaaggcc

SEQ ID NO: 8514 - DNA, 15 bp, Artificial Sequence
  dgRNA
  Birc5
aggccaggcgcagat

SEQ ID NO: 8515 - DNA, 15 bp, Artificial Sequence
  dgRNA
  Birc5
aggcgcagatgggcg

SEQ ID NO: 8516 - DNA, 15 bp, Artificial Sequence
  dgRNA
  Zfp472
ggtatgagcttggac

SEQ ID NO: 8517 - DNA, 15 bp, Artificial Sequence
  dgRNA
  Zfp472
gtatgagcttggaca

SEQ ID NO: 8518 - DNA, 15 bp, Artificial Sequence
  dgRNA
  Zfp472
cttacagacccattt

SEQ ID NO: 8519 - DNA, 15 bp, Artificial Sequence
  dgRNA
  Zfp472
acagacccatttcgg

SEQ ID NO: 8520 - DNA, 15 bp, Artificial Sequence
  dgRNA
  Mapkapk3
cacagataaaatccg

SEQ ID NO: 8521 - DNA, 15 bp, Artificial Sequence
  dgRNA
  Mapkapk3
agataaaatccgagg

SEQ ID NO: 8522 - DNA, 15 bp, Artificial Sequence
  dgRNA
  Mapkapk3
aaaatccgaggaggc

SEQ ID NO: 8523 - DNA, 15 bp, Artificial Sequence
  dgRNA
  Mapkapk3
tggtacaacagttga

SEQ ID NO: 8524 - DNA, 15 bp, Artificial Sequence
  dgRNA
  Olfr744
atcttgtgccactgg

SEQ ID NO: 8525 - DNA, 15 bp, Artificial Sequence
  dgRNA
  Olfr744
gcacaagataattct

SEQ ID NO: 8526 - DNA, 15 bp, Artificial Sequence
  dgRNA
  Wwox
gtcctgcatgatgac

SEQ ID NO: 8527 - DNA, 15 bp, Artificial Sequence
  dgRNA
  Wwox
tcctgcatgatgact

SEQ ID NO: 8528 - DNA, 15 bp, Artificial Sequence
  dgRNA
  Wwox
gcaaaacccggaaac

SEQ ID NO: 8529 - DNA, 15 bp, Artificial Sequence
  dgRNA
  Wwox
gactctgcacgttgc

SEQ ID NO: 8530 - DNA, 15 bp, Artificial Sequence
  dgRNA
  2210407C18Rik
accaaccagaagttc

SEQ ID NO: 8531 - DNA, 15 bp, Artificial Sequence
  dgRNA
  2210407C18Rik
agtgtcttaattgcc

SEQ ID NO: 8532 - DNA, 15 bp, Artificial Sequence
  dgRNA
  2210407C18Rik
ggctataaaagtgac

SEQ ID NO: 8533 - DNA, 15 bp, Artificial Sequence
  dgRNA
  2210407C18Rik
gaacttctggttggt

SEQ ID NO: 8534 - DNA, 15 bp, Artificial Sequence
  dgRNA
  Fam92a
atctaacttatagag

SEQ ID NO: 8535 - DNA, 15 bp, Artificial Sequence
  dgRNA
  Fam92a
gcggttcttttccaa

SEQ ID NO: 8536 - DNA, 15 bp, Artificial Sequence
  dgRNA
  Fam92a
ttcctgtaccccttc

SEQ ID NO: 8537 - DNA, 15 bp, Artificial Sequence
  dgRNA
  Fam92a
accccttccggttgc

SEQ ID NO: 8538 - DNA, 15 bp, Artificial Sequence
  dgRNA
  Baiap3
tggccactaccgtgc

SEQ ID NO: 8539 - DNA, 15 bp, Artificial Sequence
  dgRNA
  Baiap3
cgaccccaaacgcgc

SEQ ID NO: 8540 - DNA, 15 bp, Artificial Sequence
  dgRNA
  Baiap3
gaccccaaacgcgca

SEQ ID NO: 8541 - DNA, 15 bp, Artificial Sequence
  dgRNA
  Baiap3
ccaaacgcgcagggt

SEQ ID NO: 8542 - DNA, 15 bp, Artificial Sequence
  dgRNA
  Rpl31
ttccgaatccgggtt

SEQ ID NO: 8543 - DNA, 15 bp, Artificial Sequence
  dgRNA
  Rpl31
tccgaatccgggttc

SEQ ID NO: 8544 - DNA, 15 bp, Artificial Sequence
  dgRNA
  Rpl31
aatccgggttcgggt

SEQ ID NO: 8545 - DNA, 15 bp, Artificial Sequence
  dgRNA
  Rpl31
atccgggttcgggtt

SEQ ID NO: 8546 - DNA, 15 bp, Artificial Sequence
  dgRNA
  Haus5
cgccaagagccgcta

SEQ ID NO: 8547 - DNA, 15 bp, Artificial Sequence
  dgRNA
  Haus5
gccaagagccgctac

SEQ ID NO: 8548 - DNA, 15 bp, Artificial Sequence
  dgRNA
  Haus5
agccgctacgggtag

SEQ ID NO: 8549 - DNA, 15 bp, Artificial Sequence
  dgRNA
  Haus5
ctacgggtagcggcc

SEQ ID NO: 8550 - DNA, 15 bp, Artificial Sequence
  dgRNA
  Uggt1
ctcacctgcttgaac

SEQ ID NO: 8551 - DNA, 15 bp, Artificial Sequence
  dgRNA
  Uggt1
tcacctgcttgaact

SEQ ID NO: 8552 - DNA, 15 bp, Artificial Sequence
  dgRNA
  Uggt1
gatcttaaattcagg

SEQ ID NO: 8553 - DNA, 15 bp, Artificial Sequence
  dgRNA
  Uggt1
cgagctggctcaacc

SEQ ID NO: 8554 - DNA, 15 bp, Artificial Sequence
  dgRNA
  Dmrtc1b
tcagccccaatcacc

SEQ ID NO: 8555 - DNA, 15 bp, Artificial Sequence
  dgRNA
  Dmrtc1b
gctaaggacggggcg

SEQ ID NO: 8556 - DNA, 15 bp, Artificial Sequence
  dgRNA
  Dmrtc1b
agctaaggacggggc

SEQ ID NO: 8557 - DNA, 15 bp, Artificial Sequence
  dgRNA
  Dmrtc1b
tgagagctaaggacg

SEQ ID NO: 8558 - DNA, 15 bp, Artificial Sequence
  dgRNA
  Klhl23
ttcccggactttatg

SEQ ID NO: 8559 - DNA, 15 bp, Artificial Sequence
  dgRNA
  Klhl23
tctggtgtggcacaa

SEQ ID NO: 8560 - DNA, 15 bp, Artificial Sequence
  dgRNA
  Klhl23
atggacatcaccaga

SEQ ID NO: 8561 - DNA, 15 bp, Artificial Sequence
  dgRNA
  Klhl23
tgtcagggagcttac

SEQ ID NO: 8562 - DNA, 15 bp, Artificial Sequence
  dgRNA
  Rnase9
taaattggcaatgtg

SEQ ID NO: 8563 - DNA, 15 bp, Artificial Sequence
  dgRNA
  Rnase9
gtaaattggcaatgt

SEQ ID NO: 8564 - DNA, 15 bp, Artificial Sequence
  dgRNA
  Rnase9
gccacttgagtaaat

SEQ ID NO: 8565 - DNA, 15 bp, Artificial Sequence
  dgRNA
  Neto2
gtgggtctaaggttt

SEQ ID NO: 8566 - DNA, 15 bp, Artificial Sequence
  dgRNA
  Neto2
ggcaggtccaactgt

SEQ ID NO: 8567 - DNA, 15 bp, Artificial Sequence
  dgRNA
  Neto2
gggcaggtccaactg

SEQ ID NO: 8568 - DNA, 15 bp, Artificial Sequence
  dgRNA
  Neto2
caataatgttagggg

SEQ ID NO: 8569 - DNA, 15 bp, Artificial Sequence
  dgRNA
  Rnf165
gcgcgcgcctttgtg

SEQ ID NO: 8570 - DNA, 15 bp, Artificial Sequence
  dgRNA
  Rnf165
cgcgcctttgtgtgg

SEQ ID NO: 8571 - DNA, 15 bp, Artificial Sequence
  dgRNA
  Rnf165
cctttgaatgtcgag

SEQ ID NO: 8572 - DNA, 15 bp, Artificial Sequence
  dgRNA
  Rnf165
ctttgaatgtcgaga

SEQ ID NO: 8573 - DNA, 15 bp, Artificial Sequence
  dgRNA
  Lgmn
taaagctccgcccac

SEQ ID NO: 8574 - DNA, 15 bp, Artificial Sequence
  dgRNA
  Lgmn
aaagctccgcccaca

SEQ ID NO: 8575 - DNA, 15 bp, Artificial Sequence
  dgRNA
  Lgmn
cccgcccacgcacac

SEQ ID NO: 8576 - DNA, 15 bp, Artificial Sequence
  dgRNA
  Lgmn
gattcgtagtctttc

SEQ ID NO: 8577 - DNA, 15 bp, Artificial Sequence
  dgRNA
  Sdc4
cagtttggagccggc

SEQ ID NO: 8578 - DNA, 15 bp, Artificial Sequence
  dgRNA
  Sdc4
ccggcaggcacgctg

SEQ ID NO: 8579 - DNA, 15 bp, Artificial Sequence
  dgRNA
  Sdc4
cggcaggcacgctgt

SEQ ID NO: 8580 - DNA, 15 bp, Artificial Sequence
  dgRNA
  Sdc4
ctgtgggcgggtccc

SEQ ID NO: 8581 - DNA, 15 bp, Artificial Sequence
  dgRNA
  Efna1
tccgtcgctgagata

SEQ ID NO: 8582 - DNA, 15 bp, Artificial Sequence
  dgRNA
  Efna1
ccgtcgctgagatat

SEQ ID NO: 8583 - DNA, 15 bp, Artificial Sequence
  dgRNA
  Efna1
tggggcagcgcgcgt

SEQ ID NO: 8584 - DNA, 15 bp, Artificial Sequence
  dgRNA
  Efna1
ggggcagcgcgcgtc

SEQ ID NO: 8585 - DNA, 15 bp, Artificial Sequence
  dgRNA
  Olfr799
aacctacagtaatac

SEQ ID NO: 8586 - DNA, 15 bp, Artificial Sequence
  dgRNA
  Olfr799
atttttcaaccagat

SEQ ID NO: 8587 - DNA, 15 bp, Artificial Sequence
  dgRNA
  Olfr799
gtctcttgtccaatc

SEQ ID NO: 8588 - DNA, 15 bp, Artificial Sequence
  dgRNA
  Olfr1322
caattaggcttgata

SEQ ID NO: 8589 - DNA, 15 bp, Artificial Sequence
  dgRNA
  Olfr1322
catatcaagcctaat

SEQ ID NO: 8590 - DNA, 15 bp, Artificial Sequence
  dgRNA
  Cdv3
tcggcgcgcccacag

SEQ ID NO: 8591 - DNA, 15 bp, Artificial Sequence
  dgRNA
  Cdv3
gcgcgcccacagcgg

SEQ ID NO: 8592 - DNA, 15 bp, Artificial Sequence
  dgRNA
  Cdv3
cgcgcccacagcggc

SEQ ID NO: 8593 - DNA, 15 bp, Artificial Sequence
  dgRNA
  Cdv3
gcccacagcggcggg

SEQ ID NO: 8594 - DNA, 15 bp, Artificial Sequence
  dgRNA
  Lrig2
taatgctcgcctcct

SEQ ID NO: 8595 - DNA, 15 bp, Artificial Sequence
  dgRNA
  Lrig2
aatgctcgcctccta

SEQ ID NO: 8596 - DNA, 15 bp, Artificial Sequence
  dgRNA
  Lrig2
atgctcgcctcctag

SEQ ID NO: 8597 - DNA, 15 bp, Artificial Sequence
  dgRNA
  Lrig2
tgctcgcctcctagg

SEQ ID NO: 8598 - DNA, 15 bp, Artificial Sequence
  dgRNA
  Tnfrsf8
tcattcaaaacgcag

SEQ ID NO: 8599 - DNA, 15 bp, Artificial Sequence
  dgRNA
  Tnfrsf8
tgcgtgcgtgcgctg

SEQ ID NO: 8600 - DNA, 15 bp, Artificial Sequence
  dgRNA
  Tnfrsf8
agtcatctctgcacg

SEQ ID NO: 8601 - DNA, 15 bp, Artificial Sequence
  dgRNA
  Tnfrsf8
catctctgcacgtgg

SEQ ID NO: 8602 - DNA, 15 bp, Artificial Sequence
  dgRNA
  Prickle2
agagcctttgtctag

SEQ ID NO: 8603 - DNA, 15 bp, Artificial Sequence
  dgRNA
  Prickle2
gggaaaccacttagc

SEQ ID NO: 8604 - DNA, 15 bp, Artificial Sequence
  dgRNA
  Prickle2
ggctctacaaaggcg

SEQ ID NO: 8605 - DNA, 15 bp, Artificial Sequence
  dgRNA
  Prickle2
ccaaccactagacaa

SEQ ID NO: 8606 - DNA, 15 bp, Artificial Sequence
  dgRNA
  Gp1bb
ggaagagccacggtc

SEQ ID NO: 8607 - DNA, 15 bp, Artificial Sequence
  dgRNA
  Gp1bb
agagccacggtcagg

SEQ ID NO: 8608 - DNA, 15 bp, Artificial Sequence
  dgRNA
  Gp1bb
gaggtgttctagttt

SEQ ID NO: 8609 - DNA, 15 bp, Artificial Sequence
  dgRNA
  Gp1bb
caataggcaaagtct

SEQ ID NO: 8610 - DNA, 15 bp, Artificial Sequence
  dgRNA
  Anapc15
gccgctggagattca

SEQ ID NO: 8611 - DNA, 15 bp, Artificial Sequence
  dgRNA
  Anapc15
gctggagattcaagg

SEQ ID NO: 8612 - DNA, 15 bp, Artificial Sequence
  dgRNA
  Anapc15
gctgacaggtaggcg

SEQ ID NO: 8613 - DNA, 15 bp, Artificial Sequence
  dgRNA
  Anapc15
taggcggggcaagcg

SEQ ID NO: 8614 - DNA, 15 bp, Artificial Sequence
  dgRNA
  Plcd3
tggccaatggtagaa

SEQ ID NO: 8615 - DNA, 15 bp, Artificial Sequence
  dgRNA
  Plcd3
tagaaaggagatccg

SEQ ID NO: 8616 - DNA, 15 bp, Artificial Sequence
  dgRNA
  Plcd3
atccggggacctcta

SEQ ID NO: 8617 - DNA, 15 bp, Artificial Sequence
  dgRNA
  Plcd3
gaccgactcactagt

SEQ ID NO: 8618 - DNA, 15 bp, Artificial Sequence
  dgRNA
  Saxo2
tcaccgtctggtcgc

SEQ ID NO: 8619 - DNA, 15 bp, Artificial Sequence
  dgRNA
  Saxo2
cgcacctaagactcc

SEQ ID NO: 8620 - DNA, 15 bp, Artificial Sequence
  dgRNA
  Saxo2
gcacctaagactcca

SEQ ID NO: 8621 - DNA, 15 bp, Artificial Sequence
  dgRNA
  Saxo2
aggggtagctcagac

SEQ ID NO: 8622 - DNA, 15 bp, Artificial Sequence
  dgRNA
  Klk11
gaactgagcttccct

SEQ ID NO: 8623 - DNA, 15 bp, Artificial Sequence
  dgRNA
  Klk11
ctgtcccacgtcacc

SEQ ID NO: 8624 - DNA, 15 bp, Artificial Sequence
  dgRNA
  Klk11
tgtcccacgtcacct

SEQ ID NO: 8625 - DNA, 15 bp, Artificial Sequence
  dgRNA
  Klk11
ccacgtcacctgggt

SEQ ID NO: 8626 - DNA, 15 bp, Artificial Sequence
  dgRNA
  Mtfr2
cacaattccgaatgc

SEQ ID NO: 8627 - DNA, 15 bp, Artificial Sequence
  dgRNA
  Mtfr2
acaattccgaatgct

SEQ ID NO: 8628 - DNA, 15 bp, Artificial Sequence
  dgRNA
  Mtfr2
caattccgaatgctg

SEQ ID NO: 8629 - DNA, 15 bp, Artificial Sequence
  dgRNA
  Mtfr2
aattccgaatgctgg

SEQ ID NO: 8630 - DNA, 15 bp, Artificial Sequence
  dgRNA
  Cul2
tgacctcctcgcgcc

SEQ ID NO: 8631 - DNA, 15 bp, Artificial Sequence
  dgRNA
  Cul2
cggcattgttttact

SEQ ID NO: 8632 - DNA, 15 bp, Artificial Sequence
  dgRNA
  Cul2
tttactaggctccct

SEQ ID NO: 8633 - DNA, 15 bp, Artificial Sequence
  dgRNA
  Cul2
ttactaggctccctc

SEQ ID NO: 8634 - DNA, 15 bp, Artificial Sequence
  dgRNA
  Maoa
tccactgtatgatca

SEQ ID NO: 8635 - DNA, 15 bp, Artificial Sequence
  dgRNA
  Maoa
ccactgtatgatcaa

SEQ ID NO: 8636 - DNA, 15 bp, Artificial Sequence
  dgRNA
  Maoa
tcaagtgcctatgct

SEQ ID NO: 8637 - DNA, 15 bp, Artificial Sequence
  dgRNA
  Maoa
cctgccctgcgtatg

SEQ ID NO: 8638 - DNA, 15 bp, Artificial Sequence
  dgRNA
  Brsk1
tgcggcccaccgact

SEQ ID NO: 8639 - DNA, 15 bp, Artificial Sequence
  dgRNA
  Brsk1
gcggcccaccgactg

SEQ ID NO: 8640 - DNA, 15 bp, Artificial Sequence
  dgRNA
  Brsk1
cggcccaccgactgg

SEQ ID NO: 8641 - DNA, 15 bp, Artificial Sequence
  dgRNA
  Brsk1
ggcccaccgactggg

SEQ ID NO: 8642 - DNA, 15 bp, Artificial Sequence
  dgRNA
  Zswim1
agacttggtcctact

SEQ ID NO: 8643 - DNA, 15 bp, Artificial Sequence
  dgRNA
  Zswim1
cagaccctgaataac

SEQ ID NO: 8644 - DNA, 15 bp, Artificial Sequence
  dgRNA
  Zswim1
accattctgtatcta

SEQ ID NO: 8645 - DNA, 15 bp, Artificial Sequence
  dgRNA
  Zswim1
aagtcttaaacagct

SEQ ID NO: 8646 - DNA, 15 bp, Artificial Sequence
  dgRNA
  Mcph1
tccaaaccagttggg

SEQ ID NO: 8647 - DNA, 15 bp, Artificial Sequence
  dgRNA
  Mcph1
aacgcccggcgctta

SEQ ID NO: 8648 - DNA, 15 bp, Artificial Sequence
  dgRNA
  Mcph1
gcttaaggcgacgaa

SEQ ID NO: 8649 - DNA, 15 bp, Artificial Sequence
  dgRNA
  Mcph1
tccgtcctccctagg

SEQ ID NO: 8650 - DNA, 15 bp, Artificial Sequence
  dgRNA
  4930505A04Rik
gtcgcctagcaacgc

SEQ ID NO: 8651 - DNA, 15 bp, Artificial Sequence
  dgRNA
  4930505A04Rik
tgcttcaatccggga

SEQ ID NO: 8652 - DNA, 15 bp, Artificial Sequence
  dgRNA
  4930505A04Rik
ttgcttcaatccggg

SEQ ID NO: 8653 - DNA, 15 bp, Artificial Sequence
  dgRNA
  4930505A04Rik
ggcttgcttcaatcc

SEQ ID NO: 8654 - DNA, 15 bp, Artificial Sequence
  dgRNA
  Ifna16
tcctgtgtcttaaat

SEQ ID NO: 8655 - DNA, 15 bp, Artificial Sequence
  dgRNA
  Slc25a53
atgctaaactgttgc

SEQ ID NO: 8656 - DNA, 15 bp, Artificial Sequence
  dgRNA
  Slc25a53
ctggttgtatggagt

SEQ ID NO: 8657 - DNA, 15 bp, Artificial Sequence
  dgRNA
  Slc25a53
tggcccgccaaagcc

SEQ ID NO: 8658 - DNA, 15 bp, Artificial Sequence
  dgRNA
  Slc25a53
aaagcccggcaactc

SEQ ID NO: 8659 - DNA, 15 bp, Artificial Sequence
  dgRNA
  Pde1c
caacggtcagtctgc

SEQ ID NO: 8660 - DNA, 15 bp, Artificial Sequence
  dgRNA
  Slc35e2
gcatctcacagccgg

SEQ ID NO: 8661 - DNA, 15 bp, Artificial Sequence
  dgRNA
  Slc35e2
cagccggcggctact

SEQ ID NO: 8662 - DNA, 15 bp, Artificial Sequence
  dgRNA
  Slc35e2
agccggcggctactt

SEQ ID NO: 8663 - DNA, 15 bp, Artificial Sequence
  dgRNA
  Slc35e2
gccggcggctacttg

SEQ ID NO: 8664 - DNA, 15 bp, Artificial Sequence
  dgRNA
  Rad9a
cgcagtcacgtgacc

SEQ ID NO: 8665 - DNA, 15 bp, Artificial Sequence
  dgRNA
  Rad9a
cgtgacaccgagctt

SEQ ID NO: 8666 - DNA, 15 bp, Artificial Sequence
  dgRNA
  Rad9a
gtttttctcacgtga

SEQ ID NO: 8667 - DNA, 15 bp, Artificial Sequence
  dgRNA
  Rad9a
gtgacggagaaaccc

SEQ ID NO: 8668 - DNA, 15 bp, Artificial Sequence
  dgRNA
  Tmem150a
ccgggtcatagcctc

SEQ ID NO: 8669 - DNA, 15 bp, Artificial Sequence
  dgRNA
  Tmem150a
tagcctcgggcgccc

SEQ ID NO: 8670 - DNA, 15 bp, Artificial Sequence
  dgRNA
  Tmem150a
aggtcccttagactt

SEQ ID NO: 8671 - DNA, 15 bp, Artificial Sequence
  dgRNA
  Tmem150a
ggtcccttagacttg

SEQ ID NO: 8672 - DNA, 15 bp, Artificial Sequence
  dgRNA
  Arhgap33
taagcagccgccttg

SEQ ID NO: 8673 - DNA, 15 bp, Artificial Sequence
  dgRNA
  Arhgap33
aagcagccgccttgt

SEQ ID NO: 8674 - DNA, 15 bp, Artificial Sequence
  dgRNA
  Arhgap33
cagccgccttgtggg

SEQ ID NO: 8675 - DNA, 15 bp, Artificial Sequence
  dgRNA
  Arhgap33
gccgccttgtgggcg

SEQ ID NO: 8676 - DNA, 15 bp, Artificial Sequence
  dgRNA
  Helb
cgtctccttctccgc

SEQ ID NO: 8677 - DNA, 15 bp, Artificial Sequence
  dgRNA
  Helb
gaaccccgggaaagc

SEQ ID NO: 8678 - DNA, 15 bp, Artificial Sequence
  dgRNA
  Helb
aaggtcacgactctt

SEQ ID NO: 8679 - DNA, 15 bp, Artificial Sequence
  dgRNA
  Helb
aaaggtcacgactct

SEQ ID NO: 8680 - DNA, 15 bp, Artificial Sequence
  dgRNA
  Magea10
cgcaagtcagcactg

SEQ ID NO: 8681 - DNA, 15 bp, Artificial Sequence
  dgRNA
  Magea10
aatcctcaatgtccc

SEQ ID NO: 8682 - DNA, 15 bp, Artificial Sequence
  dgRNA
  Ung
acagccgcgcgctgt

SEQ ID NO: 8683 - DNA, 15 bp, Artificial Sequence
  dgRNA
  Ung
aggcactagccaata

SEQ ID NO: 8684 - DNA, 15 bp, Artificial Sequence
  dgRNA
  Ung
ctagccaatagggat

SEQ ID NO: 8685 - DNA, 15 bp, Artificial Sequence
  dgRNA
  Ung
gccctgctcctcgcg

SEQ ID NO: 8686 - DNA, 15 bp, Artificial Sequence
  dgRNA
  Pdpk1
cccgtcacttctgat

SEQ ID NO: 8687 - DNA, 15 bp, Artificial Sequence
  dgRNA
  Pdpk1
cctcgacaagcgcgc

SEQ ID NO: 8688 - DNA, 15 bp, Artificial Sequence
  dgRNA
  Pdpk1
ctcgacaagcgcgcc

SEQ ID NO: 8689 - DNA, 15 bp, Artificial Sequence
  dgRNA
  Pdpk1
cgccgggccccaacc

SEQ ID NO: 8690 - DNA, 15 bp, Artificial Sequence
  dgRNA
  Ptpn14
ccccggacgcattcc

SEQ ID NO: 8691 - DNA, 15 bp, Artificial Sequence
  dgRNA
  Ptpn14
gcgctccccgcctcc

SEQ ID NO: 8692 - DNA, 15 bp, Artificial Sequence
  dgRNA
  Ptpn14
ggggagcgcggccag

SEQ ID NO: 8693 - DNA, 15 bp, Artificial Sequence
  dgRNA
  Ptpn14
ccctgcgctgaaaag

SEQ ID NO: 8694 - DNA, 15 bp, Artificial Sequence
  dgRNA
  Cep63
ccccgcccttcttct

SEQ ID NO: 8695 - DNA, 15 bp, Artificial Sequence
  dgRNA
  Cep63
gggtcacgtgactcg

SEQ ID NO: 8696 - DNA, 15 bp, Artificial Sequence
  dgRNA
  Cep63
ggcgctctcaagccc

SEQ ID NO: 8697 - DNA, 15 bp, Artificial Sequence
  dgRNA
  Cep63
ctcaagccccggatg

SEQ ID NO: 8698 - DNA, 15 bp, Artificial Sequence
  dgRNA
  Agtpbp1
gcgtgccgcccccgc

SEQ ID NO: 8699 - DNA, 15 bp, Artificial Sequence
  dgRNA
  Agtpbp1
tgccgcccccgccgg

SEQ ID NO: 8700 - DNA, 15 bp, Artificial Sequence
  dgRNA
  Agtpbp1
cgggcacgcgccccg

SEQ ID NO: 8701 - DNA, 15 bp, Artificial Sequence
  dgRNA
  Agtpbp1
gggcacgcgccccgc

SEQ ID NO: 8702 - DNA, 15 bp, Artificial Sequence
  dgRNA
  Tlk2
gtgtcagttaactct

SEQ ID NO: 8703 - DNA, 15 bp, Artificial Sequence
  dgRNA
  Tlk2
aatcgtactacatat

SEQ ID NO: 8704 - DNA, 15 bp, Artificial Sequence
  dgRNA
  Eml4
tggcgaaaccgggcc

SEQ ID NO: 8705 - DNA, 15 bp, Artificial Sequence
  dgRNA
  Eml4
agttctctgcggctg

SEQ ID NO: 8706 - DNA, 15 bp, Artificial Sequence
  dgRNA
  Eml4
tctctgcggctgcgg

SEQ ID NO: 8707 - DNA, 15 bp, Artificial Sequence
  dgRNA
  Eml4
gcggctgcggaggca

SEQ ID NO: 8708 - DNA, 15 bp, Artificial Sequence
  dgRNA
  Zfp106
tgcaaaagacctatc

SEQ ID NO: 8709 - DNA, 15 bp, Artificial Sequence
  dgRNA
  Zfp106
gcaaaagacctatct

SEQ ID NO: 8710 - DNA, 15 bp, Artificial Sequence
  dgRNA
  Zfp106
gtaaggccacttgtc

SEQ ID NO: 8711 - DNA, 15 bp, Artificial Sequence
  dgRNA
  Zfp106
gctagatggttgaaa

SEQ ID NO: 8712 - DNA, 15 bp, Artificial Sequence
  dgRNA
  Use1
cgtcccaagcgtagc

SEQ ID NO: 8713 - DNA, 15 bp, Artificial Sequence
  dgRNA
  Use1
gtcccaagcgtagca

SEQ ID NO: 8714 - DNA, 15 bp, Artificial Sequence
  dgRNA
  Use1
ccaagcgtagcaggg

SEQ ID NO: 8715 - DNA, 15 bp, Artificial Sequence
  dgRNA
  Use1
cagggcggacctcgg

SEQ ID NO: 8716 - DNA, 15 bp, Artificial Sequence
  dgRNA
  Oit1
gtaaggtgtttaacg

SEQ ID NO: 8717 - DNA, 15 bp, Artificial Sequence
  dgRNA
  Oit1
ggtgtttaacgaggc

SEQ ID NO: 8718 - DNA, 15 bp, Artificial Sequence
  dgRNA
  Oit1
gtgtttaacgaggca

SEQ ID NO: 8719 - DNA, 15 bp, Artificial Sequence
  dgRNA
  Oit1
tttaacgaggcaggg

SEQ ID NO: 8720 - DNA, 15 bp, Artificial Sequence
  dgRNA
  Fam118a
agacaaaacagcgct

SEQ ID NO: 8721 - DNA, 15 bp, Artificial Sequence
  dgRNA
  Fam118a
cagtctcttaagacc

SEQ ID NO: 8722 - DNA, 15 bp, Artificial Sequence
  dgRNA
  Fam118a
agaccaggctcatcg

SEQ ID NO: 8723 - DNA, 15 bp, Artificial Sequence
  dgRNA
  Fam118a
gacagcacagtccgt

SEQ ID NO: 8724 - DNA, 15 bp, Artificial Sequence
  dgRNA
  Lsm14b
ccggctgggaagacc

SEQ ID NO: 8725 - DNA, 15 bp, Artificial Sequence
  dgRNA
  Lsm14b
tgggaagacccggag

SEQ ID NO: 8726 - DNA, 15 bp, Artificial Sequence
  dgRNA
  Lsm14b
aggcaggtccccggc

SEQ ID NO: 8727 - DNA, 15 bp, Artificial Sequence
  dgRNA
  Lsm14b
agcttccaaatgcgc

SEQ ID NO: 8728 - DNA, 15 bp, Artificial Sequence
  dgRNA
  Scn1a
ctctatgttgagctt

SEQ ID NO: 8729 - DNA, 15 bp, Artificial Sequence
  dgRNA
  Scn1a
gtgagattcctaagg

SEQ ID NO: 8730 - DNA, 15 bp, Artificial Sequence
  dgRNA
  Havcr1
cgtgatctccagacc

SEQ ID NO: 8731 - DNA, 15 bp, Artificial Sequence
  dgRNA
  Havcr1
cagaaagttagcgtt

SEQ ID NO: 8732 - DNA, 15 bp, Artificial Sequence
  dgRNA
  Havcr1
gttgtttgtcggttg

SEQ ID NO: 8733 - DNA, 15 bp, Artificial Sequence
  dgRNA
  Havcr1
tgtttgtcggttgtg

SEQ ID NO: 8734 - DNA, 15 bp, Artificial Sequence
  dgRNA
  Vmn1r222
agtgagtttggtaac

SEQ ID NO: 8735 - DNA, 15 bp, Artificial Sequence
  dgRNA
  Cdv3
aaatgcccgccctca

SEQ ID NO: 8736 - DNA, 15 bp, Artificial Sequence
  dgRNA
  Cdv3
aattccctggccaat

SEQ ID NO: 8737 - DNA, 15 bp, Artificial Sequence
  dgRNA
  Cdv3
gcaccgccccgtaga

SEQ ID NO: 8738 - DNA, 15 bp, Artificial Sequence
  dgRNA
  Cdv3
gccccgtagaaggaa

SEQ ID NO: 8739 - DNA, 15 bp, Artificial Sequence
  dgRNA
  Slc8b1
cggggcgagccttaa

SEQ ID NO: 8740 - DNA, 15 bp, Artificial Sequence
  dgRNA
  Slc8b1
ggggcgagccttaaa

SEQ ID NO: 8741 - DNA, 15 bp, Artificial Sequence
  dgRNA
  Slc8b1
ttaaagggcgtgtct

SEQ ID NO: 8742 - DNA, 15 bp, Artificial Sequence
  dgRNA
  Slc8b1
taaagggcgtgtctt

SEQ ID NO: 8743 - DNA, 15 bp, Artificial Sequence
  dgRNA
  Cd200r3
tagtcagccaactga

SEQ ID NO: 8744 - DNA, 15 bp, Artificial Sequence
  dgRNA
  Cd200r3
tgactaagcctgcac

SEQ ID NO: 8745 - DNA, 15 bp, Artificial Sequence
  dgRNA
  Cttnbp2nl
aaagttgcagaaccc

SEQ ID NO: 8746 - DNA, 15 bp, Artificial Sequence
  dgRNA
  Cttnbp2nl
gttgcagaacccggg

SEQ ID NO: 8747 - DNA, 15 bp, Artificial Sequence
  dgRNA
  Cttnbp2nl
actccagcggaccag

SEQ ID NO: 8748 - DNA, 15 bp, Artificial Sequence
  dgRNA
  Cttnbp2nl
ccagcggaccagagg

SEQ ID NO: 8749 - DNA, 15 bp, Artificial Sequence
  dgRNA
  Pias2
cccgctctgccggtg

SEQ ID NO: 8750 - DNA, 15 bp, Artificial Sequence
  dgRNA
  Pias2
ccgctctgccggtgc

SEQ ID NO: 8751 - DNA, 15 bp, Artificial Sequence
  dgRNA
  Pias2
cgctctgccggtgcg

SEQ ID NO: 8752 - DNA, 15 bp, Artificial Sequence
  dgRNA
  Pias2
gccggtgcggggaac

SEQ ID NO: 8753 - DNA, 15 bp, Artificial Sequence
  dgRNA
  Pabpc1l
tgaggactcccaggt

SEQ ID NO: 8754 - DNA, 15 bp, Artificial Sequence
  dgRNA
  Pabpc1l
attggcttgcaagcg

SEQ ID NO: 8755 - DNA, 15 bp, Artificial Sequence
  dgRNA
  Pabpc1l
ttgcaagcgtggtaa

SEQ ID NO: 8756 - DNA, 15 bp, Artificial Sequence
  dgRNA
  Pabpc1l
agcgtggtaaaggca

SEQ ID NO: 8757 - DNA, 15 bp, Artificial Sequence
  dgRNA
  Nup188
tccgctgtcaaccta

SEQ ID NO: 8758 - DNA, 15 bp, Artificial Sequence
  dgRNA
  Nup188
gactcccctcgcacc

SEQ ID NO: 8759 - DNA, 15 bp, Artificial Sequence
  dgRNA
  Nup188
actcccctcgcacca

SEQ ID NO: 8760 - DNA, 15 bp, Artificial Sequence
  dgRNA
  Nup188
acgcccaccatcacg

SEQ ID NO: 8761 - DNA, 15 bp, Artificial Sequence
  dgRNA
  Dppa2
cacgtcaaagagaag

SEQ ID NO: 8762 - DNA, 15 bp, Artificial Sequence
  dgRNA
  Dppa2
gggaagagcttaatt

SEQ ID NO: 8763 - DNA, 15 bp, Artificial Sequence
  dgRNA
  Dppa2
gcttaattgggccac

SEQ ID NO: 8764 - DNA, 15 bp, Artificial Sequence
  dgRNA
  Dppa2
tcggcattcattcag

SEQ ID NO: 8765 - DNA, 15 bp, Artificial Sequence
  dgRNA
  Sumo3
tgagtcgcgcgtccc

SEQ ID NO: 8766 - DNA, 15 bp, Artificial Sequence
  dgRNA
  Sumo3
gagtcgcgcgtcccc

SEQ ID NO: 8767 - DNA, 15 bp, Artificial Sequence
  dgRNA
  Sumo3
agtcgcgcgtccccg

SEQ ID NO: 8768 - DNA, 15 bp, Artificial Sequence
  dgRNA
  Sumo3
ggctctgcgcgcacc

SEQ ID NO: 8769 - DNA, 15 bp, Artificial Sequence
  dgRNA
  Armt1
gcacgctcccgccgc

SEQ ID NO: 8770 - DNA, 15 bp, Artificial Sequence
  dgRNA
  Armt1
ccgcaggaacctctg

SEQ ID NO: 8771 - DNA, 15 bp, Artificial Sequence
  dgRNA
  Armt1
gccccgctgcggcgc

SEQ ID NO: 8772 - DNA, 15 bp, Artificial Sequence
  dgRNA
  Armt1
cgcactgcaagcccc

SEQ ID NO: 8773 - DNA, 15 bp, Artificial Sequence
  dgRNA
  Pecam1
agcgcaagaactttg

SEQ ID NO: 8774 - DNA, 15 bp, Artificial Sequence
  dgRNA
  Pecam1
ggcaaatgctacttg

SEQ ID NO: 8775 - DNA, 15 bp, Artificial Sequence
  dgRNA
  Pecam1
ctagacaaagccatt

SEQ ID NO: 8776 - DNA, 15 bp, Artificial Sequence
  dgRNA
  Pecam1
gttcagtggtccctc

SEQ ID NO: 8777 - DNA, 15 bp, Artificial Sequence
  dgRNA
  Tcap
ggagcaaccagaatc

SEQ ID NO: 8778 - DNA, 15 bp, Artificial Sequence
  dgRNA
  Tcap
accaccagtgagtct

SEQ ID NO: 8779 - DNA, 15 bp, Artificial Sequence
  dgRNA
  Tcap
agcatctgacgccag

SEQ ID NO: 8780 - DNA, 15 bp, Artificial Sequence
  dgRNA
  Tcap
gcatctgacgccaga

SEQ ID NO: 8781 - DNA, 15 bp, Artificial Sequence
  dgRNA
  Plekhd1
gaactgggggagcgt

SEQ ID NO: 8782 - DNA, 15 bp, Artificial Sequence
  dgRNA
  Plekhd1
aactgggggagcgtt

SEQ ID NO: 8783 - DNA, 15 bp, Artificial Sequence
  dgRNA
  Plekhd1
cgttgggcgcctgag

SEQ ID NO: 8784 - DNA, 15 bp, Artificial Sequence
  dgRNA
  Plekhd1
gttgggcgcctgagt

SEQ ID NO: 8785 - DNA, 15 bp, Artificial Sequence
  dgRNA
  Atp1a3
aaggttggagcggtg

SEQ ID NO: 8786 - DNA, 15 bp, Artificial Sequence
  dgRNA
  Atp1a3
aggttggagcggtga

SEQ ID NO: 8787 - DNA, 15 bp, Artificial Sequence
  dgRNA
  Atp1a3
ggttggagcggtgag

SEQ ID NO: 8788 - DNA, 15 bp, Artificial Sequence
  dgRNA
  Atp1a3
agtactgctcctgat

SEQ ID NO: 8789 - DNA, 15 bp, Artificial Sequence
  dgRNA
  Slc22a6
catctgttgcccaaa

SEQ ID NO: 8790 - DNA, 15 bp, Artificial Sequence
  dgRNA
  Slc22a6
cccttcattcccaat

SEQ ID NO: 8791 - DNA, 15 bp, Artificial Sequence
  dgRNA
  Slc22a6
caaggaatactcaca

SEQ ID NO: 8792 - DNA, 15 bp, Artificial Sequence
  dgRNA
  Slc22a6
tggactcaccaaggg

SEQ ID NO: 8793 - DNA, 15 bp, Artificial Sequence
  dgRNA
  Olfr697
ttgatattactgatt

SEQ ID NO: 8794 - DNA, 15 bp, Artificial Sequence
  dgRNA
  Cyp4a10
cttgactcgcacgag

SEQ ID NO: 8795 - DNA, 15 bp, Artificial Sequence
  dgRNA
  Cyp4a10
agttggttaaataac

SEQ ID NO: 8796 - DNA, 15 bp, Artificial Sequence
  dgRNA
  Cd4
cacgttgacctaacc

SEQ ID NO: 8797 - DNA, 15 bp, Artificial Sequence
  dgRNA
  Cd4
acgtccgccgtgcag

SEQ ID NO: 8798 - DNA, 15 bp, Artificial Sequence
  dgRNA
  Cd4
ggttaggtcaacgtg

SEQ ID NO: 8799 - DNA, 15 bp, Artificial Sequence
  dgRNA
  Cd4
aatgtcactattgtt

SEQ ID NO: 8800 - DNA, 15 bp, Artificial Sequence
  dgRNA
  Dok4
ggctagactgccagg

SEQ ID NO: 8801 - DNA, 15 bp, Artificial Sequence
  dgRNA
  Dok4
ctagtaataagactt

SEQ ID NO: 8802 - DNA, 15 bp, Artificial Sequence
  dgRNA
  Dok4
taataagactttggc

SEQ ID NO: 8803 - DNA, 15 bp, Artificial Sequence
  dgRNA
  Dok4
caggactccgggacg

SEQ ID NO: 8804 - DNA, 15 bp, Artificial Sequence
  dgRNA
  4933409G03Rik
gaacattcgtagcca

SEQ ID NO: 8805 - DNA, 15 bp, Artificial Sequence
  dgRNA
  4933409G03Rik
atcttggaacaacct

SEQ ID NO: 8806 - DNA, 15 bp, Artificial Sequence
  dgRNA
  4933409G03Rik
gaagctcatacatct

SEQ ID NO: 8807 - DNA, 15 bp, Artificial Sequence
  dgRNA
  4933409G03Rik
taaagctgcttgatg

SEQ ID NO: 8808 - DNA, 15 bp, Artificial Sequence
  dgRNA
  Sec61g
gtcattttccgggaa

SEQ ID NO: 8809 - DNA, 15 bp, Artificial Sequence
  dgRNA
  Sec61g
aattagatgtactgc

SEQ ID NO: 8810 - DNA, 15 bp, Artificial Sequence
  dgRNA
  Sec61g
actattctccattcc

SEQ ID NO: 8811 - DNA, 15 bp, Artificial Sequence
  dgRNA
  Mtch1
gttactcaactattg

SEQ ID NO: 8812 - DNA, 15 bp, Artificial Sequence
  dgRNA
  Mtch1
ttactcaactattga

SEQ ID NO: 8813 - DNA, 15 bp, Artificial Sequence
  dgRNA
  Mtch1
tactcaactattgag

SEQ ID NO: 8814 - DNA, 15 bp, Artificial Sequence
  dgRNA
  Mtch1
gaggggtttctacac

SEQ ID NO: 8815 - DNA, 15 bp, Artificial Sequence
  dgRNA
  Plekhh1
gtgggactttcctac

SEQ ID NO: 8816 - DNA, 15 bp, Artificial Sequence
  dgRNA
  Plekhh1
ggactttcctacagg

SEQ ID NO: 8817 - DNA, 15 bp, Artificial Sequence
  dgRNA
  Plekhh1
tggctagacactcgc

SEQ ID NO: 8818 - DNA, 15 bp, Artificial Sequence
  dgRNA
  Plekhh1
ggctagacactcgct

SEQ ID NO: 8819 - DNA, 15 bp, Artificial Sequence
  dgRNA
  Nkx6-2
gcaaatttacagtcc

SEQ ID NO: 8820 - DNA, 15 bp, Artificial Sequence
  dgRNA
  Nkx6-2
aatttacagtcccgg

SEQ ID NO: 8821 - DNA, 15 bp, Artificial Sequence
  dgRNA
  Nkx6-2
cacctgcctcgctaa

SEQ ID NO: 8822 - DNA, 15 bp, Artificial Sequence
  dgRNA
  Nkx6-2
acctgcctcgctaat

SEQ ID NO: 8823 - DNA, 15 bp, Artificial Sequence
  dgRNA
  Pibf1
aacggtacctcagcc

SEQ ID NO: 8824 - DNA, 15 bp, Artificial Sequence
  dgRNA
  Pibf1
ggcaggatgcgagcg

SEQ ID NO: 8825 - DNA, 15 bp, Artificial Sequence
  dgRNA
  Pibf1
caagacccgcctccc

SEQ ID NO: 8826 - DNA, 15 bp, Artificial Sequence
  dgRNA
  Pibf1
cccctcgtcaccacg

SEQ ID NO: 8827 - DNA, 15 bp, Artificial Sequence
  dgRNA
  Tnfrsf14
gctagtgtccctgta

SEQ ID NO: 8828 - DNA, 15 bp, Artificial Sequence
  dgRNA
  Tnfrsf14
cttcagactccatac

SEQ ID NO: 8829 - DNA, 15 bp, Artificial Sequence
  dgRNA
  Tnfrsf14
acggggcgtggtgct

SEQ ID NO: 8830 - DNA, 15 bp, Artificial Sequence
  dgRNA
  Tnfrsf14
cacggggcgtggtgc

SEQ ID NO: 8831 - DNA, 15 bp, Artificial Sequence
  dgRNA
  Xpnpep2
ctgatgtgagctaat

SEQ ID NO: 8832 - DNA, 15 bp, Artificial Sequence
  dgRNA
  Xpnpep2
ctattagctcacatc

SEQ ID NO: 8833 - DNA, 15 bp, Artificial Sequence
  dgRNA
  Xpnpep2
tggacgagcaacagc

SEQ ID NO: 8834 - DNA, 15 bp, Artificial Sequence
  dgRNA
  Hmgcl
agtgggcatgattgg

SEQ ID NO: 8835 - DNA, 15 bp, Artificial Sequence
  dgRNA
  Hmgcl
ggtagagctacttag

SEQ ID NO: 8836 - DNA, 15 bp, Artificial Sequence
  dgRNA
  Hmgcl
tagagctacttagag

SEQ ID NO: 8837 - DNA, 15 bp, Artificial Sequence
  dgRNA
  Hmgcl
tacttagaggggagt

SEQ ID NO: 8838 - DNA, 15 bp, Artificial Sequence
  dgRNA
  Fcgr3
cccaagggtacaaga

SEQ ID NO: 8839 - DNA, 15 bp, Artificial Sequence
  dgRNA
  Fcgr3
ggtgctgcgtgtaga

SEQ ID NO: 8840 - DNA, 15 bp, Artificial Sequence
  dgRNA
  Fcgr3
gtgctgcgtgtagaa

SEQ ID NO: 8841 - DNA, 15 bp, Artificial Sequence
  dgRNA
  Fcgr3
ccttcttgtaccctt

SEQ ID NO: 8842 - DNA, 15 bp, Artificial Sequence
  dgRNA
  Rnf167
aaattcccgcccctc

SEQ ID NO: 8843 - DNA, 15 bp, Artificial Sequence
  dgRNA
  Rnf167
ccgcccctccggaat

SEQ ID NO: 8844 - DNA, 15 bp, Artificial Sequence
  dgRNA
  Rnf167
ccggaattggaatcg

SEQ ID NO: 8845 - DNA, 15 bp, Artificial Sequence
  dgRNA
  Rnf167
cggaattggaatcgc

SEQ ID NO: 8846 - DNA, 15 bp, Artificial Sequence
  dgRNA
  Nkx2-3
actgggtggacgcag

SEQ ID NO: 8847 - DNA, 15 bp, Artificial Sequence
  dgRNA
  Nkx2-3
ctgggtggacgcaga

SEQ ID NO: 8848 - DNA, 15 bp, Artificial Sequence
  dgRNA
  Nkx2-3
tggacgcagagggcg

SEQ ID NO: 8849 - DNA, 15 bp, Artificial Sequence
  dgRNA
  Nkx2-3
cccttgacgtgacgc

SEQ ID NO: 8850 - DNA, 15 bp, Artificial Sequence
  dgRNA
  Wdtc1
ggctcccccgctagc

SEQ ID NO: 8851 - DNA, 15 bp, Artificial Sequence
  dgRNA
  Wdtc1
ccgctagcaggttag

SEQ ID NO: 8852 - DNA, 15 bp, Artificial Sequence
  dgRNA
  Wdtc1
cgctagcaggttagt

SEQ ID NO: 8853 - DNA, 15 bp, Artificial Sequence
  dgRNA
  Wdtc1
gttagtgggcgccac

SEQ ID NO: 8854 - DNA, 15 bp, Artificial Sequence
  dgRNA
  Tmem255b
cactggctcggtggg

SEQ ID NO: 8855 - DNA, 15 bp, Artificial Sequence
  dgRNA
  Dcx
aaaccttctgcctag

SEQ ID NO: 8856 - DNA, 15 bp, Artificial Sequence
  dgRNA
  Dcx
cgcacaggaaattgc

SEQ ID NO: 8857 - DNA, 15 bp, Artificial Sequence
  dgRNA
  Chml
caacctagatctata

SEQ ID NO: 8858 - DNA, 15 bp, Artificial Sequence
  dgRNA
  Chml
atagatctaggttga

SEQ ID NO: 8859 - DNA, 15 bp, Artificial Sequence
  dgRNA
  Chml
tatagatctaggttg

SEQ ID NO: 8860 - DNA, 15 bp, Artificial Sequence
  dgRNA
  Chml
acaccgtatagatct

SEQ ID NO: 8861 - DNA, 15 bp, Artificial Sequence
  dgRNA
  Gbp7
catccgccgcccatc

SEQ ID NO: 8862 - DNA, 15 bp, Artificial Sequence
  dgRNA
  Gbp7
cgccgcccatctggc

SEQ ID NO: 8863 - DNA, 15 bp, Artificial Sequence
  dgRNA
  Gbp7
gccgcccatctggca

SEQ ID NO: 8864 - DNA, 15 bp, Artificial Sequence
  dgRNA
  Gbp7
agtgcaggcaatatc

SEQ ID NO: 8865 - DNA, 15 bp, Artificial Sequence
  dgRNA
  Gfi1
acaccactattccag

SEQ ID NO: 8866 - DNA, 15 bp, Artificial Sequence
  dgRNA
  Gfi1
caccactattccagt

SEQ ID NO: 8867 - DNA, 15 bp, Artificial Sequence
  dgRNA
  Gfi1
agtgggcgtttctcc

SEQ ID NO: 8868 - DNA, 15 bp, Artificial Sequence
  dgRNA
  Gfi1
gtgggcgtttctcct

SEQ ID NO: 8869 - DNA, 15 bp, Artificial Sequence
  dgRNA
  Lcn5
ggaggcagtccccta

SEQ ID NO: 8870 - DNA, 15 bp, Artificial Sequence
  dgRNA
  Lcn5
gtcccactatctagc

SEQ ID NO: 8871 - DNA, 15 bp, Artificial Sequence
  dgRNA
  Lcn5
ccactatctagcagg

SEQ ID NO: 8872 - DNA, 15 bp, Artificial Sequence
  dgRNA
  Lcn5
cactatctagcaggt

SEQ ID NO: 8873 - DNA, 15 bp, Artificial Sequence
  dgRNA
  Pde4c
ttttggtcacacact

SEQ ID NO: 8874 - DNA, 15 bp, Artificial Sequence
  dgRNA
  Pde4c
aatcaaggcacccca

SEQ ID NO: 8875 - DNA, 15 bp, Artificial Sequence
  dgRNA
  Pde4c
ttggggtaccaatca

SEQ ID NO: 8876 - DNA, 15 bp, Artificial Sequence
  dgRNA
  Pde4c
tacgttagtattttg

SEQ ID NO: 8877 - DNA, 15 bp, Artificial Sequence
  dgRNA
  Blvra
agccctagttgcatt

SEQ ID NO: 8878 - DNA, 15 bp, Artificial Sequence
  dgRNA
  Blvra
ttgcatttggcgcga

SEQ ID NO: 8879 - DNA, 15 bp, Artificial Sequence
  dgRNA
  Blvra
tgcatttggcgcgaa

SEQ ID NO: 8880 - DNA, 15 bp, Artificial Sequence
  dgRNA
  Blvra
agcagcatgggccgc

SEQ ID NO: 8881 - DNA, 15 bp, Artificial Sequence
  dgRNA
  Ddx3x
ggggatagcaaaccc

SEQ ID NO: 8882 - DNA, 15 bp, Artificial Sequence
  dgRNA
  Ddx3x
ctttatgagccgacg

SEQ ID NO: 8883 - DNA, 15 bp, Artificial Sequence
  dgRNA
  Ddx3x
gagccgacgaggacg

SEQ ID NO: 8884 - DNA, 15 bp, Artificial Sequence
  dgRNA
  Ddx3x
agccgacgaggacgc

SEQ ID NO: 8885 - DNA, 15 bp, Artificial Sequence
  dgRNA
  1700007G11Rik
gatactcttctgtcg

SEQ ID NO: 8886 - DNA, 15 bp, Artificial Sequence
  dgRNA
  1700007G11Rik
cttcggactttgcta

SEQ ID NO: 8887 - DNA, 15 bp, Artificial Sequence
  dgRNA
  1700007G11Rik
ttacaccaaaaaagt

SEQ ID NO: 8888 - DNA, 15 bp, Artificial Sequence
  dgRNA
  1700007G11Rik
tacaccaaaaaagtt

SEQ ID NO: 8889 - DNA, 15 bp, Artificial Sequence
  dgRNA
  Tspan2
tttccctgatctggt

SEQ ID NO: 8890 - DNA, 15 bp, Artificial Sequence
  dgRNA
  Tspan2
aggtaacagtcctct

SEQ ID NO: 8891 - DNA, 15 bp, Artificial Sequence
  dgRNA
  Tspan2
cctctaggaacgcag

SEQ ID NO: 8892 - DNA, 15 bp, Artificial Sequence
  dgRNA
  Tspan2
taggaacgcagcggc

SEQ ID NO: 8893 - DNA, 15 bp, Artificial Sequence
  dgRNA
  Cuedc2
gtttgggacctctag

SEQ ID NO: 8894 - DNA, 15 bp, Artificial Sequence
  dgRNA
  Cuedc2
ctctagcggacaaaa

SEQ ID NO: 8895 - DNA, 15 bp, Artificial Sequence
  dgRNA
  Cuedc2
tctagcggacaaaaa

SEQ ID NO: 8896 - DNA, 15 bp, Artificial Sequence
  dgRNA
  Cuedc2
aaaaatggccgccgg

SEQ ID NO: 8897 - DNA, 15 bp, Artificial Sequence
  dgRNA
  Hist1h2ac
aagtagtgggttcat

SEQ ID NO: 8898 - DNA, 15 bp, Artificial Sequence
  dgRNA
  Hist1h2ac
tagcgtttactaccc

SEQ ID NO: 8899 - DNA, 15 bp, Artificial Sequence
  dgRNA
  Hist1h2ac
gcgtctgtacagtct

SEQ ID NO: 8900 - DNA, 15 bp, Artificial Sequence
  dgRNA
  Hist1h2ac
acgctactacttgat

SEQ ID NO: 8901 - DNA, 15 bp, Artificial Sequence
  dgRNA
  Llph
tctcctgtaggtgta

SEQ ID NO: 8902 - DNA, 15 bp, Artificial Sequence
  dgRNA
  Llph
ctcctgtaggtgtag

SEQ ID NO: 8903 - DNA, 15 bp, Artificial Sequence
  dgRNA
  Llph
agaccacgcctctca

SEQ ID NO: 8904 - DNA, 15 bp, Artificial Sequence
  dgRNA
  Llph
cggcatgctgtgcgc

SEQ ID NO: 8905 - DNA, 15 bp, Artificial Sequence
  dgRNA
  Top1mt
gttttgccacttaga

SEQ ID NO: 8906 - DNA, 15 bp, Artificial Sequence
  dgRNA
  Top1mt
ttttgccacttagat

SEQ ID NO: 8907 - DNA, 15 bp, Artificial Sequence
  dgRNA
  Top1mt
cttagatgggtagat

SEQ ID NO: 8908 - DNA, 15 bp, Artificial Sequence
  dgRNA
  Top1mt
gcaggtagaagcgct

SEQ ID NO: 8909 - DNA, 15 bp, Artificial Sequence
  dgRNA
  Olfr206
catgtaaagtcatac

SEQ ID NO: 8910 - DNA, 15 bp, Artificial Sequence
  dgRNA
  Tgm7
tccttatccctggct

SEQ ID NO: 8911 - DNA, 15 bp, Artificial Sequence
  dgRNA
  Tgm7
ctgaattgccctttg

SEQ ID NO: 8912 - DNA, 15 bp, Artificial Sequence
  dgRNA
  Tgm7
tatcctgaagttagg

SEQ ID NO: 8913 - DNA, 15 bp, Artificial Sequence
  dgRNA
  Tgm7
ggattggtgtcccag

SEQ ID NO: 8914 - DNA, 15 bp, Artificial Sequence
  dgRNA
  Rgs11
taagccaccagacta

SEQ ID NO: 8915 - DNA, 15 bp, Artificial Sequence
  dgRNA
  Rgs11
gctcgtctgctttgc

SEQ ID NO: 8916 - DNA, 15 bp, Artificial Sequence
  dgRNA
  Rgs11
ggatgtccacactgc

SEQ ID NO: 8917 - DNA, 15 bp, Artificial Sequence
  dgRNA
  Rgs11
aagtcacatcttgcg

SEQ ID NO: 8918 - DNA, 15 bp, Artificial Sequence
  dgRNA
  Adamts15
gggaggggcgctgac

SEQ ID NO: 8919 - DNA, 15 bp, Artificial Sequence
  dgRNA
  Adamts15
ggaggggcgctgact

SEQ ID NO: 8920 - DNA, 15 bp, Artificial Sequence
  dgRNA
  Adamts15
ctgggcagtccaaag

SEQ ID NO: 8921 - DNA, 15 bp, Artificial Sequence
  dgRNA
  Adamts15
gagggggcctttaat

SEQ ID NO: 8922 - DNA, 15 bp, Artificial Sequence
  dgRNA
  Bdh1
atccgcttactttcc

SEQ ID NO: 8923 - DNA, 15 bp, Artificial Sequence
  dgRNA
  Bdh1
aagtaagcggatgtc

SEQ ID NO: 8924 - DNA, 15 bp, Artificial Sequence
  dgRNA
  Bdh1
agacgctgcagctaa

SEQ ID NO: 8925 - DNA, 15 bp, Artificial Sequence
  dgRNA
  Bdh1
tagacgctgcagcta

SEQ ID NO: 8926 - DNA, 15 bp, Artificial Sequence
  dgRNA
  Olfr449
ggaatcttgatccat

SEQ ID NO: 8927 - DNA, 15 bp, Artificial Sequence
  dgRNA
  Olfr449
atgtttaccagacta

SEQ ID NO: 8928 - DNA, 15 bp, Artificial Sequence
  dgRNA
  Olfr449
tcagagtccgtagtc

SEQ ID NO: 8929 - DNA, 15 bp, Artificial Sequence
  dgRNA
  Endog
aatccttcgctcgtt

SEQ ID NO: 8930 - DNA, 15 bp, Artificial Sequence
  dgRNA
  Endog
ccttcgctcgtttgg

SEQ ID NO: 8931 - DNA, 15 bp, Artificial Sequence
  dgRNA
  Endog
cgctcgtttggtggc

SEQ ID NO: 8932 - DNA, 15 bp, Artificial Sequence
  dgRNA
  Endog
tcgtttggtggcagg

SEQ ID NO: 8933 - DNA, 15 bp, Artificial Sequence
  dgRNA
  Spag11b
ttattctgggaaccg

SEQ ID NO: 8934 - DNA, 15 bp, Artificial Sequence
  dgRNA
  Spag11b
attctgggaaccgtg

SEQ ID NO: 8935 - DNA, 15 bp, Artificial Sequence
  dgRNA
  Spag11b
gtgcactctgtctag

SEQ ID NO: 8936 - DNA, 15 bp, Artificial Sequence
  dgRNA
  Spag11b
tcttataacttagct

SEQ ID NO: 8937 - DNA, 15 bp, Artificial Sequence
  dgRNA
  Ccdc43
ccaactataacgaac

SEQ ID NO: 8938 - DNA, 15 bp, Artificial Sequence
  dgRNA
  Ccdc43
gaagcgctagctgcg

SEQ ID NO: 8939 - DNA, 15 bp, Artificial Sequence
  dgRNA
  Ccdc43
agatacctcaaaccg

SEQ ID NO: 8940 - DNA, 15 bp, Artificial Sequence
  dgRNA
  Ccdc43
ccgcggatcacagcc

SEQ ID NO: 8941 - DNA, 15 bp, Artificial Sequence
  dgRNA
  Pmvk
aacgtacaaattaaa

SEQ ID NO: 8942 - DNA, 15 bp, Artificial Sequence
  dgRNA
  Pmvk
atctttatgtttggc

SEQ ID NO: 8943 - DNA, 15 bp, Artificial Sequence
  dgRNA
  Pmvk
ggccggttgtgtaga

SEQ ID NO: 8944 - DNA, 15 bp, Artificial Sequence
  dgRNA
  Pmvk
gccggttgtgtagaa

SEQ ID NO: 8945 - DNA, 15 bp, Artificial Sequence
  dgRNA
  Golga5
ccgttaactttcaga

SEQ ID NO: 8946 - DNA, 15 bp, Artificial Sequence
  dgRNA
  Golga5
cgttaactttcagat

SEQ ID NO: 8947 - DNA, 15 bp, Artificial Sequence
  dgRNA
  Golga5
aacatatctttcacg

SEQ ID NO: 8948 - DNA, 15 bp, Artificial Sequence
  dgRNA
  Golga5
atctgaaagttaacg

SEQ ID NO: 8949 - DNA, 15 bp, Artificial Sequence
  dgRNA
  Fam227b
ccacgcgctcccccc

SEQ ID NO: 8950 - DNA, 15 bp, Artificial Sequence
  dgRNA
  Fam227b
ctttccgcagaacac

SEQ ID NO: 8951 - DNA, 15 bp, Artificial Sequence
  dgRNA
  Fam227b
tccgcagaacaccgg

SEQ ID NO: 8952 - DNA, 15 bp, Artificial Sequence
  dgRNA
  Fam227b
ccgcagaacaccgga

SEQ ID NO: 8953 - DNA, 15 bp, Artificial Sequence
  dgRNA
  Fa2h
tcagcgtcttgctct

SEQ ID NO: 8954 - DNA, 15 bp, Artificial Sequence
  dgRNA
  Fa2h
agcgtcttgctctcg

SEQ ID NO: 8955 - DNA, 15 bp, Artificial Sequence
  dgRNA
  Fa2h
cttgctctcggggct

SEQ ID NO: 8956 - DNA, 15 bp, Artificial Sequence
  dgRNA
  Fa2h
ttgctctcggggctc

SEQ ID NO: 8957 - DNA, 15 bp, Artificial Sequence
  dgRNA
  Dmtn
actatcagttgttgg

SEQ ID NO: 8958 - DNA, 15 bp, Artificial Sequence
  dgRNA
  Dmtn
ctatcagttgttggt

SEQ ID NO: 8959 - DNA, 15 bp, Artificial Sequence
  dgRNA
  Dmtn
aaggggctcattcgc

SEQ ID NO: 8960 - DNA, 15 bp, Artificial Sequence
  dgRNA
  Dmtn
tagtggcgggcccca

SEQ ID NO: 8961 - DNA, 15 bp, Artificial Sequence
  dgRNA
  Fkbp5
ctccggcccccacaa

SEQ ID NO: 8962 - DNA, 15 bp, Artificial Sequence
  dgRNA
  Fkbp5
tccggcccccacaaa

SEQ ID NO: 8963 - DNA, 15 bp, Artificial Sequence
  dgRNA
  Fkbp5
ccccacaaagggcaa

SEQ ID NO: 8964 - DNA, 15 bp, Artificial Sequence
  dgRNA
  Fkbp5
caagggccagacacg

SEQ ID NO: 8965 - DNA, 15 bp, Artificial Sequence
  dgRNA
  Zfp189
ctctacgtgttgcca

SEQ ID NO: 8966 - DNA, 15 bp, Artificial Sequence
  dgRNA
  Zfp189
tctacgtgttgccaa

SEQ ID NO: 8967 - DNA, 15 bp, Artificial Sequence
  dgRNA
  Zfp189
cagacctatgcattc

SEQ ID NO: 8968 - DNA, 15 bp, Artificial Sequence
  dgRNA
  Zfp189
agacctatgcattcc

SEQ ID NO: 8969 - DNA, 15 bp, Artificial Sequence
  dgRNA
  Meis1
gtggtgttagtgcct

SEQ ID NO: 8970 - DNA, 15 bp, Artificial Sequence
  dgRNA
  Meis1
gggcgtgcgaatttg

SEQ ID NO: 8971 - DNA, 15 bp, Artificial Sequence
  dgRNA
  Meis1
agacgcgacctgtta

SEQ ID NO: 8972 - DNA, 15 bp, Artificial Sequence
  dgRNA
  Meis1
cagctcccaacccgc

SEQ ID NO: 8973 - DNA, 15 bp, Artificial Sequence
  dgRNA
  Batf3
tcggggtcttctccg

SEQ ID NO: 8974 - DNA, 15 bp, Artificial Sequence
  dgRNA
  Batf3
cggggtcttctccgt

SEQ ID NO: 8975 - DNA, 15 bp, Artificial Sequence
  dgRNA
  Batf3
ggtcttctccgtggg

SEQ ID NO: 8976 - DNA, 15 bp, Artificial Sequence
  dgRNA
  Batf3
gtcttctccgtgggt

SEQ ID NO: 8977 - DNA, 15 bp, Artificial Sequence
  dgRNA
  Kdm4a
cgagacgacgctcat

SEQ ID NO: 8978 - DNA, 15 bp, Artificial Sequence
  dgRNA
  Kdm4a
cgctcataggctaag

SEQ ID NO: 8979 - DNA, 15 bp, Artificial Sequence
  dgRNA
  Kdm4a
ttccagacgccgagt

SEQ ID NO: 8980 - DNA, 15 bp, Artificial Sequence
  dgRNA
  Kdm4a
ttcattggttagctg

SEQ ID NO: 8981 - DNA, 15 bp, Artificial Sequence
  dgRNA
  Mphosph10
cacgcgacaccactg

SEQ ID NO: 8982 - DNA, 15 bp, Artificial Sequence
  dgRNA
  Mphosph10
gcttgagatgaccaa

SEQ ID NO: 8983 - DNA, 15 bp, Artificial Sequence
  dgRNA
  Mphosph10
accaatggctctttt

SEQ ID NO: 8984 - DNA, 15 bp, Artificial Sequence
  dgRNA
  Mphosph10
aatggctcttttcgg

SEQ ID NO: 8985 - DNA, 15 bp, Artificial Sequence
  dgRNA
  Tra2b
gaaacgagtgtggca

SEQ ID NO: 8986 - DNA, 15 bp, Artificial Sequence
  dgRNA
  Tra2b
aggctacggacatca

SEQ ID NO: 8987 - DNA, 15 bp, Artificial Sequence
  dgRNA
  Tra2b
catcacggtgtcccg

SEQ ID NO: 8988 - DNA, 15 bp, Artificial Sequence
  dgRNA
  Tra2b
acaacagacgcccaa

SEQ ID NO: 8989 - DNA, 15 bp, Artificial Sequence
  dgRNA
  Tlr4
cctaatactgtgctc

SEQ ID NO: 8990 - DNA, 15 bp, Artificial Sequence
  dgRNA
  Tlr4
cagagcacagtatta

SEQ ID NO: 8991 - DNA, 15 bp, Artificial Sequence
  dgRNA
  Tlr4
ccagagcacagtatt

SEQ ID NO: 8992 - DNA, 15 bp, Artificial Sequence
  dgRNA
  A630033H20Rik
aacgactgtaatacg

SEQ ID NO: 8993 - DNA, 15 bp, Artificial Sequence
  dgRNA
  A630033H20Rik
tacacttcttcaatc

SEQ ID NO: 8994 - DNA, 15 bp, Artificial Sequence
  dgRNA
  Kif20a
aagcaaacggtcttc

SEQ ID NO: 8995 - DNA, 15 bp, Artificial Sequence
  dgRNA
  Kif20a
aaacggtcttccggt

SEQ ID NO: 8996 - DNA, 15 bp, Artificial Sequence
  dgRNA
  Kif20a
ctgattgggtccttc

SEQ ID NO: 8997 - DNA, 15 bp, Artificial Sequence
  dgRNA
  Kif20a
caaagctgttcctcg

SEQ ID NO: 8998 - DNA, 15 bp, Artificial Sequence
  dgRNA
  Zfp655
gcacaacagcaacta

SEQ ID NO: 8999 - DNA, 15 bp, Artificial Sequence
  dgRNA
  Zfp655
tatctagcgatgctg

SEQ ID NO: 9000 - DNA, 15 bp, Artificial Sequence
  dgRNA
  Zfp655
gctgacagctcgacc

SEQ ID NO: 9001 - DNA, 15 bp, Artificial Sequence
  dgRNA
  Zfp655
ctgacagctcgaccc

SEQ ID NO: 9002 - DNA, 15 bp, Artificial Sequence
  dgRNA
  Umps
gcctacagatccctc

SEQ ID NO: 9003 - DNA, 15 bp, Artificial Sequence
  dgRNA
  Umps
tacagatccctccgg

SEQ ID NO: 9004 - DNA, 15 bp, Artificial Sequence
  dgRNA
  Umps
cctccgggggaaatc

SEQ ID NO: 9005 - DNA, 15 bp, Artificial Sequence
  dgRNA
  Umps
ttcgatctagctttc

SEQ ID NO: 9006 - DNA, 15 bp, Artificial Sequence
  dgRNA
  Bdnf
cacgaccacgtccgc

SEQ ID NO: 9007 - DNA, 15 bp, Artificial Sequence
  dgRNA
  Bdnf
ggagacccttagtca

SEQ ID NO: 9008 - DNA, 15 bp, Artificial Sequence
  dgRNA
  Bdnf
acccttagtcatggt

SEQ ID NO: 9009 - DNA, 15 bp, Artificial Sequence
  dgRNA
  Bdnf
agttggtcacgtaac

SEQ ID NO: 9010 - DNA, 15 bp, Artificial Sequence
  dgRNA
  Csf2rb2
gggatcgagctactc

SEQ ID NO: 9011 - DNA, 15 bp, Artificial Sequence
  dgRNA
  Csf2rb2
cgtgagtcttatcag

SEQ ID NO: 9012 - DNA, 15 bp, Artificial Sequence
  dgRNA
  Csf2rb2
ggggcacaaataaat

SEQ ID NO: 9013 - DNA, 15 bp, Artificial Sequence
  dgRNA
  Csf2rb2
ttgtgccccatctgg

SEQ ID NO: 9014 - DNA, 15 bp, Artificial Sequence
  dgRNA
  Bcl9
ggccccattccccgc

SEQ ID NO: 9015 - DNA, 15 bp, Artificial Sequence
  dgRNA
  Bcl9
gccccattccccgcc

SEQ ID NO: 9016 - DNA, 15 bp, Artificial Sequence
  dgRNA
  Bcl9
ccattccccgccggg

SEQ ID NO: 9017 - DNA, 15 bp, Artificial Sequence
  dgRNA
  Bcl9
cattccccgccgggc

SEQ ID NO: 9018 - DNA, 15 bp, Artificial Sequence
  dgRNA
  Trim40
cttgatggttaataa

SEQ ID NO: 9019 - DNA, 15 bp, Artificial Sequence
  dgRNA
  Trim40
aggttccaccttaag

SEQ ID NO: 9020 - DNA, 15 bp, Artificial Sequence
  dgRNA
  Trim40
actaacctcttaagg

SEQ ID NO: 9021 - DNA, 15 bp, Artificial Sequence
  dgRNA
  Trim40
accactaacctctta

SEQ ID NO: 9022 - DNA, 15 bp, Artificial Sequence
  dgRNA
  Adam17
aggaaggcgccaagc

SEQ ID NO: 9023 - DNA, 15 bp, Artificial Sequence
  dgRNA
  Adam17
aagatggcgttctgc

SEQ ID NO: 9024 - DNA, 15 bp, Artificial Sequence
  dgRNA
  Adam17
ctgccggcgccgcgc

SEQ ID NO: 9025 - DNA, 15 bp, Artificial Sequence
  dgRNA
  Adam17
tgccggcgccgcgcc

SEQ ID NO: 9026 - DNA, 15 bp, Artificial Sequence
  dgRNA
  Olfr92
ggctgagacgaagtc

SEQ ID NO: 9027 - DNA, 15 bp, Artificial Sequence
  dgRNA
  Olfr92
ccgtgtctagttggc

SEQ ID NO: 9028 - DNA, 15 bp, Artificial Sequence
  dgRNA
  Tdp1
cattcggctcttttc

SEQ ID NO: 9029 - DNA, 15 bp, Artificial Sequence
  dgRNA
  Tdp1
gtctttaggacccag

SEQ ID NO: 9030 - DNA, 15 bp, Artificial Sequence
  dgRNA
  Tdp1
tctttaggacccagt

SEQ ID NO: 9031 - DNA, 15 bp, Artificial Sequence
  dgRNA
  Tdp1
ccagtggggggcttc

SEQ ID NO: 9032 - DNA, 15 bp, Artificial Sequence
  dgRNA
  Slc36a3
cccttcataactaag

SEQ ID NO: 9033 - DNA, 15 bp, Artificial Sequence
  dgRNA
  Slc36a3
ttcataactaagtgg

SEQ ID NO: 9034 - DNA, 15 bp, Artificial Sequence
  dgRNA
  Slc36a3
agtcttcctgcgcag

SEQ ID NO: 9035 - DNA, 15 bp, Artificial Sequence
  dgRNA
  Slc36a3
cgcagaggatctgag

SEQ ID NO: 9036 - DNA, 15 bp, Artificial Sequence
  dgRNA
  Prcp
aaccctgcgtagtaa

SEQ ID NO: 9037 - DNA, 15 bp, Artificial Sequence
  dgRNA
  Prcp
ggaggcaacgccttt

SEQ ID NO: 9038 - DNA, 15 bp, Artificial Sequence
  dgRNA
  Prcp
gaggcaacgcctttg

SEQ ID NO: 9039 - DNA, 15 bp, Artificial Sequence
  dgRNA
  Prcp
aacgcctttggggcc

SEQ ID NO: 9040 - DNA, 15 bp, Artificial Sequence
  dgRNA
  Lox
agtcgagtgtgtctc

SEQ ID NO: 9041 - DNA, 15 bp, Artificial Sequence
  dgRNA
  Lox
cctgtgcaacgtgtc

SEQ ID NO: 9042 - DNA, 15 bp, Artificial Sequence
  dgRNA
  Lox
ctgtgcaacgtgtct

SEQ ID NO: 9043 - DNA, 15 bp, Artificial Sequence
  dgRNA
  Lox
tgtgcaacgtgtctg

SEQ ID NO: 9044 - DNA, 15 bp, Artificial Sequence
  dgRNA
  Mfap3
ttcgccgccctcacc

SEQ ID NO: 9045 - DNA, 15 bp, Artificial Sequence
  dgRNA
  Mfap3
caccgcccctcaccg

SEQ ID NO: 9046 - DNA, 15 bp, Artificial Sequence
  dgRNA
  Mfap3
ccgacccgaccgtcg

SEQ ID NO: 9047 - DNA, 15 bp, Artificial Sequence
  dgRNA
  Mfap3
ctgacctcagcgcgg

SEQ ID NO: 9048 - DNA, 15 bp, Artificial Sequence
  dgRNA
  Ndufb7
ggccttctagccaac

SEQ ID NO: 9049 - DNA, 15 bp, Artificial Sequence
  dgRNA
  Ndufb7
gtactgtggacaccc

SEQ ID NO: 9050 - DNA, 15 bp, Artificial Sequence
  dgRNA
  Ndufb7
gcgggtgtggaagcg

SEQ ID NO: 9051 - DNA, 15 bp, Artificial Sequence
  dgRNA
  Ndufb7
tgcgggtgtggaagc

SEQ ID NO: 9052 - DNA, 15 bp, Artificial Sequence
  dgRNA
  Olfr828
ctttgccactacatt

SEQ ID NO: 9053 - DNA, 15 bp, Artificial Sequence
  dgRNA
  Gm136
cttaatgctagacac

SEQ ID NO: 9054 - DNA, 15 bp, Artificial Sequence
  dgRNA
  Agbl5
ctagtgagccgcaca

SEQ ID NO: 9055 - DNA, 15 bp, Artificial Sequence
  dgRNA
  Agbl5
gtgagccgcacacgg

SEQ ID NO: 9056 - DNA, 15 bp, Artificial Sequence
  dgRNA
  Agbl5
agccgcacacggcgg

SEQ ID NO: 9057 - DNA, 15 bp, Artificial Sequence
  dgRNA
  Agbl5
cacggcggtggcccg

SEQ ID NO: 9058 - DNA, 15 bp, Artificial Sequence
  dgRNA
  Iba57
aggaccgaggtaaga

SEQ ID NO: 9059 - DNA, 15 bp, Artificial Sequence
  dgRNA
  Iba57
taccacgaccacaag

SEQ ID NO: 9060 - DNA, 15 bp, Artificial Sequence
  dgRNA
  Iba57
acaagcggtttgacc

SEQ ID NO: 9061 - DNA, 15 bp, Artificial Sequence
  dgRNA
  Iba57
accaggagccaacta

SEQ ID NO: 9062 - DNA, 15 bp, Artificial Sequence
  dgRNA
  Acsl3
gggtccagccgtcgg

SEQ ID NO: 9063 - DNA, 15 bp, Artificial Sequence
  dgRNA
  Acsl3
agcaccgcgctcccc

SEQ ID NO: 9064 - DNA, 15 bp, Artificial Sequence
  dgRNA
  Acsl3
aggccggcatttgat

SEQ ID NO: 9065 - DNA, 15 bp, Artificial Sequence
  dgRNA
  Acsl3
acgcgccaccgcccg

SEQ ID NO: 9066 - DNA, 15 bp, Artificial Sequence
  dgRNA
  Gm11487
ctcagcacgggatgt

SEQ ID NO: 9067 - DNA, 15 bp, Artificial Sequence
  dgRNA
  Gm11487
ctaaacccatggatt

SEQ ID NO: 9068 - DNA, 15 bp, Artificial Sequence
  dgRNA
  Gm11487
acccatggattgggt

SEQ ID NO: 9069 - DNA, 15 bp, Artificial Sequence
  dgRNA
  Gm11487
ctacatcccgtgctg

SEQ ID NO: 9070 - DNA, 15 bp, Artificial Sequence
  dgRNA
  Pcsk2
ggctcgcggcgcccc

SEQ ID NO: 9071 - DNA, 15 bp, Artificial Sequence
  dgRNA
  Pcsk2
gctcgcggcgccccc

SEQ ID NO: 9072 - DNA, 15 bp, Artificial Sequence
  dgRNA
  Pcsk2
ctcgcggcgcccccg

SEQ ID NO: 9073 - DNA, 15 bp, Artificial Sequence
  dgRNA
  Pcsk2
gcgcccccggggacc

SEQ ID NO: 9074 - DNA, 15 bp, Artificial Sequence
  dgRNA
  Syt6
cggtgccactgggct

SEQ ID NO: 9075 - DNA, 15 bp, Artificial Sequence
  dgRNA
  Syt6
gcggtctttgtgtcc

SEQ ID NO: 9076 - DNA, 15 bp, Artificial Sequence
  dgRNA
  Syt6
tttctcagcagcgag

SEQ ID NO: 9077 - DNA, 15 bp, Artificial Sequence
  dgRNA
  Syt6
ctgtctgcgtctcgc

SEQ ID NO: 9078 - DNA, 15 bp, Artificial Sequence
  dgRNA
  Elmo2
tttaagaggcctccg

SEQ ID NO: 9079 - DNA, 15 bp, Artificial Sequence
  dgRNA
  Elmo2
agaggcctccgcgga

SEQ ID NO: 9080 - DNA, 15 bp, Artificial Sequence
  dgRNA
  Elmo2
gaggcctccgcggag

SEQ ID NO: 9081 - DNA, 15 bp, Artificial Sequence
  dgRNA
  Elmo2
cctccgcggagggga

SEQ ID NO: 9082 - DNA, 15 bp, Artificial Sequence
  dgRNA
  Klk15
gtcctctcaacagtc

SEQ ID NO: 9083 - DNA, 15 bp, Artificial Sequence
  dgRNA
  Klk15
tgatgttagactaag

SEQ ID NO: 9084 - DNA, 15 bp, Artificial Sequence
  dgRNA
  Klk15
gggatgacaaaaact

SEQ ID NO: 9085 - DNA, 15 bp, Artificial Sequence
  dgRNA
  Cadm1
cgcccctaggtggcg

SEQ ID NO: 9086 - DNA, 15 bp, Artificial Sequence
  dgRNA
  Cadm1
gcccctaggtggcgc

SEQ ID NO: 9087 - DNA, 15 bp, Artificial Sequence
  dgRNA
  Cadm1
ccgaacgctagcgcc

SEQ ID NO: 9088 - DNA, 15 bp, Artificial Sequence
  dgRNA
  Cadm1
cgaacgctagcgcca

SEQ ID NO: 9089 - DNA, 15 bp, Artificial Sequence
  dgRNA
  Erbb2
agcaagcgaggcgtc

SEQ ID NO: 9090 - DNA, 15 bp, Artificial Sequence
  dgRNA
  Erbb2
gcaagcgaggcgtca

SEQ ID NO: 9091 - DNA, 15 bp, Artificial Sequence
  dgRNA
  Erbb2
gaggcgtcagggcac

SEQ ID NO: 9092 - DNA, 15 bp, Artificial Sequence
  dgRNA
  Erbb2
gggcgcgacgcaccc

SEQ ID NO: 9093 - DNA, 15 bp, Artificial Sequence
  dgRNA
  Prkd2
cgacttaaactttga

SEQ ID NO: 9094 - DNA, 15 bp, Artificial Sequence
  dgRNA
  Prkd2
gacccgccccgcctt

SEQ ID NO: 9095 - DNA, 15 bp, Artificial Sequence
  dgRNA
  Prkd2
ttactgggacggaag

SEQ ID NO: 9096 - DNA, 15 bp, Artificial Sequence
  dgRNA
  Prkd2
cttactgggacggaa

SEQ ID NO: 9097 - DNA, 15 bp, Artificial Sequence
  dgRNA
  Btbd18
gggccccaggcgtgt

SEQ ID NO: 9098 - DNA, 15 bp, Artificial Sequence
  dgRNA
  Btbd18
ggccccaggcgtgtg

SEQ ID NO: 9099 - DNA, 15 bp, Artificial Sequence
  dgRNA
  Btbd18
gatcgctgaggttgt

SEQ ID NO: 9100 - DNA, 15 bp, Artificial Sequence
  dgRNA
  Btbd18
atcgctgaggttgtg

SEQ ID NO: 9101 - DNA, 15 bp, Artificial Sequence
  dgRNA
  Zfp92
agtgtcccgggttca

SEQ ID NO: 9102 - DNA, 15 bp, Artificial Sequence
  dgRNA
  Zfp92
gtgtcccgggttcat

SEQ ID NO: 9103 - DNA, 15 bp, Artificial Sequence
  dgRNA
  Zfp92
tgtcccgggttcatg

SEQ ID NO: 9104 - DNA, 15 bp, Artificial Sequence
  dgRNA
  Zfp92
gaccagacgcctaag

SEQ ID NO: 9105 - DNA, 15 bp, Artificial Sequence
  dgRNA
  Ddx10
gtgcacgctttcccc

SEQ ID NO: 9106 - DNA, 15 bp, Artificial Sequence
  dgRNA
  Ddx10
gatcgccccgcccag

SEQ ID NO: 9107 - DNA, 15 bp, Artificial Sequence
  dgRNA
  Ddx10
ttgggggcgggttcc

SEQ ID NO: 9108 - DNA, 15 bp, Artificial Sequence
  dgRNA
  Ddx10
ttccgagagtgcttg

SEQ ID NO: 9109 - DNA, 15 bp, Artificial Sequence
  dgRNA
  Elp2
tcagagtgatgcgcg

SEQ ID NO: 9110 - DNA, 15 bp, Artificial Sequence
  dgRNA
  Elp2
gcgcgaggcgagcga

SEQ ID NO: 9111 - DNA, 15 bp, Artificial Sequence
  dgRNA
  Elp2
aaccacgccagcaga

SEQ ID NO: 9112 - DNA, 15 bp, Artificial Sequence
  dgRNA
  Elp2
accacgccagcagac

SEQ ID NO: 9113 - DNA, 15 bp, Artificial Sequence
  dgRNA
  Dock4
tgtgccgtcacattt

SEQ ID NO: 9114 - DNA, 15 bp, Artificial Sequence
  dgRNA
  Dock4
tggaccaatcgattg

SEQ ID NO: 9115 - DNA, 15 bp, Artificial Sequence
  dgRNA
  Dock4
gtggcgagcctaact

SEQ ID NO: 9116 - DNA, 15 bp, Artificial Sequence
  dgRNA
  Dock4
agtcccgcctccttc

SEQ ID NO: 9117 - DNA, 15 bp, Artificial Sequence
  dgRNA
  Foxl2
gagcccctcgctgtt

SEQ ID NO: 9118 - DNA, 15 bp, Artificial Sequence
  dgRNA
  Foxl2
tgggcagactcccga

SEQ ID NO: 9119 - DNA, 15 bp, Artificial Sequence
  dgRNA
  Foxl2
actcccgatggccag

SEQ ID NO: 9120 - DNA, 15 bp, Artificial Sequence
  dgRNA
  Foxl2
ccgcagaccgctccc

SEQ ID NO: 9121 - DNA, 15 bp, Artificial Sequence
  dgRNA
  Dusp3
tgagtacggatgaca

SEQ ID NO: 9122 - DNA, 15 bp, Artificial Sequence
  dgRNA
  Dusp3
gagtacggatgacac

SEQ ID NO: 9123 - DNA, 15 bp, Artificial Sequence
  dgRNA
  Dusp3
atgacacgggagtga

SEQ ID NO: 9124 - DNA, 15 bp, Artificial Sequence
  dgRNA
  Dusp3
gatggcatctcggcc

SEQ ID NO: 9125 - DNA, 15 bp, Artificial Sequence
  dgRNA
  Gk5
tgacgtcacggtgct

SEQ ID NO: 9126 - DNA, 15 bp, Artificial Sequence
  dgRNA
  Gk5
gacgtcacggtgcta

SEQ ID NO: 9127 - DNA, 15 bp, Artificial Sequence
  dgRNA
  Gk5
acgtcacggtgctag

SEQ ID NO: 9128 - DNA, 15 bp, Artificial Sequence
  dgRNA
  Gk5
tcacggtgctagggg

SEQ ID NO: 9129 - DNA, 15 bp, Artificial Sequence
  dgRNA
  Fndc3c1
cggcgaggggcgagg

SEQ ID NO: 9130 - DNA, 15 bp, Artificial Sequence
  dgRNA
  Fndc3c1
cggggccaacaggcc

SEQ ID NO: 9131 - DNA, 15 bp, Artificial Sequence
  dgRNA
  Fndc3c1
gggttacaccgctgc

SEQ ID NO: 9132 - DNA, 15 bp, Artificial Sequence
  dgRNA
  Fndc3c1
ggttacaccgctgct

SEQ ID NO: 9133 - DNA, 15 bp, Artificial Sequence
  dgRNA
  Krt17
catgatacccaggac

SEQ ID NO: 9134 - DNA, 15 bp, Artificial Sequence
  dgRNA
  Krt17
gggcccatagccacc

SEQ ID NO: 9135 - DNA, 15 bp, Artificial Sequence
  dgRNA
  Krt17
agctggcgggtgtcc

SEQ ID NO: 9136 - DNA, 15 bp, Artificial Sequence
  dgRNA
  Krt17
ctggcgggtgtccag

SEQ ID NO: 9137 - DNA, 15 bp, Artificial Sequence
  dgRNA
  Slc2a12
agagctagccctagc

SEQ ID NO: 9138 - DNA, 15 bp, Artificial Sequence
  dgRNA
  Slc2a12
gctagccctagccgg

SEQ ID NO: 9139 - DNA, 15 bp, Artificial Sequence
  dgRNA
  Slc2a12
ccaactcgcatctaa

SEQ ID NO: 9140 - DNA, 15 bp, Artificial Sequence
  dgRNA
  Slc2a12
cctgtgtcaccgaaa

SEQ ID NO: 9141 - DNA, 15 bp, Artificial Sequence
  dgRNA
  Pde4dip
aggaccaaaagcgcc

SEQ ID NO: 9142 - DNA, 15 bp, Artificial Sequence
  dgRNA
  Pde4dip
ccaaaagcgcctggg

SEQ ID NO: 9143 - DNA, 15 bp, Artificial Sequence
  dgRNA
  Pde4dip
tggcagacagcctcg

SEQ ID NO: 9144 - DNA, 15 bp, Artificial Sequence
  dgRNA
  Pde4dip
ggcagacagcctcgc

SEQ ID NO: 9145 - DNA, 15 bp, Artificial Sequence
  dgRNA
  Ssh3
accacgcctctagcg

SEQ ID NO: 9146 - DNA, 15 bp, Artificial Sequence
  dgRNA
  Ssh3
cgcctctagcgcggt

SEQ ID NO: 9147 - DNA, 15 bp, Artificial Sequence
  dgRNA
  Ssh3
gcctctagcgcggtc

SEQ ID NO: 9148 - DNA, 15 bp, Artificial Sequence
  dgRNA
  Ssh3
cctctagcgcggtcg

SEQ ID NO: 9149 - DNA, 15 bp, Artificial Sequence
  dgRNA
  Spry1
cccagttgcgctcgc

SEQ ID NO: 9150 - DNA, 15 bp, Artificial Sequence
  dgRNA
  Spry1
tcgcaggactcctgc

SEQ ID NO: 9151 - DNA, 15 bp, Artificial Sequence
  dgRNA
  Spry1
gacacatgatatcac

SEQ ID NO: 9152 - DNA, 15 bp, Artificial Sequence
  dgRNA
  Spry1
cacatgatatcaccg

SEQ ID NO: 9153 - DNA, 15 bp, Artificial Sequence
  dgRNA
  Dis3
gaagtcggaagaacc

SEQ ID NO: 9154 - DNA, 15 bp, Artificial Sequence
  dgRNA
  Dis3
aagtcggaagaacct

SEQ ID NO: 9155 - DNA, 15 bp, Artificial Sequence
  dgRNA
  Dis3
gaacctggggtgcgc

SEQ ID NO: 9156 - DNA, 15 bp, Artificial Sequence
  dgRNA
  Dis3
ttcccggaagccagt

SEQ ID NO: 9157 - DNA, 15 bp, Artificial Sequence
  dgRNA
  Ccdc163
agcgtccttgatttg

SEQ ID NO: 9158 - DNA, 15 bp, Artificial Sequence
  dgRNA
  Ccdc163
gtccttgatttgtgg

SEQ ID NO: 9159 - DNA, 15 bp, Artificial Sequence
  dgRNA
  Ccdc163
gtctcaaccaaaatt

SEQ ID NO: 9160 - DNA, 15 bp, Artificial Sequence
  dgRNA
  Ccdc163
gaatgaaccgaattt

SEQ ID NO: 9161 - DNA, 15 bp, Artificial Sequence
  dgRNA
  Rangrf
gaccccagcggtcct

SEQ ID NO: 9162 - DNA, 15 bp, Artificial Sequence
  dgRNA
  Rangrf
agagactagccccca

SEQ ID NO: 9163 - DNA, 15 bp, Artificial Sequence
  dgRNA
  Rangrf
ccgcccccgaagcgc

SEQ ID NO: 9164 - DNA, 15 bp, Artificial Sequence
  dgRNA
  Rangrf
agcgcgggcgccgat

SEQ ID NO: 9165 - DNA, 15 bp, Artificial Sequence
  dgRNA
  Tcea1
gagtccggatagggc

SEQ ID NO: 9166 - DNA, 15 bp, Artificial Sequence
  dgRNA
  Tcea1
gttccagactgctgg

SEQ ID NO: 9167 - DNA, 15 bp, Artificial Sequence
  dgRNA
  Tcea1
ttcgtagtgcctgtg

SEQ ID NO: 9168 - DNA, 15 bp, Artificial Sequence
  dgRNA
  Tcea1
cctgtgtggcgcgcg

SEQ ID NO: 9169 - DNA, 15 bp, Artificial Sequence
  dgRNA
  Mapkap1
tccagaaacggccaa

SEQ ID NO: 9170 - DNA, 15 bp, Artificial Sequence
  dgRNA
  Mapkap1
cccttgtcccgcccc

SEQ ID NO: 9171 - DNA, 15 bp, Artificial Sequence
  dgRNA
  Mapkap1
ccttgtcccgccccc

SEQ ID NO: 9172 - DNA, 15 bp, Artificial Sequence
  dgRNA
  Mapkap1
tgtcccgcccccggg

SEQ ID NO: 9173 - DNA, 15 bp, Artificial Sequence
  dgRNA
  Bank1
tgcggcctgagcccc

SEQ ID NO: 9174 - DNA, 15 bp, Artificial Sequence
  dgRNA
  Bank1
gcggcctgagcccct

SEQ ID NO: 9175 - DNA, 15 bp, Artificial Sequence
  dgRNA
  Bank1
catttccggcaacct

SEQ ID NO: 9176 - DNA, 15 bp, Artificial Sequence
  dgRNA
  Bank1
atttccggcaacctc

SEQ ID NO: 9177 - DNA, 15 bp, Artificial Sequence
  dgRNA
  Rbfox2
ccaccgccttaaaag

SEQ ID NO: 9178 - DNA, 15 bp, Artificial Sequence
  dgRNA
  Rbfox2
tttccgagtccttcc

SEQ ID NO: 9179 - DNA, 15 bp, Artificial Sequence
  dgRNA
  Rbfox2
cttcccggcctcccg

SEQ ID NO: 9180 - DNA, 15 bp, Artificial Sequence
  dgRNA
  Rbfox2
ttcccggcctcccgc

SEQ ID NO: 9181 - DNA, 15 bp, Artificial Sequence
  dgRNA
  Unc13d
ggagcattttgatct

SEQ ID NO: 9182 - DNA, 15 bp, Artificial Sequence
  dgRNA
  Unc13d
gggagcattttgatc

SEQ ID NO: 9183 - DNA, 15 bp, Artificial Sequence
  dgRNA
  Unc13d
gcagtctctgtgcgt

SEQ ID NO: 9184 - DNA, 15 bp, Artificial Sequence
  dgRNA
  Unc13d
agcagtctctgtgcg

SEQ ID NO: 9185 - DNA, 15 bp, Artificial Sequence
  dgRNA
  Pmpcb
ttatttggagcgaac

SEQ ID NO: 9186 - DNA, 15 bp, Artificial Sequence
  dgRNA
  Pmpcb
tatttggagcgaact

SEQ ID NO: 9187 - DNA, 15 bp, Artificial Sequence
  dgRNA
  Pmpcb
gagtcaaagggtgaa

SEQ ID NO: 9188 - DNA, 15 bp, Artificial Sequence
  dgRNA
  Pmpcb
cctgctgccgccaca

SEQ ID NO: 9189 - DNA, 15 bp, Artificial Sequence
  dgRNA
  F13a1
tcagagccgaatgtc

SEQ ID NO: 9190 - DNA, 15 bp, Artificial Sequence
  dgRNA
  F13a1
accagccgtcaagaa

SEQ ID NO: 9191 - DNA, 15 bp, Artificial Sequence
  dgRNA
  F13a1
ccagccgtcaagaaa

SEQ ID NO: 9192 - DNA, 15 bp, Artificial Sequence
  dgRNA
  F13a1
cagccgtcaagaaag

SEQ ID NO: 9193 - DNA, 15 bp, Artificial Sequence
  dgRNA
  Ptbp2
cactcacaccgccca

SEQ ID NO: 9194 - DNA, 15 bp, Artificial Sequence
  dgRNA
  Ptbp2
gcgggctcgtctccg

SEQ ID NO: 9195 - DNA, 15 bp, Artificial Sequence
  dgRNA
  Ptbp2
cgggctcgtctccga

SEQ ID NO: 9196 - DNA, 15 bp, Artificial Sequence
  dgRNA
  Ptbp2
gctcgtctccgaggg

SEQ ID NO: 9197 - DNA, 15 bp, Artificial Sequence
  dgRNA
  Dync1h1
ttttgcgcagagtaa

SEQ ID NO: 9198 - DNA, 15 bp, Artificial Sequence
  dgRNA
  Dync1h1
tttgcgcagagtaat

SEQ ID NO: 9199 - DNA, 15 bp, Artificial Sequence
  dgRNA
  Dync1h1
actacaagtcccaaa

SEQ ID NO: 9200 - DNA, 15 bp, Artificial Sequence
  dgRNA
  Dync1h1
gacgccgaccgcgag

SEQ ID NO: 9201 - DNA, 15 bp, Artificial Sequence
  dgRNA
  Surf6
agtagccggcccgtc

SEQ ID NO: 9202 - DNA, 15 bp, Artificial Sequence
  dgRNA
  Surf6
ccggcccgtcaggca

SEQ ID NO: 9203 - DNA, 15 bp, Artificial Sequence
  dgRNA
  Surf6
taattgagctccgag

SEQ ID NO: 9204 - DNA, 15 bp, Artificial Sequence
  dgRNA
  Surf6
agcggatttacactg

SEQ ID NO: 9205 - DNA, 15 bp, Artificial Sequence
  dgRNA
  Acin1
taacccacgcacttc

SEQ ID NO: 9206 - DNA, 15 bp, Artificial Sequence
  dgRNA
  Acin1
cacgcacttccggtc

SEQ ID NO: 9207 - DNA, 15 bp, Artificial Sequence
  dgRNA
  Acin1
agtgccccagcgccc

SEQ ID NO: 9208 - DNA, 15 bp, Artificial Sequence
  dgRNA
  Acin1
agcgccccggccccc

SEQ ID NO: 9209 - DNA, 15 bp, Artificial Sequence
  dgRNA
  Tmem72
ctaattgccaactcc

SEQ ID NO: 9210 - DNA, 15 bp, Artificial Sequence
  dgRNA
  Tmem72
cgcagatctgggcta

SEQ ID NO: 9211 - DNA, 15 bp, Artificial Sequence
  dgRNA
  Tmem72
acgcagatctgggct

SEQ ID NO: 9212 - DNA, 15 bp, Artificial Sequence
  dgRNA
  Tmem72
ggcacacgcagatct

SEQ ID NO: 9213 - DNA, 15 bp, Artificial Sequence
  dgRNA
  Plec
ctcagcttcccgcga

SEQ ID NO: 9214 - DNA, 15 bp, Artificial Sequence
  dgRNA
  Plec
tcagcttcccgcgaa

SEQ ID NO: 9215 - DNA, 15 bp, Artificial Sequence
  dgRNA
  Plec
cagcttcccgcgaag

SEQ ID NO: 9216 - DNA, 15 bp, Artificial Sequence
  dgRNA
  Plec
gcgaaggggcgcgcc

SEQ ID NO: 9217 - DNA, 15 bp, Artificial Sequence
  dgRNA
  Espnl
gcatacccttccccc

SEQ ID NO: 9218 - DNA, 15 bp, Artificial Sequence
  dgRNA
  Espnl
cgcactcttcatgct

SEQ ID NO: 9219 - DNA, 15 bp, Artificial Sequence
  dgRNA
  Espnl
atgcttggaagggcc

SEQ ID NO: 9220 - DNA, 15 bp, Artificial Sequence
  dgRNA
  Espnl
ccagcccgagttgct

SEQ ID NO: 9221 - DNA, 15 bp, Artificial Sequence
  dgRNA
  Ralgds
ctaatcgcctgcgac

SEQ ID NO: 9222 - DNA, 15 bp, Artificial Sequence
  dgRNA
  Ralgds
atcgcctgcgaccgg

SEQ ID NO: 9223 - DNA, 15 bp, Artificial Sequence
  dgRNA
  Ralgds
tcgcctgcgaccggc

SEQ ID NO: 9224 - DNA, 15 bp, Artificial Sequence
  dgRNA
  Ralgds
cgcctgcgaccggcg

SEQ ID NO: 9225 - DNA, 15 bp, Artificial Sequence
  dgRNA
  Tmed1
gattaggcaattacc

SEQ ID NO: 9226 - DNA, 15 bp, Artificial Sequence
  dgRNA
  Tmed1
attaggcaattacca

SEQ ID NO: 9227 - DNA, 15 bp, Artificial Sequence
  dgRNA
  Tmed1
ggcagctccccatcc

SEQ ID NO: 9228 - DNA, 15 bp, Artificial Sequence
  dgRNA
  Tmed1
tcagtcagcattccg

SEQ ID NO: 9229 - DNA, 15 bp, Artificial Sequence
  dgRNA
  Gpr27
gcaccgcgactgaga

SEQ ID NO: 9230 - DNA, 15 bp, Artificial Sequence
  dgRNA
  Gpr27
ccgcgactgagatgg

SEQ ID NO: 9231 - DNA, 15 bp, Artificial Sequence
  dgRNA
  Gpr27
cgactgagatggcgg

SEQ ID NO: 9232 - DNA, 15 bp, Artificial Sequence
  dgRNA
  Gpr27
ggcgcgccgagcccc

SEQ ID NO: 9233 - DNA, 15 bp, Artificial Sequence
  dgRNA
  Rsf1
agttctcgactgctc

SEQ ID NO: 9234 - DNA, 15 bp, Artificial Sequence
  dgRNA
  Rsf1
gttctcgactgctcc

SEQ ID NO: 9235 - DNA, 15 bp, Artificial Sequence
  dgRNA
  Rsf1
tcgactgctccgggc

SEQ ID NO: 9236 - DNA, 15 bp, Artificial Sequence
  dgRNA
  Rsf1
tgctccgggccggcg

SEQ ID NO: 9237 - DNA, 15 bp, Artificial Sequence
  dgRNA
  Milr1
agctctaagtgagat

SEQ ID NO: 9238 - DNA, 15 bp, Artificial Sequence
  dgRNA
  Milr1
aaaccaacgagtcat

SEQ ID NO: 9239 - DNA, 15 bp, Artificial Sequence
  dgRNA
  Milr1
tgtccttcatattac

SEQ ID NO: 9240 - DNA, 15 bp, Artificial Sequence
  dgRNA
  Milr1
ggacctatgactcgt

SEQ ID NO: 9241 - DNA, 15 bp, Artificial Sequence
  dgRNA
  Slc22a26
gcagtcttttgtcga

SEQ ID NO: 9242 - DNA, 15 bp, Artificial Sequence
  dgRNA
  Slc22a26
cccctgggtcatttc

SEQ ID NO: 9243 - DNA, 15 bp, Artificial Sequence
  dgRNA
  Slc22a26
gtgaaccacccccct

SEQ ID NO: 9244 - DNA, 15 bp, Artificial Sequence
  dgRNA
  Slc22a26
tgtgaaccacccccc

SEQ ID NO: 9245 - DNA, 15 bp, Artificial Sequence
  dgRNA
  Rilp
gaccttgtagggcac

SEQ ID NO: 9246 - DNA, 15 bp, Artificial Sequence
  dgRNA
  Rilp
cctatttgttcctcc

SEQ ID NO: 9247 - DNA, 15 bp, Artificial Sequence
  dgRNA
  Rilp
ctaccccgcccctta

SEQ ID NO: 9248 - DNA, 15 bp, Artificial Sequence
  dgRNA
  Rilp
ggccctaaacttcct

SEQ ID NO: 9249 - DNA, 15 bp, Artificial Sequence
  dgRNA
  Ttc21b
ccccagtcgccctcg

SEQ ID NO: 9250 - DNA, 15 bp, Artificial Sequence
  dgRNA
  Ttc21b
ctcgcggtcctccct

SEQ ID NO: 9251 - DNA, 15 bp, Artificial Sequence
  dgRNA
  Ttc21b
tcgcggtcctccctc

SEQ ID NO: 9252 - DNA, 15 bp, Artificial Sequence
  dgRNA
  Ttc21b
cgcggtcctccctcg

SEQ ID NO: 9253 - DNA, 15 bp, Artificial Sequence
  dgRNA
  Qtrtd1
acctagcagctagac

SEQ ID NO: 9254 - DNA, 15 bp, Artificial Sequence
  dgRNA
  Qtrtd1
cctagcagctagaca

SEQ ID NO: 9255 - DNA, 15 bp, Artificial Sequence
  dgRNA
  Qtrtd1
ctagcagctagacag

SEQ ID NO: 9256 - DNA, 15 bp, Artificial Sequence
  dgRNA
  Qtrtd1
aggggtcagacattc

SEQ ID NO: 9257 - DNA, 15 bp, Artificial Sequence
  dgRNA
  Bmf
ttgcgcttctgacgg

SEQ ID NO: 9258 - DNA, 15 bp, Artificial Sequence
  dgRNA
  Bmf
ggtcagaaatgcgcc

SEQ ID NO: 9259 - DNA, 15 bp, Artificial Sequence
  dgRNA
  Bmf
acctccacttgccat

SEQ ID NO: 9260 - DNA, 15 bp, Artificial Sequence
  dgRNA
  Bmf
tggagtgacgcaaag

SEQ ID NO: 9261 - DNA, 15 bp, Artificial Sequence
  dgRNA
  Iah1
tccccagtctcggag

SEQ ID NO: 9262 - DNA, 15 bp, Artificial Sequence
  dgRNA
  Iah1
cagtctcggagaggc

SEQ ID NO: 9263 - DNA, 15 bp, Artificial Sequence
  dgRNA
  Iah1
agtctcggagaggcg

SEQ ID NO: 9264 - DNA, 15 bp, Artificial Sequence
  dgRNA
  Iah1
tcggagaggcggggt

SEQ ID NO: 9265 - DNA, 15 bp, Artificial Sequence
  dgRNA
  Opn4
tcttgtgggctgatc

SEQ ID NO: 9266 - DNA, 15 bp, Artificial Sequence
  dgRNA
  Opn4
cttgtgggctgatca

SEQ ID NO: 9267 - DNA, 15 bp, Artificial Sequence
  dgRNA
  Opn4
atgcgaatgcctatg

SEQ ID NO: 9268 - DNA, 15 bp, Artificial Sequence
  dgRNA
  Opn4
catgcgaatgcctat

SEQ ID NO: 9269 - DNA, 15 bp, Artificial Sequence
  dgRNA
  Zcwpw1
cctagggcgcttcgc

SEQ ID NO: 9270 - DNA, 15 bp, Artificial Sequence
  dgRNA
  Zcwpw1
cttcgcaggatatta

SEQ ID NO: 9271 - DNA, 15 bp, Artificial Sequence
  dgRNA
  Zcwpw1
ttcgcaggatattat

SEQ ID NO: 9272 - DNA, 15 bp, Artificial Sequence
  dgRNA
  Zcwpw1
tcgcaggatattatg

SEQ ID NO: 9273 - DNA, 15 bp, Artificial Sequence
  dgRNA
  Kcnq2
aagggttgtcctgtg

SEQ ID NO: 9274 - DNA, 15 bp, Artificial Sequence
  dgRNA
  Kcnq2
tgcctgccactacaa

SEQ ID NO: 9275 - DNA, 15 bp, Artificial Sequence
  dgRNA
  Kcnq2
ctacaatggcgtcgt

SEQ ID NO: 9276 - DNA, 15 bp, Artificial Sequence
  dgRNA
  Kcnq2
tacaatggcgtcgta

SEQ ID NO: 9277 - DNA, 15 bp, Artificial Sequence
  dgRNA
  Nrbp2
tccccccatcatcca

SEQ ID NO: 9278 - DNA, 15 bp, Artificial Sequence
  dgRNA
  Nrbp2
ccccccatcatccac

SEQ ID NO: 9279 - DNA, 15 bp, Artificial Sequence
  dgRNA
  Nrbp2
catcaagatcggctc

SEQ ID NO: 9280 - DNA, 15 bp, Artificial Sequence
  dgRNA
  Nrbp2
gatcggctccggtgc

SEQ ID NO: 9281 - DNA, 15 bp, Artificial Sequence
  dgRNA
  Fam173a
acccggaacccaagg

SEQ ID NO: 9282 - DNA, 15 bp, Artificial Sequence
  dgRNA
  Fam173a
cccggaacccaagga

SEQ ID NO: 9283 - DNA, 15 bp, Artificial Sequence
  dgRNA
  Fam173a
ggagggtcccccgga

SEQ ID NO: 9284 - DNA, 15 bp, Artificial Sequence
  dgRNA
  Fam173a
ggtcccccggatggc

SEQ ID NO: 9285 - DNA, 15 bp, Artificial Sequence
  dgRNA
  Wdr90
caacagcggtggaag

SEQ ID NO: 9286 - DNA, 15 bp, Artificial Sequence
  dgRNA
  Wdr90
aacagcggtggaagt

SEQ ID NO: 9287 - DNA, 15 bp, Artificial Sequence
  dgRNA
  Wdr90
gcccacgcaagacct

SEQ ID NO: 9288 - DNA, 15 bp, Artificial Sequence
  dgRNA
  Wdr90
cccacgcaagaccta

SEQ ID NO: 9289 - DNA, 15 bp, Artificial Sequence
  dgRNA
  Cxcl16
gccaccacttttcga

SEQ ID NO: 9290 - DNA, 15 bp, Artificial Sequence
  dgRNA
  Cxcl16
gtaaatacctcgtgc

SEQ ID NO: 9291 - DNA, 15 bp, Artificial Sequence
  dgRNA
  Cxcl16
aatacctcgtgctgg

SEQ ID NO: 9292 - DNA, 15 bp, Artificial Sequence
  dgRNA
  Cxcl16
gaccgtcgtgacgtc

SEQ ID NO: 9293 - DNA, 15 bp, Artificial Sequence
  dgRNA
  Trpm3
cagcgtgcctccatt

SEQ ID NO: 9294 - DNA, 15 bp, Artificial Sequence
  dgRNA
  Trpm3
ccattcggccacatt

SEQ ID NO: 9295 - DNA, 15 bp, Artificial Sequence
  dgRNA
  Trpm3
catgagcacggctgc

SEQ ID NO: 9296 - DNA, 15 bp, Artificial Sequence
  dgRNA
  Trpm3
cctaatggaatttgc

SEQ ID NO: 9297 - DNA, 15 bp, Artificial Sequence
  dgRNA
  Camk2g
gtcggtcccagtggg

SEQ ID NO: 9298 - DNA, 15 bp, Artificial Sequence
  dgRNA
  Camk2g
gggaccccgcgtcct

SEQ ID NO: 9299 - DNA, 15 bp, Artificial Sequence
  dgRNA
  Camk2g
cgcgtccttggccct

SEQ ID NO: 9300 - DNA, 15 bp, Artificial Sequence
  dgRNA
  Camk2g
gcgtccttggccctc

SEQ ID NO: 9301 - DNA, 15 bp, Artificial Sequence
  dgRNA
  Smpd3
actacatgttccagc

SEQ ID NO: 9302 - DNA, 15 bp, Artificial Sequence
  dgRNA
  Smpd3
cacttgggcggtctc

SEQ ID NO: 9303 - DNA, 15 bp, Artificial Sequence
  dgRNA
  Smpd3
cggtctctgggggcg

SEQ ID NO: 9304 - DNA, 15 bp, Artificial Sequence
  dgRNA
  Smpd3
ggggcgaggtcccaa

SEQ ID NO: 9305 - DNA, 15 bp, Artificial Sequence
  dgRNA
  Orc6
tcaccatggcgactc

SEQ ID NO: 9306 - DNA, 15 bp, Artificial Sequence
  dgRNA
  Orc6
caccatggcgactcc

SEQ ID NO: 9307 - DNA, 15 bp, Artificial Sequence
  dgRNA
  Orc6
accatggcgactccg

SEQ ID NO: 9308 - DNA, 15 bp, Artificial Sequence
  dgRNA
  Orc6
cagcgcctaccccgc

SEQ ID NO: 9309 - DNA, 15 bp, Artificial Sequence
  dgRNA
  Tbx1
gccggtcggagcggt

SEQ ID NO: 9310 - DNA, 15 bp, Artificial Sequence
  dgRNA
  Tbx1
ccggtcggagcggtc

SEQ ID NO: 9311 - DNA, 15 bp, Artificial Sequence
  dgRNA
  Tbx1
cggtcggagcggtcg

SEQ ID NO: 9312 - DNA, 15 bp, Artificial Sequence
  dgRNA
  Tbx1
ggtcggagcggtcgg

SEQ ID NO: 9313 - DNA, 15 bp, Artificial Sequence
  dgRNA
  Lmf2
ggctcaacccgctac

SEQ ID NO: 9314 - DNA, 15 bp, Artificial Sequence
  dgRNA
  Lmf2
acccgctactggttc

SEQ ID NO: 9315 - DNA, 15 bp, Artificial Sequence
  dgRNA
  Lmf2
gttctggcgccattt

SEQ ID NO: 9316 - DNA, 15 bp, Artificial Sequence
  dgRNA
  Lmf2
cggaagtacgtagcc

SEQ ID NO: 9317 - DNA, 15 bp, Artificial Sequence
  dgRNA
  Sgpp2
ctggggccgcccggt

SEQ ID NO: 9318 - DNA, 15 bp, Artificial Sequence
  dgRNA
  Sgpp2
gccgcccggttggct

SEQ ID NO: 9319 - DNA, 15 bp, Artificial Sequence
  dgRNA
  Sgpp2
cccggttggctagga

SEQ ID NO: 9320 - DNA, 15 bp, Artificial Sequence
  dgRNA
  Sgpp2
ccggttggctaggaa

SEQ ID NO: 9321 - DNA, 15 bp, Artificial Sequence
  dgRNA
  Tpgs1
tcgagattctcagag

SEQ ID NO: 9322 - DNA, 15 bp, Artificial Sequence
  dgRNA
  Tpgs1
cgagattctcagaga

SEQ ID NO: 9323 - DNA, 15 bp, Artificial Sequence
  dgRNA
  Tpgs1
caaaaatggtcgtcg

SEQ ID NO: 9324 - DNA, 15 bp, Artificial Sequence
  dgRNA
  Tpgs1
aaaaatggtcgtcga

SEQ ID NO: 9325 - DNA, 15 bp, Artificial Sequence
  dgRNA
  Xpo4
gcccttactgacttc

SEQ ID NO: 9326 - DNA, 15 bp, Artificial Sequence
  dgRNA
  Xpo4
caagcatttcgtcca

SEQ ID NO: 9327 - DNA, 15 bp, Artificial Sequence
  dgRNA
  Xpo4
cagcggaatgaaccg

SEQ ID NO: 9328 - DNA, 15 bp, Artificial Sequence
  dgRNA
  Xpo4
gaatgaaccgcggag

SEQ ID NO: 9329 - DNA, 15 bp, Artificial Sequence
  dgRNA
  Pde1c
tcttgcatgtcagca

SEQ ID NO: 9330 - DNA, 15 bp, Artificial Sequence
  dgRNA
  Pde1c
ttgctggtaagtgag

SEQ ID NO: 9331 - DNA, 15 bp, Artificial Sequence
  dgRNA
  Pde1c
tatgccctacaatga

SEQ ID NO: 9332 - DNA, 15 bp, Artificial Sequence
  dgRNA
  Pde1c
gataacactgtcagc

SEQ ID NO: 9333 - DNA, 15 bp, Artificial Sequence
  dgRNA
  Trib2
ggcgccgctgattga

SEQ ID NO: 9334 - DNA, 15 bp, Artificial Sequence
  dgRNA
  Trib2
gcgccgctgattgat

SEQ ID NO: 9335 - DNA, 15 bp, Artificial Sequence
  dgRNA
  Trib2
tccgggctcaatgac

SEQ ID NO: 9336 - DNA, 15 bp, Artificial Sequence
  dgRNA
  Trib2
ccgggctcaatgaca

SEQ ID NO: 9337 - DNA, 15 bp, Artificial Sequence
  dgRNA
  Gphn
gctctgtcttccgcg

SEQ ID NO: 9338 - DNA, 15 bp, Artificial Sequence
  dgRNA
  Gphn
ccgctactcccaccc

SEQ ID NO: 9339 - DNA, 15 bp, Artificial Sequence
  dgRNA
  Gphn
cgctactcccacccc

SEQ ID NO: 9340 - DNA, 15 bp, Artificial Sequence
  dgRNA
  Gphn
gggatcgcttcctcc

SEQ ID NO: 9341 - DNA, 15 bp, Artificial Sequence
  dgRNA
  Zfp36l2
ccgaaggggaaaaat

SEQ ID NO: 9342 - DNA, 15 bp, Artificial Sequence
  dgRNA
  Zfp36l2
ggagcctgacgtccg

SEQ ID NO: 9343 - DNA, 15 bp, Artificial Sequence
  dgRNA
  Zfp36l2
gagcctgacgtccgc

SEQ ID NO: 9344 - DNA, 15 bp, Artificial Sequence
  dgRNA
  Zfp36l2
ctgacgtccgcgggc

SEQ ID NO: 9345 - DNA, 15 bp, Artificial Sequence
  dgRNA
  Cthrc1
tctgcagcaccccgc

SEQ ID NO: 9346 - DNA, 15 bp, Artificial Sequence
  dgRNA
  Cthrc1
ctgcagcaccccgcg

SEQ ID NO: 9347 - DNA, 15 bp, Artificial Sequence
  dgRNA
  Cthrc1
tgcagcaccccgcgg

SEQ ID NO: 9348 - DNA, 15 bp, Artificial Sequence
  dgRNA
  Cthrc1
caccccgcgggggtc

SEQ ID NO: 9349 - DNA, 15 bp, Artificial Sequence
  dgRNA
  Cd300a
aagaaggtcgcagcc

SEQ ID NO: 9350 - DNA, 15 bp, Artificial Sequence
  dgRNA
  Cd300a
aatttttgggggtcc

SEQ ID NO: 9351 - DNA, 15 bp, Artificial Sequence
  dgRNA
  Ftsj2
cagatctcattcgcc

SEQ ID NO: 9352 - DNA, 15 bp, Artificial Sequence
  dgRNA
  Ftsj2
agatctcattcgccc

SEQ ID NO: 9353 - DNA, 15 bp, Artificial Sequence
  dgRNA
  Ftsj2
caaagtttcccgggg

SEQ ID NO: 9354 - DNA, 15 bp, Artificial Sequence
  dgRNA
  Ftsj2
ggcggagcctcgcgt

SEQ ID NO: 9355 - DNA, 15 bp, Artificial Sequence
  dgRNA
  Cdo1
tccaccccctgaagg

SEQ ID NO: 9356 - DNA, 15 bp, Artificial Sequence
  dgRNA
  Cdo1
ccccctgaaggcggt

SEQ ID NO: 9357 - DNA, 15 bp, Artificial Sequence
  dgRNA
  Cdo1
gcttaaaaagggccc

SEQ ID NO: 9358 - DNA, 15 bp, Artificial Sequence
  dgRNA
  Cdo1
taaaaagggcccggg

SEQ ID NO: 9359 - DNA, 15 bp, Artificial Sequence
  dgRNA
  Cpsf4l
tcacgtgcagtcacc

SEQ ID NO: 9360 - DNA, 15 bp, Artificial Sequence
  dgRNA
  Cpsf4l
gcatcagatagggcc

SEQ ID NO: 9361 - DNA, 15 bp, Artificial Sequence
  dgRNA
  Cpsf4l
ctggccccgttaatt

SEQ ID NO: 9362 - DNA, 15 bp, Artificial Sequence
  dgRNA
  Cpsf4l
ccgttaattaggatt

SEQ ID NO: 9363 - DNA, 15 bp, Artificial Sequence
  dgRNA
  Smok2b
tatatggacctgtcc

SEQ ID NO: 9364 - DNA, 15 bp, Artificial Sequence
  dgRNA
  Smok2b
tcatgtggtcatata

SEQ ID NO: 9365 - DNA, 15 bp, Artificial Sequence
  dgRNA
  Smok2b
tagtcactcctcatg

SEQ ID NO: 9366 - DNA, 15 bp, Artificial Sequence
  dgRNA
  Smok2b
cttaaacctgctggc

SEQ ID NO: 9367 - DNA, 15 bp, Artificial Sequence
  dgRNA
  D430019H16Rik
acccatcgccccagc

SEQ ID NO: 9368 - DNA, 15 bp, Artificial Sequence
  dgRNA
  D430019H16Rik
atcaagggtctggct

SEQ ID NO: 9369 - DNA, 15 bp, Artificial Sequence
  dgRNA
  D430019H16Rik
ggcttggcccgccct

SEQ ID NO: 9370 - DNA, 15 bp, Artificial Sequence
  dgRNA
  D430019H16Rik
gcttggcccgccctc

SEQ ID NO: 9371 - DNA, 15 bp, Artificial Sequence
  dgRNA
  Hist1h2ad
ttggtttatgacgga

SEQ ID NO: 9372 - DNA, 15 bp, Artificial Sequence
  dgRNA
  Hist1h2ad
aaagacgtcagccaa

SEQ ID NO: 9373 - DNA, 15 bp, Artificial Sequence
  dgRNA
  Hist1h2ad
cagcgaataatataa

SEQ ID NO: 9374 - DNA, 15 bp, Artificial Sequence
  dgRNA
  Hist1h2ad
tcataaaccaatcaa

SEQ ID NO: 9375 - DNA, 15 bp, Artificial Sequence
  dgRNA
  Olfr1445
ttggatcagaatgct

SEQ ID NO: 9376 - DNA, 15 bp, Artificial Sequence
  dgRNA
  Olfr1445
gcattggcatcctga

SEQ ID NO: 9377 - DNA, 15 bp, Artificial Sequence
  dgRNA
  Olfr1445
tagtaactttaccta

SEQ ID NO: 9378 - DNA, 15 bp, Artificial Sequence
  dgRNA
  Olfr1445
gatccaagcagactg

SEQ ID NO: 9379 - DNA, 15 bp, Artificial Sequence
  dgRNA
  Vmn1r206
tttgcgtgtgttgac

SEQ ID NO: 9380 - DNA, 15 bp, Artificial Sequence
  dgRNA
  Samd5
ggcggcgcagcgcga

SEQ ID NO: 9381 - DNA, 15 bp, Artificial Sequence
  dgRNA
  Samd5
cgacggtgacccgcg

SEQ ID NO: 9382 - DNA, 15 bp, Artificial Sequence
  dgRNA
  Samd5
gacggtgacccgcgc

SEQ ID NO: 9383 - DNA, 15 bp, Artificial Sequence
  dgRNA
  Samd5
acccgcgcgggtgcg

SEQ ID NO: 9384 - DNA, 15 bp, Artificial Sequence
  dgRNA
  Apod
tacagcccttcttgc

SEQ ID NO: 9385 - DNA, 15 bp, Artificial Sequence
  dgRNA
  Apod
atgcttccaaacatc

SEQ ID NO: 9386 - DNA, 15 bp, Artificial Sequence
  dgRNA
  Trim3
gagccgcaagggcgg

SEQ ID NO: 9387 - DNA, 15 bp, Artificial Sequence
  dgRNA
  Trim3
agccgcaagggcgga

SEQ ID NO: 9388 - DNA, 15 bp, Artificial Sequence
  dgRNA
  Trim3
gccgcaagggcggag

SEQ ID NO: 9389 - DNA, 15 bp, Artificial Sequence
  dgRNA
  Trim3
cgggcgtggtctgag

SEQ ID NO: 9390 - DNA, 15 bp, Artificial Sequence
  dgRNA
  Zfp691
attggccgtcctact

SEQ ID NO: 9391 - DNA, 15 bp, Artificial Sequence
  dgRNA
  Zfp691
gtatagccaatagag

SEQ ID NO: 9392 - DNA, 15 bp, Artificial Sequence
  dgRNA
  Zfp691
atccgaacgctgtga

SEQ ID NO: 9393 - DNA, 15 bp, Artificial Sequence
  dgRNA
  Zfp691
cgaacgctgtgaagg

SEQ ID NO: 9394 - DNA, 15 bp, Artificial Sequence
  dgRNA
  Arpp21
caccaagaaacctaa

SEQ ID NO: 9395 - DNA, 15 bp, Artificial Sequence
  dgRNA
  Igsf5
gagccggtcagactc

SEQ ID NO: 9396 - DNA, 15 bp, Artificial Sequence
  dgRNA
  Igsf5
cggtcagactctggc

SEQ ID NO: 9397 - DNA, 15 bp, Artificial Sequence
  dgRNA
  Igsf5
ctggctggtggcgaa

SEQ ID NO: 9398 - DNA, 15 bp, Artificial Sequence
  dgRNA
  Igsf5
aagggcgattgaacc

SEQ ID NO: 9399 - DNA, 15 bp, Artificial Sequence
  dgRNA
  Clpp
gagcttcttcccgcg

SEQ ID NO: 9400 - DNA, 15 bp, Artificial Sequence
  dgRNA
  Clpp
agcttcttcccgcgt

SEQ ID NO: 9401 - DNA, 15 bp, Artificial Sequence
  dgRNA
  Clpp
ttcccgcgtgggcac

SEQ ID NO: 9402 - DNA, 15 bp, Artificial Sequence
  dgRNA
  Clpp
tcccgcgtgggcacc

SEQ ID NO: 9403 - DNA, 15 bp, Artificial Sequence
  dgRNA
  Psma5
cgcgaagtaagagac

SEQ ID NO: 9404 - DNA, 15 bp, Artificial Sequence
  dgRNA
  Psma5
gagaccggtgtcccc

SEQ ID NO: 9405 - DNA, 15 bp, Artificial Sequence
  dgRNA
  Psma5
tgcatttacgcgagc

SEQ ID NO: 9406 - DNA, 15 bp, Artificial Sequence
  dgRNA
  Psma5
gaggactttttgact

SEQ ID NO: 9407 - DNA, 15 bp, Artificial Sequence
  dgRNA
  Susd2
gctaactaggcactt

SEQ ID NO: 9408 - DNA, 15 bp, Artificial Sequence
  dgRNA
  Susd2
ctaactaggcacttc

SEQ ID NO: 9409 - DNA, 15 bp, Artificial Sequence
  dgRNA
  Susd2
gtctatcggcacctg

SEQ ID NO: 9410 - DNA, 15 bp, Artificial Sequence
  dgRNA
  Susd2
cctgtggactttgag

SEQ ID NO: 9411 - DNA, 15 bp, Artificial Sequence
  dgRNA
  Eps8l3
accgtgctgtgcggt

SEQ ID NO: 9412 - DNA, 15 bp, Artificial Sequence
  dgRNA
  Eps8l3
gtgctgtgcggttgg

SEQ ID NO: 9413 - DNA, 15 bp, Artificial Sequence
  dgRNA
  Eps8l3
acggtagtggacctg

SEQ ID NO: 9414 - DNA, 15 bp, Artificial Sequence
  dgRNA
  Eps8l3
cgcacagcacggtag

SEQ ID NO: 9415 - DNA, 15 bp, Artificial Sequence
  dgRNA
  Adam26b
agagcatagtgtata

SEQ ID NO: 9416 - DNA, 15 bp, Artificial Sequence
  dgRNA
  Zfp759
ttcgtgccgtgacca

SEQ ID NO: 9417 - DNA, 15 bp, Artificial Sequence
  dgRNA
  Zfp759
tcccggcccctgtga

SEQ ID NO: 9418 - DNA, 15 bp, Artificial Sequence
  dgRNA
  Zfp759
tacagtccttggtca

SEQ ID NO: 9419 - DNA, 15 bp, Artificial Sequence
  dgRNA
  Zfp759
gttttgtacactgcc

SEQ ID NO: 9420 - DNA, 15 bp, Artificial Sequence
  dgRNA
  Ferd3l
atgtctccccgagtt

SEQ ID NO: 9421 - DNA, 15 bp, Artificial Sequence
  dgRNA
  Ferd3l
gtgatgatacgctgc

SEQ ID NO: 9422 - DNA, 15 bp, Artificial Sequence
  dgRNA
  Ferd3l
acgctgcaggaatca

SEQ ID NO: 9423 - DNA, 15 bp, Artificial Sequence
  dgRNA
  Ferd3l
gactttcaggctcta

SEQ ID NO: 9424 - DNA, 15 bp, Artificial Sequence
  dgRNA
  Polg2
ggtggagttaccaaa

SEQ ID NO: 9425 - DNA, 15 bp, Artificial Sequence
  dgRNA
  Polg2
aacggaaaatcccaa

SEQ ID NO: 9426 - DNA, 15 bp, Artificial Sequence
  dgRNA
  Polg2
taaacaatcagacgc

SEQ ID NO: 9427 - DNA, 15 bp, Artificial Sequence
  dgRNA
  Polg2
cgctggcgtcagccg

SEQ ID NO: 9428 - DNA, 15 bp, Artificial Sequence
  dgRNA
  Zfp362
gcgcggctgcacagc

SEQ ID NO: 9429 - DNA, 15 bp, Artificial Sequence
  dgRNA
  Zfp362
cgccaccgccgaagc

SEQ ID NO: 9430 - DNA, 15 bp, Artificial Sequence
  dgRNA
  Zfp362
gccaccgccgaagcc

SEQ ID NO: 9431 - DNA, 15 bp, Artificial Sequence
  dgRNA
  Zfp362
cagcccggccctact

SEQ ID NO: 9432 - DNA, 15 bp, Artificial Sequence
  dgRNA
  Pex2
gtctcttcgtccctt

SEQ ID NO: 9433 - DNA, 15 bp, Artificial Sequence
  dgRNA
  Pex2
cctcggcattttccg

SEQ ID NO: 9434 - DNA, 15 bp, Artificial Sequence
  dgRNA
  Pex2
gcattttccgtggcc

SEQ ID NO: 9435 - DNA, 15 bp, Artificial Sequence
  dgRNA
  Pex2
acccggtgttgcttc

SEQ ID NO: 9436 - DNA, 15 bp, Artificial Sequence
  dgRNA
  Nptn
gaccgcccttgtgct

SEQ ID NO: 9437 - DNA, 15 bp, Artificial Sequence
  dgRNA
  Nptn
cgcgagccttgccgc

SEQ ID NO: 9438 - DNA, 15 bp, Artificial Sequence
  dgRNA
  Nptn
tgccgccggtgctcc

SEQ ID NO: 9439 - DNA, 15 bp, Artificial Sequence
  dgRNA
  Nptn
ctcctggcccgccca

SEQ ID NO: 9440 - DNA, 15 bp, Artificial Sequence
  dgRNA
  Ehbp1l1
gtggcaccaagttga

SEQ ID NO: 9441 - DNA, 15 bp, Artificial Sequence
  dgRNA
  Ehbp1l1
accccatttgactcg

SEQ ID NO: 9442 - DNA, 15 bp, Artificial Sequence
  dgRNA
  Ehbp1l1
ccccatttgactcgc

SEQ ID NO: 9443 - DNA, 15 bp, Artificial Sequence
  dgRNA
  Ehbp1l1
gggcgcccatcaaac

SEQ ID NO: 9444 - DNA, 15 bp, Artificial Sequence
  dgRNA
  Rara
agactcgcccttccc

SEQ ID NO: 9445 - DNA, 15 bp, Artificial Sequence
  dgRNA
  Rara
gactcgcccttccct

SEQ ID NO: 9446 - DNA, 15 bp, Artificial Sequence
  dgRNA
  Rara
atgaggacccgcccc

SEQ ID NO: 9447 - DNA, 15 bp, Artificial Sequence
  dgRNA
  Rara
cccccggttagtgat

SEQ ID NO: 9448 - DNA, 15 bp, Artificial Sequence
  dgRNA
  Sytl2
accgctgctaccttg

SEQ ID NO: 9449 - DNA, 15 bp, Artificial Sequence
  dgRNA
  Sytl2
ccgctgctaccttga

SEQ ID NO: 9450 - DNA, 15 bp, Artificial Sequence
  dgRNA
  Sytl2
gtctgtaggatgaac

SEQ ID NO: 9451 - DNA, 15 bp, Artificial Sequence
  dgRNA
  Sytl2
cagcaaggtccctca

SEQ ID NO: 9452 - DNA, 15 bp, Artificial Sequence
  dgRNA
  Dcaf4
tgatccgcagtaaga

SEQ ID NO: 9453 - DNA, 15 bp, Artificial Sequence
  dgRNA
  Dcaf4
tgtcaagagagtacc

SEQ ID NO: 9454 - DNA, 15 bp, Artificial Sequence
  dgRNA
  Dcaf4
taagcgtgccaagcc

SEQ ID NO: 9455 - DNA, 15 bp, Artificial Sequence
  dgRNA
  Dcaf4
aagcgtgccaagccc

SEQ ID NO: 9456 - DNA, 15 bp, Artificial Sequence
  dgRNA
  Vmn1r17
tgtacaggaggtaca

SEQ ID NO: 9457 - DNA, 15 bp, Artificial Sequence
  dgRNA
  Zfp219
acgtaactttgtcat

SEQ ID NO: 9458 - DNA, 15 bp, Artificial Sequence
  dgRNA
  Zfp219
cgtaactttgtcata

SEQ ID NO: 9459 - DNA, 15 bp, Artificial Sequence
  dgRNA
  Zfp219
aaagtcaggacgtag

SEQ ID NO: 9460 - DNA, 15 bp, Artificial Sequence
  dgRNA
  Zfp219
ccccaatcaaactgc

SEQ ID NO: 9461 - DNA, 15 bp, Artificial Sequence
  dgRNA
  Fshb
tagactgctttggcg

SEQ ID NO: 9462 - DNA, 15 bp, Artificial Sequence
  dgRNA
  Fshb
cccagtaaatccaca

SEQ ID NO: 9463 - DNA, 15 bp, Artificial Sequence
  dgRNA
  Fshb
aaaccgaatctgata

SEQ ID NO: 9464 - DNA, 15 bp, Artificial Sequence
  dgRNA
  Fshb
ttgtttagacggaca

SEQ ID NO: 9465 - DNA, 15 bp, Artificial Sequence
  dgRNA
  Gm14393
acaattggcacaggt

SEQ ID NO: 9466 - DNA, 15 bp, Artificial Sequence
  dgRNA
  Gm14393
tgtgaactaccctta

SEQ ID NO: 9467 - DNA, 15 bp, Artificial Sequence
  dgRNA
  Parp11
ccgcgacagcacgcg

SEQ ID NO: 9468 - DNA, 15 bp, Artificial Sequence
  dgRNA
  Parp11
cgcgcggaagttcca

SEQ ID NO: 9469 - DNA, 15 bp, Artificial Sequence
  dgRNA
  Parp11
gcgcggaagttccaa

SEQ ID NO: 9470 - DNA, 15 bp, Artificial Sequence
  dgRNA
  Parp11
ccaagggcgccatag

SEQ ID NO: 9471 - DNA, 15 bp, Artificial Sequence
  dgRNA
  Trmt1
gaagagtcttgaccc

SEQ ID NO: 9472 - DNA, 15 bp, Artificial Sequence
  dgRNA
  Trmt1
ctggtcgcccactgt

SEQ ID NO: 9473 - DNA, 15 bp, Artificial Sequence
  dgRNA
  Trmt1
ggtaatgtctctaat

SEQ ID NO: 9474 - DNA, 15 bp, Artificial Sequence
  dgRNA
  Trmt1
cttgtaggttaactc

SEQ ID NO: 9475 - DNA, 15 bp, Artificial Sequence
  dgRNA
  Gm561
tgagcgcctaaccta

SEQ ID NO: 9476 - DNA, 15 bp, Artificial Sequence
  dgRNA
  Gm561
aatcttcgtccttgc

SEQ ID NO: 9477 - DNA, 15 bp, Artificial Sequence
  dgRNA
  Gm561
atcttcgtccttgcc

SEQ ID NO: 9478 - DNA, 15 bp, Artificial Sequence
  dgRNA
  Gm561
tgccgggattaacta

SEQ ID NO: 9479 - DNA, 15 bp, Artificial Sequence
  dgRNA
  Ccdc30
ggttactgcggtctc

SEQ ID NO: 9480 - DNA, 15 bp, Artificial Sequence
  dgRNA
  Ccdc30
ggtctccggagccaa

SEQ ID NO: 9481 - DNA, 15 bp, Artificial Sequence
  dgRNA
  Ccdc30
gtctccggagccaat

SEQ ID NO: 9482 - DNA, 15 bp, Artificial Sequence
  dgRNA
  Ccdc30
tctccggagccaatg

SEQ ID NO: 9483 - DNA, 15 bp, Artificial Sequence
  dgRNA
  Lhfpl2
taggaccctcccccc

SEQ ID NO: 9484 - DNA, 15 bp, Artificial Sequence
  dgRNA
  Lhfpl2
gaccctcccccccgg

SEQ ID NO: 9485 - DNA, 15 bp, Artificial Sequence
  dgRNA
  Lhfpl2
ctcccccccggaggc

SEQ ID NO: 9486 - DNA, 15 bp, Artificial Sequence
  dgRNA
  Lhfpl2
tcccccccggaggcc

SEQ ID NO: 9487 - DNA, 15 bp, Artificial Sequence
  dgRNA
  Sympk
gttcccatttccgtc

SEQ ID NO: 9488 - DNA, 15 bp, Artificial Sequence
  dgRNA
  Sympk
ggcgcctgcgcagcg

SEQ ID NO: 9489 - DNA, 15 bp, Artificial Sequence
  dgRNA
  Sympk
aggcatggcgctcga

SEQ ID NO: 9490 - DNA, 15 bp, Artificial Sequence
  dgRNA
  Sympk
atggcgctcgaaggc

SEQ ID NO: 9491 - DNA, 15 bp, Artificial Sequence
  dgRNA
  Scg2
aaagctcgcctgcgc

SEQ ID NO: 9492 - DNA, 15 bp, Artificial Sequence
  dgRNA
  Scg2
aagctcgcctgcgct

SEQ ID NO: 9493 - DNA, 15 bp, Artificial Sequence
  dgRNA
  Scg2
agctcgcctgcgctg

SEQ ID NO: 9494 - DNA, 15 bp, Artificial Sequence
  dgRNA
  Scg2
ccggtgacgtcagcg

SEQ ID NO: 9495 - DNA, 15 bp, Artificial Sequence
  dgRNA
  Trip6
aagaccgaaacacta

SEQ ID NO: 9496 - DNA, 15 bp, Artificial Sequence
  dgRNA
  Trip6
agaccgaaacactat

SEQ ID NO: 9497 - DNA, 15 bp, Artificial Sequence
  dgRNA
  Trip6
cgaaacactatgggc

SEQ ID NO: 9498 - DNA, 15 bp, Artificial Sequence
  dgRNA
  Trip6
ggagagaaccgtgag

SEQ ID NO: 9499 - DNA, 15 bp, Artificial Sequence
  dgRNA
  Cdc6
actacacttcccgcc

SEQ ID NO: 9500 - DNA, 15 bp, Artificial Sequence
  dgRNA
  Cdc6
tcccgccaggcttta

SEQ ID NO: 9501 - DNA, 15 bp, Artificial Sequence
  dgRNA
  Cdc6
cgcgcctttcctccg

SEQ ID NO: 9502 - DNA, 15 bp, Artificial Sequence
  dgRNA
  Cdc6
aagttaacgccctcc

SEQ ID NO: 9503 - DNA, 15 bp, Artificial Sequence
  dgRNA
  Bet1l
tcctccccatccagt

SEQ ID NO: 9504 - DNA, 15 bp, Artificial Sequence
  dgRNA
  Bet1l
atttagcagcgccag

SEQ ID NO: 9505 - DNA, 15 bp, Artificial Sequence
  dgRNA
  Bet1l
taacacccacagcgc

SEQ ID NO: 9506 - DNA, 15 bp, Artificial Sequence
  dgRNA
  Bet1l
ttgctgaccaatccg

SEQ ID NO: 9507 - DNA, 15 bp, Artificial Sequence
  dgRNA
  Dcun1d2
gacgcagcgaacctc

SEQ ID NO: 9508 - DNA, 15 bp, Artificial Sequence
  dgRNA
  Dcun1d2
acgcagcgaacctca

SEQ ID NO: 9509 - DNA, 15 bp, Artificial Sequence
  dgRNA
  Dcun1d2
gggaccaggacaccg

SEQ ID NO: 9510 - DNA, 15 bp, Artificial Sequence
  dgRNA
  Dcun1d2
cttctgacgcgcagc

SEQ ID NO: 9511 - DNA, 15 bp, Artificial Sequence
  dgRNA
  Mef2b
gcatcttctctcgga

SEQ ID NO: 9512 - DNA, 15 bp, Artificial Sequence
  dgRNA
  Mef2b
tagtttgaaacgtct

SEQ ID NO: 9513 - DNA, 15 bp, Artificial Sequence
  dgRNA
  Mef2b
cccaatcagctcttg

SEQ ID NO: 9514 - DNA, 15 bp, Artificial Sequence
  dgRNA
  Mef2b
cagctcttgagggcg

SEQ ID NO: 9515 - DNA, 15 bp, Artificial Sequence
  dgRNA
  Zfp65
cttaggcaggtaccc

SEQ ID NO: 9516 - DNA, 15 bp, Artificial Sequence
  dgRNA
  Zfp65
tgcaccgaactcctt

SEQ ID NO: 9517 - DNA, 15 bp, Artificial Sequence
  dgRNA
  Zfp65
tatgacgactccaga

SEQ ID NO: 9518 - DNA, 15 bp, Artificial Sequence
  dgRNA
  Zfp65
atgacgactccagaa

SEQ ID NO: 9519 - DNA, 15 bp, Artificial Sequence
  dgRNA
  Snrpa
gcgggtggagcactt

SEQ ID NO: 9520 - DNA, 15 bp, Artificial Sequence
  dgRNA
  Snrpa
cgggtggagcacttc

SEQ ID NO: 9521 - DNA, 15 bp, Artificial Sequence
  dgRNA
  Snrpa
gtggagcacttcggg

SEQ ID NO: 9522 - DNA, 15 bp, Artificial Sequence
  dgRNA
  Snrpa
taggatgttccaagt

SEQ ID NO: 9523 - DNA, 15 bp, Artificial Sequence
  dgRNA
  Crnn
ccaaatgtggtagaa

SEQ ID NO: 9524 - DNA, 15 bp, Artificial Sequence
  dgRNA
  Crnn
atcaagcctgcttgt

SEQ ID NO: 9525 - DNA, 15 bp, Artificial Sequence
  dgRNA
  Crnn
tcaagcctgcttgta

SEQ ID NO: 9526 - DNA, 15 bp, Artificial Sequence
  dgRNA
  Crnn
ggcttgattcatcca

SEQ ID NO: 9527 - DNA, 15 bp, Artificial Sequence
  dgRNA
  Fpr-rs6
gattaccctcagaat

SEQ ID NO: 9528 - DNA, 15 bp, Artificial Sequence
  dgRNA
  Fpr-rs6
agagtacctattctg

SEQ ID NO: 9529 - DNA, 15 bp, Artificial Sequence
  dgRNA
  Fam175a
aagaagcaccctacc

SEQ ID NO: 9530 - DNA, 15 bp, Artificial Sequence
  dgRNA
  Fam175a
accctacccggctag

SEQ ID NO: 9531 - DNA, 15 bp, Artificial Sequence
  dgRNA
  Fam175a
acaacccgcgtctcc

SEQ ID NO: 9532 - DNA, 15 bp, Artificial Sequence
  dgRNA
  Fam175a
cgtctcccggtgcgc

SEQ ID NO: 9533 - DNA, 15 bp, Artificial Sequence
  dgRNA
  Endou
caggcaaacgtcata

SEQ ID NO: 9534 - DNA, 15 bp, Artificial Sequence
  dgRNA
  Endou
ataaggagtgcttac

SEQ ID NO: 9535 - DNA, 15 bp, Artificial Sequence
  dgRNA
  Endou
actcaccctcttaat

SEQ ID NO: 9536 - DNA, 15 bp, Artificial Sequence
  dgRNA
  Endou
ctcaccctcttaata

SEQ ID NO: 9537 - DNA, 15 bp, Artificial Sequence
  dgRNA
  Tlk2
cccccggcggccgcc

SEQ ID NO: 9538 - DNA, 15 bp, Artificial Sequence
  dgRNA
  Tlk2
cccgcgtcagccgcc

SEQ ID NO: 9539 - DNA, 15 bp, Artificial Sequence
  dgRNA
  Tlk2
gatctgcggcctccg

SEQ ID NO: 9540 - DNA, 15 bp, Artificial Sequence
  dgRNA
  Tlk2
ccgcccgccctgtcg

SEQ ID NO: 9541 - DNA, 15 bp, Artificial Sequence
  dgRNA
  Scube1
cgaccccagctctct

SEQ ID NO: 9542 - DNA, 15 bp, Artificial Sequence
  dgRNA
  Scube1
acctgccgccggccc

SEQ ID NO: 9543 - DNA, 15 bp, Artificial Sequence
  dgRNA
  Scube1
cctgccgccggcccc

SEQ ID NO: 9544 - DNA, 15 bp, Artificial Sequence
  dgRNA
  Scube1
cggccccgggagagg

SEQ ID NO: 9545 - DNA, 15 bp, Artificial Sequence
  dgRNA
  Dynlt1c
agcaggcgcggccga

SEQ ID NO: 9546 - DNA, 15 bp, Artificial Sequence
  dgRNA
  Dynlt1c
gcaggcgcggccgaa

SEQ ID NO: 9547 - DNA, 15 bp, Artificial Sequence
  dgRNA
  Dynlt1c
ggcgcggccgaaggg

SEQ ID NO: 9548 - DNA, 15 bp, Artificial Sequence
  dgRNA
  Dynlt1c
gcgcggccgaagggt

SEQ ID NO: 9549 - DNA, 15 bp, Artificial Sequence
  dgRNA
  Fam178a
cggccaaggccgccg

SEQ ID NO: 9550 - DNA, 15 bp, Artificial Sequence
  dgRNA
  Fam178a
gccgcggccccgacg

SEQ ID NO: 9551 - DNA, 15 bp, Artificial Sequence
  dgRNA
  Fam178a
ggaggcgcgcgcccc

SEQ ID NO: 9552 - DNA, 15 bp, Artificial Sequence
  dgRNA
  Fam178a
cccaggcgcacgtga

SEQ ID NO: 9553 - DNA, 15 bp, Artificial Sequence
  dgRNA
  Ankrd63
cgccgccgcattccc

SEQ ID NO: 9554 - DNA, 15 bp, Artificial Sequence
  dgRNA
  Ankrd63
gccgccgcattccca

SEQ ID NO: 9555 - DNA, 15 bp, Artificial Sequence
  dgRNA
  Ankrd63
ccgccgcattcccag

SEQ ID NO: 9556 - DNA, 15 bp, Artificial Sequence
  dgRNA
  Ankrd63
attcccaggggagcg

SEQ ID NO: 9557 - DNA, 15 bp, Artificial Sequence
  dgRNA
  Prss51
caagtcactatgcaa

SEQ ID NO: 9558 - DNA, 15 bp, Artificial Sequence
  dgRNA
  Prss51
aagggactgataacc

SEQ ID NO: 9559 - DNA, 15 bp, Artificial Sequence
  dgRNA
  Prss51
tgtgatgcacaactg

SEQ ID NO: 9560 - DNA, 15 bp, Artificial Sequence
  dgRNA
  Prss51
ctttgcatagtgact

SEQ ID NO: 9561 - DNA, 15 bp, Artificial Sequence
  dgRNA
  Zfp445
gtgaagacactcgca

SEQ ID NO: 9562 - DNA, 15 bp, Artificial Sequence
  dgRNA
  Zfp445
gtggcattatttgct

SEQ ID NO: 9563 - DNA, 15 bp, Artificial Sequence
  dgRNA
  Gas8
ccgccatgtagactc

SEQ ID NO: 9564 - DNA, 15 bp, Artificial Sequence
  dgRNA
  Gas8
ccgaggaaccacaat

SEQ ID NO: 9565 - DNA, 15 bp, Artificial Sequence
  dgRNA
  Gas8
tagcccaagttgtag

SEQ ID NO: 9566 - DNA, 15 bp, Artificial Sequence
  dgRNA
  Gas8
agcccaagttgtagt

SEQ ID NO: 9567 - DNA, 15 bp, Artificial Sequence
  dgRNA
  L1td1
gatttgcgccctaac

SEQ ID NO: 9568 - DNA, 15 bp, Artificial Sequence
  dgRNA
  L1td1
agcgagtatggcttc

SEQ ID NO: 9569 - DNA, 15 bp, Artificial Sequence
  dgRNA
  L1td1
gcgagtatggcttct

SEQ ID NO: 9570 - DNA, 15 bp, Artificial Sequence
  dgRNA
  L1td1
ggccaccacgccttg

SEQ ID NO: 9571 - DNA, 15 bp, Artificial Sequence
  dgRNA
  Tmem235
ccgtgcgctgctgtc

SEQ ID NO: 9572 - DNA, 15 bp, Artificial Sequence
  dgRNA
  Tmem235
tttaggcggtgggag

SEQ ID NO: 9573 - DNA, 15 bp, Artificial Sequence
  dgRNA
  Tmem235
gtttaggcggtggga

SEQ ID NO: 9574 - DNA, 15 bp, Artificial Sequence
  dgRNA
  Tmem235
ggtttaggcggtggg

SEQ ID NO: 9575 - DNA, 15 bp, Artificial Sequence
  dgRNA
  Nrip1
ctccgggtgcgcgct

SEQ ID NO: 9576 - DNA, 15 bp, Artificial Sequence
  dgRNA
  Nrip1
ggtgcgcgctcggcc

SEQ ID NO: 9577 - DNA, 15 bp, Artificial Sequence
  dgRNA
  Nrip1
gtgcgcgctcggccc

SEQ ID NO: 9578 - DNA, 15 bp, Artificial Sequence
  dgRNA
  Nrip1
cggcccgggtgacaa

SEQ ID NO: 9579 - DNA, 15 bp, Artificial Sequence
  dgRNA
  Dact3
gtctgatacccccgt

SEQ ID NO: 9580 - DNA, 15 bp, Artificial Sequence
  dgRNA
  Dact3
ccccgtaggtagtcc

SEQ ID NO: 9581 - DNA, 15 bp, Artificial Sequence
  dgRNA
  Dact3
cccgtaggtagtcct

SEQ ID NO: 9582 - DNA, 15 bp, Artificial Sequence
  dgRNA
  Dact3
gggcatgcgttgtta

SEQ ID NO: 9583 - DNA, 15 bp, Artificial Sequence
  dgRNA
  Cdk4
tcggcagtcagggta

SEQ ID NO: 9584 - DNA, 15 bp, Artificial Sequence
  dgRNA
  Cdk4
cccagcgcaaagtca

SEQ ID NO: 9585 - DNA, 15 bp, Artificial Sequence
  dgRNA
  Cdk4
ccagcgcaaagtcaa

SEQ ID NO: 9586 - DNA, 15 bp, Artificial Sequence
  dgRNA
  Cdk4
cagcgcaaagtcaag

SEQ ID NO: 9587 - DNA, 15 bp, Artificial Sequence
  dgRNA
  Pnma2
acctccgagcaaagt

SEQ ID NO: 9588 - DNA, 15 bp, Artificial Sequence
  dgRNA
  Pnma2
ttggatctgagcggg

SEQ ID NO: 9589 - DNA, 15 bp, Artificial Sequence
  dgRNA
  Pnma2
agcgggcggtcgctg

SEQ ID NO: 9590 - DNA, 15 bp, Artificial Sequence
  dgRNA
  Pnma2
cggtcgctgcggcag

SEQ ID NO: 9591 - DNA, 15 bp, Artificial Sequence
  dgRNA
  Scube3
aaaacagacggagcc

SEQ ID NO: 9592 - DNA, 15 bp, Artificial Sequence
  dgRNA
  Scube3
tgcgcgctcgctctc

SEQ ID NO: 9593 - DNA, 15 bp, Artificial Sequence
  dgRNA
  Scube3
gctttctcgtctccc

SEQ ID NO: 9594 - DNA, 15 bp, Artificial Sequence
  dgRNA
  Scube3
cgcagagccggagct

SEQ ID NO: 9595 - DNA, 15 bp, Artificial Sequence
  dgRNA
  Cyp3a57
ccagaactaccagtt

SEQ ID NO: 9596 - DNA, 15 bp, Artificial Sequence
  dgRNA
  Cyp3a57
gtcaaagtgccaaaa

SEQ ID NO: 9597 - DNA, 15 bp, Artificial Sequence
  dgRNA
  Cyp3a57
ccaaactggtagttc

SEQ ID NO: 9598 - DNA, 15 bp, Artificial Sequence
  dgRNA
  Cyp3a57
atatagcctgtacaa

SEQ ID NO: 9599 - DNA, 15 bp, Artificial Sequence
  dgRNA
  Zfat
cacagcgtcccgccc

SEQ ID NO: 9600 - DNA, 15 bp, Artificial Sequence
  dgRNA
  Zfat
acagcgtcccgcccc

SEQ ID NO: 9601 - DNA, 15 bp, Artificial Sequence
  dgRNA
  Zfat
gtcccgccccgggcg

SEQ ID NO: 9602 - DNA, 15 bp, Artificial Sequence
  dgRNA
  Zfat
cagcgcgcagaacgc

SEQ ID NO: 9603 - DNA, 15 bp, Artificial Sequence
  dgRNA
  Ctnnd1
gtttcctattggata

SEQ ID NO: 9604 - DNA, 15 bp, Artificial Sequence
  dgRNA
  Ctnnd1
tccctgatttatgcc

SEQ ID NO: 9605 - DNA, 15 bp, Artificial Sequence
  dgRNA
  Ctnnd1
ctattggaagctcgc

SEQ ID NO: 9606 - DNA, 15 bp, Artificial Sequence
  dgRNA
  Ctnnd1
tattggaagctcgca

SEQ ID NO: 9607 - DNA, 15 bp, Artificial Sequence
  dgRNA
  Rheb
tagctccccgctgag

SEQ ID NO: 9608 - DNA, 15 bp, Artificial Sequence
  dgRNA
  Rheb
atccccaatagaaga

SEQ ID NO: 9609 - DNA, 15 bp, Artificial Sequence
  dgRNA
  Rheb
cattgcgtcatcgcg

SEQ ID NO: 9610 - DNA, 15 bp, Artificial Sequence
  dgRNA
  Rheb
catcgcgcggcagtc

SEQ ID NO: 9611 - DNA, 15 bp, Artificial Sequence
  dgRNA
  Cdk2ap1
gcgcgggccaatgag

SEQ ID NO: 9612 - DNA, 15 bp, Artificial Sequence
  dgRNA
  Cdk2ap1
caatgagcggcgcgc

SEQ ID NO: 9613 - DNA, 15 bp, Artificial Sequence
  dgRNA
  Cdk2ap1
ccgcgcgccgctcat

SEQ ID NO: 9614 - DNA, 15 bp, Artificial Sequence
  dgRNA
  Cdk2ap1
gggctgcggtccccg

SEQ ID NO: 9615 - DNA, 15 bp, Artificial Sequence
  dgRNA
  3010026O09Rik
gaccaccgagacagt

SEQ ID NO: 9616 - DNA, 15 bp, Artificial Sequence
  dgRNA
  3010026O09Rik
acggagagacgcacc

SEQ ID NO: 9617 - DNA, 15 bp, Artificial Sequence
  dgRNA
  3010026O09Rik
cggagagacgcacca

SEQ ID NO: 9618 - DNA, 15 bp, Artificial Sequence
  dgRNA
  3010026O09Rik
ccagggcatgcgagg

SEQ ID NO: 9619 - DNA, 15 bp, Artificial Sequence
  dgRNA
  Mlh3
taattggaacccgcc

SEQ ID NO: 9620 - DNA, 15 bp, Artificial Sequence
  dgRNA
  Mlh3
gaacccgccaggtga

SEQ ID NO: 9621 - DNA, 15 bp, Artificial Sequence
  dgRNA
  Mlh3
aacccgccaggtgaa

SEQ ID NO: 9622 - DNA, 15 bp, Artificial Sequence
  dgRNA
  Mlh3
aagggacgcgcagct

SEQ ID NO: 9623 - DNA, 15 bp, Artificial Sequence
  dgRNA
  Acsm3
cattacctgttaaga

SEQ ID NO: 9624 - DNA, 15 bp, Artificial Sequence
  dgRNA
  Acsm3
tatatccaccaatta

SEQ ID NO: 9625 - DNA, 15 bp, Artificial Sequence
  dgRNA
  Acsm3
ccaccaattaaggaa

SEQ ID NO: 9626 - DNA, 15 bp, Artificial Sequence
  dgRNA
  Acsm3
agcaaccggaatccg

SEQ ID NO: 9627 - DNA, 15 bp, Artificial Sequence
  dgRNA
  Dazap1
cgtccctctcgcaag

SEQ ID NO: 9628 - DNA, 15 bp, Artificial Sequence
  dgRNA
  Dazap1
gtccctctcgcaagc

SEQ ID NO: 9629 - DNA, 15 bp, Artificial Sequence
  dgRNA
  Dazap1
gcgggcacgcacgcg

SEQ ID NO: 9630 - DNA, 15 bp, Artificial Sequence
  dgRNA
  Dazap1
cccggaggccccgtg

SEQ ID NO: 9631 - DNA, 15 bp, Artificial Sequence
  dgRNA
  Ephb2
atcatgactcgggcg

SEQ ID NO: 9632 - DNA, 15 bp, Artificial Sequence
  dgRNA
  Ephb2
gcgtggtgcaacccg

SEQ ID NO: 9633 - DNA, 15 bp, Artificial Sequence
  dgRNA
  Ephb2
cgtggtgcaacccgt

SEQ ID NO: 9634 - DNA, 15 bp, Artificial Sequence
  dgRNA
  Ephb2
aacccgtgggtgcac

SEQ ID NO: 9635 - DNA, 15 bp, Artificial Sequence
  dgRNA
  4930486L24Rik
ttgtggctacattcc

SEQ ID NO: 9636 - DNA, 15 bp, Artificial Sequence
  dgRNA
  4930486L24Rik
aatgtcaaggtctac

SEQ ID NO: 9637 - DNA, 15 bp, Artificial Sequence
  dgRNA
  4930486L24Rik
tccagtcacaatagg

SEQ ID NO: 9638 - DNA, 15 bp, Artificial Sequence
  dgRNA
  4930486L24Rik
cagtcacaataggag

SEQ ID NO: 9639 - DNA, 15 bp, Artificial Sequence
  dgRNA
  Fam118b
caggcgtacgcaagc

SEQ ID NO: 9640 - DNA, 15 bp, Artificial Sequence
  dgRNA
  Fam118b
aggcgtacgcaagca

SEQ ID NO: 9641 - DNA, 15 bp, Artificial Sequence
  dgRNA
  Fam118b
tacgcaagcagggcg

SEQ ID NO: 9642 - DNA, 15 bp, Artificial Sequence
  dgRNA
  Fam118b
agggcgcggccatct

SEQ ID NO: 9643 - DNA, 15 bp, Artificial Sequence
  dgRNA
  Eda
tcccacccctcggag

SEQ ID NO: 9644 - DNA, 15 bp, Artificial Sequence
  dgRNA
  Eda
cagccaccgtcgctc

SEQ ID NO: 9645 - DNA, 15 bp, Artificial Sequence
  dgRNA
  Eda
accgtcgctcaggaa

SEQ ID NO: 9646 - DNA, 15 bp, Artificial Sequence
  dgRNA
  Eda
ccgtcgctcaggaac

SEQ ID NO: 9647 - DNA, 15 bp, Artificial Sequence
  dgRNA
  Mob1a
gtcaccaagtagcgc

SEQ ID NO: 9648 - DNA, 15 bp, Artificial Sequence
  dgRNA
  Mob1a
ctggcagacgtccct

SEQ ID NO: 9649 - DNA, 15 bp, Artificial Sequence
  dgRNA
  Mob1a
gacgtccctcggcca

SEQ ID NO: 9650 - DNA, 15 bp, Artificial Sequence
  dgRNA
  Mob1a
cggaacagttgacag

SEQ ID NO: 9651 - DNA, 15 bp, Artificial Sequence
  dgRNA
  Polq
atccccagccgccag

SEQ ID NO: 9652 - DNA, 15 bp, Artificial Sequence
  dgRNA
  Polq
cccagccgccagcgg

SEQ ID NO: 9653 - DNA, 15 bp, Artificial Sequence
  dgRNA
  Polq
gccgccagcggaggc

SEQ ID NO: 9654 - DNA, 15 bp, Artificial Sequence
  dgRNA
  Polq
agccagatatcagcg

SEQ ID NO: 9655 - DNA, 15 bp, Artificial Sequence
  dgRNA
  Ppm1n
tagtgacccgacttc

SEQ ID NO: 9656 - DNA, 15 bp, Artificial Sequence
  dgRNA
  Ppm1n
acccgacttcaggcc

SEQ ID NO: 9657 - DNA, 15 bp, Artificial Sequence
  dgRNA
  Fitm2
cttgggggcgatgag

SEQ ID NO: 9658 - DNA, 15 bp, Artificial Sequence
  dgRNA
  Fitm2
ggcgatgagtggaag

SEQ ID NO: 9659 - DNA, 15 bp, Artificial Sequence
  dgRNA
  Fitm2
gagtggaagcggcgc

SEQ ID NO: 9660 - DNA, 15 bp, Artificial Sequence
  dgRNA
  Fitm2
catcaaggccactag

SEQ ID NO: 9661 - DNA, 15 bp, Artificial Sequence
  dgRNA
  Fbxw24
ctgatgaactatggt

SEQ ID NO: 9662 - DNA, 15 bp, Artificial Sequence
  dgRNA
  Fbxw24
caaccatagttcatc

SEQ ID NO: 9663 - DNA, 15 bp, Artificial Sequence
  dgRNA
  Nomo1
cgccagaggcgcaag

SEQ ID NO: 9664 - DNA, 15 bp, Artificial Sequence
  dgRNA
  Nomo1
aagcggccatcattc

SEQ ID NO: 9665 - DNA, 15 bp, Artificial Sequence
  dgRNA
  Nomo1
ggccatcattccggg

SEQ ID NO: 9666 - DNA, 15 bp, Artificial Sequence
  dgRNA
  Nomo1
gatcgcgtgtcgcgt

SEQ ID NO: 9667 - DNA, 15 bp, Artificial Sequence
  dgRNA
  Cyp4x1
gactggaaatcccga

SEQ ID NO: 9668 - DNA, 15 bp, Artificial Sequence
  dgRNA
  Cyp4x1
cacctcagttacacc

SEQ ID NO: 9669 - DNA, 15 bp, Artificial Sequence
  dgRNA
  Cyp4x1
acctcagttacacca

SEQ ID NO: 9670 - DNA, 15 bp, Artificial Sequence
  dgRNA
  Cyp4x1
ggttcacgccagctc

SEQ ID NO: 9671 - DNA, 15 bp, Artificial Sequence
  dgRNA
  Tex40
cttttggttaagttc

SEQ ID NO: 9672 - DNA, 15 bp, Artificial Sequence
  dgRNA
  Tex40
acccggactcgaaac

SEQ ID NO: 9673 - DNA, 15 bp, Artificial Sequence
  dgRNA
  Tex40
gactcgaaactggac

SEQ ID NO: 9674 - DNA, 15 bp, Artificial Sequence
  dgRNA
  Tex40
actcgaaactggact

SEQ ID NO: 9675 - DNA, 15 bp, Artificial Sequence
  dgRNA
  Chrna2
actatgtgttcccat

SEQ ID NO: 9676 - DNA, 15 bp, Artificial Sequence
  dgRNA
  Chrna2
ctatgtgttcccatt

SEQ ID NO: 9677 - DNA, 15 bp, Artificial Sequence
  dgRNA
  Chrna2
actatgaacctgttc

SEQ ID NO: 9678 - DNA, 15 bp, Artificial Sequence
  dgRNA
  Chrna2
tgaacctgttctggg

SEQ ID NO: 9679 - DNA, 15 bp, Artificial Sequence
  dgRNA
  Farsa
ccttaagtacatttg

SEQ ID NO: 9680 - DNA, 15 bp, Artificial Sequence
  dgRNA
  Farsa
ttgccacacttaaga

SEQ ID NO: 9681 - DNA, 15 bp, Artificial Sequence
  dgRNA
  Farsa
gcgccacactaaaaa

SEQ ID NO: 9682 - DNA, 15 bp, Artificial Sequence
  dgRNA
  Farsa
cgctatcgcgacttc

SEQ ID NO: 9683 - DNA, 15 bp, Artificial Sequence
  dgRNA
  Gid8
agttctgcgcaaaaa

SEQ ID NO: 9684 - DNA, 15 bp, Artificial Sequence
  dgRNA
  Gid8
cggaagttgagaccc

SEQ ID NO: 9685 - DNA, 15 bp, Artificial Sequence
  dgRNA
  Gid8
tttccggcgaccgcc

SEQ ID NO: 9686 - DNA, 15 bp, Artificial Sequence
  dgRNA
  Gid8
ttccggcgaccgccc

SEQ ID NO: 9687 - DNA, 15 bp, Artificial Sequence
  dgRNA
  Zfp729a
gctggaccgcaaggc

SEQ ID NO: 9688 - DNA, 15 bp, Artificial Sequence
  dgRNA
  Zfp729a
acaagacatcttagg

SEQ ID NO: 9689 - DNA, 15 bp, Artificial Sequence
  dgRNA
  Zfp729a
caagacatcttaggt

SEQ ID NO: 9690 - DNA, 15 bp, Artificial Sequence
  dgRNA
  Zfp729a
ttgcggtccagctgt

SEQ ID NO: 9691 - DNA, 15 bp, Artificial Sequence
  dgRNA
  Musk
gccgagaaaggcatc

SEQ ID NO: 9692 - DNA, 15 bp, Artificial Sequence
  dgRNA
  Musk
tgccaccgtcttaaa

SEQ ID NO: 9693 - DNA, 15 bp, Artificial Sequence
  dgRNA
  Musk
gccaccgtcttaaaa

SEQ ID NO: 9694 - DNA, 15 bp, Artificial Sequence
  dgRNA
  Musk
ctccacttgcattac

SEQ ID NO: 9695 - DNA, 15 bp, Artificial Sequence
  dgRNA
  Map3k6
tgtttggcccgaata

SEQ ID NO: 9696 - DNA, 15 bp, Artificial Sequence
  dgRNA
  Map3k6
gtttggcccgaatag

SEQ ID NO: 9697 - DNA, 15 bp, Artificial Sequence
  dgRNA
  Map3k6
cccgaataggggcac

SEQ ID NO: 9698 - DNA, 15 bp, Artificial Sequence
  dgRNA
  Map3k6
aggctgttccggaag

SEQ ID NO: 9699 - DNA, 15 bp, Artificial Sequence
  dgRNA
  Fen1
gaggctgttcgcgcc

SEQ ID NO: 9700 - DNA, 15 bp, Artificial Sequence
  dgRNA
  Fen1
cacgtgacgagagcg

SEQ ID NO: 9701 - DNA, 15 bp, Artificial Sequence
  dgRNA
  Fen1
acgtgacgagagcgc

SEQ ID NO: 9702 - DNA, 15 bp, Artificial Sequence
  dgRNA
  Fen1
cgagagcgcgggctt

SEQ ID NO: 9703 - DNA, 15 bp, Artificial Sequence
  dgRNA
  Trnau1ap
atagacgcatttgcg

SEQ ID NO: 9704 - DNA, 15 bp, Artificial Sequence
  dgRNA
  Trnau1ap
ttttattaaagagcg

SEQ ID NO: 9705 - DNA, 15 bp, Artificial Sequence
  dgRNA
  Trnau1ap
gagccggtgccagct

SEQ ID NO: 9706 - DNA, 15 bp, Artificial Sequence
  dgRNA
  Trnau1ap
actgtgccccagccg

SEQ ID NO: 9707 - DNA, 15 bp, Artificial Sequence
  dgRNA
  Ift22
ccttccagaacgctc

SEQ ID NO: 9708 - DNA, 15 bp, Artificial Sequence
  dgRNA
  Ift22
caggttgcagttagc

SEQ ID NO: 9709 - DNA, 15 bp, Artificial Sequence
  dgRNA
  Ift22
ctcagcttccatcgt

SEQ ID NO: 9710 - DNA, 15 bp, Artificial Sequence
  dgRNA
  Ift22
gctcccggaactgtc

SEQ ID NO: 9711 - DNA, 15 bp, Artificial Sequence
  dgRNA
  Tnfrsf4
tcgtgtgcatatgtt

SEQ ID NO: 9712 - DNA, 15 bp, Artificial Sequence
  dgRNA
  Tnfrsf4
cttcacgttccccag

SEQ ID NO: 9713 - DNA, 15 bp, Artificial Sequence
  dgRNA
  Tnfrsf4
tgctttgggccgctg

SEQ ID NO: 9714 - DNA, 15 bp, Artificial Sequence
  dgRNA
  Tnfrsf4
gtgctttgggccgct

SEQ ID NO: 9715 - DNA, 15 bp, Artificial Sequence
  dgRNA
  Tpm3
accattttagtaaat

SEQ ID NO: 9716 - DNA, 15 bp, Artificial Sequence
  dgRNA
  Tpm3
tgttacgagacagcc

SEQ ID NO: 9717 - DNA, 15 bp, Artificial Sequence
  dgRNA
  Tpm3
tacgagacagcctgg

SEQ ID NO: 9718 - DNA, 15 bp, Artificial Sequence
  dgRNA
  Tpm3
acgagacagcctggt

SEQ ID NO: 9719 - DNA, 15 bp, Artificial Sequence
  dgRNA
  Epb41l1
gcggggaaagagcgg

SEQ ID NO: 9720 - DNA, 15 bp, Artificial Sequence
  dgRNA
  Epb41l1
tgggcgccgcgagcg

SEQ ID NO: 9721 - DNA, 15 bp, Artificial Sequence
  dgRNA
  Epb41l1
gcgccgcgagcgagg

SEQ ID NO: 9722 - DNA, 15 bp, Artificial Sequence
  dgRNA
  Epb41l1
cgcgagcgaggaggc

SEQ ID NO: 9723 - DNA, 15 bp, Artificial Sequence
  dgRNA
  Arhgap27
gatccaagctgtgtc

SEQ ID NO: 9724 - DNA, 15 bp, Artificial Sequence
  dgRNA
  Arhgap27
aatccaatgtgtcac

SEQ ID NO: 9725 - DNA, 15 bp, Artificial Sequence
  dgRNA
  Arhgap27
ttccgcagccctgac

SEQ ID NO: 9726 - DNA, 15 bp, Artificial Sequence
  dgRNA
  Arhgap27
acagagttgcctgat

SEQ ID NO: 9727 - DNA, 15 bp, Artificial Sequence
  dgRNA
  Tmco2
ctgtcattgtaggat

SEQ ID NO: 9728 - DNA, 15 bp, Artificial Sequence
  dgRNA
  Tmco2
ggccagtcttggttc

SEQ ID NO: 9729 - DNA, 15 bp, Artificial Sequence
  dgRNA
  Tmem97
agcgcacgcagcccg

SEQ ID NO: 9730 - DNA, 15 bp, Artificial Sequence
  dgRNA
  Tmem97
gcgcacccgccgacg

SEQ ID NO: 9731 - DNA, 15 bp, Artificial Sequence
  dgRNA
  Tmem97
tatagccccgctata

SEQ ID NO: 9732 - DNA, 15 bp, Artificial Sequence
  dgRNA
  Tmem97
atagccccgctatat

SEQ ID NO: 9733 - DNA, 15 bp, Artificial Sequence
  dgRNA
  Ankrd23
gtagtgggtgtccaa

SEQ ID NO: 9734 - DNA, 15 bp, Artificial Sequence
  dgRNA
  Ankrd23
ttttcccgcccccag

SEQ ID NO: 9735 - DNA, 15 bp, Artificial Sequence
  dgRNA
  Ankrd23
tttcccgcccccagt

SEQ ID NO: 9736 - DNA, 15 bp, Artificial Sequence
  dgRNA
  Ankrd23
cccagaacggtattt

SEQ ID NO: 9737 - DNA, 15 bp, Artificial Sequence
  dgRNA
  Nenf
ggggggcaagttact

SEQ ID NO: 9738 - DNA, 15 bp, Artificial Sequence
  dgRNA
  Nenf
caagttactcgggcc

SEQ ID NO: 9739 - DNA, 15 bp, Artificial Sequence
  dgRNA
  Nenf
tacaggctatgtagt

SEQ ID NO: 9740 - DNA, 15 bp, Artificial Sequence
  dgRNA
  Nenf
tacactagtggcacc

SEQ ID NO: 9741 - DNA, 15 bp, Artificial Sequence
  dgRNA
  Lims1
cactaacacgtgaaa

SEQ ID NO: 9742 - DNA, 15 bp, Artificial Sequence
  dgRNA
  Lims1
cacgtgaaatggttt

SEQ ID NO: 9743 - DNA, 15 bp, Artificial Sequence
  dgRNA
  Lims1
acgtgaaatggtttt

SEQ ID NO: 9744 - DNA, 15 bp, Artificial Sequence
  dgRNA
  Lims1
gctgggtgacgcatg

SEQ ID NO: 9745 - DNA, 15 bp, Artificial Sequence
  dgRNA
  Cacna1a
tcttcttctccggag

SEQ ID NO: 9746 - DNA, 15 bp, Artificial Sequence
  dgRNA
  Cacna1a
cttcttctccggagt

SEQ ID NO: 9747 - DNA, 15 bp, Artificial Sequence
  dgRNA
  Cacna1a
cttctccggagtggg

SEQ ID NO: 9748 - DNA, 15 bp, Artificial Sequence
  dgRNA
  Cacna1a
tccggagtgggtggc

SEQ ID NO: 9749 - DNA, 15 bp, Artificial Sequence
  dgRNA
  Thra
gggcgagtctgagcc

SEQ ID NO: 9750 - DNA, 15 bp, Artificial Sequence
  dgRNA
  Thra
gtctgagcctggtag

SEQ ID NO: 9751 - DNA, 15 bp, Artificial Sequence
  dgRNA
  Thra
gcctggtaggggcca

SEQ ID NO: 9752 - DNA, 15 bp, Artificial Sequence
  dgRNA
  Thra
gggccaaggcggtag

SEQ ID NO: 9753 - DNA, 15 bp, Artificial Sequence
  dgRNA
  Vmn1r42
gaacagcatcgtatt

SEQ ID NO: 9754 - DNA, 15 bp, Artificial Sequence
  dgRNA
  Vmn1r42
cgatcctgtgtccta

SEQ ID NO: 9755 - DNA, 15 bp, Artificial Sequence
  dgRNA
  Kcnn3
cgttgcgctgccacc

SEQ ID NO: 9756 - DNA, 15 bp, Artificial Sequence
  dgRNA
  Kcnn3
cgctgccacccggcg

SEQ ID NO: 9757 - DNA, 15 bp, Artificial Sequence
  dgRNA
  Kcnn3
cccggcgaggagcga

SEQ ID NO: 9758 - DNA, 15 bp, Artificial Sequence
  dgRNA
  Kcnn3
gaggcggagtttgga

SEQ ID NO: 9759 - DNA, 15 bp, Artificial Sequence
  dgRNA
  Rgs13
caatgtgcagcctaa

SEQ ID NO: 9760 - DNA, 15 bp, Artificial Sequence
  dgRNA
  AI593442
gtaagaccactcccg

SEQ ID NO: 9761 - DNA, 15 bp, Artificial Sequence
  dgRNA
  AI593442
tcccgcggcctgcgc

SEQ ID NO: 9762 - DNA, 15 bp, Artificial Sequence
  dgRNA
  AI593442
ctgcgcaggcacctc

SEQ ID NO: 9763 - DNA, 15 bp, Artificial Sequence
  dgRNA
  AI593442
cgcaggccgcgggag

SEQ ID NO: 9764 - DNA, 15 bp, Artificial Sequence
  dgRNA
  Cdc42bpa
ccgggagaagccggg

SEQ ID NO: 9765 - DNA, 15 bp, Artificial Sequence
  dgRNA
  Cdc42bpa
ctcgccgcagtccgc

SEQ ID NO: 9766 - DNA, 15 bp, Artificial Sequence
  dgRNA
  Cdc42bpa
tcgctgcaaagccct

SEQ ID NO: 9767 - DNA, 15 bp, Artificial Sequence
  dgRNA
  Cdc42bpa
aagagctcggagcgg

SEQ ID NO: 9768 - DNA, 15 bp, Artificial Sequence
  dgRNA
  Erich5
gcaggtctagcagtt

SEQ ID NO: 9769 - DNA, 15 bp, Artificial Sequence
  dgRNA
  Erich5
ttcgagttatgtaag

SEQ ID NO: 9770 - DNA, 15 bp, Artificial Sequence
  dgRNA
  Erich5
ccccccagctattta

SEQ ID NO: 9771 - DNA, 15 bp, Artificial Sequence
  dgRNA
  Erich5
aacacagttaccata

SEQ ID NO: 9772 - DNA, 15 bp, Artificial Sequence
  dgRNA
  Fzd6
cctgggtctcacgcc

SEQ ID NO: 9773 - DNA, 15 bp, Artificial Sequence
  dgRNA
  Fzd6
ctgggtctcacgcct

SEQ ID NO: 9774 - DNA, 15 bp, Artificial Sequence
  dgRNA
  Fzd6
tcacgcctgggtccg

SEQ ID NO: 9775 - DNA, 15 bp, Artificial Sequence
  dgRNA
  Fzd6
ggtccgcggtgcgag

SEQ ID NO: 9776 - DNA, 15 bp, Artificial Sequence
  dgRNA
  Lsp1
acctcaacctgctac

SEQ ID NO: 9777 - DNA, 15 bp, Artificial Sequence
  dgRNA
  Lsp1
aaacctatggggctt

SEQ ID NO: 9778 - DNA, 15 bp, Artificial Sequence
  dgRNA
  Lsp1
tcctgtagcaggttg

SEQ ID NO: 9779 - DNA, 15 bp, Artificial Sequence
  dgRNA
  Fam64a
tcggtaacagtgatc

SEQ ID NO: 9780 - DNA, 15 bp, Artificial Sequence
  dgRNA
  Fam64a
gtaacagtgatccgg

SEQ ID NO: 9781 - DNA, 15 bp, Artificial Sequence
  dgRNA
  Fam64a
gatccggtggcgacc

SEQ ID NO: 9782 - DNA, 15 bp, Artificial Sequence
  dgRNA
  Fam64a
cctctgcggcgagcc

SEQ ID NO: 9783 - DNA, 15 bp, Artificial Sequence
  dgRNA
  Daxx
gcttcggcaagctcc

SEQ ID NO: 9784 - DNA, 15 bp, Artificial Sequence
  dgRNA
  Daxx
ctccacgcctcgccg

SEQ ID NO: 9785 - DNA, 15 bp, Artificial Sequence
  dgRNA
  Daxx
gcctcgccgcggagc

SEQ ID NO: 9786 - DNA, 15 bp, Artificial Sequence
  dgRNA
  Daxx
cgccgcggagcaggc

SEQ ID NO: 9787 - DNA, 15 bp, Artificial Sequence
  dgRNA
  Fam160b1
gccccgccctcaagt

SEQ ID NO: 9788 - DNA, 15 bp, Artificial Sequence
  dgRNA
  Fam160b1
cgcgtccagcgacgc

SEQ ID NO: 9789 - DNA, 15 bp, Artificial Sequence
  dgRNA
  Fam160b1
cagcgacgccggcag

SEQ ID NO: 9790 - DNA, 15 bp, Artificial Sequence
  dgRNA
  Fam160b1
ccggcagcggagacc

SEQ ID NO: 9791 - DNA, 15 bp, Artificial Sequence
  dgRNA
  Nfkbiz
ccgccggaaaacaac

SEQ ID NO: 9792 - DNA, 15 bp, Artificial Sequence
  dgRNA
  Nfkbiz
cggaaaacaaccggt

SEQ ID NO: 9793 - DNA, 15 bp, Artificial Sequence
  dgRNA
  Nfkbiz
aacaaccggtcggcc

SEQ ID NO: 9794 - DNA, 15 bp, Artificial Sequence
  dgRNA
  Nfkbiz
acaaccggtcggccc

SEQ ID NO: 9795 - DNA, 15 bp, Artificial Sequence
  dgRNA
  Ffar1
ctaagagcggtactg

SEQ ID NO: 9796 - DNA, 15 bp, Artificial Sequence
  dgRNA
  Ffar1
agagcggtactgtgg

SEQ ID NO: 9797 - DNA, 15 bp, Artificial Sequence
  dgRNA
  Ffar1
atgctgacccgagtt

SEQ ID NO: 9798 - DNA, 15 bp, Artificial Sequence
  dgRNA
  Ffar1
agttcggttgctctc

SEQ ID NO: 9799 - DNA, 15 bp, Artificial Sequence
  dgRNA
  Elfn1
tgatctcacgcctcc

SEQ ID NO: 9800 - DNA, 15 bp, Artificial Sequence
  dgRNA
  Elfn1
cggcctctcagccca

SEQ ID NO: 9801 - DNA, 15 bp, Artificial Sequence
  dgRNA
  Elfn1
ggggtcggtgacctt

SEQ ID NO: 9802 - DNA, 15 bp, Artificial Sequence
  dgRNA
  Elfn1
gagaatgttgcatct

SEQ ID NO: 9803 - DNA, 15 bp, Artificial Sequence
  dgRNA
  Cnnm3
cgcttgtttactccc

SEQ ID NO: 9804 - DNA, 15 bp, Artificial Sequence
  dgRNA
  Cnnm3
ccgccagccgcttat

SEQ ID NO: 9805 - DNA, 15 bp, Artificial Sequence
  dgRNA
  Cnnm3
ttggtcaaagtgacg

SEQ ID NO: 9806 - DNA, 15 bp, Artificial Sequence
  dgRNA
  Cnnm3
gtcaaagtgacgcgg

SEQ ID NO: 9807 - DNA, 15 bp, Artificial Sequence
  dgRNA
  Zfp948
ggagggacgtgttcg

SEQ ID NO: 9808 - DNA, 15 bp, Artificial Sequence
  dgRNA
  Zfp948
gagggacgtgttcgc

SEQ ID NO: 9809 - DNA, 15 bp, Artificial Sequence
  dgRNA
  Zfp948
agggacgtgttcgcg

SEQ ID NO: 9810 - DNA, 15 bp, Artificial Sequence
  dgRNA
  Zfp948
acgtgttcgcggggc

SEQ ID NO: 9811 - DNA, 15 bp, Artificial Sequence
  dgRNA
  Agbl4
attttgattggcacc

SEQ ID NO: 9812 - DNA, 15 bp, Artificial Sequence
  dgRNA
  Agbl4
gcaagctcaatcccc

SEQ ID NO: 9813 - DNA, 15 bp, Artificial Sequence
  dgRNA
  Agbl4
cacttcagagcttga

SEQ ID NO: 9814 - DNA, 15 bp, Artificial Sequence
  dgRNA
  Agbl4
ggcggtatgctcgtg

SEQ ID NO: 9815 - DNA, 15 bp, Artificial Sequence
  dgRNA
  Spata32
acatgccatatcccc

SEQ ID NO: 9816 - DNA, 15 bp, Artificial Sequence
  dgRNA
  Spata32
aagccgcagcatcac

SEQ ID NO: 9817 - DNA, 15 bp, Artificial Sequence
  dgRNA
  Spata32
ccggaccaagacttg

SEQ ID NO: 9818 - DNA, 15 bp, Artificial Sequence
  dgRNA
  Spata32
cccggaccaagactt

SEQ ID NO: 9819 - DNA, 15 bp, Artificial Sequence
  dgRNA
  Fnbp4
ttggctaacagcgca

SEQ ID NO: 9820 - DNA, 15 bp, Artificial Sequence
  dgRNA
  Fnbp4
aagtcgcacacaccg

SEQ ID NO: 9821 - DNA, 15 bp, Artificial Sequence
  dgRNA
  Fnbp4
agtcgcacacaccgc

SEQ ID NO: 9822 - DNA, 15 bp, Artificial Sequence
  dgRNA
  Fnbp4
gcccttccgcactat

SEQ ID NO: 9823 - DNA, 15 bp, Artificial Sequence
  dgRNA
  Ctnnbip1
tcctttcccgctcta

SEQ ID NO: 9824 - DNA, 15 bp, Artificial Sequence
  dgRNA
  Ctnnbip1
cctttcccgctctag

SEQ ID NO: 9825 - DNA, 15 bp, Artificial Sequence
  dgRNA
  Ctnnbip1
cagggtacctccctc

SEQ ID NO: 9826 - DNA, 15 bp, Artificial Sequence
  dgRNA
  Ctnnbip1
agggtacctccctct

SEQ ID NO: 9827 - DNA, 15 bp, Artificial Sequence
  dgRNA
  Espn
agccaccaaggtagc

SEQ ID NO: 9828 - DNA, 15 bp, Artificial Sequence
  dgRNA
  Espn
tagctggcccagaaa

SEQ ID NO: 9829 - DNA, 15 bp, Artificial Sequence
  dgRNA
  Espn
tgctgagccgttacc

SEQ ID NO: 9830 - DNA, 15 bp, Artificial Sequence
  dgRNA
  Espn
gctaccttggtggct

SEQ ID NO: 9831 - DNA, 15 bp, Artificial Sequence
  dgRNA
  Cycs
acgccttacgtccta

SEQ ID NO: 9832 - DNA, 15 bp, Artificial Sequence
  dgRNA
  Cycs
cctgtcgtaagtgtc

SEQ ID NO: 9833 - DNA, 15 bp, Artificial Sequence
  dgRNA
  Cycs
agtgtcgggcaaacg

SEQ ID NO: 9834 - DNA, 15 bp, Artificial Sequence
  dgRNA
  Cycs
aaacgaggcctctga

SEQ ID NO: 9835 - DNA, 15 bp, Artificial Sequence
  dgRNA
  Cbr1
aacggagttcaggta

SEQ ID NO: 9836 - DNA, 15 bp, Artificial Sequence
  dgRNA
  Cbr1
agccacgccccccgt

SEQ ID NO: 9837 - DNA, 15 bp, Artificial Sequence
  dgRNA
  Cbr1
acgccccccgtaggg

SEQ ID NO: 9838 - DNA, 15 bp, Artificial Sequence
  dgRNA
  Cbr1
cgccccccgtaggga

SEQ ID NO: 9839 - DNA, 15 bp, Artificial Sequence
  dgRNA
  Cmklr1
ttgtgcgcccagaca

SEQ ID NO: 9840 - DNA, 15 bp, Artificial Sequence
  dgRNA
  Cmklr1
tgtgcgcccagacaa

SEQ ID NO: 9841 - DNA, 15 bp, Artificial Sequence
  dgRNA
  Cmklr1
gtgcgcccagacaag

SEQ ID NO: 9842 - DNA, 15 bp, Artificial Sequence
  dgRNA
  Cmklr1
cgcccagacaagggg

SEQ ID NO: 9843 - DNA, 15 bp, Artificial Sequence
  dgRNA
  C8a
cattttgaaggcgtt

SEQ ID NO: 9844 - DNA, 15 bp, Artificial Sequence
  dgRNA
  C8a
ggctaatcaatacct

SEQ ID NO: 9845 - DNA, 15 bp, Artificial Sequence
  dgRNA
  C8a
atccggtagacaatt

SEQ ID NO: 9846 - DNA, 15 bp, Artificial Sequence
  dgRNA
  C8a
tccggtagacaattt

SEQ ID NO: 9847 - DNA, 15 bp, Artificial Sequence
  dgRNA
  Galk2
atctgctgaacatta

SEQ ID NO: 9848 - DNA, 15 bp, Artificial Sequence
  dgRNA
  Galk2
ggatgggtcttcaac

SEQ ID NO: 9849 - DNA, 15 bp, Artificial Sequence
  dgRNA
  Galk2
gatgggtcttcaact

SEQ ID NO: 9850 - DNA, 15 bp, Artificial Sequence
  dgRNA
  Galk2
gtactcagccacatc

SEQ ID NO: 9851 - DNA, 15 bp, Artificial Sequence
  dgRNA
  Ankrd61
ctagaactgagccaa

SEQ ID NO: 9852 - DNA, 15 bp, Artificial Sequence
  dgRNA
  Tmem68
acacatttcgttatc

SEQ ID NO: 9853 - DNA, 15 bp, Artificial Sequence
  dgRNA
  Tmem68
cacatttcgttatcc

SEQ ID NO: 9854 - DNA, 15 bp, Artificial Sequence
  dgRNA
  Tmem68
tatccgggctcgctc

SEQ ID NO: 9855 - DNA, 15 bp, Artificial Sequence
  dgRNA
  Tmem68
ggtgttgtccgcgac

SEQ ID NO: 9856 - DNA, 15 bp, Artificial Sequence
  dgRNA
  Ccdc82
tctgaccctgttccg

SEQ ID NO: 9857 - DNA, 15 bp, Artificial Sequence
  dgRNA
  Ccdc82
gaccctgttccgggg

SEQ ID NO: 9858 - DNA, 15 bp, Artificial Sequence
  dgRNA
  Ccdc82
accctgttccggggc

SEQ ID NO: 9859 - DNA, 15 bp, Artificial Sequence
  dgRNA
  Ccdc82
tgttccggggcggga

SEQ ID NO: 9860 - DNA, 15 bp, Artificial Sequence
  dgRNA
  Cyp51
tttttccaagattcg

SEQ ID NO: 9861 - DNA, 15 bp, Artificial Sequence
  dgRNA
  Cyp51
caagattcgtggtgc

SEQ ID NO: 9862 - DNA, 15 bp, Artificial Sequence
  dgRNA
  Cyp51
aagattcgtggtgca

SEQ ID NO: 9863 - DNA, 15 bp, Artificial Sequence
  dgRNA
  Cyp51
gtgcagggctcacga

SEQ ID NO: 9864 - DNA, 15 bp, Artificial Sequence
  dgRNA
  Psma8
aaaggcgctcagact

SEQ ID NO: 9865 - DNA, 15 bp, Artificial Sequence
  dgRNA
  Psma8
aaggcgctcagactt

SEQ ID NO: 9866 - DNA, 15 bp, Artificial Sequence
  dgRNA
  Psma8
aggcgctcagacttg

SEQ ID NO: 9867 - DNA, 15 bp, Artificial Sequence
  dgRNA
  Psma8
gcgctcagacttggg

SEQ ID NO: 9868 - DNA, 15 bp, Artificial Sequence
  dgRNA
  Cntnap5a
tgcttaccagcaagt

SEQ ID NO: 9869 - DNA, 15 bp, Artificial Sequence
  dgRNA
  Cntnap5a
acatcctagcgacca

SEQ ID NO: 9870 - DNA, 15 bp, Artificial Sequence
  dgRNA
  Cntnap5a
accaaggatccgccc

SEQ ID NO: 9871 - DNA, 15 bp, Artificial Sequence
  dgRNA
  Cntnap5a
tggctggctcagccg

SEQ ID NO: 9872 - DNA, 15 bp, Artificial Sequence
  dgRNA
  Diablo
gcactggagcctgcg

SEQ ID NO: 9873 - DNA, 15 bp, Artificial Sequence
  dgRNA
  Diablo
gaccggcgacgaagt

SEQ ID NO: 9874 - DNA, 15 bp, Artificial Sequence
  dgRNA
  Diablo
gcgacgaagtcggag

SEQ ID NO: 9875 - DNA, 15 bp, Artificial Sequence
  dgRNA
  Diablo
cgaagtcggagcggt

SEQ ID NO: 9876 - DNA, 15 bp, Artificial Sequence
  dgRNA
  Sncb
ccggctgcacgtcag

SEQ ID NO: 9877 - DNA, 15 bp, Artificial Sequence
  dgRNA
  Sncb
gaggctcgcctgctc

SEQ ID NO: 9878 - DNA, 15 bp, Artificial Sequence
  dgRNA
  Sncb
cgccccctgtcagtc

SEQ ID NO: 9879 - DNA, 15 bp, Artificial Sequence
  dgRNA
  Sncb
attatgcggttggct

SEQ ID NO: 9880 - DNA, 15 bp, Artificial Sequence
  dgRNA
  Hsfy2
ggcataatgatcacc

SEQ ID NO: 9881 - DNA, 15 bp, Artificial Sequence
  dgRNA
  Hsfy2
atcacttagggctcc

SEQ ID NO: 9882 - DNA, 15 bp, Artificial Sequence
  dgRNA
  Hsfy2
gtgactacatcataa

SEQ ID NO: 9883 - DNA, 15 bp, Artificial Sequence
  dgRNA
  Hsfy2
gtagtcctacacaga

SEQ ID NO: 9884 - DNA, 15 bp, Artificial Sequence
  dgRNA
  Olfr1413
cagcatgtcgagaat

SEQ ID NO: 9885 - DNA, 15 bp, Artificial Sequence
  dgRNA
  Olfr1413
gtcgagaattggttc

SEQ ID NO: 9886 - DNA, 15 bp, Artificial Sequence
  dgRNA
  Olfr1413
tcgagaattggttct

SEQ ID NO: 9887 - DNA, 15 bp, Artificial Sequence
  dgRNA
  Olfr1413
caaaaagcctgctaa

SEQ ID NO: 9888 - DNA, 15 bp, Artificial Sequence
  dgRNA
  Lyve1
cagcctgggcgttca

SEQ ID NO: 9889 - DNA, 15 bp, Artificial Sequence
  dgRNA
  Lyve1
agcctgggcgttcaa

SEQ ID NO: 9890 - DNA, 15 bp, Artificial Sequence
  dgRNA
  Lyve1
gcacacgggtgagga

SEQ ID NO: 9891 - DNA, 15 bp, Artificial Sequence
  dgRNA
  Lyve1
atcccttgaacgccc

SEQ ID NO: 9892 - DNA, 15 bp, Artificial Sequence
  dgRNA
  P2ry2
gaccgcgtccccaag

SEQ ID NO: 9893 - DNA, 15 bp, Artificial Sequence
  dgRNA
  P2ry2
accgcgtccccaagc

SEQ ID NO: 9894 - DNA, 15 bp, Artificial Sequence
  dgRNA
  P2ry2
gcgtccccaagcggg

SEQ ID NO: 9895 - DNA, 15 bp, Artificial Sequence
  dgRNA
  P2ry2
aagcgggtggcagac

SEQ ID NO: 9896 - DNA, 15 bp, Artificial Sequence
  dgRNA
  Ccdc24
gggtctgctcatagt

SEQ ID NO: 9897 - DNA, 15 bp, Artificial Sequence
  dgRNA
  Ccdc24
agcacaattctggtg

SEQ ID NO: 9898 - DNA, 15 bp, Artificial Sequence
  dgRNA
  Ccdc24
gcacaattctggtgt

SEQ ID NO: 9899 - DNA, 15 bp, Artificial Sequence
  dgRNA
  Ccdc24
ggtatcgatgtcagc

SEQ ID NO: 9900 - DNA, 15 bp, Artificial Sequence
  dgRNA
  Tcea3
cttacacaccccctg

SEQ ID NO: 9901 - DNA, 15 bp, Artificial Sequence
  dgRNA
  Tcea3
gaggcacgacccgcc

SEQ ID NO: 9902 - DNA, 15 bp, Artificial Sequence
  dgRNA
  Tcea3
cgacccgccaggctc

SEQ ID NO: 9903 - DNA, 15 bp, Artificial Sequence
  dgRNA
  Tcea3
caggcaatctttgcc

SEQ ID NO: 9904 - DNA, 15 bp, Artificial Sequence
  dgRNA
  Slc17a5
tgggctccctaccgc

SEQ ID NO: 9905 - DNA, 15 bp, Artificial Sequence
  dgRNA
  Slc17a5
tgcccgaaactaaaa

SEQ ID NO: 9906 - DNA, 15 bp, Artificial Sequence
  dgRNA
  Slc17a5
ctaaaatggcgcctt

SEQ ID NO: 9907 - DNA, 15 bp, Artificial Sequence
  dgRNA
  Slc17a5
tggcgccttaggaac

SEQ ID NO: 9908 - DNA, 15 bp, Artificial Sequence
  dgRNA
  Tmem54
tcccagcacggccga

SEQ ID NO: 9909 - DNA, 15 bp, Artificial Sequence
  dgRNA
  Tmem54
agcctcaatgtccat

SEQ ID NO: 9910 - DNA, 15 bp, Artificial Sequence
  dgRNA
  Tmem54
ctcaatgtccatcgg

SEQ ID NO: 9911 - DNA, 15 bp, Artificial Sequence
  dgRNA
  Tmem54
tgtccatcggtggaa

SEQ ID NO: 9912 - DNA, 15 bp, Artificial Sequence
  dgRNA
  Nfe2l2
cggccggaagcactc

SEQ ID NO: 9913 - DNA, 15 bp, Artificial Sequence
  dgRNA
  Nfe2l2
tccatgccccgccct

SEQ ID NO: 9914 - DNA, 15 bp, Artificial Sequence
  dgRNA
  Nfe2l2
cccttgccccgccct

SEQ ID NO: 9915 - DNA, 15 bp, Artificial Sequence
  dgRNA
  Nfe2l2
cgccctaggcctttg

SEQ ID NO: 9916 - DNA, 15 bp, Artificial Sequence
  dgRNA
  Dsn1
gagaggtcaatcccc

SEQ ID NO: 9917 - DNA, 15 bp, Artificial Sequence
  dgRNA
  Dsn1
gtcaatccccaggcc

SEQ ID NO: 9918 - DNA, 15 bp, Artificial Sequence
  dgRNA
  Dsn1
tgcttgatctgtagc

SEQ ID NO: 9919 - DNA, 15 bp, Artificial Sequence
  dgRNA
  Dsn1
gtagctgggtgaaaa

SEQ ID NO: 9920 - DNA, 15 bp, Artificial Sequence
  dgRNA
  E2f5
aaaccttccgggacg

SEQ ID NO: 9921 - DNA, 15 bp, Artificial Sequence
  dgRNA
  E2f5
tacttgcacctgatc

SEQ ID NO: 9922 - DNA, 15 bp, Artificial Sequence
  dgRNA
  E2f5
agggatgagcgctcc

SEQ ID NO: 9923 - DNA, 15 bp, Artificial Sequence
  dgRNA
  E2f5
agcacgctccgcctg

SEQ ID NO: 9924 - DNA, 15 bp, Artificial Sequence
  dgRNA
  Smad7
gaggcggcgagccct

SEQ ID NO: 9925 - DNA, 15 bp, Artificial Sequence
  dgRNA
  Smad7
cattcgctcgctgat

SEQ ID NO: 9926 - DNA, 15 bp, Artificial Sequence
  dgRNA
  Smad7
ctgatcggcgcacag

SEQ ID NO: 9927 - DNA, 15 bp, Artificial Sequence
  dgRNA
  Smad7
gccgggcgcctcgct

SEQ ID NO: 9928 - DNA, 15 bp, Artificial Sequence
  dgRNA
  Olfr553
agtgacctttcaagt

SEQ ID NO: 9929 - DNA, 15 bp, Artificial Sequence
  dgRNA
  Olfr553
gatgaggatctattc

SEQ ID NO: 9930 - DNA, 15 bp, Artificial Sequence
  dgRNA
  Uchl5
ccctccggcgctccg

SEQ ID NO: 9931 - DNA, 15 bp, Artificial Sequence
  dgRNA
  Uchl5
gccccgctacttctc

SEQ ID NO: 9932 - DNA, 15 bp, Artificial Sequence
  dgRNA
  Uchl5
gctacttctccggcc

SEQ ID NO: 9933 - DNA, 15 bp, Artificial Sequence
  dgRNA
  Uchl5
tctccggcccggcag

SEQ ID NO: 9934 - DNA, 15 bp, Artificial Sequence
  dgRNA
  Micu1
agtcttgactcgggg

SEQ ID NO: 9935 - DNA, 15 bp, Artificial Sequence
  dgRNA
  Micu1
gtcttgactcggggc

SEQ ID NO: 9936 - DNA, 15 bp, Artificial Sequence
  dgRNA
  Micu1
gcgggatccgaagtg

SEQ ID NO: 9937 - DNA, 15 bp, Artificial Sequence
  dgRNA
  Micu1
cgggatccgaagtgt

SEQ ID NO: 9938 - DNA, 15 bp, Artificial Sequence
  dgRNA
  Olfr1008
acattacatatctcc

SEQ ID NO: 9939 - DNA, 15 bp, Artificial Sequence
  dgRNA
  Lefty1
caatggtgaagtata

SEQ ID NO: 9940 - DNA, 15 bp, Artificial Sequence
  dgRNA
  Lefty1
atggctaacagacag

SEQ ID NO: 9941 - DNA, 15 bp, Artificial Sequence
  dgRNA
  Lefty1
tcaccattgacttaa

SEQ ID NO: 9942 - DNA, 15 bp, Artificial Sequence
  dgRNA
  Lefty1
ttatagctggtcctg

SEQ ID NO: 9943 - DNA, 15 bp, Artificial Sequence
  dgRNA
  Lingo1
cggttctctgaaaga

SEQ ID NO: 9944 - DNA, 15 bp, Artificial Sequence
  dgRNA
  Lingo1
tccctccccacgccg

SEQ ID NO: 9945 - DNA, 15 bp, Artificial Sequence
  dgRNA
  Lingo1
cgccgcggcagagcg

SEQ ID NO: 9946 - DNA, 15 bp, Artificial Sequence
  dgRNA
  Lingo1
accggacgaagatgg

SEQ ID NO: 9947 - DNA, 15 bp, Artificial Sequence
  dgRNA
  Vgll2
cacgagctttccgcg

SEQ ID NO: 9948 - DNA, 15 bp, Artificial Sequence
  dgRNA
  Vgll2
acgagctttccgcga

SEQ ID NO: 9949 - DNA, 15 bp, Artificial Sequence
  dgRNA
  Vgll2
ttccgcgagggagtc

SEQ ID NO: 9950 - DNA, 15 bp, Artificial Sequence
  dgRNA
  Vgll2
tccgcgagggagtcc

SEQ ID NO: 9951 - DNA, 15 bp, Artificial Sequence
  dgRNA
  D3Ertd254e
gggaatgattcctct

SEQ ID NO: 9952 - DNA, 15 bp, Artificial Sequence
  dgRNA
  D3Ertd254e
ggaatgattcctcta

SEQ ID NO: 9953 - DNA, 15 bp, Artificial Sequence
  dgRNA
  D3Ertd254e
cccatagggtagtgc

SEQ ID NO: 9954 - DNA, 15 bp, Artificial Sequence
  dgRNA
  D3Ertd254e
caatcagcagcacga

SEQ ID NO: 9955 - DNA, 15 bp, Artificial Sequence
  dgRNA
  Rps16
cgaaagtcaagacca

SEQ ID NO: 9956 - DNA, 15 bp, Artificial Sequence
  dgRNA
  Rps16
gctgcggaaaagcaa

SEQ ID NO: 9957 - DNA, 15 bp, Artificial Sequence
  dgRNA
  Rps16
cttccgagttctgga

SEQ ID NO: 9958 - DNA, 15 bp, Artificial Sequence
  dgRNA
  Rps16
gcttttccgcagcct

SEQ ID NO: 9959 - DNA, 15 bp, Artificial Sequence
  dgRNA
  Atox1
aatattcatatcgaa

SEQ ID NO: 9960 - DNA, 15 bp, Artificial Sequence
  dgRNA
  Atox1
tcatatcgaaaggca

SEQ ID NO: 9961 - DNA, 15 bp, Artificial Sequence
  dgRNA
  Atox1
ggcacggtaagcaag

SEQ ID NO: 9962 - DNA, 15 bp, Artificial Sequence
  dgRNA
  Atox1
acggtaagcaagagg

SEQ ID NO: 9963 - DNA, 15 bp, Artificial Sequence
  dgRNA
  Cib2
cagtgtccagtagtc

SEQ ID NO: 9964 - DNA, 15 bp, Artificial Sequence
  dgRNA
  Cib2
tgtccagtagtcagg

SEQ ID NO: 9965 - DNA, 15 bp, Artificial Sequence
  dgRNA
  Cib2
tcaggcggccctatg

SEQ ID NO: 9966 - DNA, 15 bp, Artificial Sequence
  dgRNA
  Cib2
tatgaggccaccgct

SEQ ID NO: 9967 - DNA, 15 bp, Artificial Sequence
  dgRNA
  Kremen1
atcctagcaggcgtc

SEQ ID NO: 9968 - DNA, 15 bp, Artificial Sequence
  dgRNA
  Kremen1
aggcgtcaggcaatc

SEQ ID NO: 9969 - DNA, 15 bp, Artificial Sequence
  dgRNA
  Kremen1
ggcgtcaggcaatcc

SEQ ID NO: 9970 - DNA, 15 bp, Artificial Sequence
  dgRNA
  Kremen1
gtcaggcaatccggg

SEQ ID NO: 9971 - DNA, 15 bp, Artificial Sequence
  dgRNA
  1-Mar
attccctgcttaaat

SEQ ID NO: 9972 - DNA, 15 bp, Artificial Sequence
  dgRNA
  1-Mar
caagccgctagaagc

SEQ ID NO: 9973 - DNA, 15 bp, Artificial Sequence
  dgRNA
  1-Mar
taggcttccccagcg

SEQ ID NO: 9974 - DNA, 15 bp, Artificial Sequence
  dgRNA
  1-Mar
agcggggtgctgtcc

SEQ ID NO: 9975 - DNA, 15 bp, Artificial Sequence
  dgRNA
  Wnt6
gcacccgtgagcgcg

SEQ ID NO: 9976 - DNA, 15 bp, Artificial Sequence
  dgRNA
  Wnt6
gcgcccgccgccccg

SEQ ID NO: 9977 - DNA, 15 bp, Artificial Sequence
  dgRNA
  Wnt6
ccgccccggggcgca

SEQ ID NO: 9978 - DNA, 15 bp, Artificial Sequence
  dgRNA
  Wnt6
caactgccacccccg

SEQ ID NO: 9979 - DNA, 15 bp, Artificial Sequence
  dgRNA
  Rbx1
ccgcctgcgccttta

SEQ ID NO: 9980 - DNA, 15 bp, Artificial Sequence
  dgRNA
  Rbx1
cgcctgcgcctttaa

SEQ ID NO: 9981 - DNA, 15 bp, Artificial Sequence
  dgRNA
  Rbx1
aaggggcgtgaccgc

SEQ ID NO: 9982 - DNA, 15 bp, Artificial Sequence
  dgRNA
  Rbx1
acgctcgcgccaatg

SEQ ID NO: 9983 - DNA, 15 bp, Artificial Sequence
  dgRNA
  Ptcd2
tctagtcgccgagcc

SEQ ID NO: 9984 - DNA, 15 bp, Artificial Sequence
  dgRNA
  Ptcd2
tcccacaccgcacca

SEQ ID NO: 9985 - DNA, 15 bp, Artificial Sequence
  dgRNA
  Ptcd2
cccacaccgcaccat

SEQ ID NO: 9986 - DNA, 15 bp, Artificial Sequence
  dgRNA
  Ptcd2
ttggagcgcaccaag

SEQ ID NO: 9987 - DNA, 15 bp, Artificial Sequence
  dgRNA
  Zfp30
gtaggcctaaagact

SEQ ID NO: 9988 - DNA, 15 bp, Artificial Sequence
  dgRNA
  Zfp30
atttctgcccaatcc

SEQ ID NO: 9989 - DNA, 15 bp, Artificial Sequence
  dgRNA
  Zfp30
acaagatgctaccga

SEQ ID NO: 9990 - DNA, 15 bp, Artificial Sequence
  dgRNA
  Zfp30
ctttgaggtccagcg

SEQ ID NO: 9991 - DNA, 15 bp, Artificial Sequence
  dgRNA
  Dhfr
taaggcctccgcttc

SEQ ID NO: 9992 - DNA, 15 bp, Artificial Sequence
  dgRNA
  Dhfr
cgcttccggccacga

SEQ ID NO: 9993 - DNA, 15 bp, Artificial Sequence
  dgRNA
  Dhfr
tgaccccgcccctag

SEQ ID NO: 9994 - DNA, 15 bp, Artificial Sequence
  dgRNA
  Dhfr
ccgcccctagcggtc

SEQ ID NO: 9995 - DNA, 15 bp, Artificial Sequence
  dgRNA
  Rap2b
gagtacatagttcaa

SEQ ID NO: 9996 - DNA, 15 bp, Artificial Sequence
  dgRNA
  Rap2b
aaaatttttgggccg

SEQ ID NO: 9997 - DNA, 15 bp, Artificial Sequence
  dgRNA
  Rap2b
agtagctaggctaac

SEQ ID NO: 9998 - DNA, 15 bp, Artificial Sequence
  dgRNA
  Rap2b
cggcccaaaaatttt

SEQ ID NO: 9999 - DNA, 15 bp, Artificial Sequence
  dgRNA
  Gm13103
aagggggacttcacc

SEQ ID NO: 10000 - DNA, 15 bp, Artificial Sequence
  dgRNA
  Gm13103
tgaagtccccctttg

SEQ ID NO: 10001 - DNA, 15 bp, Artificial Sequence
  dgRNA
  A130010J15Rik
cattgcccacaggag

SEQ ID NO: 10002 - DNA, 15 bp, Artificial Sequence
  dgRNA
  A130010J15Rik
gtgtcccttattccg

SEQ ID NO: 10003 - DNA, 15 bp, Artificial Sequence
  dgRNA
  A130010J15Rik
ccgcggactgacaac

SEQ ID NO: 10004 - DNA, 15 bp, Artificial Sequence
  dgRNA
  A130010J15Rik
cggactgacaactgg

SEQ ID NO: 10005 - DNA, 15 bp, Artificial Sequence
  dgRNA
  Hsf2
gtgcatccgaagcct

SEQ ID NO: 10006 - DNA, 15 bp, Artificial Sequence
  dgRNA
  Hsf2
tccgaagccttggat

SEQ ID NO: 10007 - DNA, 15 bp, Artificial Sequence
  dgRNA
  Hsf2
tggactcgctgagac

SEQ ID NO: 10008 - DNA, 15 bp, Artificial Sequence
  dgRNA
  Hsf2
ggactcgctgagacc

SEQ ID NO: 10009 - DNA, 15 bp, Artificial Sequence
  dgRNA
  Nudt18
aattagctaatcgct

SEQ ID NO: 10010 - DNA, 15 bp, Artificial Sequence
  dgRNA
  Nudt18
attagctaatcgcta

SEQ ID NO: 10011 - DNA, 15 bp, Artificial Sequence
  dgRNA
  Nudt18
ataaccgctgcgagc

SEQ ID NO: 10012 - DNA, 15 bp, Artificial Sequence
  dgRNA
  Nudt18
gcgagctggccaatc

SEQ ID NO: 10013 - DNA, 15 bp, Artificial Sequence
  dgRNA
  Qsox1
ccggacccagctcgg

SEQ ID NO: 10014 - DNA, 15 bp, Artificial Sequence
  dgRNA
  Qsox1
cccagctcggaggtc

SEQ ID NO: 10015 - DNA, 15 bp, Artificial Sequence
  dgRNA
  Qsox1
ggaggtctggctcgc

SEQ ID NO: 10016 - DNA, 15 bp, Artificial Sequence
  dgRNA
  Qsox1
gaggtctggctcgcc

SEQ ID NO: 10017 - DNA, 15 bp, Artificial Sequence
  dgRNA
  Dkk2
agaaagagcgcctgc

SEQ ID NO: 10018 - DNA, 15 bp, Artificial Sequence
  dgRNA
  Dkk2
gaaagagcgcctgct

SEQ ID NO: 10019 - DNA, 15 bp, Artificial Sequence
  dgRNA
  Dkk2
aaagagcgcctgctg

SEQ ID NO: 10020 - DNA, 15 bp, Artificial Sequence
  dgRNA
  Dkk2
aagagcgcctgctgg

SEQ ID NO: 10021 - DNA, 15 bp, Artificial Sequence
  dgRNA
  Mum1
cgcatagctgctcgc

SEQ ID NO: 10022 - DNA, 15 bp, Artificial Sequence
  dgRNA
  Mum1
atagctgctcgcagg

SEQ ID NO: 10023 - DNA, 15 bp, Artificial Sequence
  dgRNA
  Mum1
aggcggaaatctgtc

SEQ ID NO: 10024 - DNA, 15 bp, Artificial Sequence
  dgRNA
  Mum1
accattgcaggatgt

SEQ ID NO: 10025 - DNA, 15 bp, Artificial Sequence
  dgRNA
  Mrpl27
gacaaacgtccgtgc

SEQ ID NO: 10026 - DNA, 15 bp, Artificial Sequence
  dgRNA
  Mrpl27
cactgcagaagtcgc

SEQ ID NO: 10027 - DNA, 15 bp, Artificial Sequence
  dgRNA
  Mrpl27
tgcagaagtcgccgg

SEQ ID NO: 10028 - DNA, 15 bp, Artificial Sequence
  dgRNA
  Mrpl27
agtcgccggaggtcc

SEQ ID NO: 10029 - DNA, 15 bp, Artificial Sequence
  dgRNA
  Pi4kb
tgaacaggcgtgagt

SEQ ID NO: 10030 - DNA, 15 bp, Artificial Sequence
  dgRNA
  Pi4kb
gaacaggcgtgagtc

SEQ ID NO: 10031 - DNA, 15 bp, Artificial Sequence
  dgRNA
  Pi4kb
cgactcagattacga

SEQ ID NO: 10032 - DNA, 15 bp, Artificial Sequence
  dgRNA
  Pi4kb
tagtgtcctgacacc

SEQ ID NO: 10033 - DNA, 15 bp, Artificial Sequence
  dgRNA
  Glo1
cactattgtgcacaa

SEQ ID NO: 10034 - DNA, 15 bp, Artificial Sequence
  dgRNA
  Glo1
ctgaaccagactcac

SEQ ID NO: 10035 - DNA, 15 bp, Artificial Sequence
  dgRNA
  Glo1
cagccatgtgcaccg

SEQ ID NO: 10036 - DNA, 15 bp, Artificial Sequence
  dgRNA
  Glo1
catgtgcaccgtggt

SEQ ID NO: 10037 - DNA, 15 bp, Artificial Sequence
  dgRNA
  Upf3b
aaggggcgggccccg

SEQ ID NO: 10038 - DNA, 15 bp, Artificial Sequence
  dgRNA
  Upf3b
aggggcgggccccga

SEQ ID NO: 10039 - DNA, 15 bp, Artificial Sequence
  dgRNA
  Upf3b
ggccccgagggaatc

SEQ ID NO: 10040 - DNA, 15 bp, Artificial Sequence
  dgRNA
  Upf3b
gccccgagggaatct

SEQ ID NO: 10041 - DNA, 15 bp, Artificial Sequence
  dgRNA
  Ccdc90b
gaacaatgccgaccc

SEQ ID NO: 10042 - DNA, 15 bp, Artificial Sequence
  dgRNA
  Ccdc90b
tgccgacccaggaaa

SEQ ID NO: 10043 - DNA, 15 bp, Artificial Sequence
  dgRNA
  Ccdc90b
aaggcctaaaacagt

SEQ ID NO: 10044 - DNA, 15 bp, Artificial Sequence
  dgRNA
  Ccdc90b
ctccagtgcaccaga

SEQ ID NO: 10045 - DNA, 15 bp, Artificial Sequence
  dgRNA
  Ptrhd1
taatctgtctaccac

SEQ ID NO: 10046 - DNA, 15 bp, Artificial Sequence
  dgRNA
  Ptrhd1
cgccgtacacgaaca

SEQ ID NO: 10047 - DNA, 15 bp, Artificial Sequence
  dgRNA
  Ptrhd1
cgtacacgaacatgg

SEQ ID NO: 10048 - DNA, 15 bp, Artificial Sequence
  dgRNA
  Ptrhd1
tcagttgctctcggc

SEQ ID NO: 10049 - DNA, 15 bp, Artificial Sequence
  dgRNA
  Olfr761
atagcgaaaatctac

SEQ ID NO: 10050 - DNA, 15 bp, Artificial Sequence
  dgRNA
  Olfr761
tccagataatgttta

SEQ ID NO: 10051 - DNA, 15 bp, Artificial Sequence
  dgRNA
  Wtip
agtctgcgcacccct

SEQ ID NO: 10052 - DNA, 15 bp, Artificial Sequence
  dgRNA
  Wtip
tgcgcacccctcggc

SEQ ID NO: 10053 - DNA, 15 bp, Artificial Sequence
  dgRNA
  Wtip
gcgcacccctcggcc

SEQ ID NO: 10054 - DNA, 15 bp, Artificial Sequence
  dgRNA
  Wtip
ctcacattcctgacg

SEQ ID NO: 10055 - DNA, 15 bp, Artificial Sequence
  dgRNA
  Wdr70
ccttagaaacgtgcc

SEQ ID NO: 10056 - DNA, 15 bp, Artificial Sequence
  dgRNA
  Wdr70
tctgaaaccaccgaa

SEQ ID NO: 10057 - DNA, 15 bp, Artificial Sequence
  dgRNA
  Wdr70
ccaccgaaaggtttt

SEQ ID NO: 10058 - DNA, 15 bp, Artificial Sequence
  dgRNA
  Wdr70
caccgaaaggtttta

SEQ ID NO: 10059 - DNA, 15 bp, Artificial Sequence
  dgRNA
  Dgkz
ggcctcggagctgga

SEQ ID NO: 10060 - DNA, 15 bp, Artificial Sequence
  dgRNA
  Dgkz
gacggccttgcgacg

SEQ ID NO: 10061 - DNA, 15 bp, Artificial Sequence
  dgRNA
  Dgkz
ttgcgacgtggcttg

SEQ ID NO: 10062 - DNA, 15 bp, Artificial Sequence
  dgRNA
  Dgkz
agcagagggcgccgt

SEQ ID NO: 10063 - DNA, 15 bp, Artificial Sequence
  dgRNA
  Clec2l
ggctcacagctgcga

SEQ ID NO: 10064 - DNA, 15 bp, Artificial Sequence
  dgRNA
  Clec2l
ctgcgagggagccgg

SEQ ID NO: 10065 - DNA, 15 bp, Artificial Sequence
  dgRNA
  Clec2l
gagggagccggtggc

SEQ ID NO: 10066 - DNA, 15 bp, Artificial Sequence
  dgRNA
  Clec2l
agggagccggtggcg

SEQ ID NO: 10067 - DNA, 15 bp, Artificial Sequence
  dgRNA
  Triobp
ggcttcccgggcgtg

SEQ ID NO: 10068 - DNA, 15 bp, Artificial Sequence
  dgRNA
  Triobp
tggcttcccgggcgt

SEQ ID NO: 10069 - DNA, 15 bp, Artificial Sequence
  dgRNA
  Triobp
gtggcttcccgggcg

SEQ ID NO: 10070 - DNA, 15 bp, Artificial Sequence
  dgRNA
  Cops7a
cctgcagctcccggg

SEQ ID NO: 10071 - DNA, 15 bp, Artificial Sequence
  dgRNA
  Cops7a
ggagggtcgctcccc

SEQ ID NO: 10072 - DNA, 15 bp, Artificial Sequence
  dgRNA
  Cops7a
acctccgcagagccg

SEQ ID NO: 10073 - DNA, 15 bp, Artificial Sequence
  dgRNA
  Cops7a
gatgcacggacagag

SEQ ID NO: 10074 - DNA, 15 bp, Artificial Sequence
  dgRNA
  Klhl14
cctaagagcgcaggg

SEQ ID NO: 10075 - DNA, 15 bp, Artificial Sequence
  dgRNA
  Klhl14
ctaagagcgcaggga

SEQ ID NO: 10076 - DNA, 15 bp, Artificial Sequence
  dgRNA
  Klhl14
ggagggaaccaagcg

SEQ ID NO: 10077 - DNA, 15 bp, Artificial Sequence
  dgRNA
  Klhl14
acccgtctgccaggt

SEQ ID NO: 10078 - DNA, 15 bp, Artificial Sequence
  dgRNA
  Il17f
ccgtcatctcccttt

SEQ ID NO: 10079 - DNA, 15 bp, Artificial Sequence
  dgRNA
  Il17f
cgtcatctcccttta

SEQ ID NO: 10080 - DNA, 15 bp, Artificial Sequence
  dgRNA
  Il17f
ctttgattccccttc

SEQ ID NO: 10081 - DNA, 15 bp, Artificial Sequence
  dgRNA
  Il17f
ttcgtcagtaactct

SEQ ID NO: 10082 - DNA, 15 bp, Artificial Sequence
  dgRNA
  Hamp2
gcgggagagataagt

SEQ ID NO: 10083 - DNA, 15 bp, Artificial Sequence
  dgRNA
  Hamp2
atagtggtgccaaac

SEQ ID NO: 10084 - DNA, 15 bp, Artificial Sequence
  dgRNA
  Dennd5a
ccagcagctgaccgc

SEQ ID NO: 10085 - DNA, 15 bp, Artificial Sequence
  dgRNA
  Dennd5a
ccgctggccactctg

SEQ ID NO: 10086 - DNA, 15 bp, Artificial Sequence
  dgRNA
  Dennd5a
aagcccaggcccccg

SEQ ID NO: 10087 - DNA, 15 bp, Artificial Sequence
  dgRNA
  Dennd5a
ccgcgcgtgcgcacg

SEQ ID NO: 10088 - DNA, 15 bp, Artificial Sequence
  dgRNA
  Hagh
gaggacgacactgat

SEQ ID NO: 10089 - DNA, 15 bp, Artificial Sequence
  dgRNA
  Hagh
tgatgcccacgacgc

SEQ ID NO: 10090 - DNA, 15 bp, Artificial Sequence
  dgRNA
  Hagh
acgacgctggtgttg

SEQ ID NO: 10091 - DNA, 15 bp, Artificial Sequence
  dgRNA
  Hagh
gcggactccgcgacc

SEQ ID NO: 10092 - DNA, 15 bp, Artificial Sequence
  dgRNA
  Tdrd3
tagcgccgtcccccg

SEQ ID NO: 10093 - DNA, 15 bp, Artificial Sequence
  dgRNA
  Tdrd3
gccgtgtccgatccc

SEQ ID NO: 10094 - DNA, 15 bp, Artificial Sequence
  dgRNA
  Tdrd3
tccgatccccggccc

SEQ ID NO: 10095 - DNA, 15 bp, Artificial Sequence
  dgRNA
  Tdrd3
ggcccaggccgcgtt

SEQ ID NO: 10096 - DNA, 15 bp, Artificial Sequence
  dgRNA
  Rgs19
ggctcgaggaagtcc

SEQ ID NO: 10097 - DNA, 15 bp, Artificial Sequence
  dgRNA
  Rgs19
cccggcccctctctt

SEQ ID NO: 10098 - DNA, 15 bp, Artificial Sequence
  dgRNA
  Rgs19
ccggcccctctcttt

SEQ ID NO: 10099 - DNA, 15 bp, Artificial Sequence
  dgRNA
  Rgs19
cggcccctctctttg

SEQ ID NO: 10100 - DNA, 15 bp, Artificial Sequence
  dgRNA
  Zfp143
cactcatgagcgggt

SEQ ID NO: 10101 - DNA, 15 bp, Artificial Sequence
  dgRNA
  Zfp143
catgagcgggtagga

SEQ ID NO: 10102 - DNA, 15 bp, Artificial Sequence
  dgRNA
  Zfp143
gcgggtaggaaggtc

SEQ ID NO: 10103 - DNA, 15 bp, Artificial Sequence
  dgRNA
  Zfp143
aggcaacaatgacgc

SEQ ID NO: 10104 - DNA, 15 bp, Artificial Sequence
  dgRNA
  Pet100
agacccgttttctat

SEQ ID NO: 10105 - DNA, 15 bp, Artificial Sequence
  dgRNA
  Pet100
agtgaccggaagcaa

SEQ ID NO: 10106 - DNA, 15 bp, Artificial Sequence
  dgRNA
  Pet100
gtgaccggaagcaaa

SEQ ID NO: 10107 - DNA, 15 bp, Artificial Sequence
  dgRNA
  Pet100
tgaccggaagcaaag

SEQ ID NO: 10108 - DNA, 15 bp, Artificial Sequence
  dgRNA
  Amacr
tgagggtagcgattc

SEQ ID NO: 10109 - DNA, 15 bp, Artificial Sequence
  dgRNA
  Amacr
gggtagcgattcagg

SEQ ID NO: 10110 - DNA, 15 bp, Artificial Sequence
  dgRNA
  Amacr
tgaaagtgtccgaag

SEQ ID NO: 10111 - DNA, 15 bp, Artificial Sequence
  dgRNA
  Amacr
aggactcgcacaaca

SEQ ID NO: 10112 - DNA, 15 bp, Artificial Sequence
  dgRNA
  Prl2c5
tcagttctatgtacg

SEQ ID NO: 10113 - DNA, 15 bp, Artificial Sequence
  dgRNA
  Apoa5
atgttacctacacac

SEQ ID NO: 10114 - DNA, 15 bp, Artificial Sequence
  dgRNA
  Apoa5
agggttatcgggatt

SEQ ID NO: 10115 - DNA, 15 bp, Artificial Sequence
  dgRNA
  Apoa5
gggttatcgggattt

SEQ ID NO: 10116 - DNA, 15 bp, Artificial Sequence
  dgRNA
  Apoa5
ggttatcgggatttg

SEQ ID NO: 10117 - DNA, 15 bp, Artificial Sequence
  dgRNA
  Gpsm1
tgtccacactagagc

SEQ ID NO: 10118 - DNA, 15 bp, Artificial Sequence
  dgRNA
  Gpsm1
ggactctccttgcac

SEQ ID NO: 10119 - DNA, 15 bp, Artificial Sequence
  dgRNA
  Gpsm1
cgcccaccccacggt

SEQ ID NO: 10120 - DNA, 15 bp, Artificial Sequence
  dgRNA
  Gpsm1
caccccacggtaggc

SEQ ID NO: 10121 - DNA, 15 bp, Artificial Sequence
  dgRNA
  Rpf2
aagtcgtttactttc

SEQ ID NO: 10122 - DNA, 15 bp, Artificial Sequence
  dgRNA
  Rpf2
aacgttccgtaacca

SEQ ID NO: 10123 - DNA, 15 bp, Artificial Sequence
  dgRNA
  Rpf2
acgttccgtaaccaa

SEQ ID NO: 10124 - DNA, 15 bp, Artificial Sequence
  dgRNA
  Rpf2
cgtaaccaagggaga

SEQ ID NO: 10125 - DNA, 15 bp, Artificial Sequence
  dgRNA
  Tnfrsf13b
gctgcggctggacgc

SEQ ID NO: 10126 - DNA, 15 bp, Artificial Sequence
  dgRNA
  Tnfrsf13b
cgcagctgaggtcag

SEQ ID NO: 10127 - DNA, 15 bp, Artificial Sequence
  dgRNA
  Tnfrsf13b
ccgcagctgaggtca

SEQ ID NO: 10128 - DNA, 15 bp, Artificial Sequence
  dgRNA
  Tnfrsf13b
gccgcagctgaggtc

SEQ ID NO: 10129 - DNA, 15 bp, Artificial Sequence
  dgRNA
  Olfr157
agaagctagtcttaa

SEQ ID NO: 10130 - DNA, 15 bp, Artificial Sequence
  dgRNA
  Olfr157
gtgttgattccaaca

SEQ ID NO: 10131 - DNA, 15 bp, Artificial Sequence
  dgRNA
  Olfr157
ctacatcgtcaagct

SEQ ID NO: 10132 - DNA, 15 bp, Artificial Sequence
  dgRNA
  Mfsd12
aagtcggagccgcag

SEQ ID NO: 10133 - DNA, 15 bp, Artificial Sequence
  dgRNA
  Mfsd12
agtcggagccgcaga

SEQ ID NO: 10134 - DNA, 15 bp, Artificial Sequence
  dgRNA
  Mfsd12
cggagccgcagaggg

SEQ ID NO: 10135 - DNA, 15 bp, Artificial Sequence
  dgRNA
  Mfsd12
gcagagggcggcgtt

SEQ ID NO: 10136 - DNA, 15 bp, Artificial Sequence
  dgRNA
  Scn9a
cctgcaccgtctacc

SEQ ID NO: 10137 - DNA, 15 bp, Artificial Sequence
  dgRNA
  Scn9a
caccgtctaccgggc

SEQ ID NO: 10138 - DNA, 15 bp, Artificial Sequence
  dgRNA
  Scn9a
accgtctaccgggct

SEQ ID NO: 10139 - DNA, 15 bp, Artificial Sequence
  dgRNA
  Scn9a
gtctaccgggctggg

SEQ ID NO: 10140 - DNA, 15 bp, Artificial Sequence
  dgRNA
  Ugt3a2
taactctagttaagg

SEQ ID NO: 10141 - DNA, 15 bp, Artificial Sequence
  dgRNA
  Ugt3a2
tgatgcaacatcagc

SEQ ID NO: 10142 - DNA, 15 bp, Artificial Sequence
  dgRNA
  Tgm3
ccgtcttgcataagc

SEQ ID NO: 10143 - DNA, 15 bp, Artificial Sequence
  dgRNA
  Tgm3
aggatgacctcccat

SEQ ID NO: 10144 - DNA, 15 bp, Artificial Sequence
  dgRNA
  Tgm3
cctcccattgggtga

SEQ ID NO: 10145 - DNA, 15 bp, Artificial Sequence
  dgRNA
  Tgm3
aagtgaaacgtttac

SEQ ID NO: 10146 - DNA, 15 bp, Artificial Sequence
  dgRNA
  Olfr1425
gtgccctaagagctt

SEQ ID NO: 10147 - DNA, 15 bp, Artificial Sequence
  dgRNA
  Olfr1425
aaaagaaatatctcg

SEQ ID NO: 10148 - DNA, 15 bp, Artificial Sequence
  dgRNA
  Olfr1425
cttcctaagctctta

SEQ ID NO: 10149 - DNA, 15 bp, Artificial Sequence
  dgRNA
  Egfl6
gagtgaactgaagcg

SEQ ID NO: 10150 - DNA, 15 bp, Artificial Sequence
  dgRNA
  Egfl6
agtgaactgaagcgg

SEQ ID NO: 10151 - DNA, 15 bp, Artificial Sequence
  dgRNA
  Egfl6
gtgaactgaagcggg

SEQ ID NO: 10152 - DNA, 15 bp, Artificial Sequence
  dgRNA
  Egfl6
tgaactgaagcgggg

SEQ ID NO: 10153 - DNA, 15 bp, Artificial Sequence
  dgRNA
  Rbm43
gcggaccctgctggc

SEQ ID NO: 10154 - DNA, 15 bp, Artificial Sequence
  dgRNA
  Rbm43
cgggaaggaagtgtc

SEQ ID NO: 10155 - DNA, 15 bp, Artificial Sequence
  dgRNA
  Rbm43
gaagtgtcggggatc

SEQ ID NO: 10156 - DNA, 15 bp, Artificial Sequence
  dgRNA
  Rbm43
ggtttgagaatgcgc

SEQ ID NO: 10157 - DNA, 15 bp, Artificial Sequence
  dgRNA
  Limk2
taaactgaatcaccc

SEQ ID NO: 10158 - DNA, 15 bp, Artificial Sequence
  dgRNA
  Limk2
tccgaacgcctctag

SEQ ID NO: 10159 - DNA, 15 bp, Artificial Sequence
  dgRNA
  Limk2
tcgccagtcgccagc

SEQ ID NO: 10160 - DNA, 15 bp, Artificial Sequence
  dgRNA
  Limk2
caggcgccagagatg

SEQ ID NO: 10161 - DNA, 15 bp, Artificial Sequence
  dgRNA
  Ppp1r2
ggttcacacacttgt

SEQ ID NO: 10162 - DNA, 15 bp, Artificial Sequence
  dgRNA
  Ppp1r2
cacacttgttgggct

SEQ ID NO: 10163 - DNA, 15 bp, Artificial Sequence
  dgRNA
  Ppp1r2
gcccgcctaacacag

SEQ ID NO: 10164 - DNA, 15 bp, Artificial Sequence
  dgRNA
  Ppp1r2
cgcctaacacagagg

SEQ ID NO: 10165 - DNA, 15 bp, Artificial Sequence
  dgRNA
  Fam73b
ctagtgaccaatcgg

SEQ ID NO: 10166 - DNA, 15 bp, Artificial Sequence
  dgRNA
  Fam73b
ctgcaaccacactta

SEQ ID NO: 10167 - DNA, 15 bp, Artificial Sequence
  dgRNA
  Fam73b
gcaaccacacttagg

SEQ ID NO: 10168 - DNA, 15 bp, Artificial Sequence
  dgRNA
  Fam73b
accacacttaggggg

SEQ ID NO: 10169 - DNA, 15 bp, Artificial Sequence
  dgRNA
  Parg
tgaccttccgggcgc

SEQ ID NO: 10170 - DNA, 15 bp, Artificial Sequence
  dgRNA
  Parg
cgcacttccgcttta

SEQ ID NO: 10171 - DNA, 15 bp, Artificial Sequence
  dgRNA
  Parg
ctttacggctgtgtg

SEQ ID NO: 10172 - DNA, 15 bp, Artificial Sequence
  dgRNA
  Parg
cggctgtgtgcggcc

SEQ ID NO: 10173 - DNA, 15 bp, Artificial Sequence
  dgRNA
  Ccl27a
aaagaaactgctcgg

SEQ ID NO: 10174 - DNA, 15 bp, Artificial Sequence
  dgRNA
  Ccl27a
tccgagcagtttctt

SEQ ID NO: 10175 - DNA, 15 bp, Artificial Sequence
  dgRNA
  Zfp78
tcagattaagctctt

SEQ ID NO: 10176 - DNA, 15 bp, Artificial Sequence
  dgRNA
  Zfp78
ctcttaggtcgtcgc

SEQ ID NO: 10177 - DNA, 15 bp, Artificial Sequence
  dgRNA
  Zfp78
ggtcgtcgctggcag

SEQ ID NO: 10178 - DNA, 15 bp, Artificial Sequence
  dgRNA
  Zfp78
gagaagcgggtacta

SEQ ID NO: 10179 - DNA, 15 bp, Artificial Sequence
  dgRNA
  Faim
agcagcggcgcagca

SEQ ID NO: 10180 - DNA, 15 bp, Artificial Sequence
  dgRNA
  Faim
cacaagggcgcagag

SEQ ID NO: 10181 - DNA, 15 bp, Artificial Sequence
  dgRNA
  Faim
agagcggcgcacagc

SEQ ID NO: 10182 - DNA, 15 bp, Artificial Sequence
  dgRNA
  Faim
ggattggccccaaag

SEQ ID NO: 10183 - DNA, 15 bp, Artificial Sequence
  dgRNA
  Rbbp8
ggtcaagttcccaac

SEQ ID NO: 10184 - DNA, 15 bp, Artificial Sequence
  dgRNA
  Rbbp8
aggtggactatttcc

SEQ ID NO: 10185 - DNA, 15 bp, Artificial Sequence
  dgRNA
  Rbbp8
ggtggactatttccc

SEQ ID NO: 10186 - DNA, 15 bp, Artificial Sequence
  dgRNA
  Rbbp8
ccgggaactccacga

SEQ ID NO: 10187 - DNA, 15 bp, Artificial Sequence
  dgRNA
  Cbln2
actaaccggagattt

SEQ ID NO: 10188 - DNA, 15 bp, Artificial Sequence
  dgRNA
  Cbln2
accattaaattaccg

SEQ ID NO: 10189 - DNA, 15 bp, Artificial Sequence
  dgRNA
  Cbln2
cgattccaaaatctc

SEQ ID NO: 10190 - DNA, 15 bp, Artificial Sequence
  dgRNA
  Cbln2
gcctcggtaatttaa

SEQ ID NO: 10191 - DNA, 15 bp, Artificial Sequence
  dgRNA
  Ppme1
ctctttttgcgccca

SEQ ID NO: 10192 - DNA, 15 bp, Artificial Sequence
  dgRNA
  Ppme1
cccacggccgccccc

SEQ ID NO: 10193 - DNA, 15 bp, Artificial Sequence
  dgRNA
  Ppme1
gtttcatcccgagcc

SEQ ID NO: 10194 - DNA, 15 bp, Artificial Sequence
  dgRNA
  Ppme1
tttcatcccgagcct

SEQ ID NO: 10195 - DNA, 15 bp, Artificial Sequence
  dgRNA
  Msantd1
gagtttttaggcccc

SEQ ID NO: 10196 - DNA, 15 bp, Artificial Sequence
  dgRNA
  Msantd1
catctccagctaaca

SEQ ID NO: 10197 - DNA, 15 bp, Artificial Sequence
  dgRNA
  Msantd1
gaagattgatccttg

SEQ ID NO: 10198 - DNA, 15 bp, Artificial Sequence
  dgRNA
  Dr1
tccagggcccgacgg

SEQ ID NO: 10199 - DNA, 15 bp, Artificial Sequence
  dgRNA
  Dr1
cgacggaggagacgc

SEQ ID NO: 10200 - DNA, 15 bp, Artificial Sequence
  dgRNA
  Dr1
gacggaggagacgcc

SEQ ID NO: 10201 - DNA, 15 bp, Artificial Sequence
  dgRNA
  Dr1
ccgggtcgccgtgcg

SEQ ID NO: 10202 - DNA, 15 bp, Artificial Sequence
  dgRNA
  Pdia6
ccggtaacctctacc

SEQ ID NO: 10203 - DNA, 15 bp, Artificial Sequence
  dgRNA
  Pdia6
ccggccgctttcaat

SEQ ID NO: 10204 - DNA, 15 bp, Artificial Sequence
  dgRNA
  Pdia6
aatgaaaggcggcca

SEQ ID NO: 10205 - DNA, 15 bp, Artificial Sequence
  dgRNA
  Pdia6
aaggcggccacggcg

SEQ ID NO: 10206 - DNA, 15 bp, Artificial Sequence
  dgRNA
  Vmn1r234
cttataggtttagaa

SEQ ID NO: 10207 - DNA, 15 bp, Artificial Sequence
  dgRNA
  Tmem256
tcctccgctcctaat

SEQ ID NO: 10208 - DNA, 15 bp, Artificial Sequence
  dgRNA
  Tmem256
acaaaggcgtctgta

SEQ ID NO: 10209 - DNA, 15 bp, Artificial Sequence
  dgRNA
  Tmem256
caaaggcgtctgtaa

SEQ ID NO: 10210 - DNA, 15 bp, Artificial Sequence
  dgRNA
  Tmem256
cgtctgtaagggaac

SEQ ID NO: 10211 - DNA, 15 bp, Artificial Sequence
  dgRNA
  4933402P03Rik
gtactcaagtacccg

SEQ ID NO: 10212 - DNA, 15 bp, Artificial Sequence
  dgRNA
  4933402P03Rik
tactcaagtacccga

SEQ ID NO: 10213 - DNA, 15 bp, Artificial Sequence
  dgRNA
  4933402P03Rik
agtacccgagggcca

SEQ ID NO: 10214 - DNA, 15 bp, Artificial Sequence
  dgRNA
  4933402P03Rik
ccatggtctatcaaa

SEQ ID NO: 10215 - DNA, 15 bp, Artificial Sequence
  dgRNA
  B4galt4
aatctgagaagcgcc

SEQ ID NO: 10216 - DNA, 15 bp, Artificial Sequence
  dgRNA
  B4galt4
tagttatcctcagta

SEQ ID NO: 10217 - DNA, 15 bp, Artificial Sequence
  dgRNA
  B4galt4
gtgatctaaagacta

SEQ ID NO: 10218 - DNA, 15 bp, Artificial Sequence
  dgRNA
  B4galt4
agctcccgcagcgcg

SEQ ID NO: 10219 - DNA, 15 bp, Artificial Sequence
  dgRNA
  Trio
ggacccgcccacaaa

SEQ ID NO: 10220 - DNA, 15 bp, Artificial Sequence
  dgRNA
  Trio
gccgagcccacgctc

SEQ ID NO: 10221 - DNA, 15 bp, Artificial Sequence
  dgRNA
  Trio
gctaacgaagctctc

SEQ ID NO: 10222 - DNA, 15 bp, Artificial Sequence
  dgRNA
  Trio
tcacccgggctccct

SEQ ID NO: 10223 - DNA, 15 bp, Artificial Sequence
  dgRNA
  Aptx
ccggattcagacaac

SEQ ID NO: 10224 - DNA, 15 bp, Artificial Sequence
  dgRNA
  Aptx
cggattcagacaacc

SEQ ID NO: 10225 - DNA, 15 bp, Artificial Sequence
  dgRNA
  Aptx
attcagacaaccggg

SEQ ID NO: 10226 - DNA, 15 bp, Artificial Sequence
  dgRNA
  Aptx
ggaggctgcgagcaa

SEQ ID NO: 10227 - DNA, 15 bp, Artificial Sequence
  dgRNA
  Jtb
gatcgcctctaccac

SEQ ID NO: 10228 - DNA, 15 bp, Artificial Sequence
  dgRNA
  Jtb
taccaccggtcccgc

SEQ ID NO: 10229 - DNA, 15 bp, Artificial Sequence
  dgRNA
  Jtb
gaccacactgccgcg

SEQ ID NO: 10230 - DNA, 15 bp, Artificial Sequence
  dgRNA
  Jtb
cgctctgtctgtact

SEQ ID NO: 10231 - DNA, 15 bp, Artificial Sequence
  dgRNA
  Crybb1
ggcagagccggccat

SEQ ID NO: 10232 - DNA, 15 bp, Artificial Sequence
  dgRNA
  Crybb1
ccatgggccccatcc

SEQ ID NO: 10233 - DNA, 15 bp, Artificial Sequence
  dgRNA
  Crybb1
gccaggctataaaat

SEQ ID NO: 10234 - DNA, 15 bp, Artificial Sequence
  dgRNA
  Crybb1
tttctattgttggcc

SEQ ID NO: 10235 - DNA, 15 bp, Artificial Sequence
  dgRNA
  Zfp938
cctcactagccaatc

SEQ ID NO: 10236 - DNA, 15 bp, Artificial Sequence
  dgRNA
  Zfp938
accgagcagttagaa

SEQ ID NO: 10237 - DNA, 15 bp, Artificial Sequence
  dgRNA
  Zfp938
ccgagcagttagaat

SEQ ID NO: 10238 - DNA, 15 bp, Artificial Sequence
  dgRNA
  Zfp938
actgctcggtccatc

SEQ ID NO: 10239 - DNA, 15 bp, Artificial Sequence
  dgRNA
  Tsc22d4
tgtaggctgcggctg

SEQ ID NO: 10240 - DNA, 15 bp, Artificial Sequence
  dgRNA
  Tsc22d4
tccgggccagctggc

SEQ ID NO: 10241 - DNA, 15 bp, Artificial Sequence
  dgRNA
  Tsc22d4
ccgggccagctggca

SEQ ID NO: 10242 - DNA, 15 bp, Artificial Sequence
  dgRNA
  Tsc22d4
caggcccgagaaggc

SEQ ID NO: 10243 - DNA, 15 bp, Artificial Sequence
  dgRNA
  Etnk1
gcgctcggactcctt

SEQ ID NO: 10244 - DNA, 15 bp, Artificial Sequence
  dgRNA
  Etnk1
cgctcggactccttc

SEQ ID NO: 10245 - DNA, 15 bp, Artificial Sequence
  dgRNA
  Etnk1
gactccttcgggtgc

SEQ ID NO: 10246 - DNA, 15 bp, Artificial Sequence
  dgRNA
  Etnk1
ccaaccccacagtag

SEQ ID NO: 10247 - DNA, 15 bp, Artificial Sequence
  dgRNA
  Palm2
cgacggcggcagcca

SEQ ID NO: 10248 - DNA, 15 bp, Artificial Sequence
  dgRNA
  Palm2
gacggcggcagccac

SEQ ID NO: 10249 - DNA, 15 bp, Artificial Sequence
  dgRNA
  Palm2
aggcgcggagacgtc

SEQ ID NO: 10250 - DNA, 15 bp, Artificial Sequence
  dgRNA
  Palm2
ggcgcggagacgtca

SEQ ID NO: 10251 - DNA, 15 bp, Artificial Sequence
  dgRNA
  Golph3l
tcctcgcagccaccg

SEQ ID NO: 10252 - DNA, 15 bp, Artificial Sequence
  dgRNA
  Golph3l
cgcaacacaatagcc

SEQ ID NO: 10253 - DNA, 15 bp, Artificial Sequence
  dgRNA
  Golph3l
aacacaatagcccgg

SEQ ID NO: 10254 - DNA, 15 bp, Artificial Sequence
  dgRNA
  Golph3l
ctcgtaagctccgat

SEQ ID NO: 10255 - DNA, 15 bp, Artificial Sequence
  dgRNA
  Serf2
tcccccgcgttcctt

SEQ ID NO: 10256 - DNA, 15 bp, Artificial Sequence
  dgRNA
  Serf2
cccccgcgttccttc

SEQ ID NO: 10257 - DNA, 15 bp, Artificial Sequence
  dgRNA
  Serf2
ccccgcgttccttcg

SEQ ID NO: 10258 - DNA, 15 bp, Artificial Sequence
  dgRNA
  Serf2
gcctagtcacgtgcc

SEQ ID NO: 10259 - DNA, 15 bp, Artificial Sequence
  dgRNA
  Myo1d
cccgtgcctgtcttt

SEQ ID NO: 10260 - DNA, 15 bp, Artificial Sequence
  dgRNA
  Myo1d
ccgtgcctgtcttta

SEQ ID NO: 10261 - DNA, 15 bp, Artificial Sequence
  dgRNA
  Myo1d
cgtgcctgtctttag

SEQ ID NO: 10262 - DNA, 15 bp, Artificial Sequence
  dgRNA
  Myo1d
gccgcttagccgccg

SEQ ID NO: 10263 - DNA, 15 bp, Artificial Sequence
  dgRNA
  Mylk3
gccgctggatgcttc

SEQ ID NO: 10264 - DNA, 15 bp, Artificial Sequence
  dgRNA
  Mylk3
ccgctggatgcttct

SEQ ID NO: 10265 - DNA, 15 bp, Artificial Sequence
  dgRNA
  Mylk3
cgctggatgcttctg

SEQ ID NO: 10266 - DNA, 15 bp, Artificial Sequence
  dgRNA
  Mylk3
ataagcggaaatacc

SEQ ID NO: 10267 - DNA, 15 bp, Artificial Sequence
  dgRNA
  Slc38a10
ccacatacttcttat

SEQ ID NO: 10268 - DNA, 15 bp, Artificial Sequence
  dgRNA
  Slc38a10
gcctagctccgcctc

SEQ ID NO: 10269 - DNA, 15 bp, Artificial Sequence
  dgRNA
  Slc38a10
aaaccacgcctcctc

SEQ ID NO: 10270 - DNA, 15 bp, Artificial Sequence
  dgRNA
  Slc38a10
ctacttctagttggc

SEQ ID NO: 10271 - DNA, 15 bp, Artificial Sequence
  dgRNA
  Spata18
gggcccgttacgcca

SEQ ID NO: 10272 - DNA, 15 bp, Artificial Sequence
  dgRNA
  Spata18
gttacgccacggcgc

SEQ ID NO: 10273 - DNA, 15 bp, Artificial Sequence
  dgRNA
  Spata18
ttacgccacggcgct

SEQ ID NO: 10274 - DNA, 15 bp, Artificial Sequence
  dgRNA
  Spata18
cgccacggcgctggg

SEQ ID NO: 10275 - DNA, 15 bp, Artificial Sequence
  dgRNA
  Tnnt2
ctgggggacaccagt

SEQ ID NO: 10276 - DNA, 15 bp, Artificial Sequence
  dgRNA
  Tnnt2
ccactagtcacacag

SEQ ID NO: 10277 - DNA, 15 bp, Artificial Sequence
  dgRNA
  Tnnt2
gcagagggctcccgt

SEQ ID NO: 10278 - DNA, 15 bp, Artificial Sequence
  dgRNA
  Tnnt2
gagggctcccgtggg

SEQ ID NO: 10279 - DNA, 15 bp, Artificial Sequence
  dgRNA
  Nrros
gttccttctaagacg

SEQ ID NO: 10280 - DNA, 15 bp, Artificial Sequence
  dgRNA
  Nrros
ttccttctaagacgc

SEQ ID NO: 10281 - DNA, 15 bp, Artificial Sequence
  dgRNA
  Nrros
tgctgagtcgctgag

SEQ ID NO: 10282 - DNA, 15 bp, Artificial Sequence
  dgRNA
  Nrros
gacttcagtttccgt

SEQ ID NO: 10283 - DNA, 15 bp, Artificial Sequence
  dgRNA
  Dctn3
cccagaacgttacct

SEQ ID NO: 10284 - DNA, 15 bp, Artificial Sequence
  dgRNA
  Dctn3
acgtcacttcctaca

SEQ ID NO: 10285 - DNA, 15 bp, Artificial Sequence
  dgRNA
  Dctn3
tcctacaaggcgtga

SEQ ID NO: 10286 - DNA, 15 bp, Artificial Sequence
  dgRNA
  Dctn3
gcgtgacggtgctct

SEQ ID NO: 10287 - DNA, 15 bp, Artificial Sequence
  dgRNA
  Oprd1
agcggagcccaggca

SEQ ID NO: 10288 - DNA, 15 bp, Artificial Sequence
  dgRNA
  Oprd1
cagggagcgcgcgcg

SEQ ID NO: 10289 - DNA, 15 bp, Artificial Sequence
  dgRNA
  Oprd1
cgcgcgaggcctctc

SEQ ID NO: 10290 - DNA, 15 bp, Artificial Sequence
  dgRNA
  Oprd1
cagctcggagcccgg

SEQ ID NO: 10291 - DNA, 15 bp, Artificial Sequence
  dgRNA
  Serpina3i
cactagttcacccat

SEQ ID NO: 10292 - DNA, 15 bp, Artificial Sequence
  dgRNA
  Serpina3i
atgggtgaactagtg

SEQ ID NO: 10293 - DNA, 15 bp, Artificial Sequence
  dgRNA
  Serpina3i
ggaacaagcacttac

SEQ ID NO: 10294 - DNA, 15 bp, Artificial Sequence
  dgRNA
  Nme2
ggccctagtgtcaaa

SEQ ID NO: 10295 - DNA, 15 bp, Artificial Sequence
  dgRNA
  Nme2
ggcatgggttatctt

SEQ ID NO: 10296 - DNA, 15 bp, Artificial Sequence
  dgRNA
  Pde2a
gtctgataatgcaga

SEQ ID NO: 10297 - DNA, 15 bp, Artificial Sequence
  dgRNA
  Zfp653
cagaacgcacttcca

SEQ ID NO: 10298 - DNA, 15 bp, Artificial Sequence
  dgRNA
  Zfp653
cgcacttccatggcc

SEQ ID NO: 10299 - DNA, 15 bp, Artificial Sequence
  dgRNA
  Zfp653
gcgcatgcgcagcta

SEQ ID NO: 10300 - DNA, 15 bp, Artificial Sequence
  dgRNA
  Zfp653
ctagttgtccccgtt

SEQ ID NO: 10301 - DNA, 15 bp, Artificial Sequence
  dgRNA
  Tesk1
gtgagggtatcctac

SEQ ID NO: 10302 - DNA, 15 bp, Artificial Sequence
  dgRNA
  Tesk1
accttgcacaaacta

SEQ ID NO: 10303 - DNA, 15 bp, Artificial Sequence
  dgRNA
  Tesk1
gctacccctcctggc

SEQ ID NO: 10304 - DNA, 15 bp, Artificial Sequence
  dgRNA
  Tesk1
gtgtagagattgaaa

SEQ ID NO: 10305 - DNA, 15 bp, Artificial Sequence
  dgRNA
  Tmem2
gccgctgggaaaccc

SEQ ID NO: 10306 - DNA, 15 bp, Artificial Sequence
  dgRNA
  Tmem2
aaccctggccgccga

SEQ ID NO: 10307 - DNA, 15 bp, Artificial Sequence
  dgRNA
  Tmem2
ggccgccgacggtgt

SEQ ID NO: 10308 - DNA, 15 bp, Artificial Sequence
  dgRNA
  Tmem2
cgccgacggtgttgg

SEQ ID NO: 10309 - DNA, 15 bp, Artificial Sequence
  dgRNA
  Cacna2d2
cgcttggagccagcg

SEQ ID NO: 10310 - DNA, 15 bp, Artificial Sequence
  dgRNA
  Cacna2d2
ttggagccagcgcgg

SEQ ID NO: 10311 - DNA, 15 bp, Artificial Sequence
  dgRNA
  Cacna2d2
tggagccagcgcggc

SEQ ID NO: 10312 - DNA, 15 bp, Artificial Sequence
  dgRNA
  Cacna2d2
ggagccagcgcggcg

SEQ ID NO: 10313 - DNA, 15 bp, Artificial Sequence
  dgRNA
  Kbtbd8
tagaaatgctcggct

SEQ ID NO: 10314 - DNA, 15 bp, Artificial Sequence
  dgRNA
  Kbtbd8
agaaatgctcggctt

SEQ ID NO: 10315 - DNA, 15 bp, Artificial Sequence
  dgRNA
  Kbtbd8
ggcctctgtccgact

SEQ ID NO: 10316 - DNA, 15 bp, Artificial Sequence
  dgRNA
  Kbtbd8
ccgactaggagcacg

SEQ ID NO: 10317 - DNA, 15 bp, Artificial Sequence
  dgRNA
  Olfr284
taatggtcttagtcc

SEQ ID NO: 10318 - DNA, 15 bp, Artificial Sequence
  dgRNA
  Olfr284
gtcttagtcccggcc

SEQ ID NO: 10319 - DNA, 15 bp, Artificial Sequence
  dgRNA
  Olfr284
tcttagtcccggcca

SEQ ID NO: 10320 - DNA, 15 bp, Artificial Sequence
  dgRNA
  Olfr284
aggtttatggtgagt

SEQ ID NO: 10321 - DNA, 15 bp, Artificial Sequence
  dgRNA
  Fcrlb
gtgagtaacacactc

SEQ ID NO: 10322 - DNA, 15 bp, Artificial Sequence
  dgRNA
  Fcrlb
ctctaccgagcctgc

SEQ ID NO: 10323 - DNA, 15 bp, Artificial Sequence
  dgRNA
  Fcrlb
aggctcggtagaggt

SEQ ID NO: 10324 - DNA, 15 bp, Artificial Sequence
  dgRNA
  Fcrlb
ctgcaggctcggtag

SEQ ID NO: 10325 - DNA, 15 bp, Artificial Sequence
  dgRNA
  Enoph1
gttcccgcccacgcg

SEQ ID NO: 10326 - DNA, 15 bp, Artificial Sequence
  dgRNA
  Enoph1
gcctattttgaccga

SEQ ID NO: 10327 - DNA, 15 bp, Artificial Sequence
  dgRNA
  Enoph1
cctattttgaccgac

SEQ ID NO: 10328 - DNA, 15 bp, Artificial Sequence
  dgRNA
  Enoph1
tgaccgacgggttcg

SEQ ID NO: 10329 - DNA, 15 bp, Artificial Sequence
  dgRNA
  Ccdc142
gccacctcccgttaa

SEQ ID NO: 10330 - DNA, 15 bp, Artificial Sequence
  dgRNA
  Ccdc142
cccgttaacggtgac

SEQ ID NO: 10331 - DNA, 15 bp, Artificial Sequence
  dgRNA
  Ccdc142
atttgatagtcgtta

SEQ ID NO: 10332 - DNA, 15 bp, Artificial Sequence
  dgRNA
  Ccdc142
tttgatagtcgttaa

SEQ ID NO: 10333 - DNA, 15 bp, Artificial Sequence
  dgRNA
  Ppfia1
agtggatgatcgtca

SEQ ID NO: 10334 - DNA, 15 bp, Artificial Sequence
  dgRNA
  Ppfia1
cgtcacggatagctc

SEQ ID NO: 10335 - DNA, 15 bp, Artificial Sequence
  dgRNA
  Ppfia1
gtcacggatagctct

SEQ ID NO: 10336 - DNA, 15 bp, Artificial Sequence
  dgRNA
  Ppfia1
tgcacctactgattg

SEQ ID NO: 10337 - DNA, 15 bp, Artificial Sequence
  dgRNA
  Mfap1b
taatccgaaccttcc

SEQ ID NO: 10338 - DNA, 15 bp, Artificial Sequence
  dgRNA
  Mfap1b
cgagaaaattgcctt

SEQ ID NO: 10339 - DNA, 15 bp, Artificial Sequence
  dgRNA
  Mfap1b
gttttggtaaggtcc

SEQ ID NO: 10340 - DNA, 15 bp, Artificial Sequence
  dgRNA
  Mfap1b
cgctcaagaactgga

SEQ ID NO: 10341 - DNA, 15 bp, Artificial Sequence
  dgRNA
  Clcn5
tggcgctttcccccc

SEQ ID NO: 10342 - DNA, 15 bp, Artificial Sequence
  dgRNA
  Clcn5
gctttcccccctggc

SEQ ID NO: 10343 - DNA, 15 bp, Artificial Sequence
  dgRNA
  Clcn5
cccctggccggcccg

SEQ ID NO: 10344 - DNA, 15 bp, Artificial Sequence
  dgRNA
  Clcn5
ccggcccgaggtgcc

SEQ ID NO: 10345 - DNA, 15 bp, Artificial Sequence
  dgRNA
  Ehbp1
ggtggtggcggccga

SEQ ID NO: 10346 - DNA, 15 bp, Artificial Sequence
  dgRNA
  Ehbp1
ctgggcgctgaaccg

SEQ ID NO: 10347 - DNA, 15 bp, Artificial Sequence
  dgRNA
  Ehbp1
gctgaaccgcggctc

SEQ ID NO: 10348 - DNA, 15 bp, Artificial Sequence
  dgRNA
  Ehbp1
aaccgcggctctggc

SEQ ID NO: 10349 - DNA, 15 bp, Artificial Sequence
  dgRNA
  Kcne1
gtgtcctttcgctgt

SEQ ID NO: 10350 - DNA, 15 bp, Artificial Sequence
  dgRNA
  Kcne1
cacctgtcaggcggg

SEQ ID NO: 10351 - DNA, 15 bp, Artificial Sequence
  dgRNA
  Kcne1
acctgtcaggcgggt

SEQ ID NO: 10352 - DNA, 15 bp, Artificial Sequence
  dgRNA
  Kcne1
ctgacctacagcgaa

SEQ ID NO: 10353 - DNA, 15 bp, Artificial Sequence
  dgRNA
  Cd37
gcagagacagcgcgg

SEQ ID NO: 10354 - DNA, 15 bp, Artificial Sequence
  dgRNA
  Cd37
cagcgcggtggctcg

SEQ ID NO: 10355 - DNA, 15 bp, Artificial Sequence
  dgRNA
  Cd37
gtggctcgaggctaa

SEQ ID NO: 10356 - DNA, 15 bp, Artificial Sequence
  dgRNA
  Cd37
tggctcgaggctaat

SEQ ID NO: 10357 - DNA, 15 bp, Artificial Sequence
  dgRNA
  Bcan
ccccgctgcaagtct

SEQ ID NO: 10358 - DNA, 15 bp, Artificial Sequence
  dgRNA
  Bcan
cccgctgcaagtctt

SEQ ID NO: 10359 - DNA, 15 bp, Artificial Sequence
  dgRNA
  Bcan
ttgggctcccgtccg

SEQ ID NO: 10360 - DNA, 15 bp, Artificial Sequence
  dgRNA
  Bcan
ctgcccgctgtcgcc

SEQ ID NO: 10361 - DNA, 15 bp, Artificial Sequence
  dgRNA
  P2rx7
ctttgtgcgggcgtc

SEQ ID NO: 10362 - DNA, 15 bp, Artificial Sequence
  dgRNA
  P2rx7
tttgtgcgggcgtct

SEQ ID NO: 10363 - DNA, 15 bp, Artificial Sequence
  dgRNA
  P2rx7
ttgtgcgggcgtctg

SEQ ID NO: 10364 - DNA, 15 bp, Artificial Sequence
  dgRNA
  P2rx7
tgggggaggctagcg

SEQ ID NO: 10365 - DNA, 15 bp, Artificial Sequence
  dgRNA
  Efna1
cctgaccctagtgcg

SEQ ID NO: 10366 - DNA, 15 bp, Artificial Sequence
  dgRNA
  Efna1
cctagtgcggggtta

SEQ ID NO: 10367 - DNA, 15 bp, Artificial Sequence
  dgRNA
  Efna1
ctagtgcggggttac

SEQ ID NO: 10368 - DNA, 15 bp, Artificial Sequence
  dgRNA
  Efna1
tagtgcggggttacg

SEQ ID NO: 10369 - DNA, 15 bp, Artificial Sequence
  dgRNA
  Cdadc1
accacctcggtgcgc

SEQ ID NO: 10370 - DNA, 15 bp, Artificial Sequence
  dgRNA
  Cdadc1
cgtcacattaagcgc

SEQ ID NO: 10371 - DNA, 15 bp, Artificial Sequence
  dgRNA
  Cdadc1
aagcgccggaagcga

SEQ ID NO: 10372 - DNA, 15 bp, Artificial Sequence
  dgRNA
  Cdadc1
agcgccggaagcgat

SEQ ID NO: 10373 - DNA, 15 bp, Artificial Sequence
  dgRNA
  Aldh1a7
cccttaacacagatt

SEQ ID NO: 10374 - DNA, 15 bp, Artificial Sequence
  dgRNA
  Aldh1a7
aacctcttggtggag

SEQ ID NO: 10375 - DNA, 15 bp, Artificial Sequence
  dgRNA
  Aldh1a7
gccaaatctgtgtta

SEQ ID NO: 10376 - DNA, 15 bp, Artificial Sequence
  dgRNA
  Aldh1a7
gttcttctacactat

SEQ ID NO: 10377 - DNA, 15 bp, Artificial Sequence
  dgRNA
  Fam196a
cgtgcctgcctgagg

SEQ ID NO: 10378 - DNA, 15 bp, Artificial Sequence
  dgRNA
  Fam196a
aggagctccgcgcac

SEQ ID NO: 10379 - DNA, 15 bp, Artificial Sequence
  dgRNA
  Fam196a
ttgttgagtctacct

SEQ ID NO: 10380 - DNA, 15 bp, Artificial Sequence
  dgRNA
  Fam196a
gcgctgcggggcccc

SEQ ID NO: 10381 - DNA, 15 bp, Artificial Sequence
  dgRNA
  S100a2
ggaaagtttaacgtc

SEQ ID NO: 10382 - DNA, 15 bp, Artificial Sequence
  dgRNA
  S100a2
gtgacttgtcattcc

SEQ ID NO: 10383 - DNA, 15 bp, Artificial Sequence
  dgRNA
  S100a2
ctagtgacctgcaat

SEQ ID NO: 10384 - DNA, 15 bp, Artificial Sequence
  dgRNA
  S100a2
acctgcaataggttg

SEQ ID NO: 10385 - DNA, 15 bp, Artificial Sequence
  dgRNA
  Gfpt2
cccacccctctcgga

SEQ ID NO: 10386 - DNA, 15 bp, Artificial Sequence
  dgRNA
  Gfpt2
ctctcggagggctac

SEQ ID NO: 10387 - DNA, 15 bp, Artificial Sequence
  dgRNA
  Gfpt2
cggagggctactggc

SEQ ID NO: 10388 - DNA, 15 bp, Artificial Sequence
  dgRNA
  Gfpt2
caggagaccgagcgg

SEQ ID NO: 10389 - DNA, 15 bp, Artificial Sequence
  dgRNA
  Zkscan7
gaagcaaagcctccg

SEQ ID NO: 10390 - DNA, 15 bp, Artificial Sequence
  dgRNA
  Zkscan7
ctcttagctggtaac

SEQ ID NO: 10391 - DNA, 15 bp, Artificial Sequence
  dgRNA
  Zkscan7
cacctagctcttagc

SEQ ID NO: 10392 - DNA, 15 bp, Artificial Sequence
  dgRNA
  Olfr1459
gggtaacgatggaat

SEQ ID NO: 10393 - DNA, 15 bp, Artificial Sequence
  dgRNA
  Olfr1459
aggatggggtaacga

SEQ ID NO: 10394 - DNA, 15 bp, Artificial Sequence
  dgRNA
  Olfr1459
gtattccagtaccat

SEQ ID NO: 10395 - DNA, 15 bp, Artificial Sequence
  dgRNA
  Itga11
agggcgatactggcg

SEQ ID NO: 10396 - DNA, 15 bp, Artificial Sequence
  dgRNA
  Itga11
gggcgatactggcga

SEQ ID NO: 10397 - DNA, 15 bp, Artificial Sequence
  dgRNA
  Itga11
tactggcgagggcgt

SEQ ID NO: 10398 - DNA, 15 bp, Artificial Sequence
  dgRNA
  Itga11
actggcgagggcgtc

SEQ ID NO: 10399 - DNA, 15 bp, Artificial Sequence
  dgRNA
  Ttbk1
ctatggtcaagtgaa

SEQ ID NO: 10400 - DNA, 15 bp, Artificial Sequence
  dgRNA
  Ttbk1
ccatatgagagttcc

SEQ ID NO: 10401 - DNA, 15 bp, Artificial Sequence
  dgRNA
  Ttbk1
catatgagagttccc

SEQ ID NO: 10402 - DNA, 15 bp, Artificial Sequence
  dgRNA
  Ttbk1
tcccgggcagagtct

SEQ ID NO: 10403 - DNA, 15 bp, Artificial Sequence
  dgRNA
  Akr1b10
gtgcgggcactgctg

SEQ ID NO: 10404 - DNA, 15 bp, Artificial Sequence
  dgRNA
  Akr1b10
tgcgggcactgctgc

SEQ ID NO: 10405 - DNA, 15 bp, Artificial Sequence
  dgRNA
  Akr1b10
gtgcacatactctag

SEQ ID NO: 10406 - DNA, 15 bp, Artificial Sequence
  dgRNA
  Akr1b10
agtgcacatactcta

SEQ ID NO: 10407 - DNA, 15 bp, Artificial Sequence
  dgRNA
  Hes6
cccggcctaagtggc

SEQ ID NO: 10408 - DNA, 15 bp, Artificial Sequence
  dgRNA
  Hes6
ctgccagagacccgc

SEQ ID NO: 10409 - DNA, 15 bp, Artificial Sequence
  dgRNA
  Hes6
tgccagagacccgcg

SEQ ID NO: 10410 - DNA, 15 bp, Artificial Sequence
  dgRNA
  Hes6
gcgcgccgctctcat

SEQ ID NO: 10411 - DNA, 15 bp, Artificial Sequence
  dgRNA
  Il12b
atgatagatgcactc

SEQ ID NO: 10412 - DNA, 15 bp, Artificial Sequence
  dgRNA
  Il12b
tgatagatgcactca

SEQ ID NO: 10413 - DNA, 15 bp, Artificial Sequence
  dgRNA
  Il12b
tagatgcactcaggg

SEQ ID NO: 10414 - DNA, 15 bp, Artificial Sequence
  dgRNA
  Il12b
gagtatataagcacc

SEQ ID NO: 10415 - DNA, 15 bp, Artificial Sequence
  dgRNA
  Gm12789
tttttcgattgtaca

SEQ ID NO: 10416 - DNA, 15 bp, Artificial Sequence
  dgRNA
  Slc34a1
ggttgtgatttgtgc

SEQ ID NO: 10417 - DNA, 15 bp, Artificial Sequence
  dgRNA
  Slc34a1
ggacagtctgaccat

SEQ ID NO: 10418 - DNA, 15 bp, Artificial Sequence
  dgRNA
  Slc34a1
agattagcaattaac

SEQ ID NO: 10419 - DNA, 15 bp, Artificial Sequence
  dgRNA
  Slc34a1
tagcaattaactgga

SEQ ID NO: 10420 - DNA, 15 bp, Artificial Sequence
  dgRNA
  Nnat
ggaacggtgttagag

SEQ ID NO: 10421 - DNA, 15 bp, Artificial Sequence
  dgRNA
  Nnat
gaacggtgttagagc

SEQ ID NO: 10422 - DNA, 15 bp, Artificial Sequence
  dgRNA
  Nnat
tgttagagcgggctc

SEQ ID NO: 10423 - DNA, 15 bp, Artificial Sequence
  dgRNA
  Nnat
tagagcgggctcagg

SEQ ID NO: 10424 - DNA, 15 bp, Artificial Sequence
  dgRNA
  Zfand5
agggtgactgggcga

SEQ ID NO: 10425 - DNA, 15 bp, Artificial Sequence
  dgRNA
  Zfand5
ccggctagtgcctgc

SEQ ID NO: 10426 - DNA, 15 bp, Artificial Sequence
  dgRNA
  Zfand5
tagtgcctgcaggtc

SEQ ID NO: 10427 - DNA, 15 bp, Artificial Sequence
  dgRNA
  Zfand5
gacgtcatcgcgccg

SEQ ID NO: 10428 - DNA, 15 bp, Artificial Sequence
  dgRNA
  Hmg20b
gacgcacctcccacg

SEQ ID NO: 10429 - DNA, 15 bp, Artificial Sequence
  dgRNA
  Hmg20b
ttagagcgctatcct

SEQ ID NO: 10430 - DNA, 15 bp, Artificial Sequence
  dgRNA
  Hmg20b
tagagcgctatcctt

SEQ ID NO: 10431 - DNA, 15 bp, Artificial Sequence
  dgRNA
  Hmg20b
gggttcattagcatg

SEQ ID NO: 10432 - DNA, 15 bp, Artificial Sequence
  dgRNA
  Zfp511
ggcggacggaaccgc

SEQ ID NO: 10433 - DNA, 15 bp, Artificial Sequence
  dgRNA
  Zfp511
ggacggaaccgccgg

SEQ ID NO: 10434 - DNA, 15 bp, Artificial Sequence
  dgRNA
  Zfp511
aaccgccggcggcag

SEQ ID NO: 10435 - DNA, 15 bp, Artificial Sequence
  dgRNA
  Zfp511
gctcttccccgctgc

SEQ ID NO: 10436 - DNA, 15 bp, Artificial Sequence
  dgRNA
  Gm436
cttatgcaagtatct

SEQ ID NO: 10437 - DNA, 15 bp, Artificial Sequence
  dgRNA
  Gm436
ttatgcaagtatcta

SEQ ID NO: 10438 - DNA, 15 bp, Artificial Sequence
  dgRNA
  Gm436
gtagtgtataaaact

SEQ ID NO: 10439 - DNA, 15 bp, Artificial Sequence
  dgRNA
  Gm436
gacagcaactcctag

SEQ ID NO: 10440 - DNA, 15 bp, Artificial Sequence
  dgRNA
  Ccl2
tcctggaaacacccg

SEQ ID NO: 10441 - DNA, 15 bp, Artificial Sequence
  dgRNA
  Ccl2
cctggaaacacccga

SEQ ID NO: 10442 - DNA, 15 bp, Artificial Sequence
  dgRNA
  Ccl2
tctgcacttactcag

SEQ ID NO: 10443 - DNA, 15 bp, Artificial Sequence
  dgRNA
  Ccl2
tccatcacttatcca

SEQ ID NO: 10444 - DNA, 15 bp, Artificial Sequence
  dgRNA
  Igsf1
ccttattagcatgct

SEQ ID NO: 10445 - DNA, 15 bp, Artificial Sequence
  dgRNA
  Igsf1
gcatgctaggttcct

SEQ ID NO: 10446 - DNA, 15 bp, Artificial Sequence
  dgRNA
  Igsf1
cctagcatgctaata

SEQ ID NO: 10447 - DNA, 15 bp, Artificial Sequence
  dgRNA
  Rbmxl2
cgagacactcgcttg

SEQ ID NO: 10448 - DNA, 15 bp, Artificial Sequence
  dgRNA
  Rbmxl2
cactcgcttgaggtg

SEQ ID NO: 10449 - DNA, 15 bp, Artificial Sequence
  dgRNA
  Rbmxl2
ctgccgaccaatcac

SEQ ID NO: 10450 - DNA, 15 bp, Artificial Sequence
  dgRNA
  Rbmxl2
cgaccaatcacaggc

SEQ ID NO: 10451 - DNA, 15 bp, Artificial Sequence
  dgRNA
  Gpc6
atagggaccttttgc

SEQ ID NO: 10452 - DNA, 15 bp, Artificial Sequence
  dgRNA
  Gpc6
tcccctcctgcctag

SEQ ID NO: 10453 - DNA, 15 bp, Artificial Sequence
  dgRNA
  Gpc6
ctcgcgatccattcc

SEQ ID NO: 10454 - DNA, 15 bp, Artificial Sequence
  dgRNA
  Gpc6
atttcggctgtgcac

SEQ ID NO: 10455 - DNA, 15 bp, Artificial Sequence
  dgRNA
  Olfr376
agtcatgtatgacca

SEQ ID NO: 10456 - DNA, 15 bp, Artificial Sequence
  dgRNA
  Olfr376
gctctagataatacc

SEQ ID NO: 10457 - DNA, 15 bp, Artificial Sequence
  dgRNA
  Olfr376
gatgcagggcccctt

SEQ ID NO: 10458 - DNA, 15 bp, Artificial Sequence
  dgRNA
  Olfr376
gggccccttaggttt

SEQ ID NO: 10459 - DNA, 15 bp, Artificial Sequence
  dgRNA
  Ramp2
aatttacattgaagg

SEQ ID NO: 10460 - DNA, 15 bp, Artificial Sequence
  dgRNA
  Ramp2
ctcctctccggattt

SEQ ID NO: 10461 - DNA, 15 bp, Artificial Sequence
  dgRNA
  Ramp2
tgccaaaatccggag

SEQ ID NO: 10462 - DNA, 15 bp, Artificial Sequence
  dgRNA
  Ramp2
atgtctgccaaaatc

SEQ ID NO: 10463 - DNA, 15 bp, Artificial Sequence
  dgRNA
  Thpo
cgaaccctgctggga

SEQ ID NO: 10464 - DNA, 15 bp, Artificial Sequence
  dgRNA
  Thpo
ggatctatagcctac

SEQ ID NO: 10465 - DNA, 15 bp, Artificial Sequence
  dgRNA
  Thpo
tcccggtctcaccgc

SEQ ID NO: 10466 - DNA, 15 bp, Artificial Sequence
  dgRNA
  Thpo
ggtctcaccgctggt

SEQ ID NO: 10467 - DNA, 15 bp, Artificial Sequence
  dgRNA
  Cdc20
ccccgtgttccgatt

SEQ ID NO: 10468 - DNA, 15 bp, Artificial Sequence
  dgRNA
  Cdc20
cccgtgttccgattc

SEQ ID NO: 10469 - DNA, 15 bp, Artificial Sequence
  dgRNA
  Cdc20
attcgggctccgatt

SEQ ID NO: 10470 - DNA, 15 bp, Artificial Sequence
  dgRNA
  Cdc20
ttcgggctccgattc

SEQ ID NO: 10471 - DNA, 15 bp, Artificial Sequence
  dgRNA
  Ak4
ccttgacaatagacc

SEQ ID NO: 10472 - DNA, 15 bp, Artificial Sequence
  dgRNA
  Ak4
atagaccgggtcccc

SEQ ID NO: 10473 - DNA, 15 bp, Artificial Sequence
  dgRNA
  Ak4
gaccgggtccccagg

SEQ ID NO: 10474 - DNA, 15 bp, Artificial Sequence
  dgRNA
  Ak4
tggctccggacacgc

SEQ ID NO: 10475 - DNA, 15 bp, Artificial Sequence
  dgRNA
  Mrgprb1
tggactaacttaata

SEQ ID NO: 10476 - DNA, 15 bp, Artificial Sequence
  dgRNA
  Mrgprb1
ttcaactttaactaa

SEQ ID NO: 10477 - DNA, 15 bp, Artificial Sequence
  dgRNA
  Mrgprb1
tcaactttaactaat

SEQ ID NO: 10478 - DNA, 15 bp, Artificial Sequence
  dgRNA
  Mrgprb1
ggttggcatgaccag

SEQ ID NO: 10479 - DNA, 15 bp, Artificial Sequence
  dgRNA
  Cars
catcatgccccacgt

SEQ ID NO: 10480 - DNA, 15 bp, Artificial Sequence
  dgRNA
  Cars
ggcgggacgaaatgg

SEQ ID NO: 10481 - DNA, 15 bp, Artificial Sequence
  dgRNA
  Cars
gggcgggacgaaatg

SEQ ID NO: 10482 - DNA, 15 bp, Artificial Sequence
  dgRNA
  Cars
ggggcgggacgaaat

SEQ ID NO: 10483 - DNA, 15 bp, Artificial Sequence
  dgRNA
  Smox
gacgagagacagtcc

SEQ ID NO: 10484 - DNA, 15 bp, Artificial Sequence
  dgRNA
  Smox
gcgctctgacagtgc

SEQ ID NO: 10485 - DNA, 15 bp, Artificial Sequence
  dgRNA
  Smox
cctcgtctgctttgc

SEQ ID NO: 10486 - DNA, 15 bp, Artificial Sequence
  dgRNA
  Smox
ctcgtctgctttgca

SEQ ID NO: 10487 - DNA, 15 bp, Artificial Sequence
  dgRNA
  Agap1
tctggcgcaattccc

SEQ ID NO: 10488 - DNA, 15 bp, Artificial Sequence
  dgRNA
  Agap1
ctggcgcaattcccc

SEQ ID NO: 10489 - DNA, 15 bp, Artificial Sequence
  dgRNA
  Agap1
caattccccgggatc

SEQ ID NO: 10490 - DNA, 15 bp, Artificial Sequence
  dgRNA
  Agap1
cgggatccggcgcgc

SEQ ID NO: 10491 - DNA, 15 bp, Artificial Sequence
  dgRNA
  Spryd7
gattccctgcggctg

SEQ ID NO: 10492 - DNA, 15 bp, Artificial Sequence
  dgRNA
  Spryd7
cgtcgggattccctg

SEQ ID NO: 10493 - DNA, 15 bp, Artificial Sequence
  dgRNA
  Spryd7
gagctgagagtcgtc

SEQ ID NO: 10494 - DNA, 15 bp, Artificial Sequence
  dgRNA
  Spryd7
ggagctgagagtcgt

SEQ ID NO: 10495 - DNA, 15 bp, Artificial Sequence
  dgRNA
  Hdc
agctgcttgtaggct

SEQ ID NO: 10496 - DNA, 15 bp, Artificial Sequence
  dgRNA
  Hdc
gctgcttgtaggctt

SEQ ID NO: 10497 - DNA, 15 bp, Artificial Sequence
  dgRNA
  Hdc
gcttgtaggcttggg

SEQ ID NO: 10498 - DNA, 15 bp, Artificial Sequence
  dgRNA
  Hdc
gctaggtgccccaac

SEQ ID NO: 10499 - DNA, 15 bp, Artificial Sequence
  dgRNA
  Olfr1260
atatgaccaatacta

SEQ ID NO: 10500 - DNA, 15 bp, Artificial Sequence
  dgRNA
  Olfr1260
attggaccatagtat

SEQ ID NO: 10501 - DNA, 15 bp, Artificial Sequence
  dgRNA
  G6b
tcgaagactgcatgt

SEQ ID NO: 10502 - DNA, 15 bp, Artificial Sequence
  dgRNA
  G6b
cttgaggattcctag

SEQ ID NO: 10503 - DNA, 15 bp, Artificial Sequence
  dgRNA
  G6b
ttgaggattcctaga

SEQ ID NO: 10504 - DNA, 15 bp, Artificial Sequence
  dgRNA
  G6b
agcccccagtccggc

SEQ ID NO: 10505 - DNA, 15 bp, Artificial Sequence
  dgRNA
  Trpm7
cggaacaagttctcg

SEQ ID NO: 10506 - DNA, 15 bp, Artificial Sequence
  dgRNA
  Trpm7
agttctcgtggacag

SEQ ID NO: 10507 - DNA, 15 bp, Artificial Sequence
  dgRNA
  Trpm7
tcgtggacagaggca

SEQ ID NO: 10508 - DNA, 15 bp, Artificial Sequence
  dgRNA
  Trpm7
cagctcggcgtttcc

SEQ ID NO: 10509 - DNA, 15 bp, Artificial Sequence
  dgRNA
  Nt5e
tcaggtttacccgct

SEQ ID NO: 10510 - DNA, 15 bp, Artificial Sequence
  dgRNA
  Nt5e
cctatgccaccgctg

SEQ ID NO: 10511 - DNA, 15 bp, Artificial Sequence
  dgRNA
  Nt5e
ctatgccaccgctga

SEQ ID NO: 10512 - DNA, 15 bp, Artificial Sequence
  dgRNA
  Nt5e
tccagctcgaatacg

SEQ ID NO: 10513 - DNA, 15 bp, Artificial Sequence
  dgRNA
  Cenpb
cctgcgcatctgtcc

SEQ ID NO: 10514 - DNA, 15 bp, Artificial Sequence
  dgRNA
  Cenpb
gacctttcccgcgcg

SEQ ID NO: 10515 - DNA, 15 bp, Artificial Sequence
  dgRNA
  Cenpb
tcccgcgcgtggccg

SEQ ID NO: 10516 - DNA, 15 bp, Artificial Sequence
  dgRNA
  Cenpb
ccgaggcgcacagtc

SEQ ID NO: 10517 - DNA, 15 bp, Artificial Sequence
  dgRNA
  Fam219a
ccggacacggggagg

SEQ ID NO: 10518 - DNA, 15 bp, Artificial Sequence
  dgRNA
  Fam219a
ggaacttgggcgcgc

SEQ ID NO: 10519 - DNA, 15 bp, Artificial Sequence
  dgRNA
  Fam219a
gaacttgggcgcgca

SEQ ID NO: 10520 - DNA, 15 bp, Artificial Sequence
  dgRNA
  Fam219a
cgcgcagggatcctc

SEQ ID NO: 10521 - DNA, 15 bp, Artificial Sequence
  dgRNA
  B020031M17Rik
gtctggattaaagct

SEQ ID NO: 10522 - DNA, 15 bp, Artificial Sequence
  dgRNA
  B020031M17Rik
gttagcttcaacgtc

SEQ ID NO: 10523 - DNA, 15 bp, Artificial Sequence
  dgRNA
  Lsm14a
gcagtcagcatcacc

SEQ ID NO: 10524 - DNA, 15 bp, Artificial Sequence
  dgRNA
  Lsm14a
gtcagcatcaccagg

SEQ ID NO: 10525 - DNA, 15 bp, Artificial Sequence
  dgRNA
  Lsm14a
catcaccaggcggga

SEQ ID NO: 10526 - DNA, 15 bp, Artificial Sequence
  dgRNA
  Lsm14a
atcaccaggcgggat

SEQ ID NO: 10527 - DNA, 15 bp, Artificial Sequence
  dgRNA
  Wdr27
gctacctttaccttt

SEQ ID NO: 10528 - DNA, 15 bp, Artificial Sequence
  dgRNA
  Wdr27
gtgaacgggtaagcg

SEQ ID NO: 10529 - DNA, 15 bp, Artificial Sequence
  dgRNA
  Wdr27
accgtgtattgcaca

SEQ ID NO: 10530 - DNA, 15 bp, Artificial Sequence
  dgRNA
  Wdr27
cggcccacacgtcac

SEQ ID NO: 10531 - DNA, 15 bp, Artificial Sequence
  dgRNA
  Rrs1
aacgtagtcccaacc

SEQ ID NO: 10532 - DNA, 15 bp, Artificial Sequence
  dgRNA
  Rrs1
accctcagcgccagt

SEQ ID NO: 10533 - DNA, 15 bp, Artificial Sequence
  dgRNA
  Rrs1
ccctcagcgccagtc

SEQ ID NO: 10534 - DNA, 15 bp, Artificial Sequence
  dgRNA
  Rrs1
agtcgggccaacatc

SEQ ID NO: 10535 - DNA, 15 bp, Artificial Sequence
  dgRNA
  Sqstm1
tttcccaacgacttg

SEQ ID NO: 10536 - DNA, 15 bp, Artificial Sequence
  dgRNA
  Sqstm1
aacgacttgaggctg

SEQ ID NO: 10537 - DNA, 15 bp, Artificial Sequence
  dgRNA
  Sqstm1
ggtcacccatgtatt

SEQ ID NO: 10538 - DNA, 15 bp, Artificial Sequence
  dgRNA
  Sqstm1
cacccatgtattcgg

SEQ ID NO: 10539 - DNA, 15 bp, Artificial Sequence
  dgRNA
  Dmc1
ttaccgatgacccgc

SEQ ID NO: 10540 - DNA, 15 bp, Artificial Sequence
  dgRNA
  Dmc1
taccgatgacccgca

SEQ ID NO: 10541 - DNA, 15 bp, Artificial Sequence
  dgRNA
  Dmc1
cccgcctacagcccc

SEQ ID NO: 10542 - DNA, 15 bp, Artificial Sequence
  dgRNA
  Dmc1
ggccccgcccatcaa

SEQ ID NO: 10543 - DNA, 15 bp, Artificial Sequence
  dgRNA
  Med31
gatgctcggttctcc

SEQ ID NO: 10544 - DNA, 15 bp, Artificial Sequence
  dgRNA
  Med31
gcaactcttcagtcc

SEQ ID NO: 10545 - DNA, 15 bp, Artificial Sequence
  dgRNA
  Med31
ctggctaaggacctt

SEQ ID NO: 10546 - DNA, 15 bp, Artificial Sequence
  dgRNA
  Med31
ttcatcgagccattc

SEQ ID NO: 10547 - DNA, 15 bp, Artificial Sequence
  dgRNA
  Rusc2
acctactgccccctg

SEQ ID NO: 10548 - DNA, 15 bp, Artificial Sequence
  dgRNA
  Rusc2
ctcccccagactaac

SEQ ID NO: 10549 - DNA, 15 bp, Artificial Sequence
  dgRNA
  Rusc2
agactaacaggccga

SEQ ID NO: 10550 - DNA, 15 bp, Artificial Sequence
  dgRNA
  Rusc2
gactaacaggccgaa

SEQ ID NO: 10551 - DNA, 15 bp, Artificial Sequence
  dgRNA
  2010109I03Rik
gtacgggagagggtt

SEQ ID NO: 10552 - DNA, 15 bp, Artificial Sequence
  dgRNA
  2010109I03Rik
gagggtttggagcgc

SEQ ID NO: 10553 - DNA, 15 bp, Artificial Sequence
  dgRNA
  2010109I03Rik
cacatgtaggtagtc

SEQ ID NO: 10554 - DNA, 15 bp, Artificial Sequence
  dgRNA
  2010109I03Rik
gtgagagacggacca

SEQ ID NO: 10555 - DNA, 15 bp, Artificial Sequence
  dgRNA
  Csnk1g3
cccacggccgcagcc

SEQ ID NO: 10556 - DNA, 15 bp, Artificial Sequence
  dgRNA
  Csnk1g3
accgctcccctctcg

SEQ ID NO: 10557 - DNA, 15 bp, Artificial Sequence
  dgRNA
  Csnk1g3
ccgctcccctctcgc

SEQ ID NO: 10558 - DNA, 15 bp, Artificial Sequence
  dgRNA
  Csnk1g3
gggctgctcgtgcga

SEQ ID NO: 10559 - DNA, 15 bp, Artificial Sequence
  dgRNA
  Entpd5
ggacaataattctgt

SEQ ID NO: 10560 - DNA, 15 bp, Artificial Sequence
  dgRNA
  Entpd5
ccccgccatgagaca

SEQ ID NO: 10561 - DNA, 15 bp, Artificial Sequence
  dgRNA
  Entpd5
tccccgccatgagac

SEQ ID NO: 10562 - DNA, 15 bp, Artificial Sequence
  dgRNA
  Entpd5
gaattattgtccatt

SEQ ID NO: 10563 - DNA, 15 bp, Artificial Sequence
  dgRNA
  Adrb1
ggcggagacagcgct

SEQ ID NO: 10564 - DNA, 15 bp, Artificial Sequence
  dgRNA
  Adrb1
agcgctcggctacgg

SEQ ID NO: 10565 - DNA, 15 bp, Artificial Sequence
  dgRNA
  Adrb1
cggctacggaggaga

SEQ ID NO: 10566 - DNA, 15 bp, Artificial Sequence
  dgRNA
  Adrb1
cggcgtccatgcctc

SEQ ID NO: 10567 - DNA, 15 bp, Artificial Sequence
  dgRNA
  Sema5a
ttgggggtcccatct

SEQ ID NO: 10568 - DNA, 15 bp, Artificial Sequence
  dgRNA
  Sema5a
tcccatctcgggaag

SEQ ID NO: 10569 - DNA, 15 bp, Artificial Sequence
  dgRNA
  Sema5a
catctcgggaagagg

SEQ ID NO: 10570 - DNA, 15 bp, Artificial Sequence
  dgRNA
  Sema5a
atctcgggaagaggc

SEQ ID NO: 10571 - DNA, 15 bp, Artificial Sequence
  dgRNA
  Cox6c
cctttgtaggtagtc

SEQ ID NO: 10572 - DNA, 15 bp, Artificial Sequence
  dgRNA
  Cox6c
caggactcgttttca

SEQ ID NO: 10573 - DNA, 15 bp, Artificial Sequence
  dgRNA
  Cox6c
aagacatagtgtaac

SEQ ID NO: 10574 - DNA, 15 bp, Artificial Sequence
  dgRNA
  Cox6c
tcagctgtgaccggc

SEQ ID NO: 10575 - DNA, 15 bp, Artificial Sequence
  dgRNA
  Rab6b
cttaggctcaagagg

SEQ ID NO: 10576 - DNA, 15 bp, Artificial Sequence
  dgRNA
  Rab6b
gtggctctccggagc

SEQ ID NO: 10577 - DNA, 15 bp, Artificial Sequence
  dgRNA
  Rab6b
cggagccggctgccc

SEQ ID NO: 10578 - DNA, 15 bp, Artificial Sequence
  dgRNA
  Rab6b
agccggctgcccggg

SEQ ID NO: 10579 - DNA, 15 bp, Artificial Sequence
  dgRNA
  Dnajc9
atcattgagctgtgc

SEQ ID NO: 10580 - DNA, 15 bp, Artificial Sequence
  dgRNA
  Dnajc9
aagcgcagtagtggc

SEQ ID NO: 10581 - DNA, 15 bp, Artificial Sequence
  dgRNA
  Dnajc9
gtggctggcaccggg

SEQ ID NO: 10582 - DNA, 15 bp, Artificial Sequence
  dgRNA
  Dnajc9
tggctggcaccgggt

SEQ ID NO: 10583 - DNA, 15 bp, Artificial Sequence
  dgRNA
  Litaf
tcccgcccgaccttt

SEQ ID NO: 10584 - DNA, 15 bp, Artificial Sequence
  dgRNA
  Litaf
ctcgccagcccactc

SEQ ID NO: 10585 - DNA, 15 bp, Artificial Sequence
  dgRNA
  Litaf
agaccccaccccatc

SEQ ID NO: 10586 - DNA, 15 bp, Artificial Sequence
  dgRNA
  Litaf
aaacatctccgcccc

SEQ ID NO: 10587 - DNA, 15 bp, Artificial Sequence
  dgRNA
  Lrrc36
aacaatcacattgtc

SEQ ID NO: 10588 - DNA, 15 bp, Artificial Sequence
  dgRNA
  Ifitm10
aaggggggtcagccg

SEQ ID NO: 10589 - DNA, 15 bp, Artificial Sequence
  dgRNA
  Ifitm10
aggggggtcagccgt

SEQ ID NO: 10590 - DNA, 15 bp, Artificial Sequence
  dgRNA
  Ifitm10
gccgtgggaataaag

SEQ ID NO: 10591 - DNA, 15 bp, Artificial Sequence
  dgRNA
  Ifitm10
acttgccgggacttg

SEQ ID NO: 10592 - DNA, 15 bp, Artificial Sequence
  dgRNA
  Ctdnep1
agctcctgcgcccag

SEQ ID NO: 10593 - DNA, 15 bp, Artificial Sequence
  dgRNA
  Ctdnep1
gctcctgcgcccagg

SEQ ID NO: 10594 - DNA, 15 bp, Artificial Sequence
  dgRNA
  Ctdnep1
ccccgagaatcgccg

SEQ ID NO: 10595 - DNA, 15 bp, Artificial Sequence
  dgRNA
  Ctdnep1
gcgcgcctgcgcaga

SEQ ID NO: 10596 - DNA, 15 bp, Artificial Sequence
  dgRNA
  Tagln3
ctcctgcaccatccg

SEQ ID NO: 10597 - DNA, 15 bp, Artificial Sequence
  dgRNA
  Tagln3
cacccaccgtctgtc

SEQ ID NO: 10598 - DNA, 15 bp, Artificial Sequence
  dgRNA
  Tagln3
acccaccgtctgtct

SEQ ID NO: 10599 - DNA, 15 bp, Artificial Sequence
  dgRNA
  Tagln3
cccaccgtctgtctg

SEQ ID NO: 10600 - DNA, 15 bp, Artificial Sequence
  dgRNA
  Upk3b
ggctggactaggtca

SEQ ID NO: 10601 - DNA, 15 bp, Artificial Sequence
  dgRNA
  Upk3b
gggcccagatagagg

SEQ ID NO: 10602 - DNA, 15 bp, Artificial Sequence
  dgRNA
  Ctf1
ggtgaataggagtcg

SEQ ID NO: 10603 - DNA, 15 bp, Artificial Sequence
  dgRNA
  Ctf1
gtgaataggagtcgg

SEQ ID NO: 10604 - DNA, 15 bp, Artificial Sequence
  dgRNA
  Ctf1
tgaataggagtcggg

SEQ ID NO: 10605 - DNA, 15 bp, Artificial Sequence
  dgRNA
  Ctf1
ggggggatcgaaagc

SEQ ID NO: 10606 - DNA, 15 bp, Artificial Sequence
  dgRNA
  Klhl11
gggccaccataatgg

SEQ ID NO: 10607 - DNA, 15 bp, Artificial Sequence
  dgRNA
  Klhl11
ggccaccataatgga

SEQ ID NO: 10608 - DNA, 15 bp, Artificial Sequence
  dgRNA
  Klhl11
gccaccataatggag

SEQ ID NO: 10609 - DNA, 15 bp, Artificial Sequence
  dgRNA
  Klhl11
cgcttgcctcgctag

SEQ ID NO: 10610 - DNA, 15 bp, Artificial Sequence
  dgRNA
  Gtf2f1
gtcgtgacgtcacga

SEQ ID NO: 10611 - DNA, 15 bp, Artificial Sequence
  dgRNA
  Gtf2f1
tcgtgacgtcacgac

SEQ ID NO: 10612 - DNA, 15 bp, Artificial Sequence
  dgRNA
  Gtf2f1
cacgtgacttttccg

SEQ ID NO: 10613 - DNA, 15 bp, Artificial Sequence
  dgRNA
  Gtf2f1
gagaacgccgccaaa

SEQ ID NO: 10614 - DNA, 15 bp, Artificial Sequence
  dgRNA
  Nat3
gatgatgctagatat

SEQ ID NO: 10615 - DNA, 15 bp, Artificial Sequence
  dgRNA
  Nat3
ttcttaagcaggtag

SEQ ID NO: 10616 - DNA, 15 bp, Artificial Sequence
  dgRNA
  Nat3
gattcaatgaagcct

SEQ ID NO: 10617 - DNA, 15 bp, Artificial Sequence
  dgRNA
  Nat3
tgagactacttgacc

SEQ ID NO: 10618 - DNA, 15 bp, Artificial Sequence
  dgRNA
  Vrtn
ctatcactttaccat

SEQ ID NO: 10619 - DNA, 15 bp, Artificial Sequence
  dgRNA
  Vrtn
gggtaggcgatttcc

SEQ ID NO: 10620 - DNA, 15 bp, Artificial Sequence
  dgRNA
  Vrtn
ggtaggcgatttcct

SEQ ID NO: 10621 - DNA, 15 bp, Artificial Sequence
  dgRNA
  Vrtn
gtaggcgatttcctg

SEQ ID NO: 10622 - DNA, 15 bp, Artificial Sequence
  dgRNA
  Sftpc
atgtgcctaggccaa

SEQ ID NO: 10623 - DNA, 15 bp, Artificial Sequence
  dgRNA
  Sftpc
gcagctgccttatcg

SEQ ID NO: 10624 - DNA, 15 bp, Artificial Sequence
  dgRNA
  Sftpc
tgccttatcggggcc

SEQ ID NO: 10625 - DNA, 15 bp, Artificial Sequence
  dgRNA
  Sftpc
gccttatcggggcct

SEQ ID NO: 10626 - DNA, 15 bp, Artificial Sequence
  dgRNA
  Dyrk1a
tgggacccgctgcct

SEQ ID NO: 10627 - DNA, 15 bp, Artificial Sequence
  dgRNA
  Dyrk1a
cccgctgcctcgggc

SEQ ID NO: 10628 - DNA, 15 bp, Artificial Sequence
  dgRNA
  Dyrk1a
ccgctgcctcgggcc

SEQ ID NO: 10629 - DNA, 15 bp, Artificial Sequence
  dgRNA
  Dyrk1a
tgcctcgggccgggc

SEQ ID NO: 10630 - DNA, 15 bp, Artificial Sequence
  dgRNA
  Proser3
agagagaacgcccct

SEQ ID NO: 10631 - DNA, 15 bp, Artificial Sequence
  dgRNA
  Proser3
tatcattggtcgctt

SEQ ID NO: 10632 - DNA, 15 bp, Artificial Sequence
  dgRNA
  Proser3
cattggtcgctttgg

SEQ ID NO: 10633 - DNA, 15 bp, Artificial Sequence
  dgRNA
  Proser3
cggcgttgcttagcg

SEQ ID NO: 10634 - DNA, 15 bp, Artificial Sequence
  dgRNA
  Cd84
tataaactccacaaa

SEQ ID NO: 10635 - DNA, 15 bp, Artificial Sequence
  dgRNA
  Cd84
catccatgatatgtc

SEQ ID NO: 10636 - DNA, 15 bp, Artificial Sequence
  dgRNA
  Cd84
gattgataattatac

SEQ ID NO: 10637 - DNA, 15 bp, Artificial Sequence
  dgRNA
  Cd84
gtgccagacatatca

SEQ ID NO: 10638 - DNA, 15 bp, Artificial Sequence
  dgRNA
  Sox6
ggctctattgcatga

SEQ ID NO: 10639 - DNA, 15 bp, Artificial Sequence
  dgRNA
  Sox6
gaattctcctgtcta

SEQ ID NO: 10640 - DNA, 15 bp, Artificial Sequence
  dgRNA
  Sox6
agatcggaatttggc

SEQ ID NO: 10641 - DNA, 15 bp, Artificial Sequence
  dgRNA
  Sox6
acagagatcggaatt

SEQ ID NO: 10642 - DNA, 15 bp, Artificial Sequence
  dgRNA
  Hoxd8
ccggggcggcagcct

SEQ ID NO: 10643 - DNA, 15 bp, Artificial Sequence
  dgRNA
  Hoxd8
gggcggcagcctcgg

SEQ ID NO: 10644 - DNA, 15 bp, Artificial Sequence
  dgRNA
  Hoxd8
ggcggcgacagcgct

SEQ ID NO: 10645 - DNA, 15 bp, Artificial Sequence
  dgRNA
  Hoxd8
ggcgacagcgctggg

SEQ ID NO: 10646 - DNA, 15 bp, Artificial Sequence
  dgRNA
  Bdnf
taatgctcgcatacg

SEQ ID NO: 10647 - DNA, 15 bp, Artificial Sequence
  dgRNA
  Bdnf
ctcgcatacgtggaa

SEQ ID NO: 10648 - DNA, 15 bp, Artificial Sequence
  dgRNA
  Bdnf
tcgcatacgtggaaa

SEQ ID NO: 10649 - DNA, 15 bp, Artificial Sequence
  dgRNA
  Bdnf
tgatcaactattaac

SEQ ID NO: 10650 - DNA, 15 bp, Artificial Sequence
  dgRNA
  Vps8
tccggctcagatgcc

SEQ ID NO: 10651 - DNA, 15 bp, Artificial Sequence
  dgRNA
  Vps8
ccggctcagatgcca

SEQ ID NO: 10652 - DNA, 15 bp, Artificial Sequence
  dgRNA
  Vps8
ctccttgagcgtccc

SEQ ID NO: 10653 - DNA, 15 bp, Artificial Sequence
  dgRNA
  Vps8
cttgagcgtccctgg

SEQ ID NO: 10654 - DNA, 15 bp, Artificial Sequence
  dgRNA
  Casp8
gaccaagggactaac

SEQ ID NO: 10655 - DNA, 15 bp, Artificial Sequence
  dgRNA
  Casp8
tacgtttgaatttac

SEQ ID NO: 10656 - DNA, 15 bp, Artificial Sequence
  dgRNA
  Casp8
gtacgtttgaattta

SEQ ID NO: 10657 - DNA, 15 bp, Artificial Sequence
  dgRNA
  Ncf1
gttgggccatggtgt

SEQ ID NO: 10658 - DNA, 15 bp, Artificial Sequence
  dgRNA
  Ncf1
tggtgtcggtagaac

SEQ ID NO: 10659 - DNA, 15 bp, Artificial Sequence
  dgRNA
  Ncf1
accatggcccaaccc

SEQ ID NO: 10660 - DNA, 15 bp, Artificial Sequence
  dgRNA
  Ncf1
gttctaccgacacca

SEQ ID NO: 10661 - DNA, 15 bp, Artificial Sequence
  dgRNA
  Olfm1
ttttatccgtcctcc

SEQ ID NO: 10662 - DNA, 15 bp, Artificial Sequence
  dgRNA
  Olfm1
tttatccgtcctcct

SEQ ID NO: 10663 - DNA, 15 bp, Artificial Sequence
  dgRNA
  Olfm1
aactcttcggccgac

SEQ ID NO: 10664 - DNA, 15 bp, Artificial Sequence
  dgRNA
  Olfm1
agccagggggcgtcg

SEQ ID NO: 10665 - DNA, 15 bp, Artificial Sequence
  dgRNA
  Mrps35
tgctcttccgttccc

SEQ ID NO: 10666 - DNA, 15 bp, Artificial Sequence
  dgRNA
  Mrps35
caggttacacacttc

SEQ ID NO: 10667 - DNA, 15 bp, Artificial Sequence
  dgRNA
  Mrps35
acagtctacgtctac

SEQ ID NO: 10668 - DNA, 15 bp, Artificial Sequence
  dgRNA
  Mrps35
ctgttgtggaatgat

SEQ ID NO: 10669 - DNA, 15 bp, Artificial Sequence
  dgRNA
  Olfr1440
actcaaactgtgaag

SEQ ID NO: 10670 - DNA, 15 bp, Artificial Sequence
  dgRNA
  Olfr1440
aagttagcttgattg

SEQ ID NO: 10671 - DNA, 15 bp, Artificial Sequence
  dgRNA
  Olfr1440
cgagcatctatctgc

SEQ ID NO: 10672 - DNA, 15 bp, Artificial Sequence
  dgRNA
  Olfr1440
ttttgcctacagtac

SEQ ID NO: 10673 - DNA, 15 bp, Artificial Sequence
  dgRNA
  Prc1
cgcttcccacgccct

SEQ ID NO: 10674 - DNA, 15 bp, Artificial Sequence
  dgRNA
  Prc1
ttcccacgccctagg

SEQ ID NO: 10675 - DNA, 15 bp, Artificial Sequence
  dgRNA
  Prc1
gcagcagcccttcgc

SEQ ID NO: 10676 - DNA, 15 bp, Artificial Sequence
  dgRNA
  Prc1
gcagcccttcgcagg

SEQ ID NO: 10677 - DNA, 15 bp, Artificial Sequence
  dgRNA
  Wdr31
gaaaatacgctctct

SEQ ID NO: 10678 - DNA, 15 bp, Artificial Sequence
  dgRNA
  Wdr31
tacgctctctcggct

SEQ ID NO: 10679 - DNA, 15 bp, Artificial Sequence
  dgRNA
  Wdr31
tcggctcggcccctg

SEQ ID NO: 10680 - DNA, 15 bp, Artificial Sequence
  dgRNA
  Wdr31
cggctcggcccctga

SEQ ID NO: 10681 - DNA, 15 bp, Artificial Sequence
  dgRNA
  Slc37a4
caatgtccggcagcc

SEQ ID NO: 10682 - DNA, 15 bp, Artificial Sequence
  dgRNA
  Slc37a4
agcctggcaccgcaa

SEQ ID NO: 10683 - DNA, 15 bp, Artificial Sequence
  dgRNA
  Slc37a4
attgaccaagggagt

SEQ ID NO: 10684 - DNA, 15 bp, Artificial Sequence
  dgRNA
  Slc37a4
ttgaccaagggagta

SEQ ID NO: 10685 - DNA, 15 bp, Artificial Sequence
  dgRNA
  Man2a2
gtggcgcgaccttgc

SEQ ID NO: 10686 - DNA, 15 bp, Artificial Sequence
  dgRNA
  Man2a2
tggcgcgaccttgct

SEQ ID NO: 10687 - DNA, 15 bp, Artificial Sequence
  dgRNA
  Man2a2
ggcgcgaccttgctg

SEQ ID NO: 10688 - DNA, 15 bp, Artificial Sequence
  dgRNA
  Man2a2
ccactcccgccctgc

SEQ ID NO: 10689 - DNA, 15 bp, Artificial Sequence
  dgRNA
  H2-M1
gtttaccactaccat

SEQ ID NO: 10690 - DNA, 15 bp, Artificial Sequence
  dgRNA
  H2-M1
tttaccactaccatt

SEQ ID NO: 10691 - DNA, 15 bp, Artificial Sequence
  dgRNA
  Hist1h1a
agacaggcgcacggg

SEQ ID NO: 10692 - DNA, 15 bp, Artificial Sequence
  dgRNA
  Hist1h1a
caggcgcacgggagg

SEQ ID NO: 10693 - DNA, 15 bp, Artificial Sequence
  dgRNA
  Hist1h1a
aggcgcacgggaggc

SEQ ID NO: 10694 - DNA, 15 bp, Artificial Sequence
  dgRNA
  Hist1h1a
ggcgcacgggaggcg

SEQ ID NO: 10695 - DNA, 15 bp, Artificial Sequence
  dgRNA
  Fyn
gctcaacccactcgg

SEQ ID NO: 10696 - DNA, 15 bp, Artificial Sequence
  dgRNA
  Fyn
cggcggccccaccca

SEQ ID NO: 10697 - DNA, 15 bp, Artificial Sequence
  dgRNA
  Fyn
cgacgcattcaccaa

SEQ ID NO: 10698 - DNA, 15 bp, Artificial Sequence
  dgRNA
  Fyn
agcgggccctttgat

SEQ ID NO: 10699 - DNA, 15 bp, Artificial Sequence
  dgRNA
  Slc30a5
acgctgtagccaaga

SEQ ID NO: 10700 - DNA, 15 bp, Artificial Sequence
  dgRNA
  Slc30a5
aagatggaccttagg

SEQ ID NO: 10701 - DNA, 15 bp, Artificial Sequence
  dgRNA
  Slc30a5
cttaggtggcgctgc

SEQ ID NO: 10702 - DNA, 15 bp, Artificial Sequence
  dgRNA
  Slc30a5
ttaggtggcgctgca

SEQ ID NO: 10703 - DNA, 15 bp, Artificial Sequence
  dgRNA
  Myo1c
gctccgcctgtcccg

SEQ ID NO: 10704 - DNA, 15 bp, Artificial Sequence
  dgRNA
  Myo1c
cctgtcccggggcgc

SEQ ID NO: 10705 - DNA, 15 bp, Artificial Sequence
  dgRNA
  Myo1c
ggcgccggccgtatt

SEQ ID NO: 10706 - DNA, 15 bp, Artificial Sequence
  dgRNA
  Myo1c
ctttcccgggactcg

SEQ ID NO: 10707 - DNA, 15 bp, Artificial Sequence
  dgRNA
  Dlgap3
tataccgcagcccac

SEQ ID NO: 10708 - DNA, 15 bp, Artificial Sequence
  dgRNA
  Dlgap3
gtgtgctcggatgcc

SEQ ID NO: 10709 - DNA, 15 bp, Artificial Sequence
  dgRNA
  Dlgap3
gccttatgtgcagat

SEQ ID NO: 10710 - DNA, 15 bp, Artificial Sequence
  dgRNA
  Kcnk2
gttcctttcggattc

SEQ ID NO: 10711 - DNA, 15 bp, Artificial Sequence
  dgRNA
  Kcnk2
gtagcctggaacagc

SEQ ID NO: 10712 - DNA, 15 bp, Artificial Sequence
  dgRNA
  Kcnk2
gtatgactgagtcag

SEQ ID NO: 10713 - DNA, 15 bp, Artificial Sequence
  dgRNA
  Kcnk2
ctgtatgactgagtc

SEQ ID NO: 10714 - DNA, 15 bp, Artificial Sequence
  dgRNA
  Bmp3
tgcctttttgctagg

SEQ ID NO: 10715 - DNA, 15 bp, Artificial Sequence
  dgRNA
  Bmp3
ggtggcgctggcgag

SEQ ID NO: 10716 - DNA, 15 bp, Artificial Sequence
  dgRNA
  Bmp3
aggtggcgctggcga

SEQ ID NO: 10717 - DNA, 15 bp, Artificial Sequence
  dgRNA
  Bmp3
caggtggcgctggcg

SEQ ID NO: 10718 - DNA, 15 bp, Artificial Sequence
  dgRNA
  Tspan7
gcagggcgcgcgcga

SEQ ID NO: 10719 - DNA, 15 bp, Artificial Sequence
  dgRNA
  Tspan7
cagcctgcgcgcgca

SEQ ID NO: 10720 - DNA, 15 bp, Artificial Sequence
  dgRNA
  Tspan7
agcctgcgcgcgcac

SEQ ID NO: 10721 - DNA, 15 bp, Artificial Sequence
  dgRNA
  Tspan7
gcgcacgggaagctc

SEQ ID NO: 10722 - DNA, 15 bp, Artificial Sequence
  dgRNA
  Sac3d1
acacgtacgtaaagc

SEQ ID NO: 10723 - DNA, 15 bp, Artificial Sequence
  dgRNA
  Sac3d1
gtgtggcctgcgtcg

SEQ ID NO: 10724 - DNA, 15 bp, Artificial Sequence
  dgRNA
  Sac3d1
tgtggcctgcgtcgc

SEQ ID NO: 10725 - DNA, 15 bp, Artificial Sequence
  dgRNA
  Sac3d1
tacctttgcatggtc

SEQ ID NO: 10726 - DNA, 15 bp, Artificial Sequence
  dgRNA
  Aldoc
tagggccctgttggc

SEQ ID NO: 10727 - DNA, 15 bp, Artificial Sequence
  dgRNA
  Aldoc
agggttccatgatgt

SEQ ID NO: 10728 - DNA, 15 bp, Artificial Sequence
  dgRNA
  Aldoc
ttaagcctggtttag

SEQ ID NO: 10729 - DNA, 15 bp, Artificial Sequence
  dgRNA
  Aldoc
ttatgtggaatgttg

SEQ ID NO: 10730 - DNA, 15 bp, Artificial Sequence
  dgRNA
  Fbxo25
caccagaaccgaccc

SEQ ID NO: 10731 - DNA, 15 bp, Artificial Sequence
  dgRNA
  Fbxo25
accagaaccgaccct

SEQ ID NO: 10732 - DNA, 15 bp, Artificial Sequence
  dgRNA
  Fbxo25
gaccctggggcgcct

SEQ ID NO: 10733 - DNA, 15 bp, Artificial Sequence
  dgRNA
  Fbxo25
ctggggcgcctagga

SEQ ID NO: 10734 - DNA, 15 bp, Artificial Sequence
  dgRNA
  Gabbr1
catcagtctagtctg

SEQ ID NO: 10735 - DNA, 15 bp, Artificial Sequence
  dgRNA
  Gabbr1
atcagtctagtctgc

SEQ ID NO: 10736 - DNA, 15 bp, Artificial Sequence
  dgRNA
  Gabbr1
agtctgcgggtctct

SEQ ID NO: 10737 - DNA, 15 bp, Artificial Sequence
  dgRNA
  Gabbr1
ccccgcctgcatgcg

SEQ ID NO: 10738 - DNA, 15 bp, Artificial Sequence
  dgRNA
  Psmd10
ctacggctttctcta

SEQ ID NO: 10739 - DNA, 15 bp, Artificial Sequence
  dgRNA
  Psmd10
tagttccactttgct

SEQ ID NO: 10740 - DNA, 15 bp, Artificial Sequence
  dgRNA
  Psmd10
cactttgctaggacc

SEQ ID NO: 10741 - DNA, 15 bp, Artificial Sequence
  dgRNA
  Psmd10
tccaaagacgcctcc

SEQ ID NO: 10742 - DNA, 15 bp, Artificial Sequence
  dgRNA
  Cnot2
gcgttgtgcttctca

SEQ ID NO: 10743 - DNA, 15 bp, Artificial Sequence
  dgRNA
  Cnot2
cttctcacggtcgac

SEQ ID NO: 10744 - DNA, 15 bp, Artificial Sequence
  dgRNA
  Cnot2
cggtcgactggcgta

SEQ ID NO: 10745 - DNA, 15 bp, Artificial Sequence
  dgRNA
  Cnot2
ggtcgactggcgtac

SEQ ID NO: 10746 - DNA, 15 bp, Artificial Sequence
  dgRNA
  Fkbp14
ggcacatccgagccc

SEQ ID NO: 10747 - DNA, 15 bp, Artificial Sequence
  dgRNA
  Fkbp14
ttttttcggcgccat

SEQ ID NO: 10748 - DNA, 15 bp, Artificial Sequence
  dgRNA
  Fkbp14
ttcggcgccattggc

SEQ ID NO: 10749 - DNA, 15 bp, Artificial Sequence
  dgRNA
  Fkbp14
tcggcgccattggct

SEQ ID NO: 10750 - DNA, 15 bp, Artificial Sequence
  dgRNA
  Dusp23
cctgctcgcgtccgt

SEQ ID NO: 10751 - DNA, 15 bp, Artificial Sequence
  dgRNA
  Dusp23
ctgctcgcgtccgtt

SEQ ID NO: 10752 - DNA, 15 bp, Artificial Sequence
  dgRNA
  Dusp23
cgtccgttgggctgt

SEQ ID NO: 10753 - DNA, 15 bp, Artificial Sequence
  dgRNA
  Dusp23
gtccgttgggctgta

SEQ ID NO: 10754 - DNA, 15 bp, Artificial Sequence
  dgRNA
  Ms4a2
cggtgtgctctggat

SEQ ID NO: 10755 - DNA, 15 bp, Artificial Sequence
  dgRNA
  Ms4a2
gcggtgtgctctgga

SEQ ID NO: 10756 - DNA, 15 bp, Artificial Sequence
  dgRNA
  Ms4a2
aaatgcggtgtgctc

SEQ ID NO: 10757 - DNA, 15 bp, Artificial Sequence
  dgRNA
  Rqcd1
agcccctaacccggg

SEQ ID NO: 10758 - DNA, 15 bp, Artificial Sequence
  dgRNA
  Rqcd1
ccactttaccaactt

SEQ ID NO: 10759 - DNA, 15 bp, Artificial Sequence
  dgRNA
  Rqcd1
cgcacgcgcctggac

SEQ ID NO: 10760 - DNA, 15 bp, Artificial Sequence
  dgRNA
  Rqcd1
ttacgcgcacgcgcc

SEQ ID NO: 10761 - DNA, 15 bp, Artificial Sequence
  dgRNA
  Arhgef11
gccagcggccggccc

SEQ ID NO: 10762 - DNA, 15 bp, Artificial Sequence
  dgRNA
  Arhgef11
gccggcccgggcgag

SEQ ID NO: 10763 - DNA, 15 bp, Artificial Sequence
  dgRNA
  Arhgef11
gagcggagtccgccg

SEQ ID NO: 10764 - DNA, 15 bp, Artificial Sequence
  dgRNA
  Arhgef11
cggagtccgccgtgg

SEQ ID NO: 10765 - DNA, 15 bp, Artificial Sequence
  dgRNA
  Mynn
gtgagcagctcgcac

SEQ ID NO: 10766 - DNA, 15 bp, Artificial Sequence
  dgRNA
  Mynn
ggatgcgagtgagca

SEQ ID NO: 10767 - DNA, 15 bp, Artificial Sequence
  dgRNA
  Mynn
tgtgatccggagacc

SEQ ID NO: 10768 - DNA, 15 bp, Artificial Sequence
  dgRNA
  Mynn
gtgatccggagacct

SEQ ID NO: 10769 - DNA, 15 bp, Artificial Sequence
  dgRNA
  Acap3
gagcccatatttgag

SEQ ID NO: 10770 - DNA, 15 bp, Artificial Sequence
  dgRNA
  Acap3
ccatatttgagcggg

SEQ ID NO: 10771 - DNA, 15 bp, Artificial Sequence
  dgRNA
  Acap3
catatttgagcgggc

SEQ ID NO: 10772 - DNA, 15 bp, Artificial Sequence
  dgRNA
  Acap3
atatttgagcgggcg

SEQ ID NO: 10773 - DNA, 15 bp, Artificial Sequence
  dgRNA
  Olfr1180
cagatagattaatga

SEQ ID NO: 10774 - DNA, 15 bp, Artificial Sequence
  dgRNA
  Bean1
tctgtccaacctttc

SEQ ID NO: 10775 - DNA, 15 bp, Artificial Sequence
  dgRNA
  Bean1
accatatgtcagaga

SEQ ID NO: 10776 - DNA, 15 bp, Artificial Sequence
  dgRNA
  Bean1
ggccggcacaccagg

SEQ ID NO: 10777 - DNA, 15 bp, Artificial Sequence
  dgRNA
  Bean1
ggaggccggcacacc

SEQ ID NO: 10778 - DNA, 15 bp, Artificial Sequence
  dgRNA
  Vps37b
atcatgaccgcgtga

SEQ ID NO: 10779 - DNA, 15 bp, Artificial Sequence
  dgRNA
  Vps37b
cgtgatggcgtcaca

SEQ ID NO: 10780 - DNA, 15 bp, Artificial Sequence
  dgRNA
  Vps37b
tgaagcctcggactc

SEQ ID NO: 10781 - DNA, 15 bp, Artificial Sequence
  dgRNA
  Vps37b
gaagcctcggactct

SEQ ID NO: 10782 - DNA, 15 bp, Artificial Sequence
  dgRNA
  Ccbe1
ccagcatactccctc

SEQ ID NO: 10783 - DNA, 15 bp, Artificial Sequence
  dgRNA
  Ccbe1
ccctccggccgcgca

SEQ ID NO: 10784 - DNA, 15 bp, Artificial Sequence
  dgRNA
  Ccbe1
tccggccgcgcaagg

SEQ ID NO: 10785 - DNA, 15 bp, Artificial Sequence
  dgRNA
  Ccbe1
tcggttcaccccctc

SEQ ID NO: 10786 - DNA, 15 bp, Artificial Sequence
  dgRNA
  Tmem50a
acagacttgtcggcg

SEQ ID NO: 10787 - DNA, 15 bp, Artificial Sequence
  dgRNA
  Tmem50a
gacttgtcggcgcgg

SEQ ID NO: 10788 - DNA, 15 bp, Artificial Sequence
  dgRNA
  Tmem50a
acttgtcggcgcggt

SEQ ID NO: 10789 - DNA, 15 bp, Artificial Sequence
  dgRNA
  Tmem50a
tcggcgcggtgggcg

SEQ ID NO: 10790 - DNA, 15 bp, Artificial Sequence
  dgRNA
  Slc9a6
cccgtgtttcttcag

SEQ ID NO: 10791 - DNA, 15 bp, Artificial Sequence
  dgRNA
  Slc9a6
gataagttttcactt

SEQ ID NO: 10792 - DNA, 15 bp, Artificial Sequence
  dgRNA
  Slc9a6
tctaggcgtgcctgt

SEQ ID NO: 10793 - DNA, 15 bp, Artificial Sequence
  dgRNA
  Slc9a6
aggcgtgcctgtagg

SEQ ID NO: 10794 - DNA, 15 bp, Artificial Sequence
  dgRNA
  Trpm1
ggggaccacttcaaa

SEQ ID NO: 10795 - DNA, 15 bp, Artificial Sequence
  dgRNA
  Trpm1
gaccacttcaaaggg

SEQ ID NO: 10796 - DNA, 15 bp, Artificial Sequence
  dgRNA
  Trpm1
gaagcccccactggc

SEQ ID NO: 10797 - DNA, 15 bp, Artificial Sequence
  dgRNA
  Trpm1
cgtgacctggctccc

SEQ ID NO: 10798 - DNA, 15 bp, Artificial Sequence
  dgRNA
  Tmem176b
atcatctactcctga

SEQ ID NO: 10799 - DNA, 15 bp, Artificial Sequence
  dgRNA
  Tmem176b
tggacccccctcaag

SEQ ID NO: 10800 - DNA, 15 bp, Artificial Sequence
  dgRNA
  Tmem176b
ggacccccctcaagt

SEQ ID NO: 10801 - DNA, 15 bp, Artificial Sequence
  dgRNA
  Tmem176b
gacccccctcaagtg

SEQ ID NO: 10802 - DNA, 15 bp, Artificial Sequence
  dgRNA
  Pappa2
ctatgctgttcatat

SEQ ID NO: 10803 - DNA, 15 bp, Artificial Sequence
  dgRNA
  Pappa2
caaagctaataagtt

SEQ ID NO: 10804 - DNA, 15 bp, Artificial Sequence
  dgRNA
  Pappa2
ctataattatctcct

SEQ ID NO: 10805 - DNA, 15 bp, Artificial Sequence
  dgRNA
  Gigyf1
gctttggttaactca

SEQ ID NO: 10806 - DNA, 15 bp, Artificial Sequence
  dgRNA
  Gigyf1
gagtggtcacctgtc

SEQ ID NO: 10807 - DNA, 15 bp, Artificial Sequence
  dgRNA
  Gigyf1
gtctcaccgtctaga

SEQ ID NO: 10808 - DNA, 15 bp, Artificial Sequence
  dgRNA
  Gigyf1
tcaccgtctagatgg

SEQ ID NO: 10809 - DNA, 15 bp, Artificial Sequence
  dgRNA
  Sgsm1
tcaccctaggcaact

SEQ ID NO: 10810 - DNA, 15 bp, Artificial Sequence
  dgRNA
  Sgsm1
cctgtcgctaacgcc

SEQ ID NO: 10811 - DNA, 15 bp, Artificial Sequence
  dgRNA
  Sgsm1
gtcgctaacgcctgg

SEQ ID NO: 10812 - DNA, 15 bp, Artificial Sequence
  dgRNA
  Sgsm1
gctaacgcctggagg

SEQ ID NO: 10813 - DNA, 15 bp, Artificial Sequence
  dgRNA
  Galntl6
catctggcagccgcg

SEQ ID NO: 10814 - DNA, 15 bp, Artificial Sequence
  dgRNA
  Galntl6
ctaggctcccgcacg

SEQ ID NO: 10815 - DNA, 15 bp, Artificial Sequence
  dgRNA
  Galntl6
cgggtaatctcgaac

SEQ ID NO: 10816 - DNA, 15 bp, Artificial Sequence
  dgRNA
  Galntl6
cggatcctctcttct

SEQ ID NO: 10817 - DNA, 15 bp, Artificial Sequence
  dgRNA
  Dlk1
tagcagcgtgcgccc

SEQ ID NO: 10818 - DNA, 15 bp, Artificial Sequence
  dgRNA
  Dlk1
taagtgcggctgccg

SEQ ID NO: 10819 - DNA, 15 bp, Artificial Sequence
  dgRNA
  Dlk1
gcacgctgctaagtg

SEQ ID NO: 10820 - DNA, 15 bp, Artificial Sequence
  dgRNA
  Btc
tctgagcgtgtcctt

SEQ ID NO: 10821 - DNA, 15 bp, Artificial Sequence
  dgRNA
  Btc
gtgggagcagcgtgc

SEQ ID NO: 10822 - DNA, 15 bp, Artificial Sequence
  dgRNA
  Btc
cgctcagagggccac

SEQ ID NO: 10823 - DNA, 15 bp, Artificial Sequence
  dgRNA
  Btc
aaggacacgctcaga

SEQ ID NO: 10824 - DNA, 15 bp, Artificial Sequence
  dgRNA
  Ammecr1l
tcgggtgagctgaac

SEQ ID NO: 10825 - DNA, 15 bp, Artificial Sequence
  dgRNA
  Ammecr1l
catctgcgtgagcct

SEQ ID NO: 10826 - DNA, 15 bp, Artificial Sequence
  dgRNA
  Ammecr1l
atgtcacgtgaccaa

SEQ ID NO: 10827 - DNA, 15 bp, Artificial Sequence
  dgRNA
  Ammecr1l
tgtcacgtgaccaat

SEQ ID NO: 10828 - DNA, 15 bp, Artificial Sequence
  dgRNA
  Rabl3
cagcacctcaactac

SEQ ID NO: 10829 - DNA, 15 bp, Artificial Sequence
  dgRNA
  Rabl3
gccacttgcgagaca

SEQ ID NO: 10830 - DNA, 15 bp, Artificial Sequence
  dgRNA
  Rabl3
cctaattcctgcgac

SEQ ID NO: 10831 - DNA, 15 bp, Artificial Sequence
  dgRNA
  Rabl3
ttcctgcgaccggtt

SEQ ID NO: 10832 - DNA, 15 bp, Artificial Sequence
  dgRNA
  Mif
gaagcagcgcgctga

SEQ ID NO: 10833 - DNA, 15 bp, Artificial Sequence
  dgRNA
  Mif
aagcagcgcgctgaa

SEQ ID NO: 10834 - DNA, 15 bp, Artificial Sequence
  dgRNA
  Mif
cagtcaccgcccctt

SEQ ID NO: 10835 - DNA, 15 bp, Artificial Sequence
  dgRNA
  Mif
agtcaccgccccttt

SEQ ID NO: 10836 - DNA, 15 bp, Artificial Sequence
  dgRNA
  Padi2
ggggagcgtccagaa

SEQ ID NO: 10837 - DNA, 15 bp, Artificial Sequence
  dgRNA
  Padi2
gggagcgtccagaaa

SEQ ID NO: 10838 - DNA, 15 bp, Artificial Sequence
  dgRNA
  Padi2
ggagcgtccagaaag

SEQ ID NO: 10839 - DNA, 15 bp, Artificial Sequence
  dgRNA
  Padi2
ccaaacacggaaaac

SEQ ID NO: 10840 - DNA, 15 bp, Artificial Sequence
  dgRNA
  Itgb5
ccaactccaagaccg

SEQ ID NO: 10841 - DNA, 15 bp, Artificial Sequence
  dgRNA
  Itgb5
actccaagaccgggg

SEQ ID NO: 10842 - DNA, 15 bp, Artificial Sequence
  dgRNA
  Itgb5
ctccaagaccgggga

SEQ ID NO: 10843 - DNA, 15 bp, Artificial Sequence
  dgRNA
  Itgb5
cccgatccccacaag

SEQ ID NO: 10844 - DNA, 15 bp, Artificial Sequence
  dgRNA
  Mmrn1
ttgatccatcctagg

SEQ ID NO: 10845 - DNA, 15 bp, Artificial Sequence
  dgRNA
  Mmrn1
tgatccatcctagga

SEQ ID NO: 10846 - DNA, 15 bp, Artificial Sequence
  dgRNA
  Mmrn1
tcagcaggaaacgcc

SEQ ID NO: 10847 - DNA, 15 bp, Artificial Sequence
  dgRNA
  Mmrn1
tggacaattatcagc

SEQ ID NO: 10848 - DNA, 15 bp, Artificial Sequence
  dgRNA
  Tor1aip2
ctgcccgcctccgct

SEQ ID NO: 10849 - DNA, 15 bp, Artificial Sequence
  dgRNA
  Tor1aip2
tgcccgcctccgctc

SEQ ID NO: 10850 - DNA, 15 bp, Artificial Sequence
  dgRNA
  Tor1aip2
caccaccttcccgcg

SEQ ID NO: 10851 - DNA, 15 bp, Artificial Sequence
  dgRNA
  Tor1aip2
cgtccttccctcttg

SEQ ID NO: 10852 - DNA, 15 bp, Artificial Sequence
  dgRNA
  Slc44a5
ttgaatcctgctgac

SEQ ID NO: 10853 - DNA, 15 bp, Artificial Sequence
  dgRNA
  Slc44a5
gctaccaactgtcgc

SEQ ID NO: 10854 - DNA, 15 bp, Artificial Sequence
  dgRNA
  Slc44a5
aactgtcgctggacg

SEQ ID NO: 10855 - DNA, 15 bp, Artificial Sequence
  dgRNA
  Slc44a5
actgtcgctggacga

SEQ ID NO: 10856 - DNA, 15 bp, Artificial Sequence
  dgRNA
  Olfr539
aagaggcttacacga

SEQ ID NO: 10857 - DNA, 15 bp, Artificial Sequence
  dgRNA
  Olfr539
ccatcattctgaatc

SEQ ID NO: 10858 - DNA, 15 bp, Artificial Sequence
  dgRNA
  Zmynd11
tgcatatttgagacg

SEQ ID NO: 10859 - DNA, 15 bp, Artificial Sequence
  dgRNA
  Zmynd11
ttgagacggggaact

SEQ ID NO: 10860 - DNA, 15 bp, Artificial Sequence
  dgRNA
  Zmynd11
tgagacggggaactc

SEQ ID NO: 10861 - DNA, 15 bp, Artificial Sequence
  dgRNA
  Zmynd11
caggattggaaagcg

SEQ ID NO: 10862 - DNA, 15 bp, Artificial Sequence
  dgRNA
  Dnm2
ggagggttgttcgct

SEQ ID NO: 10863 - DNA, 15 bp, Artificial Sequence
  dgRNA
  Dnm2
gagggttgttcgctc

SEQ ID NO: 10864 - DNA, 15 bp, Artificial Sequence
  dgRNA
  Dnm2
gttgttcgctcgggt

SEQ ID NO: 10865 - DNA, 15 bp, Artificial Sequence
  dgRNA
  Dnm2
ttgttcgctcgggtc

SEQ ID NO: 10866 - DNA, 15 bp, Artificial Sequence
  dgRNA
  BC100451
cttggttaaccagac

SEQ ID NO: 10867 - DNA, 15 bp, Artificial Sequence
  dgRNA
  BC100451
ttggttaaccagaca

SEQ ID NO: 10868 - DNA, 15 bp, Artificial Sequence
  dgRNA
  BC100451
ctggttaaccaaggg

SEQ ID NO: 10869 - DNA, 15 bp, Artificial Sequence
  dgRNA
  BC100451
tgtctggttaaccaa

SEQ ID NO: 10870 - DNA, 15 bp, Artificial Sequence
  dgRNA
  Ppil2
ggaggcaacgcagta

SEQ ID NO: 10871 - DNA, 15 bp, Artificial Sequence
  dgRNA
  Ppil2
ggcaacgcagtatgg

SEQ ID NO: 10872 - DNA, 15 bp, Artificial Sequence
  dgRNA
  Ppil2
gcaacgcagtatggt

SEQ ID NO: 10873 - DNA, 15 bp, Artificial Sequence
  dgRNA
  Ppil2
tttctatgcactgtc

SEQ ID NO: 10874 - DNA, 15 bp, Artificial Sequence
  dgRNA
  Btbd2
cccgccctctagccc

SEQ ID NO: 10875 - DNA, 15 bp, Artificial Sequence
  dgRNA
  Btbd2
ccgccctctagcccc

SEQ ID NO: 10876 - DNA, 15 bp, Artificial Sequence
  dgRNA
  Btbd2
cgccctctagccccg

SEQ ID NO: 10877 - DNA, 15 bp, Artificial Sequence
  dgRNA
  Btbd2
ccttcacctcaagtc

SEQ ID NO: 10878 - DNA, 15 bp, Artificial Sequence
  dgRNA
  Ikbkap
tgcctctgccgggtg

SEQ ID NO: 10879 - DNA, 15 bp, Artificial Sequence
  dgRNA
  Ikbkap
gcctctgccgggtga

SEQ ID NO: 10880 - DNA, 15 bp, Artificial Sequence
  dgRNA
  Ikbkap
ggctccccgatcccc

SEQ ID NO: 10881 - DNA, 15 bp, Artificial Sequence
  dgRNA
  Ikbkap
ctcgagctcctgagg

SEQ ID NO: 10882 - DNA, 15 bp, Artificial Sequence
  dgRNA
  Ank3
catttacattcggct

SEQ ID NO: 10883 - DNA, 15 bp, Artificial Sequence
  dgRNA
  Ank3
tggtaacgagagatc

SEQ ID NO: 10884 - DNA, 15 bp, Artificial Sequence
  dgRNA
  Ank3
gtggtaacgagagat

SEQ ID NO: 10885 - DNA, 15 bp, Artificial Sequence
  dgRNA
  Ank3
gcattgggtataccc

SEQ ID NO: 10886 - DNA, 15 bp, Artificial Sequence
  dgRNA
  Defb28
ttattacccatgact

SEQ ID NO: 10887 - DNA, 15 bp, Artificial Sequence
  dgRNA
  Defb28
cagatctagccccca

SEQ ID NO: 10888 - DNA, 15 bp, Artificial Sequence
  dgRNA
  Defb28
ctcgttccagtgttt

SEQ ID NO: 10889 - DNA, 15 bp, Artificial Sequence
  dgRNA
  Defb28
gctcgttccagtgtt

SEQ ID NO: 10890 - DNA, 15 bp, Artificial Sequence
  dgRNA
  Arpin
ctgtcttagtctata

SEQ ID NO: 10891 - DNA, 15 bp, Artificial Sequence
  dgRNA
  Arpin
ccctgttactgcacg

SEQ ID NO: 10892 - DNA, 15 bp, Artificial Sequence
  dgRNA
  Arpin
ttactgcacgaggtc

SEQ ID NO: 10893 - DNA, 15 bp, Artificial Sequence
  dgRNA
  Arpin
cgaggtctggctgtc

SEQ ID NO: 10894 - DNA, 15 bp, Artificial Sequence
  dgRNA
  Cep85l
gtagggagcggcttc

SEQ ID NO: 10895 - DNA, 15 bp, Artificial Sequence
  dgRNA
  Cep85l
ttcgccaagagtccc

SEQ ID NO: 10896 - DNA, 15 bp, Artificial Sequence
  dgRNA
  Cep85l
ccaggccccgccttg

SEQ ID NO: 10897 - DNA, 15 bp, Artificial Sequence
  dgRNA
  Cep85l
aggccccgcctgtcc

SEQ ID NO: 10898 - DNA, 15 bp, Artificial Sequence
  dgRNA
  Cds2
ttgtcccccggtaac

SEQ ID NO: 10899 - DNA, 15 bp, Artificial Sequence
  dgRNA
  Cds2
taacaggttaccttc

SEQ ID NO: 10900 - DNA, 15 bp, Artificial Sequence
  dgRNA
  Cds2
cccagcactcgcgcg

SEQ ID NO: 10901 - DNA, 15 bp, Artificial Sequence
  dgRNA
  Cds2
ccagcactcgcgcgc

SEQ ID NO: 10902 - DNA, 15 bp, Artificial Sequence
  dgRNA
  Cd28
cctgagcacattatc

SEQ ID NO: 10903 - DNA, 15 bp, Artificial Sequence
  dgRNA
  Cd28
gagcacattatctgg

SEQ ID NO: 10904 - DNA, 15 bp, Artificial Sequence
  dgRNA
  Cd28
cacattatctggtgg

SEQ ID NO: 10905 - DNA, 15 bp, Artificial Sequence
  dgRNA
  Cd28
agtcacgaagccttg

SEQ ID NO: 10906 - DNA, 15 bp, Artificial Sequence
  dgRNA
  Aatf
agcggtcacgtgctc

SEQ ID NO: 10907 - DNA, 15 bp, Artificial Sequence
  dgRNA
  Aatf
cgcgccgcgcgtccg

SEQ ID NO: 10908 - DNA, 15 bp, Artificial Sequence
  dgRNA
  Aatf
gcgccgcgcgtccga

SEQ ID NO: 10909 - DNA, 15 bp, Artificial Sequence
  dgRNA
  Aatf
cgccgcgcgtccgag

SEQ ID NO: 10910 - DNA, 15 bp, Artificial Sequence
  dgRNA
  Eno1
tttccacaccgccgg

SEQ ID NO: 10911 - DNA, 15 bp, Artificial Sequence
  dgRNA
  Eno1
tccagaacctcccgg

SEQ ID NO: 10912 - DNA, 15 bp, Artificial Sequence
  dgRNA
  Eno1
ccagaacctcccggt

SEQ ID NO: 10913 - DNA, 15 bp, Artificial Sequence
  dgRNA
  Eno1
cagaacctcccggtg

SEQ ID NO: 10914 - DNA, 15 bp, Artificial Sequence
  dgRNA
  Hectd3
aaatgtaatattcgt

SEQ ID NO: 10915 - DNA, 15 bp, Artificial Sequence
  dgRNA
  Hectd3
aatgtaatattcgtt

SEQ ID NO: 10916 - DNA, 15 bp, Artificial Sequence
  dgRNA
  Hectd3
atgtaatattcgttg

SEQ ID NO: 10917 - DNA, 15 bp, Artificial Sequence
  dgRNA
  Hectd3
aatattcgttgggga

SEQ ID NO: 10918 - DNA, 15 bp, Artificial Sequence
  dgRNA
  Slco1a5
ccaagtggctaatct

SEQ ID NO: 10919 - DNA, 15 bp, Artificial Sequence
  dgRNA
  Slco1a5
cgcctgctttcccaa

SEQ ID NO: 10920 - DNA, 15 bp, Artificial Sequence
  dgRNA
  Slco1a5
ccaagattagccact

SEQ ID NO: 10921 - DNA, 15 bp, Artificial Sequence
  dgRNA
  Slco1a5
aacaggttataatct

SEQ ID NO: 10922 - DNA, 15 bp, Artificial Sequence
  dgRNA
  Gm6904
gatgtaataaagcac

SEQ ID NO: 10923 - DNA, 15 bp, Artificial Sequence
  dgRNA
  Abcf3
agcgaaaacccgcac

SEQ ID NO: 10924 - DNA, 15 bp, Artificial Sequence
  dgRNA
  Abcf3
ggtggtagacgtaga

SEQ ID NO: 10925 - DNA, 15 bp, Artificial Sequence
  dgRNA
  Abcf3
gtggtagacgtagac

SEQ ID NO: 10926 - DNA, 15 bp, Artificial Sequence
  dgRNA
  Abcf3
acgtagacgggaaac

SEQ ID NO: 10927 - DNA, 15 bp, Artificial Sequence
  dgRNA
  Trim63
tgtttacgaccccca

SEQ ID NO: 10928 - DNA, 15 bp, Artificial Sequence
  dgRNA
  Trim63
tacgacccccacggc

SEQ ID NO: 10929 - DNA, 15 bp, Artificial Sequence
  dgRNA
  Trim63
acgacccccacggca

SEQ ID NO: 10930 - DNA, 15 bp, Artificial Sequence
  dgRNA
  Trim63
agggccaaatctttg

SEQ ID NO: 10931 - DNA, 15 bp, Artificial Sequence
  dgRNA
  Gm11744
tagtagtgaatgttc

SEQ ID NO: 10932 - DNA, 15 bp, Artificial Sequence
  dgRNA
  Gm11744
gcactcagggttacc

SEQ ID NO: 10933 - DNA, 15 bp, Artificial Sequence
  dgRNA
  Gm11744
tctcttcacaaggtc

SEQ ID NO: 10934 - DNA, 15 bp, Artificial Sequence
  dgRNA
  Gm11744
cgggctttggcatca

SEQ ID NO: 10935 - DNA, 15 bp, Artificial Sequence
  dgRNA
  Hoxa3
gggctgcgctttgtc

SEQ ID NO: 10936 - DNA, 15 bp, Artificial Sequence
  dgRNA
  Hoxa3
cgctttgtccggcga

SEQ ID NO: 10937 - DNA, 15 bp, Artificial Sequence
  dgRNA
  Hoxa3
cggcgatggcgagcg

SEQ ID NO: 10938 - DNA, 15 bp, Artificial Sequence
  dgRNA
  Hoxa3
ggcgatggcgagcga

SEQ ID NO: 10939 - DNA, 15 bp, Artificial Sequence
  dgRNA
  Dalrd3
atggaccctcaaatt

SEQ ID NO: 10940 - DNA, 15 bp, Artificial Sequence
  dgRNA
  Dalrd3
gaccctcaaatttgg

SEQ ID NO: 10941 - DNA, 15 bp, Artificial Sequence
  dgRNA
  Dalrd3
caaatttggaggtta

SEQ ID NO: 10942 - DNA, 15 bp, Artificial Sequence
  dgRNA
  Dalrd3
agggctcatgaatac

SEQ ID NO: 10943 - DNA, 15 bp, Artificial Sequence
  dgRNA
  Ext1
ccgcccgtgcgctcc

SEQ ID NO: 10944 - DNA, 15 bp, Artificial Sequence
  dgRNA
  Ext1
cgcccgtgcgctcct

SEQ ID NO: 10945 - DNA, 15 bp, Artificial Sequence
  dgRNA
  Ext1
cgccggcgcctctgc

SEQ ID NO: 10946 - DNA, 15 bp, Artificial Sequence
  dgRNA
  Ext1
gcctctgccggccgc

SEQ ID NO: 10947 - DNA, 15 bp, Artificial Sequence
  dgRNA
  Coro1a
tcgtgaccaagatgg

SEQ ID NO: 10948 - DNA, 15 bp, Artificial Sequence
  dgRNA
  Coro1a
gggagcggccgtagc

SEQ ID NO: 10949 - DNA, 15 bp, Artificial Sequence
  dgRNA
  Coro1a
ggagcggccgtagct

SEQ ID NO: 10950 - DNA, 15 bp, Artificial Sequence
  dgRNA
  Coro1a
cagaacctatgcccc

SEQ ID NO: 10951 - DNA, 15 bp, Artificial Sequence
  dgRNA
  St8sia6
gatgactctggtcaa

SEQ ID NO: 10952 - DNA, 15 bp, Artificial Sequence
  dgRNA
  St8sia6
actctggtcaaaggt

SEQ ID NO: 10953 - DNA, 15 bp, Artificial Sequence
  dgRNA
  St8sia6
gatctcttggtaatt

SEQ ID NO: 10954 - DNA, 15 bp, Artificial Sequence
  dgRNA
  St8sia6
ggtgtcaactgtcca

SEQ ID NO: 10955 - DNA, 15 bp, Artificial Sequence
  dgRNA
  Pcsk6
tatggggaactcacg

SEQ ID NO: 10956 - DNA, 15 bp, Artificial Sequence
  dgRNA
  Pcsk6
atggggaactcacgt

SEQ ID NO: 10957 - DNA, 15 bp, Artificial Sequence
  dgRNA
  Pcsk6
ttctagcagaacgcg

SEQ ID NO: 10958 - DNA, 15 bp, Artificial Sequence
  dgRNA
  Pcsk6
gaacgcgcggagccc

SEQ ID NO: 10959 - DNA, 15 bp, Artificial Sequence
  dgRNA
  Acoxl
aaactctagctgagc

SEQ ID NO: 10960 - DNA, 15 bp, Artificial Sequence
  dgRNA
  Acoxl
caacccagtccctat

SEQ ID NO: 10961 - DNA, 15 bp, Artificial Sequence
  dgRNA
  Acoxl
tccctattggtccta

SEQ ID NO: 10962 - DNA, 15 bp, Artificial Sequence
  dgRNA
  Acoxl
ctcatgacttccggg

SEQ ID NO: 10963 - DNA, 15 bp, Artificial Sequence
  dgRNA
  Serpinb6a
ggataggctagattg

SEQ ID NO: 10964 - DNA, 15 bp, Artificial Sequence
  dgRNA
  Serpinb6a
gataggctagattgt

SEQ ID NO: 10965 - DNA, 15 bp, Artificial Sequence
  dgRNA
  Serpinb6a
agattgtgggtccgc

SEQ ID NO: 10966 - DNA, 15 bp, Artificial Sequence
  dgRNA
  Serpinb6a
ccgcaggcactcacc

SEQ ID NO: 10967 - DNA, 15 bp, Artificial Sequence
  dgRNA
  Ube3a
gcgcgcgctgcctgt

SEQ ID NO: 10968 - DNA, 15 bp, Artificial Sequence
  dgRNA
  Ube3a
cgcgcgctgcctgtc

SEQ ID NO: 10969 - DNA, 15 bp, Artificial Sequence
  dgRNA
  Ube3a
gcctgtcgggatact

SEQ ID NO: 10970 - DNA, 15 bp, Artificial Sequence
  dgRNA
  Ube3a
accgagtatcccgac

SEQ ID NO: 10971 - DNA, 15 bp, Artificial Sequence
  dgRNA
  Olfr702
tatgccaaatttgaa

SEQ ID NO: 10972 - DNA, 15 bp, Artificial Sequence
  dgRNA
  Pramef25
attgtggcccaagca

SEQ ID NO: 10973 - DNA, 15 bp, Artificial Sequence
  dgRNA
  Pramef25
gcttgggccacaatg

SEQ ID NO: 10974 - DNA, 15 bp, Artificial Sequence
  dgRNA
  Fbxo41
ccgctcccctcttgc

SEQ ID NO: 10975 - DNA, 15 bp, Artificial Sequence
  dgRNA
  Fbxo41
gagagcccgccccgg

SEQ ID NO: 10976 - DNA, 15 bp, Artificial Sequence
  dgRNA
  Fbxo41
agcccgccccggagg

SEQ ID NO: 10977 - DNA, 15 bp, Artificial Sequence
  dgRNA
  Fbxo41
gcccgccccggagga

SEQ ID NO: 10978 - DNA, 15 bp, Artificial Sequence
  dgRNA
  G3bp2
cagtgggacgcgaga

SEQ ID NO: 10979 - DNA, 15 bp, Artificial Sequence
  dgRNA
  G3bp2
gggacgcgagaaggt

SEQ ID NO: 10980 - DNA, 15 bp, Artificial Sequence
  dgRNA
  G3bp2
ggacgcgagaaggtt

SEQ ID NO: 10981 - DNA, 15 bp, Artificial Sequence
  dgRNA
  G3bp2
tgatgcctgattggc

SEQ ID NO: 10982 - DNA, 15 bp, Artificial Sequence
  dgRNA
  Mroh2a
tggttgagagtgcct

SEQ ID NO: 10983 - DNA, 15 bp, Artificial Sequence
  dgRNA
  Mroh2a
ggttgagagtgcctt

SEQ ID NO: 10984 - DNA, 15 bp, Artificial Sequence
  dgRNA
  Mroh2a
aaagttccaagggtc

SEQ ID NO: 10985 - DNA, 15 bp, Artificial Sequence
  dgRNA
  Mroh2a
tatggtggcctgttt

SEQ ID NO: 10986 - DNA, 15 bp, Artificial Sequence
  dgRNA
  Txndc5
atgagctcagcggga

SEQ ID NO: 10987 - DNA, 15 bp, Artificial Sequence
  dgRNA
  Txndc5
gctcagcgggatgga

SEQ ID NO: 10988 - DNA, 15 bp, Artificial Sequence
  dgRNA
  Txndc5
ggactgagatagcgc

SEQ ID NO: 10989 - DNA, 15 bp, Artificial Sequence
  dgRNA
  Txndc5
ctgagatagcgctgg

SEQ ID NO: 10990 - DNA, 15 bp, Artificial Sequence
  dgRNA
  Sh3bp2
gcgctgagccccaag

SEQ ID NO: 10991 - DNA, 15 bp, Artificial Sequence
  dgRNA
  Sh3bp2
taggaccttgctgtg

SEQ ID NO: 10992 - DNA, 15 bp, Artificial Sequence
  dgRNA
  Sh3bp2
aaaacgccttctcct

SEQ ID NO: 10993 - DNA, 15 bp, Artificial Sequence
  dgRNA
  Sh3bp2
aaacgccttctcctt

SEQ ID NO: 10994 - DNA, 15 bp, Artificial Sequence
  dgRNA
  Scin
attcaggttcccgcc

SEQ ID NO: 10995 - DNA, 15 bp, Artificial Sequence
  dgRNA
  Scin
gttcccgcccgggtt

SEQ ID NO: 10996 - DNA, 15 bp, Artificial Sequence
  dgRNA
  Scin
ttcccgcccgggttc

SEQ ID NO: 10997 - DNA, 15 bp, Artificial Sequence
  dgRNA
  Scin
ttcgggcgtggctgt

SEQ ID NO: 10998 - DNA, 15 bp, Artificial Sequence
  dgRNA
  Wfdc18
tatttgaaccaacct

SEQ ID NO: 10999 - DNA, 15 bp, Artificial Sequence
  dgRNA
  Wfdc18
ctcagcatacgccac

SEQ ID NO: 11000 - DNA, 15 bp, Artificial Sequence
  dgRNA
  Wfdc18
gttcaaataataacc

SEQ ID NO: 11001 - DNA, 15 bp, Artificial Sequence
  dgRNA
  Wfdc18
gtattgttcctaggt

SEQ ID NO: 11002 - DNA, 15 bp, Artificial Sequence
  dgRNA
  Cnga2
atttagcctccagta

SEQ ID NO: 11003 - DNA, 15 bp, Artificial Sequence
  dgRNA
  Cnga2
tagcctccagtaagg

SEQ ID NO: 11004 - DNA, 15 bp, Artificial Sequence
  dgRNA
  Cnga2
agcctccagtaaggt

SEQ ID NO: 11005 - DNA, 15 bp, Artificial Sequence
  dgRNA
  Cnga2
ctggaggctaaatca

SEQ ID NO: 11006 - DNA, 15 bp, Artificial Sequence
  dgRNA
  Tgm1
tcccgcccctaccag

SEQ ID NO: 11007 - DNA, 15 bp, Artificial Sequence
  dgRNA
  Tgm1
ggcctcttgacagga

SEQ ID NO: 11008 - DNA, 15 bp, Artificial Sequence
  dgRNA
  Tgm1
cataaactgcttacc

SEQ ID NO: 11009 - DNA, 15 bp, Artificial Sequence
  dgRNA
  Tgm1
gctaaggagggggtc

SEQ ID NO: 11010 - DNA, 15 bp, Artificial Sequence
  dgRNA
  Cd79a
tgagagtagccgctg

SEQ ID NO: 11011 - DNA, 15 bp, Artificial Sequence
  dgRNA
  Cd79a
gaaccatggctcgcc

SEQ ID NO: 11012 - DNA, 15 bp, Artificial Sequence
  dgRNA
  Cd79a
aattgtggccagccc

SEQ ID NO: 11013 - DNA, 15 bp, Artificial Sequence
  dgRNA
  Cd79a
ggctactctcaactt

SEQ ID NO: 11014 - DNA, 15 bp, Artificial Sequence
  dgRNA
  Dnajb8
tgtggtgctcggttg

SEQ ID NO: 11015 - DNA, 15 bp, Artificial Sequence
  dgRNA
  Dnajb8
gtggtgctcggttga

SEQ ID NO: 11016 - DNA, 15 bp, Artificial Sequence
  dgRNA
  Dnajb8
ggtgctcggttgagg

SEQ ID NO: 11017 - DNA, 15 bp, Artificial Sequence
  dgRNA
  Dnajb8
gctcggttgaggggg

SEQ ID NO: 11018 - DNA, 15 bp, Artificial Sequence
  dgRNA
  Arhgap17
taactccgcccatgt

SEQ ID NO: 11019 - DNA, 15 bp, Artificial Sequence
  dgRNA
  Arhgap17
aactccgcccatgtt

SEQ ID NO: 11020 - DNA, 15 bp, Artificial Sequence
  dgRNA
  Arhgap17
cggcctctttcggct

SEQ ID NO: 11021 - DNA, 15 bp, Artificial Sequence
  dgRNA
  Arhgap17
tctttcggctaggct

SEQ ID NO: 11022 - DNA, 15 bp, Artificial Sequence
  dgRNA
  Klk1b8
aatgcttaccacagc

SEQ ID NO: 11023 - DNA, 15 bp, Artificial Sequence
  dgRNA
  Klk1b8
cttttagtcagcatc

SEQ ID NO: 11024 - DNA, 15 bp, Artificial Sequence
  dgRNA
  Rc3h2
tcgcgagagctaaat

SEQ ID NO: 11025 - DNA, 15 bp, Artificial Sequence
  dgRNA
  Rc3h2
cgcgagagctaaatc

SEQ ID NO: 11026 - DNA, 15 bp, Artificial Sequence
  dgRNA
  Rc3h2
aatcgggatccctcc

SEQ ID NO: 11027 - DNA, 15 bp, Artificial Sequence
  dgRNA
  Rc3h2
ccaggtccgcctccg

SEQ ID NO: 11028 - DNA, 15 bp, Artificial Sequence
  dgRNA
  Tmem196
tgtgtgaacccgcca

SEQ ID NO: 11029 - DNA, 15 bp, Artificial Sequence
  dgRNA
  Tmem196
gtgtgaacccgccac

SEQ ID NO: 11030 - DNA, 15 bp, Artificial Sequence
  dgRNA
  Tmem196
gaacccgccacgggc

SEQ ID NO: 11031 - DNA, 15 bp, Artificial Sequence
  dgRNA
  Tmem196
acggaaatggttctc

SEQ ID NO: 11032 - DNA, 15 bp, Artificial Sequence
  dgRNA
  Tarsl2
acagttgccccgata

SEQ ID NO: 11033 - DNA, 15 bp, Artificial Sequence
  dgRNA
  Tarsl2
cgctccgccccatgc

SEQ ID NO: 11034 - DNA, 15 bp, Artificial Sequence
  dgRNA
  Tarsl2
gctccgccccatgca

SEQ ID NO: 11035 - DNA, 15 bp, Artificial Sequence
  dgRNA
  Tarsl2
agaggggcgggctat

SEQ ID NO: 11036 - DNA, 15 bp, Artificial Sequence
  dgRNA
  Rab5c
cgccccaccggcagc

SEQ ID NO: 11037 - DNA, 15 bp, Artificial Sequence
  dgRNA
  Rab5c
cggctcctccctgtg

SEQ ID NO: 11038 - DNA, 15 bp, Artificial Sequence
  dgRNA
  Rab5c
ttcccgcgttgattg

SEQ ID NO: 11039 - DNA, 15 bp, Artificial Sequence
  dgRNA
  Rab5c
tcccgcgttgattgt

SEQ ID NO: 11040 - DNA, 15 bp, Artificial Sequence
  dgRNA
  Dclk1
cacctgcaacttgcc

SEQ ID NO: 11041 - DNA, 15 bp, Artificial Sequence
  dgRNA
  Dclk1
tatgattcagtgcaa

SEQ ID NO: 11042 - DNA, 15 bp, Artificial Sequence
  dgRNA
  Dclk1
agggattgagccggc

SEQ ID NO: 11043 - DNA, 15 bp, Artificial Sequence
  dgRNA
  Dclk1
gggattgagccggct

SEQ ID NO: 11044 - DNA, 15 bp, Artificial Sequence
  dgRNA
  Olfr550
gactggctaaaaagt

SEQ ID NO: 11045 - DNA, 15 bp, Artificial Sequence
  dgRNA
  Map2k4
gagtcaccctgatcc

SEQ ID NO: 11046 - DNA, 15 bp, Artificial Sequence
  dgRNA
  Map2k4
ctcaacctgtattgc

SEQ ID NO: 11047 - DNA, 15 bp, Artificial Sequence
  dgRNA
  Map2k4
gcgcgtcagtgctag

SEQ ID NO: 11048 - DNA, 15 bp, Artificial Sequence
  dgRNA
  Map2k4
cgcgtcagtgctagt

SEQ ID NO: 11049 - DNA, 15 bp, Artificial Sequence
  dgRNA
  Errfi1
tagaaacgtcccctc

SEQ ID NO: 11050 - DNA, 15 bp, Artificial Sequence
  dgRNA
  Errfi1
tcccctcaggagacg

SEQ ID NO: 11051 - DNA, 15 bp, Artificial Sequence
  dgRNA
  Errfi1
gctgctagcgccgcc

SEQ ID NO: 11052 - DNA, 15 bp, Artificial Sequence
  dgRNA
  Errfi1
gctagcgccgcccgg

SEQ ID NO: 11053 - DNA, 15 bp, Artificial Sequence
  dgRNA
  Smtn
gcggagccagccatc

SEQ ID NO: 11054 - DNA, 15 bp, Artificial Sequence
  dgRNA
  Smtn
atctggctggcgccg

SEQ ID NO: 11055 - DNA, 15 bp, Artificial Sequence
  dgRNA
  Smtn
tctggctggcgccgc

SEQ ID NO: 11056 - DNA, 15 bp, Artificial Sequence
  dgRNA
  Smtn
ctggcgccgcgggac

SEQ ID NO: 11057 - DNA, 15 bp, Artificial Sequence
  dgRNA
  Ankrd42
gaaacaagcctcggc

SEQ ID NO: 11058 - DNA, 15 bp, Artificial Sequence
  dgRNA
  Ankrd42
ccaccgaaaaccact

SEQ ID NO: 11059 - DNA, 15 bp, Artificial Sequence
  dgRNA
  Ankrd42
ggtaccagagcagcg

SEQ ID NO: 11060 - DNA, 15 bp, Artificial Sequence
  dgRNA
  Ankrd42
agcgcggctttccac

SEQ ID NO: 11061 - DNA, 15 bp, Artificial Sequence
  dgRNA
  Hormad1
tcagcgacctgaccc

SEQ ID NO: 11062 - DNA, 15 bp, Artificial Sequence
  dgRNA
  Hormad1
gacctgaccccggtc

SEQ ID NO: 11063 - DNA, 15 bp, Artificial Sequence
  dgRNA
  Hormad1
accccggtcaggcct

SEQ ID NO: 11064 - DNA, 15 bp, Artificial Sequence
  dgRNA
  Hormad1
tgctggggacggcgc

SEQ ID NO: 11065 - DNA, 15 bp, Artificial Sequence
  dgRNA
  Als2cl
aagggcggcccggcg

SEQ ID NO: 11066 - DNA, 15 bp, Artificial Sequence
  dgRNA
  Als2cl
agctgcgcggccact

SEQ ID NO: 11067 - DNA, 15 bp, Artificial Sequence
  dgRNA
  Als2cl
gctgcgcggccactc

SEQ ID NO: 11068 - DNA, 15 bp, Artificial Sequence
  dgRNA
  Als2cl
ctgcgcggccactcg

SEQ ID NO: 11069 - DNA, 15 bp, Artificial Sequence
  dgRNA
  Whsc1l1
tatacactacctctg

SEQ ID NO: 11070 - DNA, 15 bp, Artificial Sequence
  dgRNA
  Whsc1l1
ccctaaggatcaggc

SEQ ID NO: 11071 - DNA, 15 bp, Artificial Sequence
  dgRNA
  Slc9a9
ggagggccacgagtc

SEQ ID NO: 11072 - DNA, 15 bp, Artificial Sequence
  dgRNA
  Slc9a9
gatgaaaccaccctc

SEQ ID NO: 11073 - DNA, 15 bp, Artificial Sequence
  dgRNA
  Slc9a9
gttgtaacgagaagc

SEQ ID NO: 11074 - DNA, 15 bp, Artificial Sequence
  dgRNA
  Slc9a9
tgatgtccagactcg

SEQ ID NO: 11075 - DNA, 15 bp, Artificial Sequence
  dgRNA
  Polr3h
ggcttgcttcaggat

SEQ ID NO: 11076 - DNA, 15 bp, Artificial Sequence
  dgRNA
  Polr3h
ggggccccgcccttt

SEQ ID NO: 11077 - DNA, 15 bp, Artificial Sequence
  dgRNA
  Polr3h
cttgcgggagagtgc

SEQ ID NO: 11078 - DNA, 15 bp, Artificial Sequence
  dgRNA
  Polr3h
agctctgcgacccgc

SEQ ID NO: 11079 - DNA, 15 bp, Artificial Sequence
  dgRNA
  Vmn1r175
agctgcccttcgtgg

SEQ ID NO: 11080 - DNA, 15 bp, Artificial Sequence
  dgRNA
  Vmn1r175
cattttcccccacga

SEQ ID NO: 11081 - DNA, 15 bp, Artificial Sequence
  dgRNA
  Prr12
cgcccggggccttcc

SEQ ID NO: 11082 - DNA, 15 bp, Artificial Sequence
  dgRNA
  Prr12
gccttcccgggcctt

SEQ ID NO: 11083 - DNA, 15 bp, Artificial Sequence
  dgRNA
  Prr12
ttcccgggccttcgg

SEQ ID NO: 11084 - DNA, 15 bp, Artificial Sequence
  dgRNA
  Prr12
ccccaatttccaccg

SEQ ID NO: 11085 - DNA, 15 bp, Artificial Sequence
  dgRNA
  Amz1
ttgtgccagaggcgg

SEQ ID NO: 11086 - DNA, 15 bp, Artificial Sequence
  dgRNA
  Amz1
atctcgccccctctg

SEQ ID NO: 11087 - DNA, 15 bp, Artificial Sequence
  dgRNA
  Amz1
tctcgccccctctgt

SEQ ID NO: 11088 - DNA, 15 bp, Artificial Sequence
  dgRNA
  Amz1
caagatgtgtcgcca

SEQ ID NO: 11089 - DNA, 15 bp, Artificial Sequence
  dgRNA
  Rbp1
aaaggtcgagagacc

SEQ ID NO: 11090 - DNA, 15 bp, Artificial Sequence
  dgRNA
  Rbp1
atggccaaagtggtc

SEQ ID NO: 11091 - DNA, 15 bp, Artificial Sequence
  dgRNA
  Rbp1
actttggccatctcc

SEQ ID NO: 11092 - DNA, 15 bp, Artificial Sequence
  dgRNA
  Rbp1
tgctattcatcaggg

SEQ ID NO: 11093 - DNA, 15 bp, Artificial Sequence
  dgRNA
  Strap
gcatcctacaaggga

SEQ ID NO: 11094 - DNA, 15 bp, Artificial Sequence
  dgRNA
  Strap
tacaagggacggact

SEQ ID NO: 11095 - DNA, 15 bp, Artificial Sequence
  dgRNA
  Strap
aagggacggactcgg

SEQ ID NO: 11096 - DNA, 15 bp, Artificial Sequence
  dgRNA
  Strap
gtcgtcagagcagca

SEQ ID NO: 11097 - DNA, 15 bp, Artificial Sequence
  dgRNA
  Lama1
aggaaggactccgca

SEQ ID NO: 11098 - DNA, 15 bp, Artificial Sequence
  dgRNA
  Lama1
aaggactccgcacgg

SEQ ID NO: 11099 - DNA, 15 bp, Artificial Sequence
  dgRNA
  Lama1
aggactccgcacggc

SEQ ID NO: 11100 - DNA, 15 bp, Artificial Sequence
  dgRNA
  Lama1
cggcggggctccccc

SEQ ID NO: 11101 - DNA, 15 bp, Artificial Sequence
  dgRNA
  Olr1
agaagctccgcacac

SEQ ID NO: 11102 - DNA, 15 bp, Artificial Sequence
  dgRNA
  Olr1
ccgcacactggcagt

SEQ ID NO: 11103 - DNA, 15 bp, Artificial Sequence
  dgRNA
  Olr1
aaactgaaacagtcg

SEQ ID NO: 11104 - DNA, 15 bp, Artificial Sequence
  dgRNA
  Acp5
gcaagatgataagcc

SEQ ID NO: 11105 - DNA, 15 bp, Artificial Sequence
  dgRNA
  Acp5
gctagcactcgggtg

SEQ ID NO: 11106 - DNA, 15 bp, Artificial Sequence
  dgRNA
  Acp5
ctagcactcgggtgt

SEQ ID NO: 11107 - DNA, 15 bp, Artificial Sequence
  dgRNA
  Acp5
cccgagtgctagctg

SEQ ID NO: 11108 - DNA, 15 bp, Artificial Sequence
  dgRNA
  Nr3c1
ttgggagttacctaa

SEQ ID NO: 11109 - DNA, 15 bp, Artificial Sequence
  dgRNA
  Nr3c1
tgggagttacctaaa

SEQ ID NO: 11110 - DNA, 15 bp, Artificial Sequence
  dgRNA
  Fcer2a
gacaagtgccttggc

SEQ ID NO: 11111 - DNA, 15 bp, Artificial Sequence
  dgRNA
  Fcer2a
gggacttgaaggttc

SEQ ID NO: 11112 - DNA, 15 bp, Artificial Sequence
  dgRNA
  Fcer2a
gtgtaggacagcatc

SEQ ID NO: 11113 - DNA, 15 bp, Artificial Sequence
  dgRNA
  Fcer2a
tcaaactctcattat

SEQ ID NO: 11114 - DNA, 15 bp, Artificial Sequence
  dgRNA
  Tmem101
ggggagcgttcagaa

SEQ ID NO: 11115 - DNA, 15 bp, Artificial Sequence
  dgRNA
  Tmem101
ttcccacccggaact

SEQ ID NO: 11116 - DNA, 15 bp, Artificial Sequence
  dgRNA
  Tmem101
tcccacccggaacta

SEQ ID NO: 11117 - DNA, 15 bp, Artificial Sequence
  dgRNA
  Tmem101
tccctagttccgggt

SEQ ID NO: 11118 - DNA, 15 bp, Artificial Sequence
  dgRNA
  Pou1f1
ttgtacgtcataacc

SEQ ID NO: 11119 - DNA, 15 bp, Artificial Sequence
  dgRNA
  Pou1f1
aagcaacactcctgt

SEQ ID NO: 11120 - DNA, 15 bp, Artificial Sequence
  dgRNA
  Pou1f1
tagcctgcaccctcc

SEQ ID NO: 11121 - DNA, 15 bp, Artificial Sequence
  dgRNA
  Pou1f1
atgacgtacaaagtg

SEQ ID NO: 11122 - DNA, 15 bp, Artificial Sequence
  dgRNA
  Zfp54
agcctgagactgata

SEQ ID NO: 11123 - DNA, 15 bp, Artificial Sequence
  dgRNA
  Zfp54
ctgagactgataggg

SEQ ID NO: 11124 - DNA, 15 bp, Artificial Sequence
  dgRNA
  Zfp54
tgagactgataggga

SEQ ID NO: 11125 - DNA, 15 bp, Artificial Sequence
  dgRNA
  Zfp54
agggacctgtctccg

SEQ ID NO: 11126 - DNA, 15 bp, Artificial Sequence
  dgRNA
  Clk2
gagacccgaaccaag

SEQ ID NO: 11127 - DNA, 15 bp, Artificial Sequence
  dgRNA
  Clk2
ccgcttctctaactc

SEQ ID NO: 11128 - DNA, 15 bp, Artificial Sequence
  dgRNA
  Clk2
aactctggaaggcgc

SEQ ID NO: 11129 - DNA, 15 bp, Artificial Sequence
  dgRNA
  Clk2
actctggaaggcgca

SEQ ID NO: 11130 - DNA, 15 bp, Artificial Sequence
  dgRNA
  Nxt1
tcaaccggatcttct

SEQ ID NO: 11131 - DNA, 15 bp, Artificial Sequence
  dgRNA
  Nxt1
ggatagtgcctaacc

SEQ ID NO: 11132 - DNA, 15 bp, Artificial Sequence
  dgRNA
  Nxt1
ctttgccgccacacc

SEQ ID NO: 11133 - DNA, 15 bp, Artificial Sequence
  dgRNA
  Nxt1
tttgccgccacacct

SEQ ID NO: 11134 - DNA, 15 bp, Artificial Sequence
  dgRNA
  Irf3
agctcacctggctcg

SEQ ID NO: 11135 - DNA, 15 bp, Artificial Sequence
  dgRNA
  Irf3
gtgtccccgtcgcac

SEQ ID NO: 11136 - DNA, 15 bp, Artificial Sequence
  dgRNA
  Irf3
cccacgcctgcgcac

SEQ ID NO: 11137 - DNA, 15 bp, Artificial Sequence
  dgRNA
  Irf3
cgcactgggccgaca

SEQ ID NO: 11138 - DNA, 15 bp, Artificial Sequence
  dgRNA
  Cyp4f14
tttagggacctagcc

SEQ ID NO: 11139 - DNA, 15 bp, Artificial Sequence
  dgRNA
  Cyp4f14
gacctagcctggaac

SEQ ID NO: 11140 - DNA, 15 bp, Artificial Sequence
  dgRNA
  Cyp4f14
ttgcataatttaggg

SEQ ID NO: 11141 - DNA, 15 bp, Artificial Sequence
  dgRNA
  Cyp4f14
taaccacccccagcc

SEQ ID NO: 11142 - DNA, 15 bp, Artificial Sequence
  dgRNA
  Xrn1
cacacctcaatcaac

SEQ ID NO: 11143 - DNA, 15 bp, Artificial Sequence
  dgRNA
  Xrn1
tgtcaccaacgagta

SEQ ID NO: 11144 - DNA, 15 bp, Artificial Sequence
  dgRNA
  Xrn1
gagtatggaagagcg

SEQ ID NO: 11145 - DNA, 15 bp, Artificial Sequence
  dgRNA
  Xrn1
ggcagcgggatagac

SEQ ID NO: 11146 - DNA, 15 bp, Artificial Sequence
  dgRNA
  Nphp1
gtttagtgcaacctg

SEQ ID NO: 11147 - DNA, 15 bp, Artificial Sequence
  dgRNA
  Nphp1
gtgcaacctgtggca

SEQ ID NO: 11148 - DNA, 15 bp, Artificial Sequence
  dgRNA
  Nphp1
gcaacctgtggcacg

SEQ ID NO: 11149 - DNA, 15 bp, Artificial Sequence
  dgRNA
  Nphp1
cgacctcacaccgtg

SEQ ID NO: 11150 - DNA, 15 bp, Artificial Sequence
  dgRNA
  2010315B03Rik
catggtcgtgaaacc

SEQ ID NO: 11151 - DNA, 15 bp, Artificial Sequence
  dgRNA
  2010315B03Rik
atggtcgtgaaacct

SEQ ID NO: 11152 - DNA, 15 bp, Artificial Sequence
  dgRNA
  2010315B03Rik
gacactcaaacacta

SEQ ID NO: 11153 - DNA, 15 bp, Artificial Sequence
  dgRNA
  2010315B03Rik
taagggaggtgttcg

SEQ ID NO: 11154 - DNA, 15 bp, Artificial Sequence
  dgRNA
  Lce1a1
cttttaaactgactc

SEQ ID NO: 11155 - DNA, 15 bp, Artificial Sequence
  dgRNA
  Sqrdl
cagtgtgagaccaat

SEQ ID NO: 11156 - DNA, 15 bp, Artificial Sequence
  dgRNA
  Fam181b
cacccctggcgattg

SEQ ID NO: 11157 - DNA, 15 bp, Artificial Sequence
  dgRNA
  Fam181b
aatgccccggggcac

SEQ ID NO: 11158 - DNA, 15 bp, Artificial Sequence
  dgRNA
  Fam181b
atgccccggggcaca

SEQ ID NO: 11159 - DNA, 15 bp, Artificial Sequence
  dgRNA
  Fam181b
cccactaccaaagcc

SEQ ID NO: 11160 - DNA, 15 bp, Artificial Sequence
  dgRNA
  Tead1
ccccgccatcgcgcg

SEQ ID NO: 11161 - DNA, 15 bp, Artificial Sequence
  dgRNA
  Tead1
cggctcgctcccccg

SEQ ID NO: 11162 - DNA, 15 bp, Artificial Sequence
  dgRNA
  Tead1
ggctcgctcccccgt

SEQ ID NO: 11163 - DNA, 15 bp, Artificial Sequence
  dgRNA
  Tead1
accatgacgtcaccg

SEQ ID NO: 11164 - DNA, 15 bp, Artificial Sequence
  dgRNA
  Trp53bp2
cctccctcggagcaa

SEQ ID NO: 11165 - DNA, 15 bp, Artificial Sequence
  dgRNA
  Trp53bp2
ggttcccgccccctc

SEQ ID NO: 11166 - DNA, 15 bp, Artificial Sequence
  dgRNA
  Trp53bp2
tgcgccttcgccgcc

SEQ ID NO: 11167 - DNA, 15 bp, Artificial Sequence
  dgRNA
  Trp53bp2
ccttcgccgcccggt

SEQ ID NO: 11168 - DNA, 15 bp, Artificial Sequence
  dgRNA
  Rbbp4
cgcgcgcgcaatccg

SEQ ID NO: 11169 - DNA, 15 bp, Artificial Sequence
  dgRNA
  Rbbp4
atccgtggaagtctc

SEQ ID NO: 11170 - DNA, 15 bp, Artificial Sequence
  dgRNA
  Rbbp4
gaagtctccggactg

SEQ ID NO: 11171 - DNA, 15 bp, Artificial Sequence
  dgRNA
  Rbbp4
gtctccggactgtgg

SEQ ID NO: 11172 - DNA, 15 bp, Artificial Sequence
  dgRNA
  4430402I18Rik
acagccacaggtcga

SEQ ID NO: 11173 - DNA, 15 bp, Artificial Sequence
  dgRNA
  4430402I18Rik
ggtcgatggccagca

SEQ ID NO: 11174 - DNA, 15 bp, Artificial Sequence
  dgRNA
  4430402I18Rik
cgcagggcgatgccc

SEQ ID NO: 11175 - DNA, 15 bp, Artificial Sequence
  dgRNA
  4430402I18Rik
gggttcaagttcatg

SEQ ID NO: 11176 - DNA, 15 bp, Artificial Sequence
  dgRNA
  Fnbp1
aagagttgggctcgc

SEQ ID NO: 11177 - DNA, 15 bp, Artificial Sequence
  dgRNA
  Fnbp1
cgagcccaactcttt

SEQ ID NO: 11178 - DNA, 15 bp, Artificial Sequence
  dgRNA
  Olfr433
ttcagagtgtacagc

SEQ ID NO: 11179 - DNA, 15 bp, Artificial Sequence
  dgRNA
  Olfr433
acaagatttggcagt

SEQ ID NO: 11180 - DNA, 15 bp, Artificial Sequence
  dgRNA
  Olfr433
tacactctgaactag

SEQ ID NO: 11181 - DNA, 15 bp, Artificial Sequence
  dgRNA
  Olfr433
gtacactctgaacta

SEQ ID NO: 11182 - DNA, 15 bp, Artificial Sequence
  dgRNA
  Tcp11
gggtcgcgatgctgg

SEQ ID NO: 11183 - DNA, 15 bp, Artificial Sequence
  dgRNA
  Tcp11
ggtcgcgatgctggt

SEQ ID NO: 11184 - DNA, 15 bp, Artificial Sequence
  dgRNA
  Tcp11
gtcgcgatgctggtg

SEQ ID NO: 11185 - DNA, 15 bp, Artificial Sequence
  dgRNA
  Tcp11
tcgcgcctcgttgcc

SEQ ID NO: 11186 - DNA, 15 bp, Artificial Sequence
  dgRNA
  Elavl4
gcccacccccttgaa

SEQ ID NO: 11187 - DNA, 15 bp, Artificial Sequence
  dgRNA
  Elavl4
tcaagcgccccctag

SEQ ID NO: 11188 - DNA, 15 bp, Artificial Sequence
  dgRNA
  Elavl4
gccccctagaggcgg

SEQ ID NO: 11189 - DNA, 15 bp, Artificial Sequence
  dgRNA
  Elavl4
cctagaggcggcggc

SEQ ID NO: 11190 - DNA, 15 bp, Artificial Sequence
  dgRNA
  Tbc1d7
aagcactctgaacga

SEQ ID NO: 11191 - DNA, 15 bp, Artificial Sequence
  dgRNA
  Tbc1d7
agcactctgaacgaa

SEQ ID NO: 11192 - DNA, 15 bp, Artificial Sequence
  dgRNA
  Tbc1d7
ggggagacgatcacc

SEQ ID NO: 11193 - DNA, 15 bp, Artificial Sequence
  dgRNA
  Tbc1d7
gggagacgatcacca

SEQ ID NO: 11194 - DNA, 15 bp, Artificial Sequence
  dgRNA
  Rerg
ggcgctgagctaggc

SEQ ID NO: 11195 - DNA, 15 bp, Artificial Sequence
  dgRNA
  Rerg
gctcggctcgcagac

SEQ ID NO: 11196 - DNA, 15 bp, Artificial Sequence
  dgRNA
  Rerg
ggtggcggagcgcag

SEQ ID NO: 11197 - DNA, 15 bp, Artificial Sequence
  dgRNA
  Rerg
gcaggacgcgagctc

SEQ ID NO: 11198 - DNA, 15 bp, Artificial Sequence
  dgRNA
  Kcnc3
ttccttcacggtacc

SEQ ID NO: 11199 - DNA, 15 bp, Artificial Sequence
  dgRNA
  Kcnc3
gctctttcccatacc

SEQ ID NO: 11200 - DNA, 15 bp, Artificial Sequence
  dgRNA
  Kcnc3
cgccctctcctaggt

SEQ ID NO: 11201 - DNA, 15 bp, Artificial Sequence
  dgRNA
  Kcnc3
taccgtgaaggaagg

SEQ ID NO: 11202 - DNA, 15 bp, Artificial Sequence
  dgRNA
  Fam3c
tcctggctgcggacg

SEQ ID NO: 11203 - DNA, 15 bp, Artificial Sequence
  dgRNA
  Fam3c
gcggcagctcccacg

SEQ ID NO: 11204 - DNA, 15 bp, Artificial Sequence
  dgRNA
  Fam3c
gtcgcagacgcgacc

SEQ ID NO: 11205 - DNA, 15 bp, Artificial Sequence
  dgRNA
  Fam3c
tcgcagacgcgaccc

SEQ ID NO: 11206 - DNA, 15 bp, Artificial Sequence
  dgRNA
  Usp28
tgtaggcggggtctc

SEQ ID NO: 11207 - DNA, 15 bp, Artificial Sequence
  dgRNA
  Usp28
gcgcaagccgcaaga

SEQ ID NO: 11208 - DNA, 15 bp, Artificial Sequence
  dgRNA
  Usp28
cgcaagccgcaagat

SEQ ID NO: 11209 - DNA, 15 bp, Artificial Sequence
  dgRNA
  Usp28
aagccgcaagatggg

SEQ ID NO: 11210 - DNA, 15 bp, Artificial Sequence
  dgRNA
  Sdhb
cttctctacttgcag

SEQ ID NO: 11211 - DNA, 15 bp, Artificial Sequence
  dgRNA
  Sdhb
tagcgtggaggggcg

SEQ ID NO: 11212 - DNA, 15 bp, Artificial Sequence
  dgRNA
  Sdhb
gtagcgtggaggggc

SEQ ID NO: 11213 - DNA, 15 bp, Artificial Sequence
  dgRNA
  Sdhb
aagggtagcgtggag

SEQ ID NO: 11214 - DNA, 15 bp, Artificial Sequence
  dgRNA
  Ttc8
gaggtcggctctcag

SEQ ID NO: 11215 - DNA, 15 bp, Artificial Sequence
  dgRNA
  Ttc8
ccgtcccctgttttc

SEQ ID NO: 11216 - DNA, 15 bp, Artificial Sequence
  dgRNA
  Ttc8
ttttcaggcgcgctg

SEQ ID NO: 11217 - DNA, 15 bp, Artificial Sequence
  dgRNA
  Ttc8
cgcgcctgaaaacag

SEQ ID NO: 11218 - DNA, 15 bp, Artificial Sequence
  dgRNA
  Slc16a11
tgctattttcatgcg

SEQ ID NO: 11219 - DNA, 15 bp, Artificial Sequence
  dgRNA
  Slc16a11
gctattttcatgcgt

SEQ ID NO: 11220 - DNA, 15 bp, Artificial Sequence
  dgRNA
  Slc16a11
tcatgcgtgggcagt

SEQ ID NO: 11221 - DNA, 15 bp, Artificial Sequence
  dgRNA
  Slc16a11
gcgtgggcagttggc

SEQ ID NO: 11222 - DNA, 15 bp, Artificial Sequence
  dgRNA
  Trim2
aactgactcgtgaat

SEQ ID NO: 11223 - DNA, 15 bp, Artificial Sequence
  dgRNA
  Trim2
tcaataccgaacgcc

SEQ ID NO: 11224 - DNA, 15 bp, Artificial Sequence
  dgRNA
  Trim2
ataccgaacgcccgg

SEQ ID NO: 11225 - DNA, 15 bp, Artificial Sequence
  dgRNA
  Trim2
ccgaacgcccggcgg

SEQ ID NO: 11226 - DNA, 15 bp, Artificial Sequence
  dgRNA
  Olfr1262
atgatataactgcat

SEQ ID NO: 11227 - DNA, 15 bp, Artificial Sequence
  dgRNA
  Olfr1262
agctatgttcacctc

SEQ ID NO: 11228 - DNA, 15 bp, Artificial Sequence
  dgRNA
  Olfr1262
gctatgttcacctca

SEQ ID NO: 11229 - DNA, 15 bp, Artificial Sequence
  dgRNA
  Olfr1262
actgtactaaattga

SEQ ID NO: 11230 - DNA, 15 bp, Artificial Sequence
  dgRNA
  Cstf1
atgccgttctgtgat

SEQ ID NO: 11231 - DNA, 15 bp, Artificial Sequence
  dgRNA
  Cstf1
ccgtaaacgcgacta

SEQ ID NO: 11232 - DNA, 15 bp, Artificial Sequence
  dgRNA
  Cstf1
cgtaaacgcgactat

SEQ ID NO: 11233 - DNA, 15 bp, Artificial Sequence
  dgRNA
  Cstf1
gttccctgccgtagc

SEQ ID NO: 11234 - DNA, 15 bp, Artificial Sequence
  dgRNA
  Ptprcap
gatctaatacctgtc

SEQ ID NO: 11235 - DNA, 15 bp, Artificial Sequence
  dgRNA
  Ptprcap
atctaatacctgtct

SEQ ID NO: 11236 - DNA, 15 bp, Artificial Sequence
  dgRNA
  Ptprcap
tatctaactcaaagc

SEQ ID NO: 11237 - DNA, 15 bp, Artificial Sequence
  dgRNA
  Ptprcap
caggattacccagac

SEQ ID NO: 11238 - DNA, 15 bp, Artificial Sequence
  dgRNA
  Sdsl
ggacctggcaatcgc

SEQ ID NO: 11239 - DNA, 15 bp, Artificial Sequence
  dgRNA
  Sdsl
ccggagcctctccct

SEQ ID NO: 11240 - DNA, 15 bp, Artificial Sequence
  dgRNA
  Sdsl
cggagcctctccctg

SEQ ID NO: 11241 - DNA, 15 bp, Artificial Sequence
  dgRNA
  Sdsl
ggttatcacgatcta

SEQ ID NO: 11242 - DNA, 15 bp, Artificial Sequence
  dgRNA
  Olfr338
tgactaatatactgt

SEQ ID NO: 11243 - DNA, 15 bp, Artificial Sequence
  dgRNA
  Olfr338
ttgactaatatactg

SEQ ID NO: 11244 - DNA, 15 bp, Artificial Sequence
  dgRNA
  Acsm4
tctcaatatcagctc

SEQ ID NO: 11245 - DNA, 15 bp, Artificial Sequence
  dgRNA
  Acsm4
aatccgctaatgagc

SEQ ID NO: 11246 - DNA, 15 bp, Artificial Sequence
  dgRNA
  Acsm4
ctagatgtgccttat

SEQ ID NO: 11247 - DNA, 15 bp, Artificial Sequence
  dgRNA
  Acsm4
acgcccatctcagag

SEQ ID NO: 11248 - DNA, 15 bp, Artificial Sequence
  dgRNA
  Wnk3
gcaactaagatagca

SEQ ID NO: 11249 - DNA, 15 bp, Artificial Sequence
  dgRNA
  Wnk3
agcaactaagatagc

SEQ ID NO: 11250 - DNA, 15 bp, Artificial Sequence
  dgRNA
  Fxyd1
agttaacctagctag

SEQ ID NO: 11251 - DNA, 15 bp, Artificial Sequence
  dgRNA
  Fxyd1
gttaacctagctagc

SEQ ID NO: 11252 - DNA, 15 bp, Artificial Sequence
  dgRNA
  Fxyd1
cctagctagcgggcc

SEQ ID NO: 11253 - DNA, 15 bp, Artificial Sequence
  dgRNA
  Fxyd1
ctagctagcgggcca

SEQ ID NO: 11254 - DNA, 15 bp, Artificial Sequence
  dgRNA
  Rhbdd3
gcctcagctaccgcg

SEQ ID NO: 11255 - DNA, 15 bp, Artificial Sequence
  dgRNA
  Rhbdd3
ccctcgcgcgcaacg

SEQ ID NO: 11256 - DNA, 15 bp, Artificial Sequence
  dgRNA
  Rhbdd3
aacgcggccgccaaa

SEQ ID NO: 11257 - DNA, 15 bp, Artificial Sequence
  dgRNA
  Rhbdd3
aaccagcccgcctag

SEQ ID NO: 11258 - DNA, 15 bp, Artificial Sequence
  dgRNA
  Sectm1b
gggtatgagaacggg

SEQ ID NO: 11259 - DNA, 15 bp, Artificial Sequence
  dgRNA
  Sectm1b
agaacgggtggtact

SEQ ID NO: 11260 - DNA, 15 bp, Artificial Sequence
  dgRNA
  Sectm1b
ccctgacacgccctc

SEQ ID NO: 11261 - DNA, 15 bp, Artificial Sequence
  dgRNA
  Sectm1b
acacgccctcaggtc

SEQ ID NO: 11262 - DNA, 15 bp, Artificial Sequence
  dgRNA
  Zfp354b
agagctagtgacccg

SEQ ID NO: 11263 - DNA, 15 bp, Artificial Sequence
  dgRNA
  Zfp354b
tgacccggggccttt

SEQ ID NO: 11264 - DNA, 15 bp, Artificial Sequence
  dgRNA
  Zfp354b
gacccggggcctttt

SEQ ID NO: 11265 - DNA, 15 bp, Artificial Sequence
  dgRNA
  Zfp354b
agctgcgcaccaaag

SEQ ID NO: 11266 - DNA, 15 bp, Artificial Sequence
  dgRNA
  Dnajb11
cagcgcgctctttct

SEQ ID NO: 11267 - DNA, 15 bp, Artificial Sequence
  dgRNA
  Dnajb11
gctcctaactctctc

SEQ ID NO: 11268 - DNA, 15 bp, Artificial Sequence
  dgRNA
  Dnajb11
gttctcagccgcttc

SEQ ID NO: 11269 - DNA, 15 bp, Artificial Sequence
  dgRNA
  Dnajb11
tcagccgcttccggg

SEQ ID NO: 11270 - DNA, 15 bp, Artificial Sequence
  dgRNA
  Cobl
tgtgccatcctaggg

SEQ ID NO: 11271 - DNA, 15 bp, Artificial Sequence
  dgRNA
  Phactr3
gtccatatgtctccc

SEQ ID NO: 11272 - DNA, 15 bp, Artificial Sequence
  dgRNA
  Phactr3
tatggactggatcgt

SEQ ID NO: 11273 - DNA, 15 bp, Artificial Sequence
  dgRNA
  Phactr3
gggagacatatggac

SEQ ID NO: 11274 - DNA, 15 bp, Artificial Sequence
  dgRNA
  Phactr3
ggccggggagacata

SEQ ID NO: 11275 - DNA, 15 bp, Artificial Sequence
  dgRNA
  Srcin1
atccgggtgtgctgc

SEQ ID NO: 11276 - DNA, 15 bp, Artificial Sequence
  dgRNA
  Srcin1
cgggtgtgctgctgg

SEQ ID NO: 11277 - DNA, 15 bp, Artificial Sequence
  dgRNA
  Srcin1
ctgctggagggcgcg

SEQ ID NO: 11278 - DNA, 15 bp, Artificial Sequence
  dgRNA
  Srcin1
ctggagggcgcgagg

SEQ ID NO: 11279 - DNA, 15 bp, Artificial Sequence
  dgRNA
  Pde7a
cggcgcctagcgcag

SEQ ID NO: 11280 - DNA, 15 bp, Artificial Sequence
  dgRNA
  Pde7a
gcgagcagccctgtc

SEQ ID NO: 11281 - DNA, 15 bp, Artificial Sequence
  dgRNA
  Pde7a
ccctgtccggacagc

SEQ ID NO: 11282 - DNA, 15 bp, Artificial Sequence
  dgRNA
  Pde7a
tgtccggacagccgg

SEQ ID NO: 11283 - DNA, 15 bp, Artificial Sequence
  dgRNA
  Dph6
tcactgcccttactt

SEQ ID NO: 11284 - DNA, 15 bp, Artificial Sequence
  dgRNA
  Dph6
ctgcccttacttagg

SEQ ID NO: 11285 - DNA, 15 bp, Artificial Sequence
  dgRNA
  Dph6
cttacttaggtggtt

SEQ ID NO: 11286 - DNA, 15 bp, Artificial Sequence
  dgRNA
  Dph6
ctagcctctacaccc

SEQ ID NO: 11287 - DNA, 15 bp, Artificial Sequence
  dgRNA
  Zfp740
cgcgcgccacggcgc

SEQ ID NO: 11288 - DNA, 15 bp, Artificial Sequence
  dgRNA
  Zfp740
cgcaccaccctcctc

SEQ ID NO: 11289 - DNA, 15 bp, Artificial Sequence
  dgRNA
  Zfp740
agcctcacccctttt

SEQ ID NO: 11290 - DNA, 15 bp, Artificial Sequence
  dgRNA
  Zfp740
ctcaccccttttcgg

SEQ ID NO: 11291 - DNA, 15 bp, Artificial Sequence
  dgRNA
  Ankrd28
gcggcggctgcgtgt

SEQ ID NO: 11292 - DNA, 15 bp, Artificial Sequence
  dgRNA
  Ankrd28
gcggctgcgtgtggg

SEQ ID NO: 11293 - DNA, 15 bp, Artificial Sequence
  dgRNA
  Ankrd28
aggaggcgggaccgg

SEQ ID NO: 11294 - DNA, 15 bp, Artificial Sequence
  dgRNA
  Ankrd28
ggaggcgggaccggc

SEQ ID NO: 11295 - DNA, 15 bp, Artificial Sequence
  dgRNA
  Prg2
gcttccctccacatg

SEQ ID NO: 11296 - DNA, 15 bp, Artificial Sequence
  dgRNA
  Prg2
cacatgtggtgacta

SEQ ID NO: 11297 - DNA, 15 bp, Artificial Sequence
  dgRNA
  Prg2
gtcaccacatgtgga

SEQ ID NO: 11298 - DNA, 15 bp, Artificial Sequence
  dgRNA
  Prg2
agtcaccacatgtgg

SEQ ID NO: 11299 - DNA, 15 bp, Artificial Sequence
  dgRNA
  Ccpg1
gcttccggtagcctc

SEQ ID NO: 11300 - DNA, 15 bp, Artificial Sequence
  dgRNA
  Ccpg1
cttccggtagcctca

SEQ ID NO: 11301 - DNA, 15 bp, Artificial Sequence
  dgRNA
  Ccpg1
ttccggtagcctcag

SEQ ID NO: 11302 - DNA, 15 bp, Artificial Sequence
  dgRNA
  Ccpg1
ggccgtacgcatctt

SEQ ID NO: 11303 - DNA, 15 bp, Artificial Sequence
  dgRNA
  Zfp157
aggccttgtcaattc

SEQ ID NO: 11304 - DNA, 15 bp, Artificial Sequence
  dgRNA
  Zfp157
gcttcatccacccct

SEQ ID NO: 11305 - DNA, 15 bp, Artificial Sequence
  dgRNA
  Zfp157
cgtgaactgtcactc

SEQ ID NO: 11306 - DNA, 15 bp, Artificial Sequence
  dgRNA
  Zfp157
aatcagacacacggt

SEQ ID NO: 11307 - DNA, 15 bp, Artificial Sequence
  dgRNA
  Rpe65
caggctcctccaata

SEQ ID NO: 11308 - DNA, 15 bp, Artificial Sequence
  dgRNA
  Rpe65
acttggatcctttca

SEQ ID NO: 11309 - DNA, 15 bp, Artificial Sequence
  dgRNA
  Rpe65
cacattatttggact

SEQ ID NO: 11310 - DNA, 15 bp, Artificial Sequence
  dgRNA
  Rpe65
tgcttgcacattatt

SEQ ID NO: 11311 - DNA, 15 bp, Artificial Sequence
  dgRNA
  Zfp9
ggacaccgagccccg

SEQ ID NO: 11312 - DNA, 15 bp, Artificial Sequence
  dgRNA
  Zfp9
gcatcccccgatttg

SEQ ID NO: 11313 - DNA, 15 bp, Artificial Sequence
  dgRNA
  Zfp9
catcccccgatttga

SEQ ID NO: 11314 - DNA, 15 bp, Artificial Sequence
  dgRNA
  Zfp9
atcccccgatttgag

SEQ ID NO: 11315 - DNA, 15 bp, Artificial Sequence
  dgRNA
  Duox1
gtacacagcgcgtgt

SEQ ID NO: 11316 - DNA, 15 bp, Artificial Sequence
  dgRNA
  Duox1
attctctcgaatatt

SEQ ID NO: 11317 - DNA, 15 bp, Artificial Sequence
  dgRNA
  Duox1
tctctcgaatatttg

SEQ ID NO: 11318 - DNA, 15 bp, Artificial Sequence
  dgRNA
  Duox1
acctggcctcggctc

SEQ ID NO: 11319 - DNA, 15 bp, Artificial Sequence
  dgRNA
  Sdhaf1
aagacatatctgcac

SEQ ID NO: 11320 - DNA, 15 bp, Artificial Sequence
  dgRNA
  Sdhaf1
atatctgcactggtg

SEQ ID NO: 11321 - DNA, 15 bp, Artificial Sequence
  dgRNA
  Sdhaf1
ctgtcaactgtatga

SEQ ID NO: 11322 - DNA, 15 bp, Artificial Sequence
  dgRNA
  Sdhaf1
cctgttattccagtc

SEQ ID NO: 11323 - DNA, 15 bp, Artificial Sequence
  dgRNA
  Myl6
cgagagtcccaaccc

SEQ ID NO: 11324 - DNA, 15 bp, Artificial Sequence
  dgRNA
  Myl6
ttcctgagccgaggt

SEQ ID NO: 11325 - DNA, 15 bp, Artificial Sequence
  dgRNA
  Myl6
tcctgagccgaggta

SEQ ID NO: 11326 - DNA, 15 bp, Artificial Sequence
  dgRNA
  Myl6
gactagcgtgcctat

SEQ ID NO: 11327 - DNA, 15 bp, Artificial Sequence
  dgRNA
  Pvrl4
cgcacctccccaatt

SEQ ID NO: 11328 - DNA, 15 bp, Artificial Sequence
  dgRNA
  Pvrl4
gcacctccccaatta

SEQ ID NO: 11329 - DNA, 15 bp, Artificial Sequence
  dgRNA
  Pvrl4
cacctccccaattag

SEQ ID NO: 11330 - DNA, 15 bp, Artificial Sequence
  dgRNA
  Pvrl4
ttaggggatcacagt

SEQ ID NO: 11331 - DNA, 15 bp, Artificial Sequence
  dgRNA
  Naa20
ttggaaagggtctgc

SEQ ID NO: 11332 - DNA, 15 bp, Artificial Sequence
  dgRNA
  Naa20
tggaaagggtctgcg

SEQ ID NO: 11333 - DNA, 15 bp, Artificial Sequence
  dgRNA
  Naa20
gggcgcggatcatta

SEQ ID NO: 11334 - DNA, 15 bp, Artificial Sequence
  dgRNA
  Naa20
ccctttccaaaaagt

SEQ ID NO: 11335 - DNA, 15 bp, Artificial Sequence
  dgRNA
  Rhobtb1
aaacagctgatttcg

SEQ ID NO: 11336 - DNA, 15 bp, Artificial Sequence
  dgRNA
  Rhobtb1
cagctgatttcgggg

SEQ ID NO: 11337 - DNA, 15 bp, Artificial Sequence
  dgRNA
  Rhobtb1
agctgatttcggggt

SEQ ID NO: 11338 - DNA, 15 bp, Artificial Sequence
  dgRNA
  Rhobtb1
gggaccccttgagcc

SEQ ID NO: 11339 - DNA, 15 bp, Artificial Sequence
  dgRNA
  Hist1h4f
tattcccctcgccac

SEQ ID NO: 11340 - DNA, 15 bp, Artificial Sequence
  dgRNA
  Hist1h4f
attcccctcgccaca

SEQ ID NO: 11341 - DNA, 15 bp, Artificial Sequence
  dgRNA
  Hist1h4f
ttcccctcgccacag

SEQ ID NO: 11342 - DNA, 15 bp, Artificial Sequence
  dgRNA
  Hist1h4f
atataccagctgtag

SEQ ID NO: 11343 - DNA, 15 bp, Artificial Sequence
  dgRNA
  Trps1
gtagcccccagagtc

SEQ ID NO: 11344 - DNA, 15 bp, Artificial Sequence
  dgRNA
  Trps1
gtcaagttcagccgc

SEQ ID NO: 11345 - DNA, 15 bp, Artificial Sequence
  dgRNA
  Trps1
caagttcagccgccg

SEQ ID NO: 11346 - DNA, 15 bp, Artificial Sequence
  dgRNA
  Trps1
gttcagccgccgggg

SEQ ID NO: 11347 - DNA, 15 bp, Artificial Sequence
  dgRNA
  Chst5
gggcggtcagtgttc

SEQ ID NO: 11348 - DNA, 15 bp, Artificial Sequence
  dgRNA
  Chst5
ggcggtcagtgttcc

SEQ ID NO: 11349 - DNA, 15 bp, Artificial Sequence
  dgRNA
  Chst5
caccacggtcacgcc

SEQ ID NO: 11350 - DNA, 15 bp, Artificial Sequence
  dgRNA
  Chst5
accacggtcacgcct

SEQ ID NO: 11351 - DNA, 15 bp, Artificial Sequence
  dgRNA
  Hgf
tcgcagactatgagc

SEQ ID NO: 11352 - DNA, 15 bp, Artificial Sequence
  dgRNA
  Hgf
cgcagactatgagct

SEQ ID NO: 11353 - DNA, 15 bp, Artificial Sequence
  dgRNA
  Hgf
tttcctgttcaaacg

SEQ ID NO: 11354 - DNA, 15 bp, Artificial Sequence
  dgRNA
  Hgf
tcaaacggggcgaat

SEQ ID NO: 11355 - DNA, 15 bp, Artificial Sequence
  dgRNA
  Tshz1
ttgtcagggtgacgt

SEQ ID NO: 11356 - DNA, 15 bp, Artificial Sequence
  dgRNA
  Tshz1
ggtgacgttggcgag

SEQ ID NO: 11357 - DNA, 15 bp, Artificial Sequence
  dgRNA
  Tshz1
gacgttggcgagagg

SEQ ID NO: 11358 - DNA, 15 bp, Artificial Sequence
  dgRNA
  Cstf3
ggcgtcatcagttcc

SEQ ID NO: 11359 - DNA, 15 bp, Artificial Sequence
  dgRNA
  Cstf3
actgagcccgccctc

SEQ ID NO: 11360 - DNA, 15 bp, Artificial Sequence
  dgRNA
  Cstf3
ctgagcccgccctct

SEQ ID NO: 11361 - DNA, 15 bp, Artificial Sequence
  dgRNA
  Cstf3
gcacctccaataatc

SEQ ID NO: 11362 - DNA, 15 bp, Artificial Sequence
  dgRNA
  Poli
accgtgcagcagctg

SEQ ID NO: 11363 - DNA, 15 bp, Artificial Sequence
  dgRNA
  Poli
cagctgcggtgcggt

SEQ ID NO: 11364 - DNA, 15 bp, Artificial Sequence
  dgRNA
  Poli
gtgcggttggcccga

SEQ ID NO: 11365 - DNA, 15 bp, Artificial Sequence
  dgRNA
  Poli
tgcggttggcccgaa

SEQ ID NO: 11366 - DNA, 15 bp, Artificial Sequence
  dgRNA
  Adam8
tcatgggagatcaat

SEQ ID NO: 11367 - DNA, 15 bp, Artificial Sequence
  dgRNA
  Adam8
tagaagttacttcgg

SEQ ID NO: 11368 - DNA, 15 bp, Artificial Sequence
  dgRNA
  Adam8
agaagttacttcgga

SEQ ID NO: 11369 - DNA, 15 bp, Artificial Sequence
  dgRNA
  Adam8
gaagttacttcggag

SEQ ID NO: 11370 - DNA, 15 bp, Artificial Sequence
  dgRNA
  Otub2
accaactctcctgat

SEQ ID NO: 11371 - DNA, 15 bp, Artificial Sequence
  dgRNA
  Otub2
ccaactctcctgatt

SEQ ID NO: 11372 - DNA, 15 bp, Artificial Sequence
  dgRNA
  Otub2
ttgggctagctcctt

SEQ ID NO: 11373 - DNA, 15 bp, Artificial Sequence
  dgRNA
  Otub2
ggcctcctgtcaaac

SEQ ID NO: 11374 - DNA, 15 bp, Artificial Sequence
  dgRNA
  Il13ra2
tgtagtgagtattga

SEQ ID NO: 11375 - DNA, 15 bp, Artificial Sequence
  dgRNA
  Il13ra2
tgagtattgagggac

SEQ ID NO: 11376 - DNA, 15 bp, Artificial Sequence
  dgRNA
  Il13ra2
acgatgtgaatgttt

SEQ ID NO: 11377 - DNA, 15 bp, Artificial Sequence
  dgRNA
  Il13ra2
cgatgtgaatgtttt

SEQ ID NO: 11378 - DNA, 15 bp, Artificial Sequence
  dgRNA
  Prx
ccacgcccttgcaga

SEQ ID NO: 11379 - DNA, 15 bp, Artificial Sequence
  dgRNA
  Prx
atgtagtgcacagaa

SEQ ID NO: 11380 - DNA, 15 bp, Artificial Sequence
  dgRNA
  Prx
atctgcaagggcgtg

SEQ ID NO: 11381 - DNA, 15 bp, Artificial Sequence
  dgRNA
  Prx
catctgcaagggcgt

SEQ ID NO: 11382 - DNA, 15 bp, Artificial Sequence
  dgRNA
  Vat1l
tagtactagcacaaa

SEQ ID NO: 11383 - DNA, 15 bp, Artificial Sequence
  dgRNA
  Vat1l
tactagcacaaaagg

SEQ ID NO: 11384 - DNA, 15 bp, Artificial Sequence
  dgRNA
  Vat1l
tggggcgctagggcg

SEQ ID NO: 11385 - DNA, 15 bp, Artificial Sequence
  dgRNA
  Vat1l
ggcgcggctcctcta

SEQ ID NO: 11386 - DNA, 15 bp, Artificial Sequence
  dgRNA
  Glt8d1
cgcgccctcaccatc

SEQ ID NO: 11387 - DNA, 15 bp, Artificial Sequence
  dgRNA
  Glt8d1
gcgccctcaccatct

SEQ ID NO: 11388 - DNA, 15 bp, Artificial Sequence
  dgRNA
  Glt8d1
gtgggcagcgaactc

SEQ ID NO: 11389 - DNA, 15 bp, Artificial Sequence
  dgRNA
  Glt8d1
ataccgacaacgaaa

SEQ ID NO: 11390 - DNA, 15 bp, Artificial Sequence
  dgRNA
  Zfp275
ccaatcgcagccgac

SEQ ID NO: 11391 - DNA, 15 bp, Artificial Sequence
  dgRNA
  Zfp275
tcgcagccgacaggc

SEQ ID NO: 11392 - DNA, 15 bp, Artificial Sequence
  dgRNA
  Zfp275
agccgacaggccggg

SEQ ID NO: 11393 - DNA, 15 bp, Artificial Sequence
  dgRNA
  Zfp275
gccgacaggccgggc

SEQ ID NO: 11394 - DNA, 15 bp, Artificial Sequence
  dgRNA
  Ms4a4c
ctcttagtcagtgga

SEQ ID NO: 11395 - DNA, 15 bp, Artificial Sequence
  dgRNA
  Ms4a4c
cctccactgactaag

SEQ ID NO: 11396 - DNA, 15 bp, Artificial Sequence
  dgRNA
  Hibch
gtgagcgtagcgcag

SEQ ID NO: 11397 - DNA, 15 bp, Artificial Sequence
  dgRNA
  Hibch
gcgcagcggaagtgt

SEQ ID NO: 11398 - DNA, 15 bp, Artificial Sequence
  dgRNA
  Hibch
cggaagtgtaggcgt

SEQ ID NO: 11399 - DNA, 15 bp, Artificial Sequence
  dgRNA
  Hibch
ggaagtgtaggcgtt

SEQ ID NO: 11400 - DNA, 15 bp, Artificial Sequence
  dgRNA
  Trappc1
ctccccgcacatcac

SEQ ID NO: 11401 - DNA, 15 bp, Artificial Sequence
  dgRNA
  Trappc1
tccccgcacatcact

SEQ ID NO: 11402 - DNA, 15 bp, Artificial Sequence
  dgRNA
  Trappc1
agaggcccgggaacg

SEQ ID NO: 11403 - DNA, 15 bp, Artificial Sequence
  dgRNA
  Trappc1
gaggcccgggaacgt

SEQ ID NO: 11404 - DNA, 15 bp, Artificial Sequence
  dgRNA
  Dnm1l
ttacccgcccagttc

SEQ ID NO: 11405 - DNA, 15 bp, Artificial Sequence
  dgRNA
  Dnm1l
gaaaccttctagaat

SEQ ID NO: 11406 - DNA, 15 bp, Artificial Sequence
  dgRNA
  Dnm1l
tatgcctccaggagt

SEQ ID NO: 11407 - DNA, 15 bp, Artificial Sequence
  dgRNA
  Dnm1l
tatgagtatgcctcc

SEQ ID NO: 11408 - DNA, 15 bp, Artificial Sequence
  dgRNA
  Mtx2
tcttagggctctcgc

SEQ ID NO: 11409 - DNA, 15 bp, Artificial Sequence
  dgRNA
  Mtx2
gggctctcgcaggtc

SEQ ID NO: 11410 - DNA, 15 bp, Artificial Sequence
  dgRNA
  Mtx2
caggtccggagcgcg

SEQ ID NO: 11411 - DNA, 15 bp, Artificial Sequence
  dgRNA
  Mtx2
aggtccggagcgcgc

SEQ ID NO: 11412 - DNA, 15 bp, Artificial Sequence
  dgRNA
  Ltb
cccggccccagcgct

SEQ ID NO: 11413 - DNA, 15 bp, Artificial Sequence
  dgRNA
  Ltb
tgttcggaaagtccc

SEQ ID NO: 11414 - DNA, 15 bp, Artificial Sequence
  dgRNA
  Ltb
gttcggaaagtcccc

SEQ ID NO: 11415 - DNA, 15 bp, Artificial Sequence
  dgRNA
  Ltb
ccagcgctggggccg

SEQ ID NO: 11416 - DNA, 15 bp, Artificial Sequence
  dgRNA
  Myo7b
ttagccagttccgct

SEQ ID NO: 11417 - DNA, 15 bp, Artificial Sequence
  dgRNA
  Myo7b
gccctagaggcctca

SEQ ID NO: 11418 - DNA, 15 bp, Artificial Sequence
  dgRNA
  Myo7b
ttaatggtgccctag

SEQ ID NO: 11419 - DNA, 15 bp, Artificial Sequence
  dgRNA
  Myo7b
agtattcactcccac

SEQ ID NO: 11420 - DNA, 15 bp, Artificial Sequence
  dgRNA
  Afmid
cccgagtcttgctgg

SEQ ID NO: 11421 - DNA, 15 bp, Artificial Sequence
  dgRNA
  Afmid
gcccgcgaactcaaa

SEQ ID NO: 11422 - DNA, 15 bp, Artificial Sequence
  dgRNA
  Afmid
cccgcgaactcaaaa

SEQ ID NO: 11423 - DNA, 15 bp, Artificial Sequence
  dgRNA
  Afmid
ccgcgaactcaaaag

SEQ ID NO: 11424 - DNA, 15 bp, Artificial Sequence
  dgRNA
  Olfr944
aggcaattatattga

SEQ ID NO: 11425 - DNA, 15 bp, Artificial Sequence
  dgRNA
  Olfr944
tcctttagatctgat

SEQ ID NO: 11426 - DNA, 15 bp, Artificial Sequence
  dgRNA
  Olfr944
tttagatctgattgg

SEQ ID NO: 11427 - DNA, 15 bp, Artificial Sequence
  dgRNA
  Olfr944
tccaatcagatctaa

SEQ ID NO: 11428 - DNA, 15 bp, Artificial Sequence
  dgRNA
  Il15ra
gcagcccaactgggg

SEQ ID NO: 11429 - DNA, 15 bp, Artificial Sequence
  dgRNA
  Il15ra
agggggcgtcactgc

SEQ ID NO: 11430 - DNA, 15 bp, Artificial Sequence
  dgRNA
  Il15ra
cacctctctgcaatc

SEQ ID NO: 11431 - DNA, 15 bp, Artificial Sequence
  dgRNA
  Il15ra
cctctctgcaatccg

SEQ ID NO: 11432 - DNA, 15 bp, Artificial Sequence
  dgRNA
  Ctnna2
agcccgggcgagtcg

SEQ ID NO: 11433 - DNA, 15 bp, Artificial Sequence
  dgRNA
  Ctnna2
gcccgggcgagtcgc

SEQ ID NO: 11434 - DNA, 15 bp, Artificial Sequence
  dgRNA
  Ctnna2
ggccacctcccctag

SEQ ID NO: 11435 - DNA, 15 bp, Artificial Sequence
  dgRNA
  Ctnna2
cccctagcggcgatc

SEQ ID NO: 11436 - DNA, 15 bp, Artificial Sequence
  dgRNA
  Per1
aaccgctgagctcag

SEQ ID NO: 11437 - DNA, 15 bp, Artificial Sequence
  dgRNA
  Per1
ctcagcggctgacgt

SEQ ID NO: 11438 - DNA, 15 bp, Artificial Sequence
  dgRNA
  Per1
tgacgtcggtttccc

SEQ ID NO: 11439 - DNA, 15 bp, Artificial Sequence
  dgRNA
  Per1
tttccctggcgaccg

SEQ ID NO: 11440 - DNA, 15 bp, Artificial Sequence
  dgRNA
  Olfr1347
gtttcgttcaaagac

SEQ ID NO: 11441 - DNA, 15 bp, Artificial Sequence
  dgRNA
  Olfr1347
acgaaactctaagca

SEQ ID NO: 11442 - DNA, 15 bp, Artificial Sequence
  dgRNA
  Olfr1347
aatgtgcacgtttcc

SEQ ID NO: 11443 - DNA, 15 bp, Artificial Sequence
  dgRNA
  Cadps2
gcgggggtcggcggc

SEQ ID NO: 11444 - DNA, 15 bp, Artificial Sequence
  dgRNA
  Cadps2
gtcggcggcggggct

SEQ ID NO: 11445 - DNA, 15 bp, Artificial Sequence
  dgRNA
  Cadps2
gctgggcgcgcgcgc

SEQ ID NO: 11446 - DNA, 15 bp, Artificial Sequence
  dgRNA
  Cadps2
cgggctggacgcccg

SEQ ID NO: 11447 - DNA, 15 bp, Artificial Sequence
  dgRNA
  Sugp2
accaccccgaccccg

SEQ ID NO: 11448 - DNA, 15 bp, Artificial Sequence
  dgRNA
  Sugp2
acaagcacaggcggc

SEQ ID NO: 11449 - DNA, 15 bp, Artificial Sequence
  dgRNA
  Sugp2
gccggtgctcctcac

SEQ ID NO: 11450 - DNA, 15 bp, Artificial Sequence
  dgRNA
  Sugp2
ccggtgctcctcacc

SEQ ID NO: 11451 - DNA, 15 bp, Artificial Sequence
  dgRNA
  Dab2ip
ttattccctcccacg

SEQ ID NO: 11452 - DNA, 15 bp, Artificial Sequence
  dgRNA
  Dab2ip
ttccctcccacgagg

SEQ ID NO: 11453 - DNA, 15 bp, Artificial Sequence
  dgRNA
  Dab2ip
ccccatccattcgca

SEQ ID NO: 11454 - DNA, 15 bp, Artificial Sequence
  dgRNA
  Dab2ip
cccatccattcgcac

SEQ ID NO: 11455 - DNA, 15 bp, Artificial Sequence
  dgRNA
  Crip1
gtccgcaggagccgc

SEQ ID NO: 11456 - DNA, 15 bp, Artificial Sequence
  dgRNA
  Crip1
tccgcaggagccgct

SEQ ID NO: 11457 - DNA, 15 bp, Artificial Sequence
  dgRNA
  Crip1
agccgctgggcttag

SEQ ID NO: 11458 - DNA, 15 bp, Artificial Sequence
  dgRNA
  Crip1
gccgctgggcttaga

SEQ ID NO: 11459 - DNA, 15 bp, Artificial Sequence
  dgRNA
  Zadh2
gttccgcgggggctg

SEQ ID NO: 11460 - DNA, 15 bp, Artificial Sequence
  dgRNA
  Zadh2
gctgcggcgcgcgga

SEQ ID NO: 11461 - DNA, 15 bp, Artificial Sequence
  dgRNA
  Zadh2
ctgcggcgcgcggag

SEQ ID NO: 11462 - DNA, 15 bp, Artificial Sequence
  dgRNA
  Zadh2
ggagccaggcggcga

SEQ ID NO: 11463 - DNA, 15 bp, Artificial Sequence
  dgRNA
  Ogfr
aggtcgacaaagatt

SEQ ID NO: 11464 - DNA, 15 bp, Artificial Sequence
  dgRNA
  Ogfr
ctgcacccagacggc

SEQ ID NO: 11465 - DNA, 15 bp, Artificial Sequence
  dgRNA
  Ogfr
acccagacggctggc

SEQ ID NO: 11466 - DNA, 15 bp, Artificial Sequence
  dgRNA
  Ogfr
agaggcacttcccgt

SEQ ID NO: 11467 - DNA, 15 bp, Artificial Sequence
  dgRNA
  Kif2c
agcccggccacgcgc

SEQ ID NO: 11468 - DNA, 15 bp, Artificial Sequence
  dgRNA
  Kif2c
ccacgcgccggaagt

SEQ ID NO: 11469 - DNA, 15 bp, Artificial Sequence
  dgRNA
  Kif2c
ttccggcgcgtggcc

SEQ ID NO: 11470 - DNA, 15 bp, Artificial Sequence
  dgRNA
  Kif2c
cttccggcgcgtggc

SEQ ID NO: 11471 - DNA, 15 bp, Artificial Sequence
  dgRNA
  Vamp3
cccactcgtcagcgc

SEQ ID NO: 11472 - DNA, 15 bp, Artificial Sequence
  dgRNA
  Vamp3
tatcccgcccatttc

SEQ ID NO: 11473 - DNA, 15 bp, Artificial Sequence
  dgRNA
  Vamp3
tttccggcgcgcccc

SEQ ID NO: 11474 - DNA, 15 bp, Artificial Sequence
  dgRNA
  Vamp3
actaagagcgcgtcg

SEQ ID NO: 11475 - DNA, 15 bp, Artificial Sequence
  dgRNA
  Rab29
ttgctcaagatagct

SEQ ID NO: 11476 - DNA, 15 bp, Artificial Sequence
  dgRNA
  Rab29
tcccaagagtgtacg

SEQ ID NO: 11477 - DNA, 15 bp, Artificial Sequence
  dgRNA
  Rab29
ggcaagtcgccacac

SEQ ID NO: 11478 - DNA, 15 bp, Artificial Sequence
  dgRNA
  Rab29
gtcgccacactggtc

SEQ ID NO: 11479 - DNA, 15 bp, Artificial Sequence
  dgRNA
  Dus3l
atcaagagtgaccca

SEQ ID NO: 11480 - DNA, 15 bp, Artificial Sequence
  dgRNA
  Dus3l
cgacaagaacccctc

SEQ ID NO: 11481 - DNA, 15 bp, Artificial Sequence
  dgRNA
  Dus3l
cgtggaagtgaatct

SEQ ID NO: 11482 - DNA, 15 bp, Artificial Sequence
  dgRNA
  Dus3l
ccgtggaagtgaatc

SEQ ID NO: 11483 - DNA, 15 bp, Artificial Sequence
  dgRNA
  Uts2r
ggtagttgacacaaa

SEQ ID NO: 11484 - DNA, 15 bp, Artificial Sequence
  dgRNA
  Uts2r
gtagttgacacaaaa

SEQ ID NO: 11485 - DNA, 15 bp, Artificial Sequence
  dgRNA
  Uts2r
ctaatcttctcccac

SEQ ID NO: 11486 - DNA, 15 bp, Artificial Sequence
  dgRNA
  Uts2r
ggacaagttccccac

SEQ ID NO: 11487 - DNA, 15 bp, Artificial Sequence
  dgRNA
  Il12rb2
acacgcctcctgcac

SEQ ID NO: 11488 - DNA, 15 bp, Artificial Sequence
  dgRNA
  Il12rb2
cacgcctcctgcact

SEQ ID NO: 11489 - DNA, 15 bp, Artificial Sequence
  dgRNA
  Il12rb2
ccgcactaagcacgc

SEQ ID NO: 11490 - DNA, 15 bp, Artificial Sequence
  dgRNA
  Il12rb2
cgcactaagcacgct

SEQ ID NO: 11491 - DNA, 15 bp, Artificial Sequence
  dgRNA
  Tmem106c
agaagcgctctgatc

SEQ ID NO: 11492 - DNA, 15 bp, Artificial Sequence
  dgRNA
  Tmem106c
ccggaagctcagatc

SEQ ID NO: 11493 - DNA, 15 bp, Artificial Sequence
  dgRNA
  Tmem106c
cggaagctcagatct

SEQ ID NO: 11494 - DNA, 15 bp, Artificial Sequence
  dgRNA
  Tmem106c
ctccgagcacctccg

SEQ ID NO: 11495 - DNA, 15 bp, Artificial Sequence
  dgRNA
  Txlnb
caaaggatactcccc

SEQ ID NO: 11496 - DNA, 15 bp, Artificial Sequence
  dgRNA
  Txlnb
tttcttgctgcgtca

SEQ ID NO: 11497 - DNA, 15 bp, Artificial Sequence
  dgRNA
  Txlnb
ttcttgctgcgtcac

SEQ ID NO: 11498 - DNA, 15 bp, Artificial Sequence
  dgRNA
  Txlnb
cgccccctccttttg

SEQ ID NO: 11499 - DNA, 15 bp, Artificial Sequence
  dgRNA
  Mss51
catccaggaaatagt

SEQ ID NO: 11500 - DNA, 15 bp, Artificial Sequence
  dgRNA
  Mss51
aaatcagtatttggc

SEQ ID NO: 11501 - DNA, 15 bp, Artificial Sequence
  dgRNA
  Mss51
tcttgggattaatta

SEQ ID NO: 11502 - DNA, 15 bp, Artificial Sequence
  dgRNA
  Mss51
agcttcattaggagg

SEQ ID NO: 11503 - DNA, 15 bp, Artificial Sequence
  dgRNA
  Esrp2
gaatggattcgtccc

SEQ ID NO: 11504 - DNA, 15 bp, Artificial Sequence
  dgRNA
  Esrp2
ccggactgcagcaag

SEQ ID NO: 11505 - DNA, 15 bp, Artificial Sequence
  dgRNA
  Esrp2
gttttggccctcccg

SEQ ID NO: 11506 - DNA, 15 bp, Artificial Sequence
  dgRNA
  Esrp2
ttttggccctcccgc

SEQ ID NO: 11507 - DNA, 15 bp, Artificial Sequence
  dgRNA
  Mt3
gctcagcatcccgtt

SEQ ID NO: 11508 - DNA, 15 bp, Artificial Sequence
  dgRNA
  Mt3
ctgatcaagacaatc

SEQ ID NO: 11509 - DNA, 15 bp, Artificial Sequence
  dgRNA
  Mt3
gaagaacctacggga

SEQ ID NO: 11510 - DNA, 15 bp, Artificial Sequence
  dgRNA
  Mt3
aagaacctacgggaa

SEQ ID NO: 11511 - DNA, 15 bp, Artificial Sequence
  dgRNA
  Tcf23
acccctcagccggaa

SEQ ID NO: 11512 - DNA, 15 bp, Artificial Sequence
  dgRNA
  Tcf23
cccctcagccggaat

SEQ ID NO: 11513 - DNA, 15 bp, Artificial Sequence
  dgRNA
  Tcf23
ctcagccggaatggg

SEQ ID NO: 11514 - DNA, 15 bp, Artificial Sequence
  dgRNA
  Tcf23
gccggaatgggaggc

SEQ ID NO: 11515 - DNA, 15 bp, Artificial Sequence
  dgRNA
  Dhx9
atctcgcgcgacctc

SEQ ID NO: 11516 - DNA, 15 bp, Artificial Sequence
  dgRNA
  Dhx9
gcgcgacctcaggtt

SEQ ID NO: 11517 - DNA, 15 bp, Artificial Sequence
  dgRNA
  Dhx9
ctcaggtttggcgcc

SEQ ID NO: 11518 - DNA, 15 bp, Artificial Sequence
  dgRNA
  Dhx9
tttggcgcccggaag

SEQ ID NO: 11519 - DNA, 15 bp, Artificial Sequence
  dgRNA
  Ugt8a
ggccgaggcagcgcg

SEQ ID NO: 11520 - DNA, 15 bp, Artificial Sequence
  dgRNA
  Ugt8a
gaggcagcgcgcggc

SEQ ID NO: 11521 - DNA, 15 bp, Artificial Sequence
  dgRNA
  Ugt8a
aggcagcgcgcggca

SEQ ID NO: 11522 - DNA, 15 bp, Artificial Sequence
  dgRNA
  Ugt8a
cagcgcgcggcaggg

SEQ ID NO: 11523 - DNA, 15 bp, Artificial Sequence
  dgRNA
  Mill1
gtccttgttgatgag

SEQ ID NO: 11524 - DNA, 15 bp, Artificial Sequence
  dgRNA
  Mill1
tagggatagctgtaa

SEQ ID NO: 11525 - DNA, 15 bp, Artificial Sequence
  dgRNA
  Mill1
caggtatctcaaccg

SEQ ID NO: 11526 - DNA, 15 bp, Artificial Sequence
  dgRNA
  Mill1
gcaggtatctcaacc

SEQ ID NO: 11527 - DNA, 15 bp, Artificial Sequence
  dgRNA
  Rps24
gagtggatccaattc

SEQ ID NO: 11528 - DNA, 15 bp, Artificial Sequence
  dgRNA
  Rps24
tctggggcgtggcta

SEQ ID NO: 11529 - DNA, 15 bp, Artificial Sequence
  dgRNA
  Rps24
ctggggcgtggctaa

SEQ ID NO: 11530 - DNA, 15 bp, Artificial Sequence
  dgRNA
  Rps24
ggctaagggctagcg

SEQ ID NO: 11531 - DNA, 15 bp, Artificial Sequence
  dgRNA
  Spinkl
atatgtctcatgcat

SEQ ID NO: 11532 - DNA, 15 bp, Artificial Sequence
  dgRNA
  Spinkl
ccagtcacatttata

SEQ ID NO: 11533 - DNA, 15 bp, Artificial Sequence
  dgRNA
  Spinkl
ttgtgttcttactcg

SEQ ID NO: 11534 - DNA, 15 bp, Artificial Sequence
  dgRNA
  Spinkl
taatgcaaatagcca

SEQ ID NO: 11535 - DNA, 15 bp, Artificial Sequence
  dgRNA
  Rnf41
caaggcgggacaccc

SEQ ID NO: 11536 - DNA, 15 bp, Artificial Sequence
  dgRNA
  Rnf41
aaggcgggacaccca

SEQ ID NO: 11537 - DNA, 15 bp, Artificial Sequence
  dgRNA
  Rnf41
cacccagggtcgccc

SEQ ID NO: 11538 - DNA, 15 bp, Artificial Sequence
  dgRNA
  Rnf41
cgtcctaagaacttc

SEQ ID NO: 11539 - DNA, 15 bp, Artificial Sequence
  dgRNA
  Ap2a1
gcgttctattgtgag

SEQ ID NO: 11540 - DNA, 15 bp, Artificial Sequence
  dgRNA
  Ap2a1
tctattgtgagcggc

SEQ ID NO: 11541 - DNA, 15 bp, Artificial Sequence
  dgRNA
  Ap2a1
ctattgtgagcggca

SEQ ID NO: 11542 - DNA, 15 bp, Artificial Sequence
  dgRNA
  Ap2a1
agtggcgtacgttcc

SEQ ID NO: 11543 - DNA, 15 bp, Artificial Sequence
  dgRNA
  Ugt1a6a
ggttaaggcaagtac

SEQ ID NO: 11544 - DNA, 15 bp, Artificial Sequence
  dgRNA
  Ugt1a6a
caccccagtcggttg

SEQ ID NO: 11545 - DNA, 15 bp, Artificial Sequence
  dgRNA
  Ugt1a6a
gcaccccagtcggtt

SEQ ID NO: 11546 - DNA, 15 bp, Artificial Sequence
  dgRNA
  Ugt1a6a
ggcaccccagtcggt

SEQ ID NO: 11547 - DNA, 15 bp, Artificial Sequence
  dgRNA
  Olfr522
aaggctgacccgtcc

SEQ ID NO: 11548 - DNA, 15 bp, Artificial Sequence
  dgRNA
  Olfr522
aggctgacccgtcct

SEQ ID NO: 11549 - DNA, 15 bp, Artificial Sequence
  dgRNA
  Olfr522
aacatccctcggtcc

SEQ ID NO: 11550 - DNA, 15 bp, Artificial Sequence
  dgRNA
  Olfr522
acatccctcggtcct

SEQ ID NO: 11551 - DNA, 15 bp, Artificial Sequence
  dgRNA
  Lypla2
agctggtaggacatc

SEQ ID NO: 11552 - DNA, 15 bp, Artificial Sequence
  dgRNA
  Lypla2
tccagacgctgtagg

SEQ ID NO: 11553 - DNA, 15 bp, Artificial Sequence
  dgRNA
  Lypla2
gcagcgtcgcatcac

SEQ ID NO: 11554 - DNA, 15 bp, Artificial Sequence
  dgRNA
  Lypla2
cagcgtcgcatcaca

SEQ ID NO: 11555 - DNA, 15 bp, Artificial Sequence
  dgRNA
  Zfp263
gggtcacatccgccc

SEQ ID NO: 11556 - DNA, 15 bp, Artificial Sequence
  dgRNA
  Zfp263
ggtcacatccgccca

SEQ ID NO: 11557 - DNA, 15 bp, Artificial Sequence
  dgRNA
  Zfp263
taccgcttccccacc

SEQ ID NO: 11558 - DNA, 15 bp, Artificial Sequence
  dgRNA
  Zfp263
cgcttccccacctgg

SEQ ID NO: 11559 - DNA, 15 bp, Artificial Sequence
  dgRNA
  Lrtm2
gagatggccgctcct

SEQ ID NO: 11560 - DNA, 15 bp, Artificial Sequence
  dgRNA
  Lrtm2
atggccgctcctggg

SEQ ID NO: 11561 - DNA, 15 bp, Artificial Sequence
  dgRNA
  Lrtm2
gtagtacctgtagtc

SEQ ID NO: 11562 - DNA, 15 bp, Artificial Sequence
  dgRNA
  Lrtm2
tagtacctgtagtct

SEQ ID NO: 11563 - DNA, 15 bp, Artificial Sequence
  dgRNA
  Asph
acaatcacagtgtac

SEQ ID NO: 11564 - DNA, 15 bp, Artificial Sequence
  dgRNA
  Asph
gtactggcggaactg

SEQ ID NO: 11565 - DNA, 15 bp, Artificial Sequence
  dgRNA
  Asph
gagggcttgcaccct

SEQ ID NO: 11566 - DNA, 15 bp, Artificial Sequence
  dgRNA
  Asph
cccttggtcgtactt

SEQ ID NO: 11567 - DNA, 15 bp, Artificial Sequence
  dgRNA
  Odc1
gcgcaggcctgccgc

SEQ ID NO: 11568 - DNA, 15 bp, Artificial Sequence
  dgRNA
  Odc1
cgcaggcctgccgca

SEQ ID NO: 11569 - DNA, 15 bp, Artificial Sequence
  dgRNA
  Odc1
ggcgtgtccgacacg

SEQ ID NO: 11570 - DNA, 15 bp, Artificial Sequence
  dgRNA
  Odc1
gtccgacacgaggcc

SEQ ID NO: 11571 - DNA, 15 bp, Artificial Sequence
  dgRNA
  Lrrc61
aatgaccaaactaac

SEQ ID NO: 11572 - DNA, 15 bp, Artificial Sequence
  dgRNA
  Lrrc61
agctagaagctcctc

SEQ ID NO: 11573 - DNA, 15 bp, Artificial Sequence
  dgRNA
  Lrrc61
actccccgccccttc

SEQ ID NO: 11574 - DNA, 15 bp, Artificial Sequence
  dgRNA
  Lrrc61
gagcgacgttgggaa

SEQ ID NO: 11575 - DNA, 15 bp, Artificial Sequence
  dgRNA
  Brd2
gcaacagccttagcg

SEQ ID NO: 11576 - DNA, 15 bp, Artificial Sequence
  dgRNA
  Brd2
agccttagcgaggtc

SEQ ID NO: 11577 - DNA, 15 bp, Artificial Sequence
  dgRNA
  Brd2
ccttagcgaggtctg

SEQ ID NO: 11578 - DNA, 15 bp, Artificial Sequence
  dgRNA
  Brd2
cgaggtctggggtct

SEQ ID NO: 11579 - DNA, 15 bp, Artificial Sequence
  dgRNA
  Lvrn
aacaaacaaccgtcg

SEQ ID NO: 11580 - DNA, 15 bp, Artificial Sequence
  dgRNA
  Lvrn
cgaggacatccagat

SEQ ID NO: 11581 - DNA, 15 bp, Artificial Sequence
  dgRNA
  Lvrn
cggtgcctccccgcg

SEQ ID NO: 11582 - DNA, 15 bp, Artificial Sequence
  dgRNA
  Lvrn
ccccgcgaggaccaa

SEQ ID NO: 11583 - DNA, 15 bp, Artificial Sequence
  dgRNA
  Stc2
tttgtggggcgatcg

SEQ ID NO: 11584 - DNA, 15 bp, Artificial Sequence
  dgRNA
  Stc2
gtggggcgatcgcgg

SEQ ID NO: 11585 - DNA, 15 bp, Artificial Sequence
  dgRNA
  Stc2
cgtagaagttggcgc

SEQ ID NO: 11586 - DNA, 15 bp, Artificial Sequence
  dgRNA
  Stc2
cgctgtgttgtcaaa

SEQ ID NO: 11587 - DNA, 15 bp, Artificial Sequence
  dgRNA
  Phka2
ctttagcctcagccg

SEQ ID NO: 11588 - DNA, 15 bp, Artificial Sequence
  dgRNA
  Phka2
agcctcagccgcggt

SEQ ID NO: 11589 - DNA, 15 bp, Artificial Sequence
  dgRNA
  Phka2
gccgcggttggaagc

SEQ ID NO: 11590 - DNA, 15 bp, Artificial Sequence
  dgRNA
  Phka2
ccccgccgctcccag

SEQ ID NO: 11591 - DNA, 15 bp, Artificial Sequence
  dgRNA
  Ociad2
acataatataggcac

SEQ ID NO: 11592 - DNA, 15 bp, Artificial Sequence
  dgRNA
  Rnasel
tacgggtgagcaaga

SEQ ID NO: 11593 - DNA, 15 bp, Artificial Sequence
  dgRNA
  Rnasel
tgagcaagacggccc

SEQ ID NO: 11594 - DNA, 15 bp, Artificial Sequence
  dgRNA
  Rnasel
ggcagctccgctcag

SEQ ID NO: 11595 - DNA, 15 bp, Artificial Sequence
  dgRNA
  Rnasel
agctccgctcagcgg

SEQ ID NO: 11596 - DNA, 15 bp, Artificial Sequence
  dgRNA
  Rpl34
aaacgcacccgccta

SEQ ID NO: 11597 - DNA, 15 bp, Artificial Sequence
  dgRNA
  Rpl34
atccgccgctcaacg

SEQ ID NO: 11598 - DNA, 15 bp, Artificial Sequence
  dgRNA
  Rpl34
cggcgccatccacac

SEQ ID NO: 11599 - DNA, 15 bp, Artificial Sequence
  dgRNA
  Rpl34
cgcttccgtacaaca

SEQ ID NO: 11600 - DNA, 15 bp, Artificial Sequence
  dgRNA
  Chrnb2
gtcatgccccaactt

SEQ ID NO: 11601 - DNA, 15 bp, Artificial Sequence
  dgRNA
  Chrnb2
acaccccacctcggc

SEQ ID NO: 11602 - DNA, 15 bp, Artificial Sequence
  dgRNA
  Chrnb2
ggcaggcccagtcaa

SEQ ID NO: 11603 - DNA, 15 bp, Artificial Sequence
  dgRNA
  Chrnb2
caaaggtcccctcac

SEQ ID NO: 11604 - DNA, 15 bp, Artificial Sequence
  dgRNA
  Cd200r2
ttttgacacctcttg

SEQ ID NO: 11605 - DNA, 15 bp, Artificial Sequence
  dgRNA
  Cd200r2
gaaattgcagtattg

SEQ ID NO: 11606 - DNA, 15 bp, Artificial Sequence
  dgRNA
  Cd200r2
ctagagctacacatt

SEQ ID NO: 11607 - DNA, 15 bp, Artificial Sequence
  dgRNA
  Cdkl3
cttgcgtactgtgct

SEQ ID NO: 11608 - DNA, 15 bp, Artificial Sequence
  dgRNA
  Cdkl3
actgtgctcggaacg

SEQ ID NO: 11609 - DNA, 15 bp, Artificial Sequence
  dgRNA
  Cdkl3
cctcaccccgttgcc

SEQ ID NO: 11610 - DNA, 15 bp, Artificial Sequence
  dgRNA
  Cdkl3
ctcaccccgttgcca

SEQ ID NO: 11611 - DNA, 15 bp, Artificial Sequence
  dgRNA
  Rad51c
aaccgccacactctg

SEQ ID NO: 11612 - DNA, 15 bp, Artificial Sequence
  dgRNA
  Rad51c
accgccacactctga

SEQ ID NO: 11613 - DNA, 15 bp, Artificial Sequence
  dgRNA
  Rad51c
gagctccggagtccc

SEQ ID NO: 11614 - DNA, 15 bp, Artificial Sequence
  dgRNA
  Rad51c
agctccggagtcccg

SEQ ID NO: 11615 - DNA, 15 bp, Artificial Sequence
  dgRNA
  Pianp
cataaaagaagtgcc

SEQ ID NO: 11616 - DNA, 15 bp, Artificial Sequence
  dgRNA
  Pianp
gcctggcgcttcaag

SEQ ID NO: 11617 - DNA, 15 bp, Artificial Sequence
  dgRNA
  Pianp
gcttcaagaggtgac

SEQ ID NO: 11618 - DNA, 15 bp, Artificial Sequence
  dgRNA
  Pianp
aaactccctccctag

SEQ ID NO: 11619 - DNA, 15 bp, Artificial Sequence
  dgRNA
  Alg12
cgtcccgcgagaatg

SEQ ID NO: 11620 - DNA, 15 bp, Artificial Sequence
  dgRNA
  Alg12
accgtaatcttctat

SEQ ID NO: 11621 - DNA, 15 bp, Artificial Sequence
  dgRNA
  Alg12
ccgtaatcttctatc

SEQ ID NO: 11622 - DNA, 15 bp, Artificial Sequence
  dgRNA
  Alg12
cccgccctccacgag

SEQ ID NO: 11623 - DNA, 15 bp, Artificial Sequence
  dgRNA
  Tubd1
cgtagcattagctcc

SEQ ID NO: 11624 - DNA, 15 bp, Artificial Sequence
  dgRNA
  Tubd1
gtagcattagctccc

SEQ ID NO: 11625 - DNA, 15 bp, Artificial Sequence
  dgRNA
  Tubd1
tagcattagctcccg

SEQ ID NO: 11626 - DNA, 15 bp, Artificial Sequence
  dgRNA
  Tubd1
ttagctcccggggcc

SEQ ID NO: 11627 - DNA, 15 bp, Artificial Sequence
  dgRNA
  Cntnap1
cagccttgggttaat

SEQ ID NO: 11628 - DNA, 15 bp, Artificial Sequence
  dgRNA
  Cntnap1
agccttgggttaatt

SEQ ID NO: 11629 - DNA, 15 bp, Artificial Sequence
  dgRNA
  Cntnap1
gccttgggttaattg

SEQ ID NO: 11630 - DNA, 15 bp, Artificial Sequence
  dgRNA
  Cntnap1
ccttgggttaattgg

SEQ ID NO: 11631 - DNA, 15 bp, Artificial Sequence
  dgRNA
  Mrgprb3
tcactagtgcataaa

SEQ ID NO: 11632 - DNA, 15 bp, Artificial Sequence
  dgRNA
  Mrgprb3
cactagtgcataaaa

SEQ ID NO: 11633 - DNA, 15 bp, Artificial Sequence
  dgRNA
  Mrgprb3
gtgttgccgagcatc

SEQ ID NO: 11634 - DNA, 15 bp, Artificial Sequence
  dgRNA
  Mrgprb3
ttacaggaacactag

SEQ ID NO: 11635 - DNA, 15 bp, Artificial Sequence
  dgRNA
  Rorc
cagctagaactcccc

SEQ ID NO: 11636 - DNA, 15 bp, Artificial Sequence
  dgRNA
  Rorc
aactcccctggcgag

SEQ ID NO: 11637 - DNA, 15 bp, Artificial Sequence
  dgRNA
  Rorc
ccgcggctgtagctg

SEQ ID NO: 11638 - DNA, 15 bp, Artificial Sequence
  dgRNA
  Rorc
aacgccccctgtgat

SEQ ID NO: 11639 - DNA, 15 bp, Artificial Sequence
  dgRNA
  Rreb1
gccgacgcgtattgt

SEQ ID NO: 11640 - DNA, 15 bp, Artificial Sequence
  dgRNA
  Rreb1
ttgttggtgactccg

SEQ ID NO: 11641 - DNA, 15 bp, Artificial Sequence
  dgRNA
  Rreb1
tggtgactccgaggc

SEQ ID NO: 11642 - DNA, 15 bp, Artificial Sequence
  dgRNA
  Rreb1
gactccgaggctggc

SEQ ID NO: 11643 - DNA, 15 bp, Artificial Sequence
  dgRNA
  Lta4h
gatcgcgctgcatca

SEQ ID NO: 11644 - DNA, 15 bp, Artificial Sequence
  dgRNA
  Lta4h
atcgcgctgcatcat

SEQ ID NO: 11645 - DNA, 15 bp, Artificial Sequence
  dgRNA
  Lta4h
gctgcatcatgggat

SEQ ID NO: 11646 - DNA, 15 bp, Artificial Sequence
  dgRNA
  Lta4h
ctccactaagcccct

SEQ ID NO: 11647 - DNA, 15 bp, Artificial Sequence
  dgRNA
  Rpl35
gatagcgagatggtt

SEQ ID NO: 11648 - DNA, 15 bp, Artificial Sequence
  dgRNA
  Rpl35
ttttgtacccaagtt

SEQ ID NO: 11649 - DNA, 15 bp, Artificial Sequence
  dgRNA
  Rpl35
cgaacgcaagtggtc

SEQ ID NO: 11650 - DNA, 15 bp, Artificial Sequence
  dgRNA
  Rpl35
aacgtcgaacgcaag

SEQ ID NO: 11651 - DNA, 15 bp, Artificial Sequence
  dgRNA
  Pfdn1
tgtctcgtagcagag

SEQ ID NO: 11652 - DNA, 15 bp, Artificial Sequence
  dgRNA
  Pfdn1
ggttcacttttgcgc

SEQ ID NO: 11653 - DNA, 15 bp, Artificial Sequence
  dgRNA
  Pfdn1
gaacctccactagcc

SEQ ID NO: 11654 - DNA, 15 bp, Artificial Sequence
  dgRNA
  Pfdn1
gggaagggcgttttc

SEQ ID NO: 11655 - DNA, 15 bp, Artificial Sequence
  dgRNA
  Dolk
ccagcccgcgcttca

SEQ ID NO: 11656 - DNA, 15 bp, Artificial Sequence
  dgRNA
  Dolk
tccgcacctcacaca

SEQ ID NO: 11657 - DNA, 15 bp, Artificial Sequence
  dgRNA
  Dolk
cacacggcccaccag

SEQ ID NO: 11658 - DNA, 15 bp, Artificial Sequence
  dgRNA
  Dolk
ccatcttcgcgcgcg

SEQ ID NO: 11659 - DNA, 15 bp, Artificial Sequence
  dgRNA
  4933434E20Rik
atcaggattcccttc

SEQ ID NO: 11660 - DNA, 15 bp, Artificial Sequence
  dgRNA
  4933434E20Rik
cccttcaggtcacta

SEQ ID NO: 11661 - DNA, 15 bp, Artificial Sequence
  dgRNA
  4933434E20Rik
ggtcactagggcaac

SEQ ID NO: 11662 - DNA, 15 bp, Artificial Sequence
  dgRNA
  4933434E20Rik
aaccagtcaactacc

SEQ ID NO: 11663 - DNA, 15 bp, Artificial Sequence
  dgRNA
  Rtn4
ctccgaacgccacca

SEQ ID NO: 11664 - DNA, 15 bp, Artificial Sequence
  dgRNA
  Rtn4
gcaccctatttctat

SEQ ID NO: 11665 - DNA, 15 bp, Artificial Sequence
  dgRNA
  Rtn4
tatcccgcagcctat

SEQ ID NO: 11666 - DNA, 15 bp, Artificial Sequence
  dgRNA
  Rtn4
tgagtcacgccaaac

SEQ ID NO: 11667 - DNA, 15 bp, Artificial Sequence
  dgRNA
  Arhgap35
tgcgcgccccccttg

SEQ ID NO: 11668 - DNA, 15 bp, Artificial Sequence
  dgRNA
  Arhgap35
gcgcgccccccttgc

SEQ ID NO: 11669 - DNA, 15 bp, Artificial Sequence
  dgRNA
  Arhgap35
cttcggtggcttcgc

SEQ ID NO: 11670 - DNA, 15 bp, Artificial Sequence
  dgRNA
  Arhgap35
cctgtgccagttcgc

SEQ ID NO: 11671 - DNA, 15 bp, Artificial Sequence
  dgRNA
  Ptpro
caagatctgcacttg

SEQ ID NO: 11672 - DNA, 15 bp, Artificial Sequence
  dgRNA
  Ptpro
caccactgttgctag

SEQ ID NO: 11673 - DNA, 15 bp, Artificial Sequence
  dgRNA
  Ptpro
accactgttgctagg

SEQ ID NO: 11674 - DNA, 15 bp, Artificial Sequence
  dgRNA
  Ptpro
gctagggggccgcgg

SEQ ID NO: 11675 - DNA, 15 bp, Artificial Sequence
  dgRNA
  Vmn1r54
ctggacgccttgaag

SEQ ID NO: 11676 - DNA, 15 bp, Artificial Sequence
  dgRNA
  Vmn1r54
gacgccttgaagtgg

SEQ ID NO: 11677 - DNA, 15 bp, Artificial Sequence
  dgRNA
  Vmn1r54
ggaggttatattacg

SEQ ID NO: 11678 - DNA, 15 bp, Artificial Sequence
  dgRNA
  Vmn1r54
atattacgtggaata

SEQ ID NO: 11679 - DNA, 15 bp, Artificial Sequence
  dgRNA
  Fbxo22
gccggcttaaacgcc

SEQ ID NO: 11680 - DNA, 15 bp, Artificial Sequence
  dgRNA
  Fbxo22
ccggtcccttccggg

SEQ ID NO: 11681 - DNA, 15 bp, Artificial Sequence
  dgRNA
  Fbxo22
cgggcggaactgtgc

SEQ ID NO: 11682 - DNA, 15 bp, Artificial Sequence
  dgRNA
  Fbxo22
cggaactgtgcaggc

SEQ ID NO: 11683 - DNA, 15 bp, Artificial Sequence
  dgRNA
  9330182L06Rik
cacaaggctcctgcg

SEQ ID NO: 11684 - DNA, 15 bp, Artificial Sequence
  dgRNA
  9330182L06Rik
aggctcctgcgcggt

SEQ ID NO: 11685 - DNA, 15 bp, Artificial Sequence
  dgRNA
  9330182L06Rik
ccgctccacgcgtgc

SEQ ID NO: 11686 - DNA, 15 bp, Artificial Sequence
  dgRNA
  9330182L06Rik
cgctccacgcgtgct

SEQ ID NO: 11687 - DNA, 15 bp, Artificial Sequence
  dgRNA
  Ubn2
gcgtccccgttgcca

SEQ ID NO: 11688 - DNA, 15 bp, Artificial Sequence
  dgRNA
  Ubn2
ttccgccgagctgtc

SEQ ID NO: 11689 - DNA, 15 bp, Artificial Sequence
  dgRNA
  Ubn2
caacagccacgactg

SEQ ID NO: 11690 - DNA, 15 bp, Artificial Sequence
  dgRNA
  Ubn2
catgcgcccgctcag

SEQ ID NO: 11691 - DNA, 15 bp, Artificial Sequence
  dgRNA
  Tet3
acccgctagaactgc

SEQ ID NO: 11692 - DNA, 15 bp, Artificial Sequence
  dgRNA
  Tet3
cccgctagaactgca

SEQ ID NO: 11693 - DNA, 15 bp, Artificial Sequence
  dgRNA
  Tet3
ccgctagaactgcag

SEQ ID NO: 11694 - DNA, 15 bp, Artificial Sequence
  dgRNA
  Tet3
ggtaggagggtgccc

SEQ ID NO: 11695 - DNA, 15 bp, Artificial Sequence
  dgRNA
  Os9
aatctcgccgatgat

SEQ ID NO: 11696 - DNA, 15 bp, Artificial Sequence
  dgRNA
  Os9
tgcgacccgcctccc

SEQ ID NO: 11697 - DNA, 15 bp, Artificial Sequence
  dgRNA
  Os9
gacccgcctccctgg

SEQ ID NO: 11698 - DNA, 15 bp, Artificial Sequence
  dgRNA
  Os9
ccacgtttacaaatg

SEQ ID NO: 11699 - DNA, 15 bp, Artificial Sequence
  dgRNA
  Stk36
gctgttgctagttcc

SEQ ID NO: 11700 - DNA, 15 bp, Artificial Sequence
  dgRNA
  Stk36
cccggcaccagatcc

SEQ ID NO: 11701 - DNA, 15 bp, Artificial Sequence
  dgRNA
  Stk36
gtcttctccggctct

SEQ ID NO: 11702 - DNA, 15 bp, Artificial Sequence
  dgRNA
  Stk36
tctccggctcttggc

SEQ ID NO: 11703 - DNA, 15 bp, Artificial Sequence
  dgRNA
  Zfyve28
atccaccacttgcag

SEQ ID NO: 11704 - DNA, 15 bp, Artificial Sequence
  dgRNA
  Zfyve28
ccacttgcagcgggc

SEQ ID NO: 11705 - DNA, 15 bp, Artificial Sequence
  dgRNA
  Zfyve28
cacttgcagcgggcc

SEQ ID NO: 11706 - DNA, 15 bp, Artificial Sequence
  dgRNA
  Zfyve28
acttgcagcgggccg

SEQ ID NO: 11707 - DNA, 15 bp, Artificial Sequence
  dgRNA
  Gngt1
tctgactcaactaag

SEQ ID NO: 11708 - DNA, 15 bp, Artificial Sequence
  dgRNA
  Gngt1
gtggcatcgattctt

SEQ ID NO: 11709 - DNA, 15 bp, Artificial Sequence
  dgRNA
  1110038F14Rik
gctgagcgcttgctc

SEQ ID NO: 11710 - DNA, 15 bp, Artificial Sequence
  dgRNA
  1110038F14Rik
ccgctgcgctttctg

SEQ ID NO: 11711 - DNA, 15 bp, Artificial Sequence
  dgRNA
  1110038F14Rik
tagacgtgtttccag

SEQ ID NO: 11712 - DNA, 15 bp, Artificial Sequence
  dgRNA
  1110038F14Rik
ggagtgagttcgctg

SEQ ID NO: 11713 - DNA, 15 bp, Artificial Sequence
  dgRNA
  Ssxb3
ccatagacctagtcc

SEQ ID NO: 11714 - DNA, 15 bp, Artificial Sequence
  dgRNA
  Ssxb3
ctggactaggtctat

SEQ ID NO: 11715 - DNA, 15 bp, Artificial Sequence
  dgRNA
  Ssxb3
tgagatcatctatcc

SEQ ID NO: 11716 - DNA, 15 bp, Artificial Sequence
  dgRNA
  Itga10
tagagagctggacta

SEQ ID NO: 11717 - DNA, 15 bp, Artificial Sequence
  dgRNA
  Itga10
tttttagctgccagt

SEQ ID NO: 11718 - DNA, 15 bp, Artificial Sequence
  dgRNA
  Itga10
ttagctgccagtggg

SEQ ID NO: 11719 - DNA, 15 bp, Artificial Sequence
  dgRNA
  Syce3
tagcaccttcccagt

SEQ ID NO: 11720 - DNA, 15 bp, Artificial Sequence
  dgRNA
  Syce3
atgtggctctacccg

SEQ ID NO: 11721 - DNA, 15 bp, Artificial Sequence
  dgRNA
  Syce3
cgaggcacgtaagaa

SEQ ID NO: 11722 - DNA, 15 bp, Artificial Sequence
  dgRNA
  Syce3
gtacatgccttacag

SEQ ID NO: 11723 - DNA, 15 bp, Artificial Sequence
  dgRNA
  Nr6a1
cactcagataacctt

SEQ ID NO: 11724 - DNA, 15 bp, Artificial Sequence
  dgRNA
  Nr6a1
tgtgaggatgacggt

SEQ ID NO: 11725 - DNA, 15 bp, Artificial Sequence
  dgRNA
  Nr6a1
cggtcggccgtagtt

SEQ ID NO: 11726 - DNA, 15 bp, Artificial Sequence
  dgRNA
  Nr6a1
cctgagaactaatac

SEQ ID NO: 11727 - DNA, 15 bp, Artificial Sequence
  dgRNA
  Rita1
gtgtggacaaactcg

SEQ ID NO: 11728 - DNA, 15 bp, Artificial Sequence
  dgRNA
  Rita1
tgtaccaaccacgca

SEQ ID NO: 11729 - DNA, 15 bp, Artificial Sequence
  dgRNA
  Rita1
aggttgaccctacca

SEQ ID NO: 11730 - DNA, 15 bp, Artificial Sequence
  dgRNA
  Rita1
ggttgaccctaccaa

SEQ ID NO: 11731 - DNA, 15 bp, Artificial Sequence
  dgRNA
  Lmntd1
cacgtagtctgctgc

SEQ ID NO: 11732 - DNA, 15 bp, Artificial Sequence
  dgRNA
  Lmntd1
acgtagtctgctgca

SEQ ID NO: 11733 - DNA, 15 bp, Artificial Sequence
  dgRNA
  Lmntd1
cgtagtctgctgcag

SEQ ID NO: 11734 - DNA, 15 bp, Artificial Sequence
  dgRNA
  Lmntd1
ccgataagacaaatg

SEQ ID NO: 11735 - DNA, 15 bp, Artificial Sequence
  dgRNA
  Sftpb
tgagggggttcggga

SEQ ID NO: 11736 - DNA, 15 bp, Artificial Sequence
  dgRNA
  Sftpb
tcgggaagggggtaa

SEQ ID NO: 11737 - DNA, 15 bp, Artificial Sequence
  dgRNA
  Sftpb
actaggaaccgacat

SEQ ID NO: 11738 - DNA, 15 bp, Artificial Sequence
  dgRNA
  Sftpb
acatcggccagcaca

SEQ ID NO: 11739 - DNA, 15 bp, Artificial Sequence
  dgRNA
  Utp23
aatttgcgcactccg

SEQ ID NO: 11740 - DNA, 15 bp, Artificial Sequence
  dgRNA
  Utp23
gctcgcgctaggaag

SEQ ID NO: 11741 - DNA, 15 bp, Artificial Sequence
  dgRNA
  Utp23
ctcgcgctaggaagt

SEQ ID NO: 11742 - DNA, 15 bp, Artificial Sequence
  dgRNA
  Utp23
actacagaatccgag

SEQ ID NO: 11743 - DNA, 15 bp, Artificial Sequence
  dgRNA
  Hoxa11
gccgggactagctcg

SEQ ID NO: 11744 - DNA, 15 bp, Artificial Sequence
  dgRNA
  Hoxa11
tgtcaatttcaacat

SEQ ID NO: 11745 - DNA, 15 bp, Artificial Sequence
  dgRNA
  Hoxa11
gtcaatttcaacatc

SEQ ID NO: 11746 - DNA, 15 bp, Artificial Sequence
  dgRNA
  Hoxa11
ctccctgctaaggat

SEQ ID NO: 11747 - DNA, 15 bp, Artificial Sequence
  dgRNA
  Nme7
cggaagtgaacgcgt

SEQ ID NO: 11748 - DNA, 15 bp, Artificial Sequence
  dgRNA
  Nme7
gtgaacgcgttggaa

SEQ ID NO: 11749 - DNA, 15 bp, Artificial Sequence
  dgRNA
  Nme7
gcgttggaacggaga

SEQ ID NO: 11750 - DNA, 15 bp, Artificial Sequence
  dgRNA
  Nme7
gcgtcgcgttgcccc

SEQ ID NO: 11751 - DNA, 15 bp, Artificial Sequence
  dgRNA
  Trmt2a
ccctgaccccagcgg

SEQ ID NO: 11752 - DNA, 15 bp, Artificial Sequence
  dgRNA
  Trmt2a
cctgaccccagcggc

SEQ ID NO: 11753 - DNA, 15 bp, Artificial Sequence
  dgRNA
  Trmt2a
ccagtgtagctttat

SEQ ID NO: 11754 - DNA, 15 bp, Artificial Sequence
  dgRNA
  Trmt2a
tattggctccgacag

SEQ ID NO: 11755 - DNA, 15 bp, Artificial Sequence
  dgRNA
  Pi16
cccttgctctttccg

SEQ ID NO: 11756 - DNA, 15 bp, Artificial Sequence
  dgRNA
  Pi16
ctctttccgtggtac

SEQ ID NO: 11757 - DNA, 15 bp, Artificial Sequence
  dgRNA
  Pi16
ttacccaatcctgta

SEQ ID NO: 11758 - DNA, 15 bp, Artificial Sequence
  dgRNA
  Pi16
tacccaatcctgtag

SEQ ID NO: 11759 - DNA, 15 bp, Artificial Sequence
  dgRNA
  Foxn3
agaggacgcgcgttg

SEQ ID NO: 11760 - DNA, 15 bp, Artificial Sequence
  dgRNA
  Foxn3
cgcgttgtggctgtg

SEQ ID NO: 11761 - DNA, 15 bp, Artificial Sequence
  dgRNA
  Foxn3
ttggatagttggcga

SEQ ID NO: 11762 - DNA, 15 bp, Artificial Sequence
  dgRNA
  Foxn3
cagttcttggatagt

SEQ ID NO: 11763 - DNA, 15 bp, Artificial Sequence
  dgRNA
  Stx11
tcgcccgcagcatct

SEQ ID NO: 11764 - DNA, 15 bp, Artificial Sequence
  dgRNA
  Stx11
cgcccgcagcatctc

SEQ ID NO: 11765 - DNA, 15 bp, Artificial Sequence
  dgRNA
  Stx11
gcccgcagcatctcg

SEQ ID NO: 11766 - DNA, 15 bp, Artificial Sequence
  dgRNA
  Stx11
catctcggggtgcac

SEQ ID NO: 11767 - DNA, 15 bp, Artificial Sequence
  dgRNA
  1700034O15Rik
tggcagcgatgtcat

SEQ ID NO: 11768 - DNA, 15 bp, Artificial Sequence
  dgRNA
  1700034O15Rik
taccacaacctaaaa

SEQ ID NO: 11769 - DNA, 15 bp, Artificial Sequence
  dgRNA
  1700034O15Rik
ataccacaacctaaa

SEQ ID NO: 11770 - DNA, 15 bp, Artificial Sequence
  dgRNA
  Ren1
gcagccaggtaactc

SEQ ID NO: 11771 - DNA, 15 bp, Artificial Sequence
  dgRNA
  Sgk1
ttctcggagattagt

SEQ ID NO: 11772 - DNA, 15 bp, Artificial Sequence
  dgRNA
  Sgk1
gtcaggaatgtgtag

SEQ ID NO: 11773 - DNA, 15 bp, Artificial Sequence
  dgRNA
  Pla2g12a
caatgactatgtcta

SEQ ID NO: 11774 - DNA, 15 bp, Artificial Sequence
  dgRNA
  Pla2g12a
ctatgtctagggcat

SEQ ID NO: 11775 - DNA, 15 bp, Artificial Sequence
  dgRNA
  Pla2g12a
tctagggcattggca

SEQ ID NO: 11776 - DNA, 15 bp, Artificial Sequence
  dgRNA
  Pla2g12a
agactccatagaggc

SEQ ID NO: 11777 - DNA, 15 bp, Artificial Sequence
  dgRNA
  Cct4
atggatgtccgtaaa

SEQ ID NO: 11778 - DNA, 15 bp, Artificial Sequence
  dgRNA
  Cct4
atgtccgtaaaaggc

SEQ ID NO: 11779 - DNA, 15 bp, Artificial Sequence
  dgRNA
  Cct4
cgggtccatctagaa

SEQ ID NO: 11780 - DNA, 15 bp, Artificial Sequence
  dgRNA
  Cct4
gcaaccggcctttta

SEQ ID NO: 11781 - DNA, 15 bp, Artificial Sequence
  dgRNA
  Zfp710
catctgctcctcgct

SEQ ID NO: 11782 - DNA, 15 bp, Artificial Sequence
  dgRNA
  Zfp710
tcctcgctgggagaa

SEQ ID NO: 11783 - DNA, 15 bp, Artificial Sequence
  dgRNA
  Zfp710
cgggctgcatctcct

SEQ ID NO: 11784 - DNA, 15 bp, Artificial Sequence
  dgRNA
  Sptbn1
aaagtagcatgaccg

SEQ ID NO: 11785 - DNA, 15 bp, Artificial Sequence
  dgRNA
  Sptbn1
ggccttggctctaga

SEQ ID NO: 11786 - DNA, 15 bp, Artificial Sequence
  dgRNA
  Sptbn1
tattatcaccccagc

SEQ ID NO: 11787 - DNA, 15 bp, Artificial Sequence
  dgRNA
  Sptbn1
cccaaacccggagga

SEQ ID NO: 11788 - DNA, 15 bp, Artificial Sequence
  dgRNA
  Tbc1d31
ctagagagaagccgt

SEQ ID NO: 11789 - DNA, 15 bp, Artificial Sequence
  dgRNA
  Tbc1d31
attgtccagagtgga

SEQ ID NO: 11790 - DNA, 15 bp, Artificial Sequence
  dgRNA
  Tbc1d31
ggaccacaagagcgg

SEQ ID NO: 11791 - DNA, 15 bp, Artificial Sequence
  dgRNA
  Tbc1d31
ccacaagagcggagg

SEQ ID NO: 11792 - DNA, 15 bp, Artificial Sequence
  dgRNA
  Crem
actgcaggataaata

SEQ ID NO: 11793 - DNA, 15 bp, Artificial Sequence
  dgRNA
  Fryl
tctccaaagcaacgt

SEQ ID NO: 11794 - DNA, 15 bp, Artificial Sequence
  dgRNA
  Fryl
ccaaagcaacgttgg

SEQ ID NO: 11795 - DNA, 15 bp, Artificial Sequence
  dgRNA
  Fryl
gcaacgttggaggcg

SEQ ID NO: 11796 - DNA, 15 bp, Artificial Sequence
  dgRNA
  Fryl
accgagagtgattag

SEQ ID NO: 11797 - DNA, 15 bp, Artificial Sequence
  dgRNA
  Olfr955
gagattatgcagtcc

SEQ ID NO: 11798 - DNA, 15 bp, Artificial Sequence
  dgRNA
  Cabyr
gtcagttcaccttga

SEQ ID NO: 11799 - DNA, 15 bp, Artificial Sequence
  dgRNA
  Cabyr
agttcaccttgaagg

SEQ ID NO: 11800 - DNA, 15 bp, Artificial Sequence
  dgRNA
  Cabyr
aaaagctcggatctc

SEQ ID NO: 11801 - DNA, 15 bp, Artificial Sequence
  dgRNA
  Cabyr
tctccggctccctat

SEQ ID NO: 11802 - DNA, 15 bp, Artificial Sequence
  dgRNA
  Epha7
ctagcaggcgggctg

SEQ ID NO: 11803 - DNA, 15 bp, Artificial Sequence
  dgRNA
  Epha7
cggctgccactcagt

SEQ ID NO: 11804 - DNA, 15 bp, Artificial Sequence
  dgRNA
  Epha7
gccactcagtcggag

SEQ ID NO: 11805 - DNA, 15 bp, Artificial Sequence
  dgRNA
  Epha7
actcagtcggagtgg

SEQ ID NO: 11806 - DNA, 15 bp, Artificial Sequence
  dgRNA
  Lemd2
caacatggcggcgcc

SEQ ID NO: 11807 - DNA, 15 bp, Artificial Sequence
  dgRNA
  Lemd2
agacgcctttcatca

SEQ ID NO: 11808 - DNA, 15 bp, Artificial Sequence
  dgRNA
  Lemd2
cgcctttcatcatgg

SEQ ID NO: 11809 - DNA, 15 bp, Artificial Sequence
  dgRNA
  Lemd2
ccgcccttcccaata

SEQ ID NO: 11810 - DNA, 15 bp, Artificial Sequence
  dgRNA
  Cldn17
ttcttggcgtatctt

SEQ ID NO: 11811 - DNA, 15 bp, Artificial Sequence
  dgRNA
  Cldn17
acgtgagtctacaac

SEQ ID NO: 11812 - DNA, 15 bp, Artificial Sequence
  dgRNA
  Ivns1abp
gccgccccgctctcc

SEQ ID NO: 11813 - DNA, 15 bp, Artificial Sequence
  dgRNA
  Ivns1abp
ctagttgagccgaga

SEQ ID NO: 11814 - DNA, 15 bp, Artificial Sequence
  dgRNA
  Ivns1abp
ttgagccgagaagga

SEQ ID NO: 11815 - DNA, 15 bp, Artificial Sequence
  dgRNA
  Ivns1abp
gctatgaggtgggcg

SEQ ID NO: 11816 - DNA, 15 bp, Artificial Sequence
  dgRNA
  Prrg3
caaggcctgtgcgct

SEQ ID NO: 11817 - DNA, 15 bp, Artificial Sequence
  dgRNA
  Prrg3
gtgcgcttggctgcg

SEQ ID NO: 11818 - DNA, 15 bp, Artificial Sequence
  dgRNA
  Prrg3
tgcgcttggctgcga

SEQ ID NO: 11819 - DNA, 15 bp, Artificial Sequence
  dgRNA
  Prrg3
gcgcttggctgcgag

SEQ ID NO: 11820 - DNA, 15 bp, Artificial Sequence
  dgRNA
  Wasf1
gtgtttgaagcctcg

SEQ ID NO: 11821 - DNA, 15 bp, Artificial Sequence
  dgRNA
  Wasf1
gaggaccttcactcc

SEQ ID NO: 11822 - DNA, 15 bp, Artificial Sequence
  dgRNA
  Wasf1
tcccggcgtacagtg

SEQ ID NO: 11823 - DNA, 15 bp, Artificial Sequence
  dgRNA
  Wasf1
gcgtacagtgcggcg

SEQ ID NO: 11824 - DNA, 15 bp, Artificial Sequence
  dgRNA
  Celf2
agtgggctacaaaaa

SEQ ID NO: 11825 - DNA, 15 bp, Artificial Sequence
  dgRNA
  Celf2
gttggagcagattac

SEQ ID NO: 11826 - DNA, 15 bp, Artificial Sequence
  dgRNA
  Celf2
gagctggaaccggtc

SEQ ID NO: 11827 - DNA, 15 bp, Artificial Sequence
  dgRNA
  Celf2
agctggaaccggtct

SEQ ID NO: 11828 - DNA, 15 bp, Artificial Sequence
  dgRNA
  Fam179a
ccccatgctttgttg

SEQ ID NO: 11829 - DNA, 15 bp, Artificial Sequence
  dgRNA
  Fam179a
ttgttgtggccctag

SEQ ID NO: 11830 - DNA, 15 bp, Artificial Sequence
  dgRNA
  Fam179a
gtggccctagaggac

SEQ ID NO: 11831 - DNA, 15 bp, Artificial Sequence
  dgRNA
  Fam179a
gcgtgcccagcaccg

SEQ ID NO: 11832 - DNA, 15 bp, Artificial Sequence
  dgRNA
  Slc6a14
ggggagatcagcact

SEQ ID NO: 11833 - DNA, 15 bp, Artificial Sequence
  dgRNA
  Slc6a14
gaggcaagattgcta

SEQ ID NO: 11834 - DNA, 15 bp, Artificial Sequence
  dgRNA
  Slc6a14
agattgctaaggcac

SEQ ID NO: 11835 - DNA, 15 bp, Artificial Sequence
  dgRNA
  Slc6a14
agtgctgatctcccc

SEQ ID NO: 11836 - DNA, 15 bp, Artificial Sequence
  dgRNA
  Impdh1
ccgcaacccctggcc

SEQ ID NO: 11837 - DNA, 15 bp, Artificial Sequence
  dgRNA
  Impdh1
tggtcgccagagtcg

SEQ ID NO: 11838 - DNA, 15 bp, Artificial Sequence
  dgRNA
  Impdh1
gtcgaggtgccattg

SEQ ID NO: 11839 - DNA, 15 bp, Artificial Sequence
  dgRNA
  Impdh1
tcgaggtgccattgc

SEQ ID NO: 11840 - DNA, 15 bp, Artificial Sequence
  dgRNA
  Heatr9
ccattatgctgcaga

SEQ ID NO: 11841 - DNA, 15 bp, Artificial Sequence
  dgRNA
  Heatr9
agtgggactcaacaa

SEQ ID NO: 11842 - DNA, 15 bp, Artificial Sequence
  dgRNA
  Heatr9
acccatgtgaagtac

SEQ ID NO: 11843 - DNA, 15 bp, Artificial Sequence
  dgRNA
  Heatr9
caactctagtagctt

SEQ ID NO: 11844 - DNA, 15 bp, Artificial Sequence
  dgRNA
  Klk1b22
ggcctactggacatc

SEQ ID NO: 11845 - DNA, 15 bp, Artificial Sequence
  dgRNA
  Klk1b22
gacatcaggtgcaac

SEQ ID NO: 11846 - DNA, 15 bp, Artificial Sequence
  dgRNA
  Klk1b22
gccccttaccacagc

SEQ ID NO: 11847 - DNA, 15 bp, Artificial Sequence
  dgRNA
  Klk1b22
ccccttaccacagca

SEQ ID NO: 11848 - DNA, 15 bp, Artificial Sequence
  dgRNA
  Olfr486
ggttacttcaaattt

SEQ ID NO: 11849 - DNA, 15 bp, Artificial Sequence
  dgRNA
  Ociad2
gtgccttcccctcat

SEQ ID NO: 11850 - DNA, 15 bp, Artificial Sequence
  dgRNA
  Ociad2
tcataggctagccat

SEQ ID NO: 11851 - DNA, 15 bp, Artificial Sequence
  dgRNA
  Ociad2
cataggctagccatt

SEQ ID NO: 11852 - DNA, 15 bp, Artificial Sequence
  dgRNA
  Ociad2
tagcctatgagggga

SEQ ID NO: 11853 - DNA, 15 bp, Artificial Sequence
  dgRNA
  Pcdhb19
gcaggataatgttac

SEQ ID NO: 11854 - DNA, 15 bp, Artificial Sequence
  dgRNA
  Zfp868
tatgttgacacctgc

SEQ ID NO: 11855 - DNA, 15 bp, Artificial Sequence
  dgRNA
  Zfp868
cgcaacactaaacaa

SEQ ID NO: 11856 - DNA, 15 bp, Artificial Sequence
  dgRNA
  Zfp868
gcaacactaaacaat

SEQ ID NO: 11857 - DNA, 15 bp, Artificial Sequence
  dgRNA
  Zfp868
cagttctaaccaatc

SEQ ID NO: 11858 - DNA, 15 bp, Artificial Sequence
  dgRNA
  Agpat1
ggaagaggctcgagc

SEQ ID NO: 11859 - DNA, 15 bp, Artificial Sequence
  dgRNA
  Agpat1
cttttaatgcctgcc

SEQ ID NO: 11860 - DNA, 15 bp, Artificial Sequence
  dgRNA
  Agpat1
tgagaggtcatatca

SEQ ID NO: 11861 - DNA, 15 bp, Artificial Sequence
  dgRNA
  Naa25
cacaacaaccgcccc

SEQ ID NO: 11862 - DNA, 15 bp, Artificial Sequence
  dgRNA
  Naa25
acaacaaccgcccct

SEQ ID NO: 11863 - DNA, 15 bp, Artificial Sequence
  dgRNA
  Naa25
caacaaccgcccctg

SEQ ID NO: 11864 - DNA, 15 bp, Artificial Sequence
  dgRNA
  Naa25
tcccgatgactccgc

SEQ ID NO: 11865 - DNA, 15 bp, Artificial Sequence
  dgRNA
  Tmem164
agtgaagtggatcgg

SEQ ID NO: 11866 - DNA, 15 bp, Artificial Sequence
  dgRNA
  Tmem164
ggtgaagtggacggg

SEQ ID NO: 11867 - DNA, 15 bp, Artificial Sequence
  dgRNA
  Tmem164
cgggaggagggccga

SEQ ID NO: 11868 - DNA, 15 bp, Artificial Sequence
  dgRNA
  Tmem164
gagggccgaaggtgg

SEQ ID NO: 11869 - DNA, 15 bp, Artificial Sequence
  dgRNA
  Prr3
cccgtcccgccgctg

SEQ ID NO: 11870 - DNA, 15 bp, Artificial Sequence
  dgRNA
  Prr3
ccgtcccgccgctgc

SEQ ID NO: 11871 - DNA, 15 bp, Artificial Sequence
  dgRNA
  Prr3
gggaaacccccaccg

SEQ ID NO: 11872 - DNA, 15 bp, Artificial Sequence
  dgRNA
  Prr3
ccgtggcagcccacg

SEQ ID NO: 11873 - DNA, 15 bp, Artificial Sequence
  dgRNA
  Gk
tcacaaccctcagac

SEQ ID NO: 11874 - DNA, 15 bp, Artificial Sequence
  dgRNA
  Gk
tctgtagtcgctcat

SEQ ID NO: 11875 - DNA, 15 bp, Artificial Sequence
  dgRNA
  Gk
gctcattggcccgcc

SEQ ID NO: 11876 - DNA, 15 bp, Artificial Sequence
  dgRNA
  Gk
ttgccacgcctccca

SEQ ID NO: 11877 - DNA, 15 bp, Artificial Sequence
  dgRNA
  Dzip1l
tcctgccgctcatca

SEQ ID NO: 11878 - DNA, 15 bp, Artificial Sequence
  dgRNA
  Dzip1l
ccgctcatcaaggcc

SEQ ID NO: 11879 - DNA, 15 bp, Artificial Sequence
  dgRNA
  Dzip1l
cgctcatcaaggcct

SEQ ID NO: 11880 - DNA, 15 bp, Artificial Sequence
  dgRNA
  Dzip1l
tgttcccgggctctg

SEQ ID NO: 11881 - DNA, 15 bp, Artificial Sequence
  dgRNA
  Polr2g
ggctttggttcttcg

SEQ ID NO: 11882 - DNA, 15 bp, Artificial Sequence
  dgRNA
  Polr2g
tttgctttaagtagg

SEQ ID NO: 11883 - DNA, 15 bp, Artificial Sequence
  dgRNA
  Polr2g
ggggagtatgaacgg

SEQ ID NO: 11884 - DNA, 15 bp, Artificial Sequence
  dgRNA
  Polr2g
gagtatgaacggtgg

SEQ ID NO: 11885 - DNA, 15 bp, Artificial Sequence
  dgRNA
  1700013D24Rik
tcccttgtcatagac

SEQ ID NO: 11886 - DNA, 15 bp, Artificial Sequence
  dgRNA
  Senp2
atgctcagactccgg

SEQ ID NO: 11887 - DNA, 15 bp, Artificial Sequence
  dgRNA
  Senp2
aggccgctttcccgt

SEQ ID NO: 11888 - DNA, 15 bp, Artificial Sequence
  dgRNA
  Senp2
ggccgctttcccgtt

SEQ ID NO: 11889 - DNA, 15 bp, Artificial Sequence
  dgRNA
  Senp2
cgctttcccgttggg

SEQ ID NO: 11890 - DNA, 15 bp, Artificial Sequence
  dgRNA
  E2f7
caggtacccggaagg

SEQ ID NO: 11891 - DNA, 15 bp, Artificial Sequence
  dgRNA
  E2f7
tacccggaaggggga

SEQ ID NO: 11892 - DNA, 15 bp, Artificial Sequence
  dgRNA
  E2f7
gaggcgacaacaatc

SEQ ID NO: 11893 - DNA, 15 bp, Artificial Sequence
  dgRNA
  E2f7
gcgacaacaatccgg

SEQ ID NO: 11894 - DNA, 15 bp, Artificial Sequence
  dgRNA
  Phlda2
gggctcccgtcagag

SEQ ID NO: 11895 - DNA, 15 bp, Artificial Sequence
  dgRNA
  Phlda2
ccgtcctccgataag

SEQ ID NO: 11896 - DNA, 15 bp, Artificial Sequence
  dgRNA
  Phlda2
ggtagcttcaagcaa

SEQ ID NO: 11897 - DNA, 15 bp, Artificial Sequence
  dgRNA
  Phlda2
cctggggcggttggt

SEQ ID NO: 11898 - DNA, 15 bp, Artificial Sequence
  dgRNA
  Caprin1
ataacggtctccgtg

SEQ ID NO: 11899 - DNA, 15 bp, Artificial Sequence
  dgRNA
  Caprin1
taacggtctccgtga

SEQ ID NO: 11900 - DNA, 15 bp, Artificial Sequence
  dgRNA
  Caprin1
aggaacctggcgccg

SEQ ID NO: 11901 - DNA, 15 bp, Artificial Sequence
  dgRNA
  Caprin1
ctggcgccgaggaca

SEQ ID NO: 11902 - DNA, 15 bp, Artificial Sequence
  dgRNA
  Reg3d
cctaatcagcacctg

SEQ ID NO: 11903 - DNA, 15 bp, Artificial Sequence
  dgRNA
  Reg3d
agtcctgtattctta

SEQ ID NO: 11904 - DNA, 15 bp, Artificial Sequence
  dgRNA
  Reg3d
cctcaggtgctgatt

SEQ ID NO: 11905 - DNA, 15 bp, Artificial Sequence
  dgRNA
  Reg3d
atacaggactactca

SEQ ID NO: 11906 - DNA, 15 bp, Artificial Sequence
  dgRNA
  Nkain4
gtctaaagagcctgt

SEQ ID NO: 11907 - DNA, 15 bp, Artificial Sequence
  dgRNA
  Nkain4
tgctaggtttacccg

SEQ ID NO: 11908 - DNA, 15 bp, Artificial Sequence
  dgRNA
  Nkain4
gaggcaagatcccgt

SEQ ID NO: 11909 - DNA, 15 bp, Artificial Sequence
  dgRNA
  Nkain4
aggcaagatcccgtt

SEQ ID NO: 11910 - DNA, 15 bp, Artificial Sequence
  dgRNA
  Thy1
taaccgtcttttccc

SEQ ID NO: 11911 - DNA, 15 bp, Artificial Sequence
  dgRNA
  Thy1
aaccgtcttttccct

SEQ ID NO: 11912 - DNA, 15 bp, Artificial Sequence
  dgRNA
  Thy1
agtcagcccaatcac

SEQ ID NO: 11913 - DNA, 15 bp, Artificial Sequence
  dgRNA
  Thy1
cggttagggaccctg

SEQ ID NO: 11914 - DNA, 15 bp, Artificial Sequence
  dgRNA
  Ccdc116
cacgtctccgcacct

SEQ ID NO: 11915 - DNA, 15 bp, Artificial Sequence
  dgRNA
  Ccdc116
acgtctccgcacctg

SEQ ID NO: 11916 - DNA, 15 bp, Artificial Sequence
  dgRNA
  Ccdc116
cgagaaagaagcctt

SEQ ID NO: 11917 - DNA, 15 bp, Artificial Sequence
  dgRNA
  Ccdc116
aagccttcggggctg

SEQ ID NO: 11918 - DNA, 15 bp, Artificial Sequence
  dgRNA
  2410137M14Rik
ccccgcaccacccct

SEQ ID NO: 11919 - DNA, 15 bp, Artificial Sequence
  dgRNA
  2410137M14Rik
caccttgtacgatcc

SEQ ID NO: 11920 - DNA, 15 bp, Artificial Sequence
  dgRNA
  2410137M14Rik
gtacgatcctggcta

SEQ ID NO: 11921 - DNA, 15 bp, Artificial Sequence
  dgRNA
  2410137M14Rik
ggctaaggcaaacct

SEQ ID NO: 11922 - DNA, 15 bp, Artificial Sequence
  dgRNA
  Vwa5a
gagtagactatgcag

SEQ ID NO: 11923 - DNA, 15 bp, Artificial Sequence
  dgRNA
  Vwa5a
gtgtaactttatagc

SEQ ID NO: 11924 - DNA, 15 bp, Artificial Sequence
  dgRNA
  Vwa5a
tagctggtccctaga

SEQ ID NO: 11925 - DNA, 15 bp, Artificial Sequence
  dgRNA
  Vwa5a
gctggtccctagaag

SEQ ID NO: 11926 - DNA, 15 bp, Artificial Sequence
  dgRNA
  Sema3f
cgtcctcctgtcatc

SEQ ID NO: 11927 - DNA, 15 bp, Artificial Sequence
  dgRNA
  Sema3f
gtctgtgaggaccgc

SEQ ID NO: 11928 - DNA, 15 bp, Artificial Sequence
  dgRNA
  Sema3f
tgaaatgagacttac

SEQ ID NO: 11929 - DNA, 15 bp, Artificial Sequence
  dgRNA
  Sema3f
tttgaggtgatcact

SEQ ID NO: 11930 - DNA, 15 bp, Artificial Sequence
  dgRNA
  Dock9
gggcgccccgcccat

SEQ ID NO: 11931 - DNA, 15 bp, Artificial Sequence
  dgRNA
  Dock9
cccgccccacctcgc

SEQ ID NO: 11932 - DNA, 15 bp, Artificial Sequence
  dgRNA
  Dock9
cgccccgcccctagg

SEQ ID NO: 11933 - DNA, 15 bp, Artificial Sequence
  dgRNA
  Dock9
cccgcccctaggagg

SEQ ID NO: 11934 - DNA, 15 bp, Artificial Sequence
  dgRNA
  Tmeff1
gtccggccagccgga

SEQ ID NO: 11935 - DNA, 15 bp, Artificial Sequence
  dgRNA
  Tmeff1
gccagccggagggat

SEQ ID NO: 11936 - DNA, 15 bp, Artificial Sequence
  dgRNA
  Tmeff1
agggatcggcgaccc

SEQ ID NO: 11937 - DNA, 15 bp, Artificial Sequence
  dgRNA
  Tmeff1
ccgcctcaggaacaa

SEQ ID NO: 11938 - DNA, 15 bp, Artificial Sequence
  dgRNA
  1700029J07Rik
gaaactattcgccga

SEQ ID NO: 11939 - DNA, 15 bp, Artificial Sequence
  dgRNA
  1700029J07Rik
actattcgccgatgg

SEQ ID NO: 11940 - DNA, 15 bp, Artificial Sequence
  dgRNA
  1700029J07Rik
ctattcgccgatggc

SEQ ID NO: 11941 - DNA, 15 bp, Artificial Sequence
  dgRNA
  1700029J07Rik
tattcgccgatggcg

SEQ ID NO: 11942 - DNA, 15 bp, Artificial Sequence
  dgRNA
  Psph
agcgactcgagtttg

SEQ ID NO: 11943 - DNA, 15 bp, Artificial Sequence
  dgRNA
  Psph
ggccatcgagccgcc

SEQ ID NO: 11944 - DNA, 15 bp, Artificial Sequence
  dgRNA
  Psph
gggcttacatcttca

SEQ ID NO: 11945 - DNA, 15 bp, Artificial Sequence
  dgRNA
  Psph
ccttaggccccaagt

SEQ ID NO: 11946 - DNA, 15 bp, Artificial Sequence
  dgRNA
  Ufd1l
tcctatcaagttgtt

SEQ ID NO: 11947 - DNA, 15 bp, Artificial Sequence
  dgRNA
  Ufd1l
tccgccgctgacttc

SEQ ID NO: 11948 - DNA, 15 bp, Artificial Sequence
  dgRNA
  Ufd1l
gtaccccatcccctg

SEQ ID NO: 11949 - DNA, 15 bp, Artificial Sequence
  dgRNA
  Ufd1l
gagccgttctcctta

SEQ ID NO: 11950 - DNA, 15 bp, Artificial Sequence
  dgRNA
  Slc39a2
ggacgtaactaccgt

SEQ ID NO: 11951 - DNA, 15 bp, Artificial Sequence
  dgRNA
  Slc39a2
tgatctaacctcaaa

SEQ ID NO: 11952 - DNA, 15 bp, Artificial Sequence
  dgRNA
  Slc39a2
ctcttagttcatgtc

SEQ ID NO: 11953 - DNA, 15 bp, Artificial Sequence
  dgRNA
  Ttc16
ccttgacttaggcct

SEQ ID NO: 11954 - DNA, 15 bp, Artificial Sequence
  dgRNA
  Ttc16
tctagtgactctcgg

SEQ ID NO: 11955 - DNA, 15 bp, Artificial Sequence
  dgRNA
  Ttc16
agtgactctcggagg

SEQ ID NO: 11956 - DNA, 15 bp, Artificial Sequence
  dgRNA
  Ttc16
tgactctcggaggcg

SEQ ID NO: 11957 - DNA, 15 bp, Artificial Sequence
  dgRNA
  Gnb5
tgtaccagctgtcta

SEQ ID NO: 11958 - DNA, 15 bp, Artificial Sequence
  dgRNA
  Gnb5
tctgcccacgtgtgg

SEQ ID NO: 11959 - DNA, 15 bp, Artificial Sequence
  dgRNA
  Gnb5
cccacgtgtggaggc

SEQ ID NO: 11960 - DNA, 15 bp, Artificial Sequence
  dgRNA
  Gnb5
acatggttcactggc

SEQ ID NO: 11961 - DNA, 15 bp, Artificial Sequence
  dgRNA
  Chchd3
cagcacctatcgctc

SEQ ID NO: 11962 - DNA, 15 bp, Artificial Sequence
  dgRNA
  Chchd3
gttgccatagcatcc

SEQ ID NO: 11963 - DNA, 15 bp, Artificial Sequence
  dgRNA
  Chchd3
ccttctgataagagg

SEQ ID NO: 11964 - DNA, 15 bp, Artificial Sequence
  dgRNA
  Chchd3
cgggctaacccgaag

SEQ ID NO: 11965 - DNA, 15 bp, Artificial Sequence
  dgRNA
  Prl7c1
cattgttgcgactgc

SEQ ID NO: 11966 - DNA, 15 bp, Artificial Sequence
  dgRNA
  Prl7c1
ctgcagtcgcaacaa

SEQ ID NO: 11967 - DNA, 15 bp, Artificial Sequence
  dgRNA
  Gpr160
gaggtgagcgacgcg

SEQ ID NO: 11968 - DNA, 15 bp, Artificial Sequence
  dgRNA
  Olfr1054
attgtaaattctccc

SEQ ID NO: 11969 - DNA, 15 bp, Artificial Sequence
  dgRNA
  Olfr1054
ttctgcattaccacc

SEQ ID NO: 11970 - DNA, 15 bp, Artificial Sequence
  dgRNA
  Olfr1054
gagcaaattctgttc

SEQ ID NO: 11971 - DNA, 15 bp, Artificial Sequence
  dgRNA
  Ndufa8
gagacatggacgaat

SEQ ID NO: 11972 - DNA, 15 bp, Artificial Sequence
  dgRNA
  Ndufa8
agacatggacgaatg

SEQ ID NO: 11973 - DNA, 15 bp, Artificial Sequence
  dgRNA
  Ndufa8
gacatggacgaatgg

SEQ ID NO: 11974 - DNA, 15 bp, Artificial Sequence
  dgRNA
  Ndufa8
tattccccgaaatac

SEQ ID NO: 11975 - DNA, 15 bp, Artificial Sequence
  dgRNA
  Cd36
acaagggtctatttc

SEQ ID NO: 11976 - DNA, 15 bp, Artificial Sequence
  dgRNA
  Cd36
tagttaagctcacaa

SEQ ID NO: 11977 - DNA, 15 bp, Artificial Sequence
  dgRNA
  Cd36
ctagttaagctcaca

SEQ ID NO: 11978 - DNA, 15 bp, Artificial Sequence
  dgRNA
  Cd36
gtggttggttgccaa

SEQ ID NO: 11979 - DNA, 15 bp, Artificial Sequence
  dgRNA
  Poln
gcctagcgggaagga

SEQ ID NO: 11980 - DNA, 15 bp, Artificial Sequence
  dgRNA
  Poln
tagcgggaaggacgg

SEQ ID NO: 11981 - DNA, 15 bp, Artificial Sequence
  dgRNA
  Poln
agcgggaaggacggc

SEQ ID NO: 11982 - DNA, 15 bp, Artificial Sequence
  dgRNA
  Poln
aggacggcgggccag

SEQ ID NO: 11983 - DNA, 15 bp, Artificial Sequence
  dgRNA
  Rgs17
tgtgagctctgtcgc

SEQ ID NO: 11984 - DNA, 15 bp, Artificial Sequence
  dgRNA
  Rgs17
gtgagctctgtcgcc

SEQ ID NO: 11985 - DNA, 15 bp, Artificial Sequence
  dgRNA
  Rgs17
agctctgtcgccggg

SEQ ID NO: 11986 - DNA, 15 bp, Artificial Sequence
  dgRNA
  Rgs17
gctctgtcgccgggc

SEQ ID NO: 11987 - DNA, 15 bp, Artificial Sequence
  dgRNA
  Olfr1329
agctgtctgatcgcc

SEQ ID NO: 11988 - DNA, 15 bp, Artificial Sequence
  dgRNA
  Nlrp1b
ctgctgagacttaac

SEQ ID NO: 11989 - DNA, 15 bp, Artificial Sequence
  dgRNA
  Nlrp1b
ccaacttactgaaag

SEQ ID NO: 11990 - DNA, 15 bp, Artificial Sequence
  dgRNA
  Nlrp1b
caacttactgaaagt

SEQ ID NO: 11991 - DNA, 15 bp, Artificial Sequence
  dgRNA
  Nlrp1b
agatgtctaggctgg

SEQ ID NO: 11992 - DNA, 15 bp, Artificial Sequence
  dgRNA
  Lypd2
ctcgaacagtctgag

SEQ ID NO: 11993 - DNA, 15 bp, Artificial Sequence
  dgRNA
  Lypd2
tcgaacagtctgaga

SEQ ID NO: 11994 - DNA, 15 bp, Artificial Sequence
  dgRNA
  Lypd2
gctgggtagggtccg

SEQ ID NO: 11995 - DNA, 15 bp, Artificial Sequence
  dgRNA
  Lypd2
ctgggtagggtccga

SEQ ID NO: 11996 - DNA, 15 bp, Artificial Sequence
  dgRNA
  Tmem214
tagaccacacgtgcg

SEQ ID NO: 11997 - DNA, 15 bp, Artificial Sequence
  dgRNA
  Tmem214
cacacgtgcgtggca

SEQ ID NO: 11998 - DNA, 15 bp, Artificial Sequence
  dgRNA
  Tmem214
tgtggtctacttcag

SEQ ID NO: 11999 - DNA, 15 bp, Artificial Sequence
  dgRNA
  Tmem214
cttgccacgcacgtg

SEQ ID NO: 12000 - DNA, 15 bp, Artificial Sequence
  dgRNA
  Rec114
accacacttccgtag

SEQ ID NO: 12001 - DNA, 15 bp, Artificial Sequence
  dgRNA
  Rec114
gccgtgcttcctgat

SEQ ID NO: 12002 - DNA, 15 bp, Artificial Sequence
  dgRNA
  Rec114
tcgtcagctatcacg

SEQ ID NO: 12003 - DNA, 15 bp, Artificial Sequence
  dgRNA
  Rec114
tcagctatcacgtgg

SEQ ID NO: 12004 - DNA, 15 bp, Artificial Sequence
  dgRNA
  2610042L04Rik
gctctaggagccgat

SEQ ID NO: 12005 - DNA, 15 bp, Artificial Sequence
  dgRNA
  2610042L04Rik
gggtggcgaacgcgt

SEQ ID NO: 12006 - DNA, 15 bp, Artificial Sequence
  dgRNA
  2610042L04Rik
cgctccgtccgtcag

SEQ ID NO: 12007 - DNA, 15 bp, Artificial Sequence
  dgRNA
  2610042L04Rik
gctccgtccgtcagc

SEQ ID NO: 12008 - DNA, 15 bp, Artificial Sequence
  dgRNA
  Map3k1
gccgctccgcgctcc

SEQ ID NO: 12009 - DNA, 15 bp, Artificial Sequence
  dgRNA
  Map3k1
ccgctccgcgctccc

SEQ ID NO: 12010 - DNA, 15 bp, Artificial Sequence
  dgRNA
  Map3k1
cgcgctcccgggccc

SEQ ID NO: 12011 - DNA, 15 bp, Artificial Sequence
  dgRNA
  Map3k1
ctcccgggccccggc

SEQ ID NO: 12012 - DNA, 15 bp, Artificial Sequence
  dgRNA
  Usp26
cggctgagtcagaaa

SEQ ID NO: 12013 - DNA, 15 bp, Artificial Sequence
  dgRNA
  Usp26
gttgcatcttgagcg

SEQ ID NO: 12014 - DNA, 15 bp, Artificial Sequence
  dgRNA
  Usp26
ttgcatcttgagcgc

SEQ ID NO: 12015 - DNA, 15 bp, Artificial Sequence
  dgRNA
  Usp26
gatgcaaccattata

SEQ ID NO: 12016 - DNA, 15 bp, Artificial Sequence
  dgRNA
  Exoc3l4
tgggcttgagcacta

SEQ ID NO: 12017 - DNA, 15 bp, Artificial Sequence
  dgRNA
  Exoc3l4
gggcttgagcactag

SEQ ID NO: 12018 - DNA, 15 bp, Artificial Sequence
  dgRNA
  Exoc3l4
ggcttgagcactagg

SEQ ID NO: 12019 - DNA, 15 bp, Artificial Sequence
  dgRNA
  Exoc3l4
ggatctgacaatcct

SEQ ID NO: 12020 - DNA, 15 bp, Artificial Sequence
  dgRNA
  Slitrk1
cgcttgccctaaacg

SEQ ID NO: 12021 - DNA, 15 bp, Artificial Sequence
  dgRNA
  Slitrk1
cattccctcaccaga

SEQ ID NO: 12022 - DNA, 15 bp, Artificial Sequence
  dgRNA
  Slitrk1
aaacgtgggtattaa

SEQ ID NO: 12023 - DNA, 15 bp, Artificial Sequence
  dgRNA
  Slitrk1
aagcgttgaaaacgt

SEQ ID NO: 12024 - DNA, 15 bp, Artificial Sequence
  dgRNA
  Ank2
acactggaacgtcca

SEQ ID NO: 12025 - DNA, 15 bp, Artificial Sequence
  dgRNA
  Ank2
gggctgatgatttga

SEQ ID NO: 12026 - DNA, 15 bp, Artificial Sequence
  dgRNA
  Ank2
caactgtgctatgac

SEQ ID NO: 12027 - DNA, 15 bp, Artificial Sequence
  dgRNA
  Gm7534
tgacgagcaagccac

SEQ ID NO: 12028 - DNA, 15 bp, Artificial Sequence
  dgRNA
  Gm7534
gacttaagcgacagc

SEQ ID NO: 12029 - DNA, 15 bp, Artificial Sequence
  dgRNA
  Gm7534
ttgctcgtcattgtg

SEQ ID NO: 12030 - DNA, 15 bp, Artificial Sequence
  dgRNA
  Gm7534
cttgctcgtcattgt

SEQ ID NO: 12031 - DNA, 15 bp, Artificial Sequence
  dgRNA
  Cyp2d34
ggtagtagaggacaa

SEQ ID NO: 12032 - DNA, 15 bp, Artificial Sequence
  dgRNA
  Cyp2d34
gcatgttgattctgc

SEQ ID NO: 12033 - DNA, 15 bp, Artificial Sequence
  dgRNA
  Cyp2d34
gcttggccaagtgta

SEQ ID NO: 12034 - DNA, 15 bp, Artificial Sequence
  dgRNA
  Tom1l2
gggggttgtgccgct

SEQ ID NO: 12035 - DNA, 15 bp, Artificial Sequence
  dgRNA
  Tom1l2
gtgccgctaggctga

SEQ ID NO: 12036 - DNA, 15 bp, Artificial Sequence
  dgRNA
  Tom1l2
tgcttcgtgcccaat

SEQ ID NO: 12037 - DNA, 15 bp, Artificial Sequence
  dgRNA
  Tom1l2
cccaatcggacgccg

SEQ ID NO: 12038 - DNA, 15 bp, Artificial Sequence
  dgRNA
  Tg
cttgtccccatagac

SEQ ID NO: 12039 - DNA, 15 bp, Artificial Sequence
  dgRNA
  Tg
ccccatagactggag

SEQ ID NO: 12040 - DNA, 15 bp, Artificial Sequence
  dgRNA
  Tg
caagtgtccttgaac

SEQ ID NO: 12041 - DNA, 15 bp, Artificial Sequence
  dgRNA
  Tg
gccactgtgctataa

SEQ ID NO: 12042 - DNA, 15 bp, Artificial Sequence
  dgRNA
  Cep57l1
cgcaaagacagccat

SEQ ID NO: 12043 - DNA, 15 bp, Artificial Sequence
  dgRNA
  Cep57l1
cgggcagagtacctc

SEQ ID NO: 12044 - DNA, 15 bp, Artificial Sequence
  dgRNA
  Cep57l1
tgcgcgacgccggcc

SEQ ID NO: 12045 - DNA, 15 bp, Artificial Sequence
  dgRNA
  Cep57l1
gcgcgacgccggcca

SEQ ID NO: 12046 - DNA, 15 bp, Artificial Sequence
  dgRNA
  Thap3
acgcttttttagtcc

SEQ ID NO: 12047 - DNA, 15 bp, Artificial Sequence
  dgRNA
  Thap3
ccaaagttgtttact

SEQ ID NO: 12048 - DNA, 15 bp, Artificial Sequence
  dgRNA
  Thap3
ttgggcacaagttgt

SEQ ID NO: 12049 - DNA, 15 bp, Artificial Sequence
  dgRNA
  Thap3
ggcacaagttgtagg

SEQ ID NO: 12050 - DNA, 15 bp, Artificial Sequence
  dgRNA
  Pcdha1
ggtgtgacagcgata

SEQ ID NO: 12051 - DNA, 15 bp, Artificial Sequence
  dgRNA
  Pcdha1
tacagcgacaccatg

SEQ ID NO: 12052 - DNA, 15 bp, Artificial Sequence
  dgRNA
  Pcdha1
ttatcttttctcggc

SEQ ID NO: 12053 - DNA, 15 bp, Artificial Sequence
  dgRNA
  Spint2
accacgcctcctccc

SEQ ID NO: 12054 - DNA, 15 bp, Artificial Sequence
  dgRNA
  Spint2
ggcggtgccaggtgc

SEQ ID NO: 12055 - DNA, 15 bp, Artificial Sequence
  dgRNA
  Spint2
accttgcgggaggcg

SEQ ID NO: 12056 - DNA, 15 bp, Artificial Sequence
  dgRNA
  Spint2
gccggaccttgcggg

SEQ ID NO: 12057 - DNA, 15 bp, Artificial Sequence
  dgRNA
  Tmem211
atgggaattagccca

SEQ ID NO: 12058 - DNA, 15 bp, Artificial Sequence
  dgRNA
  Tmem211
tagcccacggaaaga

SEQ ID NO: 12059 - DNA, 15 bp, Artificial Sequence
  dgRNA
  Tmem211
cgcatcctgcagcac

SEQ ID NO: 12060 - DNA, 15 bp, Artificial Sequence
  dgRNA
  Tmem211
agccagtgagactcg

SEQ ID NO: 12061 - DNA, 15 bp, Artificial Sequence
  dgRNA
  Tigd2
tgcgtcgccctctgc

SEQ ID NO: 12062 - DNA, 15 bp, Artificial Sequence
  dgRNA
  Tigd2
ccgtgagccacacgc

SEQ ID NO: 12063 - DNA, 15 bp, Artificial Sequence
  dgRNA
  Tigd2
cgtgagccacacgct

SEQ ID NO: 12064 - DNA, 15 bp, Artificial Sequence
  dgRNA
  Tigd2
cacacgctgggtgtc

SEQ ID NO: 12065 - DNA, 15 bp, Artificial Sequence
  dgRNA
  Rundc3a
tctccgttgtttctc

SEQ ID NO: 12066 - DNA, 15 bp, Artificial Sequence
  dgRNA
  Rundc3a
ctccgttgtttctcc

SEQ ID NO: 12067 - DNA, 15 bp, Artificial Sequence
  dgRNA
  Rundc3a
tccgttgtttctccg

SEQ ID NO: 12068 - DNA, 15 bp, Artificial Sequence
  dgRNA
  Rundc3a
ccgttgtttctccgg

SEQ ID NO: 12069 - DNA, 15 bp, Artificial Sequence
  dgRNA
  Mme
ctggcgaagcccttt

SEQ ID NO: 12070 - DNA, 15 bp, Artificial Sequence
  dgRNA
  Mme
tggcgaagccctttt

SEQ ID NO: 12071 - DNA, 15 bp, Artificial Sequence
  dgRNA
  Mme
gaagcccttttggga

SEQ ID NO: 12072 - DNA, 15 bp, Artificial Sequence
  dgRNA
  Mme
ctccgcccctttaca

SEQ ID NO: 12073 - DNA, 15 bp, Artificial Sequence
  dgRNA
  Bcl7a
cccccatcgcacctg

SEQ ID NO: 12074 - DNA, 15 bp, Artificial Sequence
  dgRNA
  Bcl7a
cgcacctgcggcctc

SEQ ID NO: 12075 - DNA, 15 bp, Artificial Sequence
  dgRNA
  Bcl7a
gcacctgcggcctct

SEQ ID NO: 12076 - DNA, 15 bp, Artificial Sequence
  dgRNA
  Bcl7a
gcccgtcccgcgtgc

SEQ ID NO: 12077 - DNA, 15 bp, Artificial Sequence
  dgRNA
  Olfr910
atgggagttcaatat

SEQ ID NO: 12078 - DNA, 15 bp, Artificial Sequence
  dgRNA
  Olfr910
ttcaatattggcata

SEQ ID NO: 12079 - DNA, 15 bp, Artificial Sequence
  dgRNA
  Olfr910
ggtcatacctttgtc

SEQ ID NO: 12080 - DNA, 15 bp, Artificial Sequence
  dgRNA
  Olfr910
gctctaggaagcggc

SEQ ID NO: 12081 - DNA, 15 bp, Artificial Sequence
  dgRNA
  Spag11a
tacctaaaaatagac

SEQ ID NO: 12082 - DNA, 15 bp, Artificial Sequence
  dgRNA
  Tspyl1
aatcaggtgcgctgc

SEQ ID NO: 12083 - DNA, 15 bp, Artificial Sequence
  dgRNA
  Tspyl1
ttctcgcgagacttg

SEQ ID NO: 12084 - DNA, 15 bp, Artificial Sequence
  dgRNA
  Tspyl1
gagacttgcgggctg

SEQ ID NO: 12085 - DNA, 15 bp, Artificial Sequence
  dgRNA
  Tspyl1
ccttcgcccgcatcc

SEQ ID NO: 12086 - DNA, 15 bp, Artificial Sequence
  dgRNA
  Rhox4c
ggtgcgaaacaaaac

SEQ ID NO: 12087 - DNA, 15 bp, Artificial Sequence
  dgRNA
  Serpinh1
tgggagagagcccgc

SEQ ID NO: 12088 - DNA, 15 bp, Artificial Sequence
  dgRNA
  Serpinh1
agagcccgcaggcac

SEQ ID NO: 12089 - DNA, 15 bp, Artificial Sequence
  dgRNA
  Serpinh1
gagcccgcaggcaca

SEQ ID NO: 12090 - DNA, 15 bp, Artificial Sequence
  dgRNA
  Serpinh1
ccgcaggcacagggg

SEQ ID NO: 12091 - DNA, 15 bp, Artificial Sequence
  dgRNA
  St5
catagggctactaaa

SEQ ID NO: 12092 - DNA, 15 bp, Artificial Sequence
  dgRNA
  St5
atagggctactaaaa

SEQ ID NO: 12093 - DNA, 15 bp, Artificial Sequence
  dgRNA
  St5
tcccaggtacggccc

SEQ ID NO: 12094 - DNA, 15 bp, Artificial Sequence
  dgRNA
  St5
tctcattggaggcct

SEQ ID NO: 12095 - DNA, 15 bp, Artificial Sequence
  dgRNA
  Dbi
gatccgacttctgat

SEQ ID NO: 12096 - DNA, 15 bp, Artificial Sequence
  dgRNA
  Dbi
tcgcccgagctcagt

SEQ ID NO: 12097 - DNA, 15 bp, Artificial Sequence
  dgRNA
  Dbi
gctcagttggaacgc

SEQ ID NO: 12098 - DNA, 15 bp, Artificial Sequence
  dgRNA
  Dbi
ctcagttggaacgcc

SEQ ID NO: 12099 - DNA, 15 bp, Artificial Sequence
  dgRNA
  Ttc30a2
gacttccgtttccgt

SEQ ID NO: 12100 - DNA, 15 bp, Artificial Sequence
  dgRNA
  Ttc30a2
gttggcttgttgcca

SEQ ID NO: 12101 - DNA, 15 bp, Artificial Sequence
  dgRNA
  Ttc30a2
ttggcttgttgccat

SEQ ID NO: 12102 - DNA, 15 bp, Artificial Sequence
  dgRNA
  Ttc30a2
ctagccattcttgga

SEQ ID NO: 12103 - DNA, 15 bp, Artificial Sequence
  dgRNA
  Clcn6
agacgagacgacggc

SEQ ID NO: 12104 - DNA, 15 bp, Artificial Sequence
  dgRNA
  Clcn6
agtcccgccccaaca

SEQ ID NO: 12105 - DNA, 15 bp, Artificial Sequence
  dgRNA
  Clcn6
catggccgcgcccag

SEQ ID NO: 12106 - DNA, 15 bp, Artificial Sequence
  dgRNA
  Clcn6
gcgcccagaggtctc

SEQ ID NO: 12107 - DNA, 15 bp, Artificial Sequence
  dgRNA
  Dbndd1
cgcagctcagtgcgc

SEQ ID NO: 12108 - DNA, 15 bp, Artificial Sequence
  dgRNA
  Dbndd1
gtcggaggtccgcaa

SEQ ID NO: 12109 - DNA, 15 bp, Artificial Sequence
  dgRNA
  Dbndd1
tcggaggtccgcaaa

SEQ ID NO: 12110 - DNA, 15 bp, Artificial Sequence
  dgRNA
  Dbndd1
ctacgtccctgcaga

SEQ ID NO: 12111 - DNA, 15 bp, Artificial Sequence
  dgRNA
  Asap1
tcctgccgaagtgtt

SEQ ID NO: 12112 - DNA, 15 bp, Artificial Sequence
  dgRNA
  Asap1
gcgggctcgagagag

SEQ ID NO: 12113 - DNA, 15 bp, Artificial Sequence
  dgRNA
  Asap1
gcggctccgcgtcgc

SEQ ID NO: 12114 - DNA, 15 bp, Artificial Sequence
  dgRNA
  Asap1
cccctcctcggcaca

SEQ ID NO: 12115 - DNA, 15 bp, Artificial Sequence
  dgRNA
  Sae1
ctctccgggattgat

SEQ ID NO: 12116 - DNA, 15 bp, Artificial Sequence
  dgRNA
  Sae1
gtctccatcacgtga

SEQ ID NO: 12117 - DNA, 15 bp, Artificial Sequence
  dgRNA
  Sae1
tctccatcacgtgat

SEQ ID NO: 12118 - DNA, 15 bp, Artificial Sequence
  dgRNA
  Sae1
ctccatcacgtgatg

SEQ ID NO: 12119 - DNA, 15 bp, Artificial Sequence
  dgRNA
  Eps8l1
acgtggagttgaaag

SEQ ID NO: 12120 - DNA, 15 bp, Artificial Sequence
  dgRNA
  Fmo6
tggtggtccccgact

SEQ ID NO: 12121 - DNA, 15 bp, Artificial Sequence
  dgRNA
  Fmo6
aagcccctccctacg

SEQ ID NO: 12122 - DNA, 15 bp, Artificial Sequence
  dgRNA
  Fmo6
ggggaccaccacttc

SEQ ID NO: 12123 - DNA, 15 bp, Artificial Sequence
  dgRNA
  Fmo6
gaaatgaccaagtcg

SEQ ID NO: 12124 - DNA, 15 bp, Artificial Sequence
  dgRNA
  Fbxl20
tggtgggctggcgcc

SEQ ID NO: 12125 - DNA, 15 bp, Artificial Sequence
  dgRNA
  Fbxl20
gtcaccccacgttcc

SEQ ID NO: 12126 - DNA, 15 bp, Artificial Sequence
  dgRNA
  Fbxl20
cgttccaggcgctcg

SEQ ID NO: 12127 - DNA, 15 bp, Artificial Sequence
  dgRNA
  Fbxl20
gttccaggcgctcgc

SEQ ID NO: 12128 - DNA, 15 bp, Artificial Sequence
  dgRNA
  Ralgps1
gcaagaccgaagcgc

SEQ ID NO: 12129 - DNA, 15 bp, Artificial Sequence
  dgRNA
  Ralgps1
ccgaagcgcaggccg

SEQ ID NO: 12130 - DNA, 15 bp, Artificial Sequence
  dgRNA
  Ralgps1
agcgcaggccgcggc

SEQ ID NO: 12131 - DNA, 15 bp, Artificial Sequence
  dgRNA
  Ralgps1
gcaggccgcggctgg

SEQ ID NO: 12132 - DNA, 15 bp, Artificial Sequence
  dgRNA
  Kcnmb3
ttacacgttgtgtat

SEQ ID NO: 12133 - DNA, 15 bp, Artificial Sequence
  dgRNA
  Kcnmb3
tacacgttgtgtatt

SEQ ID NO: 12134 - DNA, 15 bp, Artificial Sequence
  dgRNA
  Kcnmb3
caattacagagtccc

SEQ ID NO: 12135 - DNA, 15 bp, Artificial Sequence
  dgRNA
  Kcnmb3
ctatgacaatgcacc

SEQ ID NO: 12136 - DNA, 15 bp, Artificial Sequence
  dgRNA
  Tmem205
tgaggacaccatcgt

SEQ ID NO: 12137 - DNA, 15 bp, Artificial Sequence
  dgRNA
  Tmem205
catcgttggaaaacg

SEQ ID NO: 12138 - DNA, 15 bp, Artificial Sequence
  dgRNA
  Tmem205
atcgttggaaaacga

SEQ ID NO: 12139 - DNA, 15 bp, Artificial Sequence
  dgRNA
  Tmem205
tcgttggaaaacgag

SEQ ID NO: 12140 - DNA, 15 bp, Artificial Sequence
  dgRNA
  Tex28
acagtatatctcttc

SEQ ID NO: 12141 - DNA, 15 bp, Artificial Sequence
  dgRNA
  Tex28
cagcacaactagagg

SEQ ID NO: 12142 - DNA, 15 bp, Artificial Sequence
  dgRNA
  Tex28
ttcagcacaactaga

SEQ ID NO: 12143 - DNA, 15 bp, Artificial Sequence
  dgRNA
  Tex28
tttcagcacaactag

SEQ ID NO: 12144 - DNA, 15 bp, Artificial Sequence
  dgRNA
  C1qtnf9
tgcacttaggttcac

SEQ ID NO: 12145 - DNA, 15 bp, Artificial Sequence
  dgRNA
  C1qtnf9
gcacttaggttcact

SEQ ID NO: 12146 - DNA, 15 bp, Artificial Sequence
  dgRNA
  C1qtnf9
ggggagttctatggc

SEQ ID NO: 12147 - DNA, 15 bp, Artificial Sequence
  dgRNA
  C1qtnf9
atcacagcgacacta

SEQ ID NO: 12148 - DNA, 15 bp, Artificial Sequence
  dgRNA
  Itgb6
gaggagcgaatgcgc

SEQ ID NO: 12149 - DNA, 15 bp, Artificial Sequence
  dgRNA
  Itgb6
gcgcttgcgcgcgct

SEQ ID NO: 12150 - DNA, 15 bp, Artificial Sequence
  dgRNA
  Itgb6
cgcttgcgcgcgctt

SEQ ID NO: 12151 - DNA, 15 bp, Artificial Sequence
  dgRNA
  Itgb6
gcttgcgcgcgcttg

SEQ ID NO: 12152 - DNA, 15 bp, Artificial Sequence
  dgRNA
  Bhlhe40
gcggccagacgtgct

SEQ ID NO: 12153 - DNA, 15 bp, Artificial Sequence
  dgRNA
  Bhlhe40
cgtgcttggagtcac

SEQ ID NO: 12154 - DNA, 15 bp, Artificial Sequence
  dgRNA
  Bhlhe40
ggccgctgccgggga

SEQ ID NO: 12155 - DNA, 15 bp, Artificial Sequence
  dgRNA
  Bhlhe40
tggccgctgccgggg

SEQ ID NO: 12156 - DNA, 15 bp, Artificial Sequence
  dgRNA
  Syngap1
tgggtcagcttctac

SEQ ID NO: 12157 - DNA, 15 bp, Artificial Sequence
  dgRNA
  Syngap1
tctacgggacttccc

SEQ ID NO: 12158 - DNA, 15 bp, Artificial Sequence
  dgRNA
  Syngap1
ttttccgggtctccc

SEQ ID NO: 12159 - DNA, 15 bp, Artificial Sequence
  dgRNA
  Syngap1
tttccgggtctccct

SEQ ID NO: 12160 - DNA, 15 bp, Artificial Sequence
  dgRNA
  Arhgef25
ggcagagctaacgct

SEQ ID NO: 12161 - DNA, 15 bp, Artificial Sequence
  dgRNA
  Arhgef25
ccacacttggattga

SEQ ID NO: 12162 - DNA, 15 bp, Artificial Sequence
  dgRNA
  Arhgef25
gaatcaggattaaga

SEQ ID NO: 12163 - DNA, 15 bp, Artificial Sequence
  dgRNA
  Arhgef25
gttcagctacgtttg

SEQ ID NO: 12164 - DNA, 15 bp, Artificial Sequence
  dgRNA
  Cadm2
tcctgagtgcgtgaa

SEQ ID NO: 12165 - DNA, 15 bp, Artificial Sequence
  dgRNA
  Cadm2
cctgagtgcgtgaaa

SEQ ID NO: 12166 - DNA, 15 bp, Artificial Sequence
  dgRNA
  Cadm2
ctgagtgcgtgaaag

SEQ ID NO: 12167 - DNA, 15 bp, Artificial Sequence
  dgRNA
  Cadm2
gagcttcctgcccga

SEQ ID NO: 12168 - DNA, 15 bp, Artificial Sequence
  dgRNA
  Mapk6
ccgcgcccggttccg

SEQ ID NO: 12169 - DNA, 15 bp, Artificial Sequence
  dgRNA
  Mapk6
cgcgcccggttccgc

SEQ ID NO: 12170 - DNA, 15 bp, Artificial Sequence
  dgRNA
  Mapk6
tccccgccaacgcgc

SEQ ID NO: 12171 - DNA, 15 bp, Artificial Sequence
  dgRNA
  Mapk6
gccaacgcgcaggcg

SEQ ID NO: 12172 - DNA, 15 bp, Artificial Sequence
  dgRNA
  Prpf38b
cggcacacagaccac

SEQ ID NO: 12173 - DNA, 15 bp, Artificial Sequence
  dgRNA
  Prpf38b
cgacctcgcgcaacc

SEQ ID NO: 12174 - DNA, 15 bp, Artificial Sequence
  dgRNA
  Prpf38b
cgcgcaaccaggaag

SEQ ID NO: 12175 - DNA, 15 bp, Artificial Sequence
  dgRNA
  Prpf38b
aatagcctgcacaca

SEQ ID NO: 12176 - DNA, 15 bp, Artificial Sequence
  dgRNA
  Nbr1
gctagttccgcccct

SEQ ID NO: 12177 - DNA, 15 bp, Artificial Sequence
  dgRNA
  Nbr1
ttccgcccctcggcc

SEQ ID NO: 12178 - DNA, 15 bp, Artificial Sequence
  dgRNA
  Nbr1
tccgcccctcggcct

SEQ ID NO: 12179 - DNA, 15 bp, Artificial Sequence
  dgRNA
  Nbr1
gaccaatcggtagag

SEQ ID NO: 12180 - DNA, 15 bp, Artificial Sequence
  dgRNA
  Dmtf1
cccgccacagctcga

SEQ ID NO: 12181 - DNA, 15 bp, Artificial Sequence
  dgRNA
  Dmtf1
atcgctcgctgagaa

SEQ ID NO: 12182 - DNA, 15 bp, Artificial Sequence
  dgRNA
  Dmtf1
agacggaagtgacgt

SEQ ID NO: 12183 - DNA, 15 bp, Artificial Sequence
  dgRNA
  Dmtf1
gacggaagtgacgtc

SEQ ID NO: 12184 - DNA, 15 bp, Artificial Sequence
  dgRNA
  Selm
gcgtttcacacttag

SEQ ID NO: 12185 - DNA, 15 bp, Artificial Sequence
  dgRNA
  Selm
cgtttcacacttagt

SEQ ID NO: 12186 - DNA, 15 bp, Artificial Sequence
  dgRNA
  Selm
tgggcaaatgcaata

SEQ ID NO: 12187 - DNA, 15 bp, Artificial Sequence
  dgRNA
  Selm
gcaaccacccgattt

SEQ ID NO: 12188 - DNA, 15 bp, Artificial Sequence
  dgRNA
  Pcdhb18
catagcatgttattt

SEQ ID NO: 12189 - DNA, 15 bp, Artificial Sequence
  dgRNA
  Gins2
ggccgaacgaaggag

SEQ ID NO: 12190 - DNA, 15 bp, Artificial Sequence
  dgRNA
  Gins2
cgaacgaaggagggg

SEQ ID NO: 12191 - DNA, 15 bp, Artificial Sequence
  dgRNA
  Gins2
cgggagcaagaggcg

SEQ ID NO: 12192 - DNA, 15 bp, Artificial Sequence
  dgRNA
  Gins2
gacccgacccaaacg

SEQ ID NO: 12193 - DNA, 15 bp, Artificial Sequence
  dgRNA
  Trim43b
agctaaatagtgatt

SEQ ID NO: 12194 - DNA, 15 bp, Artificial Sequence
  dgRNA
  Trim43b
gctaaatagtgattt

SEQ ID NO: 12195 - DNA, 15 bp, Artificial Sequence
  dgRNA
  Ppcdc
agcctttcaatgtcg

SEQ ID NO: 12196 - DNA, 15 bp, Artificial Sequence
  dgRNA
  Ppcdc
gctttagccttgcac

SEQ ID NO: 12197 - DNA, 15 bp, Artificial Sequence
  dgRNA
  Ppcdc
accacgactcccaga

SEQ ID NO: 12198 - DNA, 15 bp, Artificial Sequence
  dgRNA
  Ppcdc
atcactcgctttctc

SEQ ID NO: 12199 - DNA, 15 bp, Artificial Sequence
  dgRNA
  Ccdc169
gttctgacaacccac

SEQ ID NO: 12200 - DNA, 15 bp, Artificial Sequence
  dgRNA
  Ccdc169
accctgaccttgcac

SEQ ID NO: 12201 - DNA, 15 bp, Artificial Sequence
  dgRNA
  Ccdc169
cacctagctcctaag

SEQ ID NO: 12202 - DNA, 15 bp, Artificial Sequence
  dgRNA
  Ccdc169
tatgacgtcatgcca

SEQ ID NO: 12203 - DNA, 15 bp, Artificial Sequence
  dgRNA
  Brd4
ggccgagtgggctcg

SEQ ID NO: 12204 - DNA, 15 bp, Artificial Sequence
  dgRNA
  Brd4
tcgcggactttgtac

SEQ ID NO: 12205 - DNA, 15 bp, Artificial Sequence
  dgRNA
  Brd4
cgcggactttgtacc

SEQ ID NO: 12206 - DNA, 15 bp, Artificial Sequence
  dgRNA
  Brd4
gcggactttgtaccg

SEQ ID NO: 12207 - DNA, 15 bp, Artificial Sequence
  dgRNA
  Slc17a5
cagccagcacggcga

SEQ ID NO: 12208 - DNA, 15 bp, Artificial Sequence
  dgRNA
  Slc17a5
agccagcacggcgaa

SEQ ID NO: 12209 - DNA, 15 bp, Artificial Sequence
  dgRNA
  Slc17a5
cgtgctggctgggcg

SEQ ID NO: 12210 - DNA, 15 bp, Artificial Sequence
  dgRNA
  Slc17a5
ttcgccgtgctggct

SEQ ID NO: 12211 - DNA, 15 bp, Artificial Sequence
  dgRNA
  Prss16
acagactctggcgtc

SEQ ID NO: 12212 - DNA, 15 bp, Artificial Sequence
  dgRNA
  Prss16
gacgctgaacctgcc

SEQ ID NO: 12213 - DNA, 15 bp, Artificial Sequence
  dgRNA
  Prss16
cgccagagtctgtag

SEQ ID NO: 12214 - DNA, 15 bp, Artificial Sequence
  dgRNA
  Prss16
gctttgtatttcacg

SEQ ID NO: 12215 - DNA, 15 bp, Artificial Sequence
  dgRNA
  Tmem80
gcttccaacgaagtc

SEQ ID NO: 12216 - DNA, 15 bp, Artificial Sequence
  dgRNA
  Tmem80
cttccaacgaagtct

SEQ ID NO: 12217 - DNA, 15 bp, Artificial Sequence
  dgRNA
  Tmem80
ttcgcagacagaccc

SEQ ID NO: 12218 - DNA, 15 bp, Artificial Sequence
  dgRNA
  Tmem80
cagaccctggcgcca

SEQ ID NO: 12219 - DNA, 15 bp, Artificial Sequence
  dgRNA
  Ube4b
gaaacccaaggcgca

SEQ ID NO: 12220 - DNA, 15 bp, Artificial Sequence
  dgRNA
  Ube4b
aaacccaaggcgcag

SEQ ID NO: 12221 - DNA, 15 bp, Artificial Sequence
  dgRNA
  Ube4b
tggaagggccatatt

SEQ ID NO: 12222 - DNA, 15 bp, Artificial Sequence
  dgRNA
  Ube4b
gggccatattcggat

SEQ ID NO: 12223 - DNA, 15 bp, Artificial Sequence
  dgRNA
  Def8
tgaatgcaattacta

SEQ ID NO: 12224 - DNA, 15 bp, Artificial Sequence
  dgRNA
  Def8
gcaattactaaggcg

SEQ ID NO: 12225 - DNA, 15 bp, Artificial Sequence
  dgRNA
  Def8
caattactaaggcgt

SEQ ID NO: 12226 - DNA, 15 bp, Artificial Sequence
  dgRNA
  Def8
aattactaaggcgtg

SEQ ID NO: 12227 - DNA, 15 bp, Artificial Sequence
  dgRNA
  Arpc4
gcccggaagtgctgt

SEQ ID NO: 12228 - DNA, 15 bp, Artificial Sequence
  dgRNA
  Arpc4
tgcgcctctctcgaa

SEQ ID NO: 12229 - DNA, 15 bp, Artificial Sequence
  dgRNA
  Arpc4
acagcacttccgggc

SEQ ID NO: 12230 - DNA, 15 bp, Artificial Sequence
  dgRNA
  Arpc4
tccgacagcacttcc

SEQ ID NO: 12231 - DNA, 15 bp, Artificial Sequence
  dgRNA
  Dffa
aagaaatctccaatc

SEQ ID NO: 12232 - DNA, 15 bp, Artificial Sequence
  dgRNA
  Dffa
attcccgtcgtgccc

SEQ ID NO: 12233 - DNA, 15 bp, Artificial Sequence
  dgRNA
  Dffa
tctcccggcgtgcct

SEQ ID NO: 12234 - DNA, 15 bp, Artificial Sequence
  dgRNA
  Dffa
gggggattcagttta

SEQ ID NO: 12235 - DNA, 15 bp, Artificial Sequence
  dgRNA
  1700023F06Rik
caagcagtagactgc

SEQ ID NO: 12236 - DNA, 15 bp, Artificial Sequence
  dgRNA
  1700023F06Rik
gggcaagcttagttg

SEQ ID NO: 12237 - DNA, 15 bp, Artificial Sequence
  dgRNA
  1700023F06Rik
ggcaagcttagttgc

SEQ ID NO: 12238 - DNA, 15 bp, Artificial Sequence
  dgRNA
  1700023F06Rik
ggtcccccccatgga

SEQ ID NO: 12239 - DNA, 15 bp, Artificial Sequence
  dgRNA
  Casc5
tttatgtcttagggg

SEQ ID NO: 12240 - DNA, 15 bp, Artificial Sequence
  dgRNA
  Casc5
ttatgtcttaggggc

SEQ ID NO: 12241 - DNA, 15 bp, Artificial Sequence
  dgRNA
  Casc5
tatgtcttaggggcg

SEQ ID NO: 12242 - DNA, 15 bp, Artificial Sequence
  dgRNA
  Casc5
ccggtctggagccga

SEQ ID NO: 12243 - DNA, 15 bp, Artificial Sequence
  dgRNA
  Bbs9
gccgccgataccctg

SEQ ID NO: 12244 - DNA, 15 bp, Artificial Sequence
  dgRNA
  Bbs9
ccgccgataccctga

SEQ ID NO: 12245 - DNA, 15 bp, Artificial Sequence
  dgRNA
  Bbs9
gataccctgagggac

SEQ ID NO: 12246 - DNA, 15 bp, Artificial Sequence
  dgRNA
  Bbs9
ccactctactccata

SEQ ID NO: 12247 - DNA, 15 bp, Artificial Sequence
  dgRNA
  Srr
cccaggggccgccgc

SEQ ID NO: 12248 - DNA, 15 bp, Artificial Sequence
  dgRNA
  Srr
gggccgccgcaggcc

SEQ ID NO: 12249 - DNA, 15 bp, Artificial Sequence
  dgRNA
  Srr
gcccgggcgcactgt

SEQ ID NO: 12250 - DNA, 15 bp, Artificial Sequence
  dgRNA
  Srr
cccgggcgcactgtt

SEQ ID NO: 12251 - DNA, 15 bp, Artificial Sequence
  dgRNA
  Pax1
ggggggtaagggttc

SEQ ID NO: 12252 - DNA, 15 bp, Artificial Sequence
  dgRNA
  Pax1
gtaagggttccggag

SEQ ID NO: 12253 - DNA, 15 bp, Artificial Sequence
  dgRNA
  Pax1
taagggttccggaga

SEQ ID NO: 12254 - DNA, 15 bp, Artificial Sequence
  dgRNA
  Pax1
gaggggtagagtttc

SEQ ID NO: 12255 - DNA, 15 bp, Artificial Sequence
  dgRNA
  Ulk4
agatcatgttcgaag

SEQ ID NO: 12256 - DNA, 15 bp, Artificial Sequence
  dgRNA
  Ulk4
atgttcgaagtggcg

SEQ ID NO: 12257 - DNA, 15 bp, Artificial Sequence
  dgRNA
  Ulk4
tgttcgaagtggcgt

SEQ ID NO: 12258 - DNA, 15 bp, Artificial Sequence
  dgRNA
  Ulk4
gttcgaagtggcgtg

SEQ ID NO: 12259 - DNA, 15 bp, Artificial Sequence
  dgRNA
  Cntn4
tgtacaagccccggt

SEQ ID NO: 12260 - DNA, 15 bp, Artificial Sequence
  dgRNA
  Cntn4
tctgtttttatcgta

SEQ ID NO: 12261 - DNA, 15 bp, Artificial Sequence
  dgRNA
  Cntn4
gctggtcttagcttc

SEQ ID NO: 12262 - DNA, 15 bp, Artificial Sequence
  dgRNA
  Cntn4
cacacactgtccaac

SEQ ID NO: 12263 - DNA, 15 bp, Artificial Sequence
  dgRNA
  Gpn2
agttccggcggaatc

SEQ ID NO: 12264 - DNA, 15 bp, Artificial Sequence
  dgRNA
  Gpn2
gcggaatccggaagt

SEQ ID NO: 12265 - DNA, 15 bp, Artificial Sequence
  dgRNA
  Gpn2
acttccggattccgc

SEQ ID NO: 12266 - DNA, 15 bp, Artificial Sequence
  dgRNA
  Gpn2
aaaagttccgacttc

SEQ ID NO: 12267 - DNA, 15 bp, Artificial Sequence
  dgRNA
  Tax1bp3
cagcacacgcccgac

SEQ ID NO: 12268 - DNA, 15 bp, Artificial Sequence
  dgRNA
  Tax1bp3
cgcccgacaggctcg

SEQ ID NO: 12269 - DNA, 15 bp, Artificial Sequence
  dgRNA
  Tax1bp3
ttacctgagacgccg

SEQ ID NO: 12270 - DNA, 15 bp, Artificial Sequence
  dgRNA
  Tax1bp3
cgtgttccctcagac

SEQ ID NO: 12271 - DNA, 15 bp, Artificial Sequence
  dgRNA
  Fbxl5
aagagatgtaacgca

SEQ ID NO: 12272 - DNA, 15 bp, Artificial Sequence
  dgRNA
  Fbxl5
agagatgtaacgcaa

SEQ ID NO: 12273 - DNA, 15 bp, Artificial Sequence
  dgRNA
  Fbxl5
gtaacgcaagggacc

SEQ ID NO: 12274 - DNA, 15 bp, Artificial Sequence
  dgRNA
  Fbxl5
taacgcaagggacca

SEQ ID NO: 12275 - DNA, 15 bp, Artificial Sequence
  dgRNA
  Olfr361
cccagttacccaatc

SEQ ID NO: 12276 - DNA, 15 bp, Artificial Sequence
  dgRNA
  Olfr361
ccagttacccaatct

SEQ ID NO: 12277 - DNA, 15 bp, Artificial Sequence
  dgRNA
  Olfr361
tacctgtgatatggc

SEQ ID NO: 12278 - DNA, 15 bp, Artificial Sequence
  dgRNA
  Olfr361
tttacaggtgatgta

SEQ ID NO: 12279 - DNA, 15 bp, Artificial Sequence
  dgRNA
  Cntn1
caactgcatttaccg

SEQ ID NO: 12280 - DNA, 15 bp, Artificial Sequence
  dgRNA
  Cntn1
gtaagtatgaaacct

SEQ ID NO: 12281 - DNA, 15 bp, Artificial Sequence
  dgRNA
  Ttc32
ttaatttcccgcgaa

SEQ ID NO: 12282 - DNA, 15 bp, Artificial Sequence
  dgRNA
  Ttc32
cccgcgaacggcgtc

SEQ ID NO: 12283 - DNA, 15 bp, Artificial Sequence
  dgRNA
  Ttc32
tgtctcgcgatacta

SEQ ID NO: 12284 - DNA, 15 bp, Artificial Sequence
  dgRNA
  Ttc32
gtctcgcgatactac

SEQ ID NO: 12285 - DNA, 15 bp, Artificial Sequence
  dgRNA
  Foxo6
gcacagacaggcggc

SEQ ID NO: 12286 - DNA, 15 bp, Artificial Sequence
  dgRNA
  Foxo6
gaggtgtgtgcccgc

SEQ ID NO: 12287 - DNA, 15 bp, Artificial Sequence
  dgRNA
  Foxo6
aggtgtgtgcccgct

SEQ ID NO: 12288 - DNA, 15 bp, Artificial Sequence
  dgRNA
  Foxo6
cgccccctcactgcc

SEQ ID NO: 12289 - DNA, 15 bp, Artificial Sequence
  dgRNA
  Anxa7
tctcaggatccccgg

SEQ ID NO: 12290 - DNA, 15 bp, Artificial Sequence
  dgRNA
  Anxa7
ggatccccggaggcc

SEQ ID NO: 12291 - DNA, 15 bp, Artificial Sequence
  dgRNA
  Anxa7
ggttcaaagttctac

SEQ ID NO: 12292 - DNA, 15 bp, Artificial Sequence
  dgRNA
  Cdh2
ggcgggtggctgccg

SEQ ID NO: 12293 - DNA, 15 bp, Artificial Sequence
  dgRNA
  Cdh2
tggctgccgcggatc

SEQ ID NO: 12294 - DNA, 15 bp, Artificial Sequence
  dgRNA
  Cdh2
gctacctccgcagct

SEQ ID NO: 12295 - DNA, 15 bp, Artificial Sequence
  dgRNA
  Cdh2
acctccgcagctcgg

SEQ ID NO: 12296 - DNA, 15 bp, Artificial Sequence
  dgRNA
  Hoxd8
cgcgccccctctctg

SEQ ID NO: 12297 - DNA, 15 bp, Artificial Sequence
  dgRNA
  Hoxd8
cctctctgcggaccc

SEQ ID NO: 12298 - DNA, 15 bp, Artificial Sequence
  dgRNA
  Hoxd8
ctctctgcggacccg

SEQ ID NO: 12299 - DNA, 15 bp, Artificial Sequence
  dgRNA
  Hoxd8
tctctgcggacccgg

SEQ ID NO: 12300 - DNA, 15 bp, Artificial Sequence
  dgRNA
  Spc25
tgaaagactgcgcgc

SEQ ID NO: 12301 - DNA, 15 bp, Artificial Sequence
  dgRNA
  Spc25
aagactgcgcgctgg

SEQ ID NO: 12302 - DNA, 15 bp, Artificial Sequence
  dgRNA
  Clock
ggcctcggggcatcc

SEQ ID NO: 12303 - DNA, 15 bp, Artificial Sequence
  dgRNA
  Clock
cccggcttccctcgg

SEQ ID NO: 12304 - DNA, 15 bp, Artificial Sequence
  dgRNA
  Clock
ggaacgagctcacgc

SEQ ID NO: 12305 - DNA, 15 bp, Artificial Sequence
  dgRNA
  Clock
gccggcctgcaagag

SEQ ID NO: 12306 - DNA, 15 bp, Artificial Sequence
  dgRNA
  Gbp2
ggtgccatttcttgt

SEQ ID NO: 12307 - DNA, 15 bp, Artificial Sequence
  dgRNA
  Gbp2
ctcaaccagcactgc

SEQ ID NO: 12308 - DNA, 15 bp, Artificial Sequence
  dgRNA
  Gbp2
aaaagagttcctaac

SEQ ID NO: 12309 - DNA, 15 bp, Artificial Sequence
  dgRNA
  Pum2
ccgcgctcgcttcgt

SEQ ID NO: 12310 - DNA, 15 bp, Artificial Sequence
  dgRNA
  Pum2
cgcgctcgcttcgtc

SEQ ID NO: 12311 - DNA, 15 bp, Artificial Sequence
  dgRNA
  Pum2
gcttcgtcgggtccg

SEQ ID NO: 12312 - DNA, 15 bp, Artificial Sequence
  dgRNA
  Pum2
cttcgtcgggtccgt

SEQ ID NO: 12313 - DNA, 15 bp, Artificial Sequence
  dgRNA
  Acly
acccaacccggcggc

SEQ ID NO: 12314 - DNA, 15 bp, Artificial Sequence
  dgRNA
  Acly
aacccggcggctggc

SEQ ID NO: 12315 - DNA, 15 bp, Artificial Sequence
  dgRNA
  Acly
gcccctgaaacgatc

SEQ ID NO: 12316 - DNA, 15 bp, Artificial Sequence
  dgRNA
  Acly
agcccccagcctcgt

SEQ ID NO: 12317 - DNA, 15 bp, Artificial Sequence
  dgRNA
  Csk
ttggctctagcatgc

SEQ ID NO: 12318 - DNA, 15 bp, Artificial Sequence
  dgRNA
  Csk
gctctagcatgctgg

SEQ ID NO: 12319 - DNA, 15 bp, Artificial Sequence
  dgRNA
  Csk
cgggagccttcgcga

SEQ ID NO: 12320 - DNA, 15 bp, Artificial Sequence
  dgRNA
  Csk
gcgaaggccagcaag

SEQ ID NO: 12321 - DNA, 15 bp, Artificial Sequence
  dgRNA
  Krt6a
ttgctccgtgactaa

SEQ ID NO: 12322 - DNA, 15 bp, Artificial Sequence
  dgRNA
  Krt6a
tgtaccatatataag

SEQ ID NO: 12323 - DNA, 15 bp, Artificial Sequence
  dgRNA
  Krt6a
gcagccgcttatata

SEQ ID NO: 12324 - DNA, 15 bp, Artificial Sequence
  dgRNA
  Pfkfb3
ctgtcttgcgccctt

SEQ ID NO: 12325 - DNA, 15 bp, Artificial Sequence
  dgRNA
  Pfkfb3
tgtcttgcgccctta

SEQ ID NO: 12326 - DNA, 15 bp, Artificial Sequence
  dgRNA
  Pfkfb3
ttagggacggaaagg

SEQ ID NO: 12327 - DNA, 15 bp, Artificial Sequence
  dgRNA
  Pfkfb3
acgaaagaaccagcc

SEQ ID NO: 12328 - DNA, 15 bp, Artificial Sequence
  dgRNA
  Drd1
ggaaaagcatggtcg

SEQ ID NO: 12329 - DNA, 15 bp, Artificial Sequence
  dgRNA
  Drd1
cgaggccctgcatct

SEQ ID NO: 12330 - DNA, 15 bp, Artificial Sequence
  dgRNA
  Drd1
tgatctgaacctgct

SEQ ID NO: 12331 - DNA, 15 bp, Artificial Sequence
  dgRNA
  Drd1
aacctgctagggcgc

SEQ ID NO: 12332 - DNA, 15 bp, Artificial Sequence
  dgRNA
  Rasef
cgcgcgtggcttccg

SEQ ID NO: 12333 - DNA, 15 bp, Artificial Sequence
  dgRNA
  Rasef
cttccgcggagcgct

SEQ ID NO: 12334 - DNA, 15 bp, Artificial Sequence
  dgRNA
  Rasef
cgcggagcgctcggt

SEQ ID NO: 12335 - DNA, 15 bp, Artificial Sequence
  dgRNA
  Rasef
gcggagcgctcggtc

SEQ ID NO: 12336 - DNA, 15 bp, Artificial Sequence
  dgRNA
  Clip1
tcttgctccttatcg

SEQ ID NO: 12337 - DNA, 15 bp, Artificial Sequence
  dgRNA
  Clip1
tgctccttatcgtgg

SEQ ID NO: 12338 - DNA, 15 bp, Artificial Sequence
  dgRNA
  Clip1
tatcgtggaggattt

SEQ ID NO: 12339 - DNA, 15 bp, Artificial Sequence
  dgRNA
  Clip1
atcgtggaggattta

SEQ ID NO: 12340 - DNA, 15 bp, Artificial Sequence
  dgRNA
  Olfr279
ccatcagagtcatgt

SEQ ID NO: 12341 - DNA, 15 bp, Artificial Sequence
  dgRNA
  Olfr279
ccctcttaaactaac

SEQ ID NO: 12342 - DNA, 15 bp, Artificial Sequence
  dgRNA
  Olfr279
gccaagcatcgagtg

SEQ ID NO: 12343 - DNA, 15 bp, Artificial Sequence
  dgRNA
  Olfr279
cctgttagtttaaga

SEQ ID NO: 12344 - DNA, 15 bp, Artificial Sequence
  dgRNA
  Plp2
ggcaccttgtagata

SEQ ID NO: 12345 - DNA, 15 bp, Artificial Sequence
  dgRNA
  Plp2
gacccgtatcgtctt

SEQ ID NO: 12346 - DNA, 15 bp, Artificial Sequence
  dgRNA
  Plp2
atcgtcttcggccgc

SEQ ID NO: 12347 - DNA, 15 bp, Artificial Sequence
  dgRNA
  Plp2
tcgtcttcggccgca

SEQ ID NO: 12348 - DNA, 15 bp, Artificial Sequence
  dgRNA
  Hsf4
cttcctctccgccgg

SEQ ID NO: 12349 - DNA, 15 bp, Artificial Sequence
  dgRNA
  Hsf4
ctctccgccggtggc

SEQ ID NO: 12350 - DNA, 15 bp, Artificial Sequence
  dgRNA
  Hsf4
tctccgccggtggct

SEQ ID NO: 12351 - DNA, 15 bp, Artificial Sequence
  dgRNA
  Hsf4
ccgagccccgcctct

SEQ ID NO: 12352 - DNA, 15 bp, Artificial Sequence
  dgRNA
  Syt6
gtcatatccgcagtg

SEQ ID NO: 12353 - DNA, 15 bp, Artificial Sequence
  dgRNA
  Syt6
tgatgtgggacagcg

SEQ ID NO: 12354 - DNA, 15 bp, Artificial Sequence
  dgRNA
  Syt6
aacctgcccggactc

SEQ ID NO: 12355 - DNA, 15 bp, Artificial Sequence
  dgRNA
  Syt6
gagggggcggccgtg

SEQ ID NO: 12356 - DNA, 15 bp, Artificial Sequence
  dgRNA
  6-Sep
ggtcgggacgtacca

SEQ ID NO: 12357 - DNA, 15 bp, Artificial Sequence
  dgRNA
  6-Sep
gagcccagtagcggc

SEQ ID NO: 12358 - DNA, 15 bp, Artificial Sequence
  dgRNA
  6-Sep
agcccagtagcggca

SEQ ID NO: 12359 - DNA, 15 bp, Artificial Sequence
  dgRNA
  6-Sep
ccagtagcggcaggg

SEQ ID NO: 12360 - DNA, 15 bp, Artificial Sequence
  dgRNA
  Slc27a4
cgggtttatgctacc

SEQ ID NO: 12361 - DNA, 15 bp, Artificial Sequence
  dgRNA
  Slc27a4
acaagctagactact

SEQ ID NO: 12362 - DNA, 15 bp, Artificial Sequence
  dgRNA
  Slc27a4
cactcccagcgggcc

SEQ ID NO: 12363 - DNA, 15 bp, Artificial Sequence
  dgRNA
  Slc27a4
tcccagcgggccggg

SEQ ID NO: 12364 - DNA, 15 bp, Artificial Sequence
  dgRNA
  Megf6
cgagcttagccttaa

SEQ ID NO: 12365 - DNA, 15 bp, Artificial Sequence
  dgRNA
  Megf6
cttagccttaaaggt

SEQ ID NO: 12366 - DNA, 15 bp, Artificial Sequence
  dgRNA
  Megf6
cttaaaggtaggacc

SEQ ID NO: 12367 - DNA, 15 bp, Artificial Sequence
  dgRNA
  Megf6
agcggggctggaagt

SEQ ID NO: 12368 - DNA, 15 bp, Artificial Sequence
  dgRNA
  Ngfrap1
actggcctcccgaac

SEQ ID NO: 12369 - DNA, 15 bp, Artificial Sequence
  dgRNA
  Ngfrap1
ctggcctcccgaaca

SEQ ID NO: 12370 - DNA, 15 bp, Artificial Sequence
  dgRNA
  Ngfrap1
tggcctcccgaacag

SEQ ID NO: 12371 - DNA, 15 bp, Artificial Sequence
  dgRNA
  Ngfrap1
ggccagtgcgacagg

SEQ ID NO: 12372 - DNA, 15 bp, Artificial Sequence
  dgRNA
  Amelx
gcatgatataaattg

SEQ ID NO: 12373 - DNA, 15 bp, Artificial Sequence
  dgRNA
  Amelx
ggcaataataggttt

SEQ ID NO: 12374 - DNA, 15 bp, Artificial Sequence
  dgRNA
  Amelx
aggcaataataggtt

SEQ ID NO: 12375 - DNA, 15 bp, Artificial Sequence
  dgRNA
  Amelx
attacaggcaataat

SEQ ID NO: 12376 - DNA, 15 bp, Artificial Sequence
  dgRNA
  Klhl40
ttgagccctcttcat

SEQ ID NO: 12377 - DNA, 15 bp, Artificial Sequence
  dgRNA
  Klhl40
agcatttctagacta

SEQ ID NO: 12378 - DNA, 15 bp, Artificial Sequence
  dgRNA
  Klhl40
gagaccttccagttc

SEQ ID NO: 12379 - DNA, 15 bp, Artificial Sequence
  dgRNA
  Klhl40
gaacccagttgcctc

SEQ ID NO: 12380 - DNA, 15 bp, Artificial Sequence
  dgRNA
  Zfp27
taatcgatcctccta

SEQ ID NO: 12381 - DNA, 15 bp, Artificial Sequence
  dgRNA
  Zfp27
tatgtaagcacgctg

SEQ ID NO: 12382 - DNA, 15 bp, Artificial Sequence
  dgRNA
  Zfp27
atgtaagcacgctgt

SEQ ID NO: 12383 - DNA, 15 bp, Artificial Sequence
  dgRNA
  Zfp27
cacgctgtgggttat

SEQ ID NO: 12384 - DNA, 15 bp, Artificial Sequence
  dgRNA
  Gna13
cgctcccggctgcac

SEQ ID NO: 12385 - DNA, 15 bp, Artificial Sequence
  dgRNA
  Gna13
gtgcgcgtacccgaa

SEQ ID NO: 12386 - DNA, 15 bp, Artificial Sequence
  dgRNA
  Gna13
tacccgaaaggcagc

SEQ ID NO: 12387 - DNA, 15 bp, Artificial Sequence
  dgRNA
  Gna13
cacgcgcacgcccag

SEQ ID NO: 12388 - DNA, 15 bp, Artificial Sequence
  dgRNA
  Mex3b
agtgtcagctcccgc

SEQ ID NO: 12389 - DNA, 15 bp, Artificial Sequence
  dgRNA
  Mex3b
tccctcgtccccctc

SEQ ID NO: 12390 - DNA, 15 bp, Artificial Sequence
  dgRNA
  Mex3b
ccctccggagccgtc

SEQ ID NO: 12391 - DNA, 15 bp, Artificial Sequence
  dgRNA
  Mex3b
gccgtctggctgcag

SEQ ID NO: 12392 - DNA, 15 bp, Artificial Sequence
  dgRNA
  Adam33
cagacttcagcaacg

SEQ ID NO: 12393 - DNA, 15 bp, Artificial Sequence
  dgRNA
  Adam33
caccacaagacccct

SEQ ID NO: 12394 - DNA, 15 bp, Artificial Sequence
  dgRNA
  Adam33
tgggacactaggtgc

SEQ ID NO: 12395 - DNA, 15 bp, Artificial Sequence
  dgRNA
  Adam33
tacctaggggtcttg

SEQ ID NO: 12396 - DNA, 15 bp, Artificial Sequence
  dgRNA
  Rab40b
cccttcggtttcttc

SEQ ID NO: 12397 - DNA, 15 bp, Artificial Sequence
  dgRNA
  Rab40b
cggtttcttctggct

SEQ ID NO: 12398 - DNA, 15 bp, Artificial Sequence
  dgRNA
  Rab40b
ttctggctcggcctt

SEQ ID NO: 12399 - DNA, 15 bp, Artificial Sequence
  dgRNA
  Rab40b
gacctccattggctt

SEQ ID NO: 12400 - DNA, 15 bp, Artificial Sequence
  dgRNA
  Rcbtb1
gacgccttcgccttc

SEQ ID NO: 12401 - DNA, 15 bp, Artificial Sequence
  dgRNA
  Rcbtb1
gccttccggtcctcg

SEQ ID NO: 12402 - DNA, 15 bp, Artificial Sequence
  dgRNA
  Rcbtb1
ccttccggtcctcgc

SEQ ID NO: 12403 - DNA, 15 bp, Artificial Sequence
  dgRNA
  Rcbtb1
tcgcgggagccacta

SEQ ID NO: 12404 - DNA, 15 bp, Artificial Sequence
  dgRNA
  Gaa
cctgcactactaccc

SEQ ID NO: 12405 - DNA, 15 bp, Artificial Sequence
  dgRNA
  Gaa
ctgcactactacccc

SEQ ID NO: 12406 - DNA, 15 bp, Artificial Sequence
  dgRNA
  Gaa
actaccccgggcttc

SEQ ID NO: 12407 - DNA, 15 bp, Artificial Sequence
  dgRNA
  Gaa
ttatatcaaatgccc

SEQ ID NO: 12408 - DNA, 15 bp, Artificial Sequence
  dgRNA
  Cryba2
ccgttgtcatgcatg

SEQ ID NO: 12409 - DNA, 15 bp, Artificial Sequence
  dgRNA
  Cryba2
cgttgtcatgcatgc

SEQ ID NO: 12410 - DNA, 15 bp, Artificial Sequence
  dgRNA
  Cryba2
tcatgcatgcgggct

SEQ ID NO: 12411 - DNA, 15 bp, Artificial Sequence
  dgRNA
  Cryba2
ccacccggattccac

SEQ ID NO: 12412 - DNA, 15 bp, Artificial Sequence
  dgRNA
  Zbtb37
gcaactcccttgccg

SEQ ID NO: 12413 - DNA, 15 bp, Artificial Sequence
  dgRNA
  Zbtb37
caactcccttgccgc

SEQ ID NO: 12414 - DNA, 15 bp, Artificial Sequence
  dgRNA
  Zbtb37
aactcccttgccgcg

SEQ ID NO: 12415 - DNA, 15 bp, Artificial Sequence
  dgRNA
  Zbtb37
tcctgtcgagcttcc

SEQ ID NO: 12416 - DNA, 15 bp, Artificial Sequence
  dgRNA
  Zfp568
ccagcgctgcttcgc

SEQ ID NO: 12417 - DNA, 15 bp, Artificial Sequence
  dgRNA
  Zfp568
gcgctgcttcgccgg

SEQ ID NO: 12418 - DNA, 15 bp, Artificial Sequence
  dgRNA
  Zfp568
gtctcgccgcgctaa

SEQ ID NO: 12419 - DNA, 15 bp, Artificial Sequence
  dgRNA
  Zfp568
tctcgccgcgctaat

SEQ ID NO: 12420 - DNA, 15 bp, Artificial Sequence
  dgRNA
  Mcmbp
atggagtttgccacc

SEQ ID NO: 12421 - DNA, 15 bp, Artificial Sequence
  dgRNA
  Mcmbp
accaggcgcgcacac

SEQ ID NO: 12422 - DNA, 15 bp, Artificial Sequence
  dgRNA
  Mcmbp
ccaggcgcgcacaca

SEQ ID NO: 12423 - DNA, 15 bp, Artificial Sequence
  dgRNA
  Mcmbp
tctccgtctccaaaa

SEQ ID NO: 12424 - DNA, 15 bp, Artificial Sequence
  dgRNA
  Timm8a1
tcgccagaagagttc

SEQ ID NO: 12425 - DNA, 15 bp, Artificial Sequence
  dgRNA
  Timm8a1
aagagttctggcttg

SEQ ID NO: 12426 - DNA, 15 bp, Artificial Sequence
  dgRNA
  Timm8a1
aagcgcgggccaatt

SEQ ID NO: 12427 - DNA, 15 bp, Artificial Sequence
  dgRNA
  Timm8a1
gggccaatttggaag

SEQ ID NO: 12428 - DNA, 15 bp, Artificial Sequence
  dgRNA
  Plekhg5
tggctggggttccgc

SEQ ID NO: 12429 - DNA, 15 bp, Artificial Sequence
  dgRNA
  Plekhg5
ggctggggttccgcg

SEQ ID NO: 12430 - DNA, 15 bp, Artificial Sequence
  dgRNA
  Plekhg5
cgggtcaacttcctt

SEQ ID NO: 12431 - DNA, 15 bp, Artificial Sequence
  dgRNA
  Plekhg5
acgggtcaacttcct

SEQ ID NO: 12432 - DNA, 15 bp, Artificial Sequence
  dgRNA
  Fgf8
ggggggtctggccca

SEQ ID NO: 12433 - DNA, 15 bp, Artificial Sequence
  dgRNA
  Fgf8
tggggggtctggccc

SEQ ID NO: 12434 - DNA, 15 bp, Artificial Sequence
  dgRNA
  Krt77
gataaatgatcaagt

SEQ ID NO: 12435 - DNA, 15 bp, Artificial Sequence
  dgRNA
  Krt77
atttcagcaacacat

SEQ ID NO: 12436 - DNA, 15 bp, Artificial Sequence
  dgRNA
  Krt77
gtaagcagatgctac

SEQ ID NO: 12437 - DNA, 15 bp, Artificial Sequence
  dgRNA
  Krt77
ggatagcaatctctc

SEQ ID NO: 12438 - DNA, 15 bp, Artificial Sequence
  dgRNA
  Bcl2l11
ctgcaggacagccgg

SEQ ID NO: 12439 - DNA, 15 bp, Artificial Sequence
  dgRNA
  Bcl2l11
tgcaggacagccggc

SEQ ID NO: 12440 - DNA, 15 bp, Artificial Sequence
  dgRNA
  Bcl2l11
gcaggacagccggcg

SEQ ID NO: 12441 - DNA, 15 bp, Artificial Sequence
  dgRNA
  Bcl2l11
gcctgcacgcgccag

SEQ ID NO: 12442 - DNA, 15 bp, Artificial Sequence
  dgRNA
  Ier3
gcattcactactccc

SEQ ID NO: 12443 - DNA, 15 bp, Artificial Sequence
  dgRNA
  Ier3
ggaaagaacgtgcac

SEQ ID NO: 12444 - DNA, 15 bp, Artificial Sequence
  dgRNA
  Ier3
gaaagaacgtgcact

SEQ ID NO: 12445 - DNA, 15 bp, Artificial Sequence
  dgRNA
  Ier3
gctccccagctgcga

SEQ ID NO: 12446 - DNA, 15 bp, Artificial Sequence
  dgRNA
  Perp
acaggtgtgtgcgct

SEQ ID NO: 12447 - DNA, 15 bp, Artificial Sequence
  dgRNA
  Perp
gggctggcggcaatc

SEQ ID NO: 12448 - DNA, 15 bp, Artificial Sequence
  dgRNA
  Perp
ctggcggcaatctgg

SEQ ID NO: 12449 - DNA, 15 bp, Artificial Sequence
  dgRNA
  Perp
tggcggcaatctggt

SEQ ID NO: 12450 - DNA, 15 bp, Artificial Sequence
  dgRNA
  Ick
tgtgcagccggagag

SEQ ID NO: 12451 - DNA, 15 bp, Artificial Sequence
  dgRNA
  Ick
gatcccacaatacaa

SEQ ID NO: 12452 - DNA, 15 bp, Artificial Sequence
  dgRNA
  Ick
atcccacaatacaac

SEQ ID NO: 12453 - DNA, 15 bp, Artificial Sequence
  dgRNA
  Ick
cccacaatacaacgg

SEQ ID NO: 12454 - DNA, 15 bp, Artificial Sequence
  dgRNA
  Nek8
gcgatgtggctggta

SEQ ID NO: 12455 - DNA, 15 bp, Artificial Sequence
  dgRNA
  Nek8
tctctgatccctcgt

SEQ ID NO: 12456 - DNA, 15 bp, Artificial Sequence
  dgRNA
  Nek8
ctctgatccctcgtt

SEQ ID NO: 12457 - DNA, 15 bp, Artificial Sequence
  dgRNA
  Nek8
tctgatccctcgttg

SEQ ID NO: 12458 - DNA, 15 bp, Artificial Sequence
  dgRNA
  Styxl1
agcacgccctagacc

SEQ ID NO: 12459 - DNA, 15 bp, Artificial Sequence
  dgRNA
  Styxl1
tagacccggcgagcg

SEQ ID NO: 12460 - DNA, 15 bp, Artificial Sequence
  dgRNA
  Styxl1
cgtcacgattctctc

SEQ ID NO: 12461 - DNA, 15 bp, Artificial Sequence
  dgRNA
  Styxl1
gagatctcgcgagag

SEQ ID NO: 12462 - DNA, 15 bp, Artificial Sequence
  dgRNA
  Sun2
agggcggtgcgcgcg

SEQ ID NO: 12463 - DNA, 15 bp, Artificial Sequence
  dgRNA
  Prm2
gcaagatgagtaact

SEQ ID NO: 12464 - DNA, 15 bp, Artificial Sequence
  dgRNA
  Prm2
gtgccgccctcacag

SEQ ID NO: 12465 - DNA, 15 bp, Artificial Sequence
  dgRNA
  Prm2
tgccgccctcacaga

SEQ ID NO: 12466 - DNA, 15 bp, Artificial Sequence
  dgRNA
  Prm2
gccgccctcacagag

SEQ ID NO: 12467 - DNA, 15 bp, Artificial Sequence
  dgRNA
  Lrrc41
ctagctacgagacgt

SEQ ID NO: 12468 - DNA, 15 bp, Artificial Sequence
  dgRNA
  Lrrc41
tagctacgagacgta

SEQ ID NO: 12469 - DNA, 15 bp, Artificial Sequence
  dgRNA
  Lrrc41
agctacgagacgtag

SEQ ID NO: 12470 - DNA, 15 bp, Artificial Sequence
  dgRNA
  Lrrc41
gctacgagacgtagg

SEQ ID NO: 12471 - DNA, 15 bp, Artificial Sequence
  dgRNA
  Smim24
gggtgcaaggtgcgg

SEQ ID NO: 12472 - DNA, 15 bp, Artificial Sequence
  dgRNA
  Smim24
ggaacctgccgtctg

SEQ ID NO: 12473 - DNA, 15 bp, Artificial Sequence
  dgRNA
  Smim24
gacagtgattgggcg

SEQ ID NO: 12474 - DNA, 15 bp, Artificial Sequence
  dgRNA
  Smim24
gcacagggctcgggt

SEQ ID NO: 12475 - DNA, 15 bp, Artificial Sequence
  dgRNA
  Ush1c
gcccggctgaactgc

SEQ ID NO: 12476 - DNA, 15 bp, Artificial Sequence
  dgRNA
  Ush1c
aggtgaccccgcctc

SEQ ID NO: 12477 - DNA, 15 bp, Artificial Sequence
  dgRNA
  Ush1c
ggtgaccccgcctcc

SEQ ID NO: 12478 - DNA, 15 bp, Artificial Sequence
  dgRNA
  Ush1c
agaagcctcgtcgtg

SEQ ID NO: 12479 - DNA, 15 bp, Artificial Sequence
  dgRNA
  Fbxo30
gacgggccccgtgcg

SEQ ID NO: 12480 - DNA, 15 bp, Artificial Sequence
  dgRNA
  Fbxo30
gccccgtgcgtggtc

SEQ ID NO: 12481 - DNA, 15 bp, Artificial Sequence
  dgRNA
  Fbxo30
gtgcgtggtccggtc

SEQ ID NO: 12482 - DNA, 15 bp, Artificial Sequence
  dgRNA
  Fbxo30
tggtccggtccggtg

SEQ ID NO: 12483 - DNA, 15 bp, Artificial Sequence
  dgRNA
  Ephb4
caggctcagttcggg

SEQ ID NO: 12484 - DNA, 15 bp, Artificial Sequence
  dgRNA
  Ephb4
gcctgtcgggaagtt

SEQ ID NO: 12485 - DNA, 15 bp, Artificial Sequence
  dgRNA
  Ephb4
cgaactgagcctgtc

SEQ ID NO: 12486 - DNA, 15 bp, Artificial Sequence
  dgRNA
  Ephb4
ccgaactgagcctgt

SEQ ID NO: 12487 - DNA, 15 bp, Artificial Sequence
  dgRNA
  Cnih3
ccggacctcctcgcc

SEQ ID NO: 12488 - DNA, 15 bp, Artificial Sequence
  dgRNA
  Cnih3
tcgcctggtccagag

SEQ ID NO: 12489 - DNA, 15 bp, Artificial Sequence
  dgRNA
  Cnih3
tggagtcctcgcacc

SEQ ID NO: 12490 - DNA, 15 bp, Artificial Sequence
  dgRNA
  Cnih3
tttcttcttcggcta

SEQ ID NO: 12491 - DNA, 15 bp, Artificial Sequence
  dgRNA
  Rpl30
cccaccacgtgggtt

SEQ ID NO: 12492 - DNA, 15 bp, Artificial Sequence
  dgRNA
  Rpl30
taaaaccgccgcaaa

SEQ ID NO: 12493 - DNA, 15 bp, Artificial Sequence
  dgRNA
  Rpl30
aaaaccgccgcaaaa

SEQ ID NO: 12494 - DNA, 15 bp, Artificial Sequence
  dgRNA
  Rpl30
aaaccgccgcaaaag

SEQ ID NO: 12495 - DNA, 15 bp, Artificial Sequence
  dgRNA
  Coq9
cccggcttccccaag

SEQ ID NO: 12496 - DNA, 15 bp, Artificial Sequence
  dgRNA
  Coq9
gccgaagcgagagca

SEQ ID NO: 12497 - DNA, 15 bp, Artificial Sequence
  dgRNA
  Coq9
ccgaagcgagagcac

SEQ ID NO: 12498 - DNA, 15 bp, Artificial Sequence
  dgRNA
  Coq9
agagtggcccctagg

SEQ ID NO: 12499 - DNA, 15 bp, Artificial Sequence
  dgRNA
  Pdcd4
tccataaccccacac

SEQ ID NO: 12500 - DNA, 15 bp, Artificial Sequence
  dgRNA
  Pdcd4
ctggttggcccggcc

SEQ ID NO: 12501 - DNA, 15 bp, Artificial Sequence
  dgRNA
  Pdcd4
tggttggcccggcct

SEQ ID NO: 12502 - DNA, 15 bp, Artificial Sequence
  dgRNA
  Pdcd4
ggggcttctatgtca

SEQ ID NO: 12503 - DNA, 15 bp, Artificial Sequence
  dgRNA
  Eif2b5
ctaagtagacaacgg

SEQ ID NO: 12504 - DNA, 15 bp, Artificial Sequence
  dgRNA
  Eif2b5
taagtagacaacggt

SEQ ID NO: 12505 - DNA, 15 bp, Artificial Sequence
  dgRNA
  Eif2b5
cggtcagccacgccc

SEQ ID NO: 12506 - DNA, 15 bp, Artificial Sequence
  dgRNA
  Eif2b5
cgccctggtcttgca

SEQ ID NO: 12507 - DNA, 15 bp, Artificial Sequence
  dgRNA
  Mpst
acgcgggagtggagg

SEQ ID NO: 12508 - DNA, 15 bp, Artificial Sequence
  dgRNA
  Mpst
cgcgggagtggagga

SEQ ID NO: 12509 - DNA, 15 bp, Artificial Sequence
  dgRNA
  Mpst
taggaagactgtccg

SEQ ID NO: 12510 - DNA, 15 bp, Artificial Sequence
  dgRNA
  Mpst
gtccgtggctgcttg

SEQ ID NO: 12511 - DNA, 15 bp, Artificial Sequence
  dgRNA
  Olfr169
caagtgcctcataga

SEQ ID NO: 12512 - DNA, 15 bp, Artificial Sequence
  dgRNA
  Olfr169
tcaagtgcctcatag

SEQ ID NO: 12513 - DNA, 15 bp, Artificial Sequence
  dgRNA
  Tmem39a
acagaaaaactccgc

SEQ ID NO: 12514 - DNA, 15 bp, Artificial Sequence
  dgRNA
  Tmem39a
cagaaaaactccgcc

SEQ ID NO: 12515 - DNA, 15 bp, Artificial Sequence
  dgRNA
  Tmem39a
tccgccgggcacgta

SEQ ID NO: 12516 - DNA, 15 bp, Artificial Sequence
  dgRNA
  Tmem39a
ccgccgggcacgtat

SEQ ID NO: 12517 - DNA, 15 bp, Artificial Sequence
  dgRNA
  Olfr1082
cccgatttttaacat

SEQ ID NO: 12518 - DNA, 15 bp, Artificial Sequence
  dgRNA
  Olfr1082
aaaatcggggaacag

SEQ ID NO: 12519 - DNA, 15 bp, Artificial Sequence
  dgRNA
  Olfr1082
caatgttaaaaatcg

SEQ ID NO: 12520 - DNA, 15 bp, Artificial Sequence
  dgRNA
  Fh1
tttcccgtgaacccg

SEQ ID NO: 12521 - DNA, 15 bp, Artificial Sequence
  dgRNA
  Fh1
aaacagccatactac

SEQ ID NO: 12522 - DNA, 15 bp, Artificial Sequence
  dgRNA
  Fh1
ccatactacaggccc

SEQ ID NO: 12523 - DNA, 15 bp, Artificial Sequence
  dgRNA
  Fh1
catactacaggccca

SEQ ID NO: 12524 - DNA, 15 bp, Artificial Sequence
  dgRNA
  Amy1
tgcctctttgaccag

SEQ ID NO: 12525 - DNA, 15 bp, Artificial Sequence
  dgRNA
  Amy1
tgtaatgcacgatgt

SEQ ID NO: 12526 - DNA, 15 bp, Artificial Sequence
  dgRNA
  Amy1
ctgtaatgcacgatg

SEQ ID NO: 12527 - DNA, 15 bp, Artificial Sequence
  dgRNA
  Fam126b
gacggaatctttagg

SEQ ID NO: 12528 - DNA, 15 bp, Artificial Sequence
  dgRNA
  Fam126b
aggcggagcaccgag

SEQ ID NO: 12529 - DNA, 15 bp, Artificial Sequence
  dgRNA
  Fam126b
cggagcaccgagagg

SEQ ID NO: 12530 - DNA, 15 bp, Artificial Sequence
  dgRNA
  Fam126b
cgcagccaatgagag

SEQ ID NO: 12531 - DNA, 15 bp, Artificial Sequence
  dgRNA
  Pola2
agcgcctcctggcca

SEQ ID NO: 12532 - DNA, 15 bp, Artificial Sequence
  dgRNA
  Pola2
gcgcctcctggccaa

SEQ ID NO: 12533 - DNA, 15 bp, Artificial Sequence
  dgRNA
  Pola2
aacagccacagtacg

SEQ ID NO: 12534 - DNA, 15 bp, Artificial Sequence
  dgRNA
  Pola2
ttctcaatttccgcg

SEQ ID NO: 12535 - DNA, 15 bp, Artificial Sequence
  dgRNA
  Usp19
agtgcgtcatcagct

SEQ ID NO: 12536 - DNA, 15 bp, Artificial Sequence
  dgRNA
  Usp19
aagcagcggcgaagg

SEQ ID NO: 12537 - DNA, 15 bp, Artificial Sequence
  dgRNA
  Usp19
gcggaggagccggga

SEQ ID NO: 12538 - DNA, 15 bp, Artificial Sequence
  dgRNA
  Usp19
cggaggagccgggac

SEQ ID NO: 12539 - DNA, 15 bp, Artificial Sequence
  dgRNA
  Tsen34
cgaattccaaagtca

SEQ ID NO: 12540 - DNA, 15 bp, Artificial Sequence
  dgRNA
  Tsen34
tccaaagtcacggct

SEQ ID NO: 12541 - DNA, 15 bp, Artificial Sequence
  dgRNA
  Tsen34
atgcgtttacaaact

SEQ ID NO: 12542 - DNA, 15 bp, Artificial Sequence
  dgRNA
  Tsen34
gtttacaaactcggc

SEQ ID NO: 12543 - DNA, 15 bp, Artificial Sequence
  dgRNA
  Fam110a
acgttaaatcacact

SEQ ID NO: 12544 - DNA, 15 bp, Artificial Sequence
  dgRNA
  Fam110a
atcacactaggcgac

SEQ ID NO: 12545 - DNA, 15 bp, Artificial Sequence
  dgRNA
  Fam110a
tcacactaggcgacc

SEQ ID NO: 12546 - DNA, 15 bp, Artificial Sequence
  dgRNA
  Fam110a
ccctgtgacgtgcgt

SEQ ID NO: 12547 - DNA, 15 bp, Artificial Sequence
  dgRNA
  Pparg
caggcctgaattggc

SEQ ID NO: 12548 - DNA, 15 bp, Artificial Sequence
  dgRNA
  Pparg
gaatcaggcctgaat

SEQ ID NO: 12549 - DNA, 15 bp, Artificial Sequence
  dgRNA
  Pparg
agattggttggttaa

SEQ ID NO: 12550 - DNA, 15 bp, Artificial Sequence
  dgRNA
  Pparg
ttgcaaaagattggt

SEQ ID NO: 12551 - DNA, 15 bp, Artificial Sequence
  dgRNA
  Cyp24a1
gggccagcagcgtgt

SEQ ID NO: 12552 - DNA, 15 bp, Artificial Sequence
  dgRNA
  Cyp24a1
cgtgtcggtcacccg

SEQ ID NO: 12553 - DNA, 15 bp, Artificial Sequence
  dgRNA
  Cyp24a1
ggtcacccgaggccc

SEQ ID NO: 12554 - DNA, 15 bp, Artificial Sequence
  dgRNA
  Cyp24a1
attcagcgtgctcat

SEQ ID NO: 12555 - DNA, 15 bp, Artificial Sequence
  dgRNA
  Kcnip1
gatccagcccgagcg

SEQ ID NO: 12556 - DNA, 15 bp, Artificial Sequence
  dgRNA
  Kcnip1
atccagcccgagcgc

SEQ ID NO: 12557 - DNA, 15 bp, Artificial Sequence
  dgRNA
  Kcnip1
tccagcccgagcgcg

SEQ ID NO: 12558 - DNA, 15 bp, Artificial Sequence
  dgRNA
  Kcnip1
agcccgagcgcgggg

SEQ ID NO: 12559 - DNA, 15 bp, Artificial Sequence
  dgRNA
  Ndc1
tcctctagagtatcc

SEQ ID NO: 12560 - DNA, 15 bp, Artificial Sequence
  dgRNA
  Ndc1
cgcgagcctgtactt

SEQ ID NO: 12561 - DNA, 15 bp, Artificial Sequence
  dgRNA
  Ndc1
ggagcagccttttac

SEQ ID NO: 12562 - DNA, 15 bp, Artificial Sequence
  dgRNA
  Ndc1
acccggatactctag

SEQ ID NO: 12563 - DNA, 15 bp, Artificial Sequence
  dgRNA
  4833423E24Rik
tcctcccatggcgca

SEQ ID NO: 12564 - DNA, 15 bp, Artificial Sequence
  dgRNA
  4833423E24Rik
cctcccatggcgcaa

SEQ ID NO: 12565 - DNA, 15 bp, Artificial Sequence
  dgRNA
  4833423E24Rik
ctcccatggcgcaag

SEQ ID NO: 12566 - DNA, 15 bp, Artificial Sequence
  dgRNA
  4833423E24Rik
ccatggcgcaagggg

SEQ ID NO: 12567 - DNA, 15 bp, Artificial Sequence
  dgRNA
  Olfr645
cgcctttccttccat

SEQ ID NO: 12568 - DNA, 15 bp, Artificial Sequence
  dgRNA
  Olfr645
gaataccaacagtat

SEQ ID NO: 12569 - DNA, 15 bp, Artificial Sequence
  dgRNA
  Olfr645
gaacatccatctgac

SEQ ID NO: 12570 - DNA, 15 bp, Artificial Sequence
  dgRNA
  Olfr645
atgaacctccagcta

SEQ ID NO: 12571 - DNA, 15 bp, Artificial Sequence
  dgRNA
  Appl1
ccctttaatgacgga

SEQ ID NO: 12572 - DNA, 15 bp, Artificial Sequence
  dgRNA
  Appl1
gagatttgacatgta

SEQ ID NO: 12573 - DNA, 15 bp, Artificial Sequence
  dgRNA
  Appl1
accgattgtcaggtt

SEQ ID NO: 12574 - DNA, 15 bp, Artificial Sequence
  dgRNA
  Appl1
cgcaaaccgattgtc

SEQ ID NO: 12575 - DNA, 15 bp, Artificial Sequence
  dgRNA
  Flnc
cggaggcggggccgt

SEQ ID NO: 12576 - DNA, 15 bp, Artificial Sequence
  dgRNA
  Flnc
ccgtggggctcagcg

SEQ ID NO: 12577 - DNA, 15 bp, Artificial Sequence
  dgRNA
  Flnc
gcggcccccacccgc

SEQ ID NO: 12578 - DNA, 15 bp, Artificial Sequence
  dgRNA
  Flnc
cccccacccgcgggc

SEQ ID NO: 12579 - DNA, 15 bp, Artificial Sequence
  dgRNA
  Chst4
ggagcctgtcttgca

SEQ ID NO: 12580 - DNA, 15 bp, Artificial Sequence
  dgRNA
  Chst4
ctgtcttgcaaggcg

SEQ ID NO: 12581 - DNA, 15 bp, Artificial Sequence
  dgRNA
  Chst4
tgtcttgcaaggcgg

SEQ ID NO: 12582 - DNA, 15 bp, Artificial Sequence
  dgRNA
  Chst4
gaacggtgctgagcc

SEQ ID NO: 12583 - DNA, 15 bp, Artificial Sequence
  dgRNA
  Vps4a
tctcccggatctacc

SEQ ID NO: 12584 - DNA, 15 bp, Artificial Sequence
  dgRNA
  Vps4a
ccacccctcactcgg

SEQ ID NO: 12585 - DNA, 15 bp, Artificial Sequence
  dgRNA
  Vps4a
tcactccggttttac

SEQ ID NO: 12586 - DNA, 15 bp, Artificial Sequence
  dgRNA
  Vps4a
ggttttaccggcctt

SEQ ID NO: 12587 - DNA, 15 bp, Artificial Sequence
  dgRNA
  Rasd1
cctttcagcgcacgt

SEQ ID NO: 12588 - DNA, 15 bp, Artificial Sequence
  dgRNA
  Rasd1
cacgtaggtctgaag

SEQ ID NO: 12589 - DNA, 15 bp, Artificial Sequence
  dgRNA
  Rasd1
caggctccaaggcgg

SEQ ID NO: 12590 - DNA, 15 bp, Artificial Sequence
  dgRNA
  Rasd1
gaggtcgctgcgtct

SEQ ID NO: 12591 - DNA, 15 bp, Artificial Sequence
  dgRNA
  Olfr646
actgatgaataatac

SEQ ID NO: 12592 - DNA, 15 bp, Artificial Sequence
  dgRNA
  Olfr646
cagacacctaatttc

SEQ ID NO: 12593 - DNA, 15 bp, Artificial Sequence
  dgRNA
  Olfr646
catgccgtcaaccct

SEQ ID NO: 12594 - DNA, 15 bp, Artificial Sequence
  dgRNA
  Olfr646
ctgaaattaggtgtc

SEQ ID NO: 12595 - DNA, 15 bp, Artificial Sequence
  dgRNA
  Kti12
taccctctttgacgg

SEQ ID NO: 12596 - DNA, 15 bp, Artificial Sequence
  dgRNA
  Kti12
accctctttgacgga

SEQ ID NO: 12597 - DNA, 15 bp, Artificial Sequence
  dgRNA
  Kti12
gaggcctttaacgtt

SEQ ID NO: 12598 - DNA, 15 bp, Artificial Sequence
  dgRNA
  Kti12
tgttggtccttgatc

SEQ ID NO: 12599 - DNA, 15 bp, Artificial Sequence
  dgRNA
  Psmd14
ctgacttccgcctcg

SEQ ID NO: 12600 - DNA, 15 bp, Artificial Sequence
  dgRNA
  Psmd14
tgacttccgcctcgc

SEQ ID NO: 12601 - DNA, 15 bp, Artificial Sequence
  dgRNA
  Psmd14
gacttccgcctcgcg

SEQ ID NO: 12602 - DNA, 15 bp, Artificial Sequence
  dgRNA
  Psmd14
ccgcctcgcggggac

SEQ ID NO: 12603 - DNA, 15 bp, Artificial Sequence
  dgRNA
  2010106E10Rik
gtgaatggcttatat

SEQ ID NO: 12604 - DNA, 15 bp, Artificial Sequence
  dgRNA
  Hnrnpul1
gattggcttggttcc

SEQ ID NO: 12605 - DNA, 15 bp, Artificial Sequence
  dgRNA
  Hnrnpul1
tcgttttacatcgta

SEQ ID NO: 12606 - DNA, 15 bp, Artificial Sequence
  dgRNA
  Hnrnpul1
ttacatcgtacggtc

SEQ ID NO: 12607 - DNA, 15 bp, Artificial Sequence
  dgRNA
  Hnrnpul1
tacatcgtacggtcc

SEQ ID NO: 12608 - DNA, 15 bp, Artificial Sequence
  dgRNA
  Micalcl
gctaagtctgggccc

SEQ ID NO: 12609 - DNA, 15 bp, Artificial Sequence
  dgRNA
  Micalcl
aggggctaatgagta

SEQ ID NO: 12610 - DNA, 15 bp, Artificial Sequence
  dgRNA
  Micalcl
ctaatgagtagggca

SEQ ID NO: 12611 - DNA, 15 bp, Artificial Sequence
  dgRNA
  Micalcl
taatgagtagggcat

SEQ ID NO: 12612 - DNA, 15 bp, Artificial Sequence
  dgRNA
  Dhx32
gcccctccttgaatc

SEQ ID NO: 12613 - DNA, 15 bp, Artificial Sequence
  dgRNA
  Dhx32
ctccttgaatctggt

SEQ ID NO: 12614 - DNA, 15 bp, Artificial Sequence
  dgRNA
  Dhx32
ggttggctgcttcga

SEQ ID NO: 12615 - DNA, 15 bp, Artificial Sequence
  dgRNA
  Dhx32
tcgaaggagacaagt

SEQ ID NO: 12616 - DNA, 15 bp, Artificial Sequence
  dgRNA
  Islr
tgtgcattgcacaag

SEQ ID NO: 12617 - DNA, 15 bp, Artificial Sequence
  dgRNA
  Islr
acaaggggccttgtc

SEQ ID NO: 12618 - DNA, 15 bp, Artificial Sequence
  dgRNA
  Islr
gcaaaacatacctat

SEQ ID NO: 12619 - DNA, 15 bp, Artificial Sequence
  dgRNA
  Islr
aaacatacctatggg

SEQ ID NO: 12620 - DNA, 15 bp, Artificial Sequence
  dgRNA
  Serpinb6a
gcgcttttcgatttc

SEQ ID NO: 12621 - DNA, 15 bp, Artificial Sequence
  dgRNA
  Serpinb6a
cgcttttcgatttcc

SEQ ID NO: 12622 - DNA, 15 bp, Artificial Sequence
  dgRNA
  Serpinb6a
gtcccgcccgccacc

SEQ ID NO: 12623 - DNA, 15 bp, Artificial Sequence
  dgRNA
  Serpinb6a
ccgccacccggcttc

SEQ ID NO: 12624 - DNA, 15 bp, Artificial Sequence
  dgRNA
  Spr
tgggagtggcgctca

SEQ ID NO: 12625 - DNA, 15 bp, Artificial Sequence
  dgRNA
  Spr
gggagtggcgctcaa

SEQ ID NO: 12626 - DNA, 15 bp, Artificial Sequence
  dgRNA
  Spr
ggagtggcgctcaag

SEQ ID NO: 12627 - DNA, 15 bp, Artificial Sequence
  dgRNA
  Spr
cgctcaaggggaacc

SEQ ID NO: 12628 - DNA, 15 bp, Artificial Sequence
  dgRNA
  Sv2a
catcttttgctaggg

SEQ ID NO: 12629 - DNA, 15 bp, Artificial Sequence
  dgRNA
  Sv2a
tctcccgctgctcac

SEQ ID NO: 12630 - DNA, 15 bp, Artificial Sequence
  dgRNA
  Sv2a
cgctgctcactggcg

SEQ ID NO: 12631 - DNA, 15 bp, Artificial Sequence
  dgRNA
  Sv2a
ctgctcactggcgcg

SEQ ID NO: 12632 - DNA, 15 bp, Artificial Sequence
  dgRNA
  Slc16a3
gagcgagtgccagcc

SEQ ID NO: 12633 - DNA, 15 bp, Artificial Sequence
  dgRNA
  Slc16a3
ggtctccctgttaag

SEQ ID NO: 12634 - DNA, 15 bp, Artificial Sequence
  dgRNA
  Slc16a3
cctgttaagtggaga

SEQ ID NO: 12635 - DNA, 15 bp, Artificial Sequence
  dgRNA
  Slc16a3
cattgtccgcgccgt

SEQ ID NO: 12636 - DNA, 15 bp, Artificial Sequence
  dgRNA
  Diexf
acgcctatgtgctag

SEQ ID NO: 12637 - DNA, 15 bp, Artificial Sequence
  dgRNA
  Diexf
gtgctagaggcgctc

SEQ ID NO: 12638 - DNA, 15 bp, Artificial Sequence
  dgRNA
  Diexf
tagaggcgctccggc

SEQ ID NO: 12639 - DNA, 15 bp, Artificial Sequence
  dgRNA
  Diexf
agaggcgctccggca

SEQ ID NO: 12640 - DNA, 15 bp, Artificial Sequence
  dgRNA
  Pcnxl2
ttgcaaacttactct

SEQ ID NO: 12641 - DNA, 15 bp, Artificial Sequence
  dgRNA
  Pcnxl2
tgcaaacttactctt

SEQ ID NO: 12642 - DNA, 15 bp, Artificial Sequence
  dgRNA
  Pcnxl2
cttcgcagacttgtg

SEQ ID NO: 12643 - DNA, 15 bp, Artificial Sequence
  dgRNA
  Pcnxl2
ttcgcagacttgtgt

SEQ ID NO: 12644 - DNA, 15 bp, Artificial Sequence
  dgRNA
  Krtap4-6
cttgaaagtataatc

SEQ ID NO: 12645 - DNA, 15 bp, Artificial Sequence
  dgRNA
  Krtap4-6
gctcatagtcagttc

SEQ ID NO: 12646 - DNA, 15 bp, Artificial Sequence
  dgRNA
  Tmem236
catctgacttctagt

SEQ ID NO: 12647 - DNA, 15 bp, Artificial Sequence
  dgRNA
  Tmem236
tcattgaaccatatg

SEQ ID NO: 12648 - DNA, 15 bp, Artificial Sequence
  dgRNA
  Tmem236
cattgaaccatatga

SEQ ID NO: 12649 - DNA, 15 bp, Artificial Sequence
  dgRNA
  Tmem236
agcgatttgagtaca

SEQ ID NO: 12650 - DNA, 15 bp, Artificial Sequence
  dgRNA
  Trim46
gtgagtagtatgacc

SEQ ID NO: 12651 - DNA, 15 bp, Artificial Sequence
  dgRNA
  Trim46
caagcttctaatagg

SEQ ID NO: 12652 - DNA, 15 bp, Artificial Sequence
  dgRNA
  Trim46
cccctagaccgcctt

SEQ ID NO: 12653 - DNA, 15 bp, Artificial Sequence
  dgRNA
  Trim46
ctttggagaaccacg

SEQ ID NO: 12654 - DNA, 15 bp, Artificial Sequence
  dgRNA
  Tubb2a
ccagcaggaccggct

SEQ ID NO: 12655 - DNA, 15 bp, Artificial Sequence
  dgRNA
  Tubb2a
gcaggaccggctggg

SEQ ID NO: 12656 - DNA, 15 bp, Artificial Sequence
  dgRNA
  Tubb2a
gggcgtaataaccct

SEQ ID NO: 12657 - DNA, 15 bp, Artificial Sequence
  dgRNA
  Tubb2a
cgtaataaccctagg

SEQ ID NO: 12658 - DNA, 15 bp, Artificial Sequence
  dgRNA
  Slc28a1
cggcttgagtgagcc

SEQ ID NO: 12659 - DNA, 15 bp, Artificial Sequence
  dgRNA
  Slc28a1
gggtccccgcccctg

SEQ ID NO: 12660 - DNA, 15 bp, Artificial Sequence
  dgRNA
  Slc28a1
tccccgcccctgcgg

SEQ ID NO: 12661 - DNA, 15 bp, Artificial Sequence
  dgRNA
  Slc28a1
catgatggggtagcc

SEQ ID NO: 12662 - DNA, 15 bp, Artificial Sequence
  dgRNA
  Lamc2
gaggatcgatcctgt

SEQ ID NO: 12663 - DNA, 15 bp, Artificial Sequence
  dgRNA
  Lamc2
aggatcgatcctgtt

SEQ ID NO: 12664 - DNA, 15 bp, Artificial Sequence
  dgRNA
  Lamc2
ttagactagagtgga

SEQ ID NO: 12665 - DNA, 15 bp, Artificial Sequence
  dgRNA
  Lamc2
gcgtccaactgtgac

SEQ ID NO: 12666 - DNA, 15 bp, Artificial Sequence
  dgRNA
  Add1
gggcgttcagaccaa

SEQ ID NO: 12667 - DNA, 15 bp, Artificial Sequence
  dgRNA
  Add1
ggcgttcagaccaat

SEQ ID NO: 12668 - DNA, 15 bp, Artificial Sequence
  dgRNA
  Add1
gcgttcagaccaatg

SEQ ID NO: 12669 - DNA, 15 bp, Artificial Sequence
  dgRNA
  Add1
gggctgtgcattgtt

SEQ ID NO: 12670 - DNA, 15 bp, Artificial Sequence
  dgRNA
  Oprm1
ttgaattgcaaatcc

SEQ ID NO: 12671 - DNA, 15 bp, Artificial Sequence
  dgRNA
  Oprm1
ggctcttcattgcat

SEQ ID NO: 12672 - DNA, 15 bp, Artificial Sequence
  dgRNA
  Oprm1
tgaccaacacatctc

SEQ ID NO: 12673 - DNA, 15 bp, Artificial Sequence
  dgRNA
  Rasgrf1
agctaggagcgagca

SEQ ID NO: 12674 - DNA, 15 bp, Artificial Sequence
  dgRNA
  Rasgrf1
aagtgtagatcttga

SEQ ID NO: 12675 - DNA, 15 bp, Artificial Sequence
  dgRNA
  Rasgrf1
gtgtagatcttgaag

SEQ ID NO: 12676 - DNA, 15 bp, Artificial Sequence
  dgRNA
  Rasgrf1
gatcttgaagggggc

SEQ ID NO: 12677 - DNA, 15 bp, Artificial Sequence
  dgRNA
  Mrgprb4
gcttagcgactgtag

SEQ ID NO: 12678 - DNA, 15 bp, Artificial Sequence
  dgRNA
  Mrgprb4
taccccatatcatat

SEQ ID NO: 12679 - DNA, 15 bp, Artificial Sequence
  dgRNA
  Mrgprb4
cgaaatagtataaac

SEQ ID NO: 12680 - DNA, 15 bp, Artificial Sequence
  dgRNA
  Mrgprb4
gtcgctaagcatttc

SEQ ID NO: 12681 - DNA, 15 bp, Artificial Sequence
  dgRNA
  Sdc2
taggggcggttgaag

SEQ ID NO: 12682 - DNA, 15 bp, Artificial Sequence
  dgRNA
  Sdc2
gggcggttgaagcgg

SEQ ID NO: 12683 - DNA, 15 bp, Artificial Sequence
  dgRNA
  Sdc2
tccgtgtcctctccc

SEQ ID NO: 12684 - DNA, 15 bp, Artificial Sequence
  dgRNA
  Pltp
gctgtctggacaagt

SEQ ID NO: 12685 - DNA, 15 bp, Artificial Sequence
  dgRNA
  Pltp
cgctggcagttggga

SEQ ID NO: 12686 - DNA, 15 bp, Artificial Sequence
  dgRNA
  Pltp
acgctggcagttggg

SEQ ID NO: 12687 - DNA, 15 bp, Artificial Sequence
  dgRNA
  Pltp
gggacgctggcagtt

SEQ ID NO: 12688 - DNA, 15 bp, Artificial Sequence
  dgRNA
  Mndal
cacccttaagtctac

SEQ ID NO: 12689 - DNA, 15 bp, Artificial Sequence
  dgRNA
  Mndal
agtagacttaagggt

SEQ ID NO: 12690 - DNA, 15 bp, Artificial Sequence
  dgRNA
  Mndal
cagtagacttaaggg

SEQ ID NO: 12691 - DNA, 15 bp, Artificial Sequence
  dgRNA
  Mndal
gtccagtagacttaa

SEQ ID NO: 12692 - DNA, 15 bp, Artificial Sequence
  dgRNA
  Ppara
gcgcgcttggccctg

SEQ ID NO: 12693 - DNA, 15 bp, Artificial Sequence
  dgRNA
  Ppara
gccctgcggacccgc

SEQ ID NO: 12694 - DNA, 15 bp, Artificial Sequence
  dgRNA
  Ppara
ctgcggacccgcagg

SEQ ID NO: 12695 - DNA, 15 bp, Artificial Sequence
  dgRNA
  Ppara
gcggagtgcagcctc

SEQ ID NO: 12696 - DNA, 15 bp, Artificial Sequence
  dgRNA
  Lamb3
agggagctctccgag

SEQ ID NO: 12697 - DNA, 15 bp, Artificial Sequence
  dgRNA
  Lamb3
gggagctctccgaga

SEQ ID NO: 12698 - DNA, 15 bp, Artificial Sequence
  dgRNA
  Lamb3
tctccgagagggatc

SEQ ID NO: 12699 - DNA, 15 bp, Artificial Sequence
  dgRNA
  Lamb3
gccaaggccgattgc

SEQ ID NO: 12700 - DNA, 15 bp, Artificial Sequence
  dgRNA
  Dnaaf3
caccctactctggtc

SEQ ID NO: 12701 - DNA, 15 bp, Artificial Sequence
  dgRNA
  Dnaaf3
tatgacaaccgcgtc

SEQ ID NO: 12702 - DNA, 15 bp, Artificial Sequence
  dgRNA
  Dnaaf3
accgcagccatctcc

SEQ ID NO: 12703 - DNA, 15 bp, Artificial Sequence
  dgRNA
  Dnaaf3
tcccggagcttctat

SEQ ID NO: 12704 - DNA, 15 bp, Artificial Sequence
  dgRNA
  Slc35b2
ggagggagtcccaac

SEQ ID NO: 12705 - DNA, 15 bp, Artificial Sequence
  dgRNA
  Slc35b2
caactggagttcccc

SEQ ID NO: 12706 - DNA, 15 bp, Artificial Sequence
  dgRNA
  Slc35b2
caggggaaccgggct

SEQ ID NO: 12707 - DNA, 15 bp, Artificial Sequence
  dgRNA
  Slc35b2
tgcctccgggccgcg

SEQ ID NO: 12708 - DNA, 15 bp, Artificial Sequence
  dgRNA
  Sec16b
caaatatgcccagtc

SEQ ID NO: 12709 - DNA, 15 bp, Artificial Sequence
  dgRNA
  Sec16b
aaatatgcccagtca

SEQ ID NO: 12710 - DNA, 15 bp, Artificial Sequence
  dgRNA
  Sec16b
aatgaatcagctccg

SEQ ID NO: 12711 - DNA, 15 bp, Artificial Sequence
  dgRNA
  Sec16b
gccgggcagttgcaa

SEQ ID NO: 12712 - DNA, 15 bp, Artificial Sequence
  dgRNA
  Stil
gcgagcgctaatccc

SEQ ID NO: 12713 - DNA, 15 bp, Artificial Sequence
  dgRNA
  Stil
gcgctaatcccaggc

SEQ ID NO: 12714 - DNA, 15 bp, Artificial Sequence
  dgRNA
  Stil
cgctaatcccaggct

SEQ ID NO: 12715 - DNA, 15 bp, Artificial Sequence
  dgRNA
  Stil
aggctgggctccgat

SEQ ID NO: 12716 - DNA, 15 bp, Artificial Sequence
  dgRNA
  Tmem191c
tttgtatacctgaat

SEQ ID NO: 12717 - DNA, 15 bp, Artificial Sequence
  dgRNA
  Tmem191c
tatacctgaattggt

SEQ ID NO: 12718 - DNA, 15 bp, Artificial Sequence
  dgRNA
  Tmem191c
atacctgaattggtc

SEQ ID NO: 12719 - DNA, 15 bp, Artificial Sequence
  dgRNA
  Tmem191c
gggcgtgatccgtct

SEQ ID NO: 12720 - DNA, 15 bp, Artificial Sequence
  dgRNA
  Ccr3
tgagtcaatgattat

SEQ ID NO: 12721 - DNA, 15 bp, Artificial Sequence
  dgRNA
  Ccr3
gagtcaatgattatt

SEQ ID NO: 12722 - DNA, 15 bp, Artificial Sequence
  dgRNA
  Ccr3
gacagcaaatttgct

SEQ ID NO: 12723 - DNA, 15 bp, Artificial Sequence
  dgRNA
  Rasal3
ccagcctgactgtaa

SEQ ID NO: 12724 - DNA, 15 bp, Artificial Sequence
  dgRNA
  Rasal3
agcctgactgtaaag

SEQ ID NO: 12725 - DNA, 15 bp, Artificial Sequence
  dgRNA
  Rasal3
cgggggagacaagac

SEQ ID NO: 12726 - DNA, 15 bp, Artificial Sequence
  dgRNA
  Rasal3
caagacagggtcacg

SEQ ID NO: 12727 - DNA, 15 bp, Artificial Sequence
  dgRNA
  Ak1
tgtggagagtcgtgc

SEQ ID NO: 12728 - DNA, 15 bp, Artificial Sequence
  dgRNA
  Ak1
cgtgcgggcatagag

SEQ ID NO: 12729 - DNA, 15 bp, Artificial Sequence
  dgRNA
  Ak1
gcgggcatagagtgg

SEQ ID NO: 12730 - DNA, 15 bp, Artificial Sequence
  dgRNA
  Ak1
atctcgccagagtgc

SEQ ID NO: 12731 - DNA, 15 bp, Artificial Sequence
  dgRNA
  Naa10
acttcccgccttgaa

SEQ ID NO: 12732 - DNA, 15 bp, Artificial Sequence
  dgRNA
  Naa10
tcaaacgcaccacct

SEQ ID NO: 12733 - DNA, 15 bp, Artificial Sequence
  dgRNA
  Naa10
caaacgcaccacctt

SEQ ID NO: 12734 - DNA, 15 bp, Artificial Sequence
  dgRNA
  Naa10
aagtgccacgctcat

SEQ ID NO: 12735 - DNA, 15 bp, Artificial Sequence
  dgRNA
  Suclg1
tgcaggatcacggtc

SEQ ID NO: 12736 - DNA, 15 bp, Artificial Sequence
  dgRNA
  Suclg1
cctcagcgtttgtca

SEQ ID NO: 12737 - DNA, 15 bp, Artificial Sequence
  dgRNA
  Suclg1
tgtcacggcttttcc

SEQ ID NO: 12738 - DNA, 15 bp, Artificial Sequence
  dgRNA
  Suclg1
gtcacggcttttcct

SEQ ID NO: 12739 - DNA, 15 bp, Artificial Sequence
  dgRNA
  Irgm1
cccgacccctgttga

SEQ ID NO: 12740 - DNA, 15 bp, Artificial Sequence
  dgRNA
  Irgm1
ccccgctcccccgct

SEQ ID NO: 12741 - DNA, 15 bp, Artificial Sequence
  dgRNA
  Irgm1
tcccccgctgggccc

SEQ ID NO: 12742 - DNA, 15 bp, Artificial Sequence
  dgRNA
  Irgm1
gtcgggatgagggat

SEQ ID NO: 12743 - DNA, 15 bp, Artificial Sequence
  dgRNA
  Fam220a
actcttcaccattag

SEQ ID NO: 12744 - DNA, 15 bp, Artificial Sequence
  dgRNA
  Fam220a
gcgcacttcacttgc

SEQ ID NO: 12745 - DNA, 15 bp, Artificial Sequence
  dgRNA
  Fam220a
caggaaagccgcccg

SEQ ID NO: 12746 - DNA, 15 bp, Artificial Sequence
  dgRNA
  Fam220a
aggaaagccgcccga

SEQ ID NO: 12747 - DNA, 15 bp, Artificial Sequence
  dgRNA
  Mapk8
gccacgcccaagtcg

SEQ ID NO: 12748 - DNA, 15 bp, Artificial Sequence
  dgRNA
  Mapk8
ccacgcccaagtcgc

SEQ ID NO: 12749 - DNA, 15 bp, Artificial Sequence
  dgRNA
  Mapk8
cacgcccaagtcgcg

SEQ ID NO: 12750 - DNA, 15 bp, Artificial Sequence
  dgRNA
  Mapk8
cacgccctcgtaatc

SEQ ID NO: 12751 - DNA, 15 bp, Artificial Sequence
  dgRNA
  Tmem45a
tttctaggatgcgag

SEQ ID NO: 12752 - DNA, 15 bp, Artificial Sequence
  dgRNA
  Tmem45a
atgcgagtggcccag

SEQ ID NO: 12753 - DNA, 15 bp, Artificial Sequence
  dgRNA
  Tmem45a
tgcgagtggcccagt

SEQ ID NO: 12754 - DNA, 15 bp, Artificial Sequence
  dgRNA
  Tmem45a
gcagattgagcccgc

SEQ ID NO: 12755 - DNA, 15 bp, Artificial Sequence
  dgRNA
  Mybpc1
atctgccacacgaga

SEQ ID NO: 12756 - DNA, 15 bp, Artificial Sequence
  dgRNA
  Mybpc1
ccacacgagacggac

SEQ ID NO: 12757 - DNA, 15 bp, Artificial Sequence
  dgRNA
  Mybpc1
tccttgtgccgaagt

SEQ ID NO: 12758 - DNA, 15 bp, Artificial Sequence
  dgRNA
  Mybpc1
ccttgtgccgaagta

SEQ ID NO: 12759 - DNA, 15 bp, Artificial Sequence
  dgRNA
  Inpp5e
cgagatctttagtgt

SEQ ID NO: 12760 - DNA, 15 bp, Artificial Sequence
  dgRNA
  Inpp5e
gtgttggtagagcct

SEQ ID NO: 12761 - DNA, 15 bp, Artificial Sequence
  dgRNA
  Inpp5e
tgttggtagagcctt

SEQ ID NO: 12762 - DNA, 15 bp, Artificial Sequence
  dgRNA
  Inpp5e
ccttgggcagctatt

SEQ ID NO: 12763 - DNA, 15 bp, Artificial Sequence
  dgRNA
  Mesdc1
agcctctccggatgc

SEQ ID NO: 12764 - DNA, 15 bp, Artificial Sequence
  dgRNA
  Mesdc1
gcctctccggatgca

SEQ ID NO: 12765 - DNA, 15 bp, Artificial Sequence
  dgRNA
  Mesdc1
gggaccaccggcccc

SEQ ID NO: 12766 - DNA, 15 bp, Artificial Sequence
  dgRNA
  Mesdc1
ccagggccgcagcgt

SEQ ID NO: 12767 - DNA, 15 bp, Artificial Sequence
  dgRNA
  Pygo1
agcccggccccgtgc

SEQ ID NO: 12768 - DNA, 15 bp, Artificial Sequence
  dgRNA
  Pygo1
gcccggccccgtgct

SEQ ID NO: 12769 - DNA, 15 bp, Artificial Sequence
  dgRNA
  Pygo1
gccacgtcccccgag

SEQ ID NO: 12770 - DNA, 15 bp, Artificial Sequence
  dgRNA
  Pygo1
ccgagcggccgctgc

SEQ ID NO: 12771 - DNA, 15 bp, Artificial Sequence
  dgRNA
  Homer3
cccgccctccgtagc

SEQ ID NO: 12772 - DNA, 15 bp, Artificial Sequence
  dgRNA
  Homer3
ccgtagctggccagc

SEQ ID NO: 12773 - DNA, 15 bp, Artificial Sequence
  dgRNA
  Homer3
cgctgggcagaggcg

SEQ ID NO: 12774 - DNA, 15 bp, Artificial Sequence
  dgRNA
  Homer3
ttgggcggggtgaaa

SEQ ID NO: 12775 - DNA, 15 bp, Artificial Sequence
  dgRNA
  Ltbp3
accccctgattcccc

SEQ ID NO: 12776 - DNA, 15 bp, Artificial Sequence
  dgRNA
  Ltbp3
gttgggctcggcttt

SEQ ID NO: 12777 - DNA, 15 bp, Artificial Sequence
  dgRNA
  Ltbp3
gggtggtaatctgat

SEQ ID NO: 12778 - DNA, 15 bp, Artificial Sequence
  dgRNA
  Ltbp3
ggggtggtaatctga

SEQ ID NO: 12779 - DNA, 15 bp, Artificial Sequence
  dgRNA
  Clip2
gtagatggtcttgat

SEQ ID NO: 12780 - DNA, 15 bp, Artificial Sequence
  dgRNA
  Clip2
cggagaccaggattg

SEQ ID NO: 12781 - DNA, 15 bp, Artificial Sequence
  dgRNA
  Clip2
cgcccgccgctacgc

SEQ ID NO: 12782 - DNA, 15 bp, Artificial Sequence
  dgRNA
  Clip2
gacgcgcaaagactg

SEQ ID NO: 12783 - DNA, 15 bp, Artificial Sequence
  dgRNA
  Igfn1
cgtccctctcaaaga

SEQ ID NO: 12784 - DNA, 15 bp, Artificial Sequence
  dgRNA
  Igfn1
catgccatgtccctc

SEQ ID NO: 12785 - DNA, 15 bp, Artificial Sequence
  dgRNA
  Igfn1
catttagtagagggc

SEQ ID NO: 12786 - DNA, 15 bp, Artificial Sequence
  dgRNA
  Igfn1
gggacatttagtaga

SEQ ID NO: 12787 - DNA, 15 bp, Artificial Sequence
  dgRNA
  Kctd10
actaaacgcctgact

SEQ ID NO: 12788 - DNA, 15 bp, Artificial Sequence
  dgRNA
  Kctd10
cgcctgactcggcca

SEQ ID NO: 12789 - DNA, 15 bp, Artificial Sequence
  dgRNA
  Kctd10
gcctgactcggccaa

SEQ ID NO: 12790 - DNA, 15 bp, Artificial Sequence
  dgRNA
  Kctd10
cctgactcggccaag

SEQ ID NO: 12791 - DNA, 15 bp, Artificial Sequence
  dgRNA
  Ets1
cgcgcgcggaatagc

SEQ ID NO: 12792 - DNA, 15 bp, Artificial Sequence
  dgRNA
  Ets1
ctggagcagcgccgc

SEQ ID NO: 12793 - DNA, 15 bp, Artificial Sequence
  dgRNA
  Ets1
tggagcagcgccgcc

SEQ ID NO: 12794 - DNA, 15 bp, Artificial Sequence
  dgRNA
  Ets1
cagcgccgccgggcc

SEQ ID NO: 12795 - DNA, 15 bp, Artificial Sequence
  dgRNA
  Pdia5
ctactctgcgtcctc

SEQ ID NO: 12796 - DNA, 15 bp, Artificial Sequence
  dgRNA
  Pdia5
ctcaggcaaagtccg

SEQ ID NO: 12797 - DNA, 15 bp, Artificial Sequence
  dgRNA
  Pdia5
caaagtccgaggcag

SEQ ID NO: 12798 - DNA, 15 bp, Artificial Sequence
  dgRNA
  Pdia5
ctggtgcgcatgctt

SEQ ID NO: 12799 - DNA, 15 bp, Artificial Sequence
  dgRNA
  Olfr356
ctactagagctaatg

SEQ ID NO: 12800 - DNA, 15 bp, Artificial Sequence
  dgRNA
  Olfr356
tcatgaccagatcag

SEQ ID NO: 12801 - DNA, 15 bp, Artificial Sequence
  dgRNA
  Olfr356
tctagtagcactaga

SEQ ID NO: 12802 - DNA, 15 bp, Artificial Sequence
  dgRNA
  Olfr356
attgatcctctgatc

SEQ ID NO: 12803 - DNA, 15 bp, Artificial Sequence
  dgRNA
  Ece2
tgccacgaggagatg

SEQ ID NO: 12804 - DNA, 15 bp, Artificial Sequence
  dgRNA
  Ece2
gtggtcgagtttaga

SEQ ID NO: 12805 - DNA, 15 bp, Artificial Sequence
  dgRNA
  Ece2
tggtcgagtttagac

SEQ ID NO: 12806 - DNA, 15 bp, Artificial Sequence
  dgRNA
  Ece2
tcttacctcggtgat

SEQ ID NO: 12807 - DNA, 15 bp, Artificial Sequence
  dgRNA
  U2af2
aaagttaccgaaact

SEQ ID NO: 12808 - DNA, 15 bp, Artificial Sequence
  dgRNA
  U2af2
aagttaccgaaactc

SEQ ID NO: 12809 - DNA, 15 bp, Artificial Sequence
  dgRNA
  U2af2
cgaaactcgggcagc

SEQ ID NO: 12810 - DNA, 15 bp, Artificial Sequence
  dgRNA
  U2af2
gcataatcctcgctt

SEQ ID NO: 12811 - DNA, 15 bp, Artificial Sequence
  dgRNA
  Golga7
cttcttccgcccgga

SEQ ID NO: 12812 - DNA, 15 bp, Artificial Sequence
  dgRNA
  Golga7
ttcttccgcccggaa

SEQ ID NO: 12813 - DNA, 15 bp, Artificial Sequence
  dgRNA
  Golga7
cgcaacgcgcagccg

SEQ ID NO: 12814 - DNA, 15 bp, Artificial Sequence
  dgRNA
  Golga7
aacgcgcagccgcgg

SEQ ID NO: 12815 - DNA, 15 bp, Artificial Sequence
  dgRNA
  Cd59a
atcaagagcctttta

SEQ ID NO: 12816 - DNA, 15 bp, Artificial Sequence
  dgRNA
  Cd59a
tttagggtgttagtt

SEQ ID NO: 12817 - DNA, 15 bp, Artificial Sequence
  dgRNA
  Cd59a
aactaacaccctaaa

SEQ ID NO: 12818 - DNA, 15 bp, Artificial Sequence
  dgRNA
  Wiz
ggccataggctttga

SEQ ID NO: 12819 - DNA, 15 bp, Artificial Sequence
  dgRNA
  Wiz
ctagggttctgagag

SEQ ID NO: 12820 - DNA, 15 bp, Artificial Sequence
  dgRNA
  Wiz
gtgaagattcacggc

SEQ ID NO: 12821 - DNA, 15 bp, Artificial Sequence
  dgRNA
  Wiz
cttagttgaagtgag

SEQ ID NO: 12822 - DNA, 15 bp, Artificial Sequence
  dgRNA
  F2
tagaacatccaccgc

SEQ ID NO: 12823 - DNA, 15 bp, Artificial Sequence
  dgRNA
  F2
tccaccgctggttcc

SEQ ID NO: 12824 - DNA, 15 bp, Artificial Sequence
  dgRNA
  F2
gtcctcttgaatgtc

SEQ ID NO: 12825 - DNA, 15 bp, Artificial Sequence
  dgRNA
  F2
cttgaatgtcagggg

SEQ ID NO: 12826 - DNA, 15 bp, Artificial Sequence
  dgRNA
  Scai
tctcaaccaaacctc

SEQ ID NO: 12827 - DNA, 15 bp, Artificial Sequence
  dgRNA
  Scai
ctcaaccaaacctcg

SEQ ID NO: 12828 - DNA, 15 bp, Artificial Sequence
  dgRNA
  Scai
aaccaaacctcgggg

SEQ ID NO: 12829 - DNA, 15 bp, Artificial Sequence
  dgRNA
  Scai
accaaacctcggggt

SEQ ID NO: 12830 - DNA, 15 bp, Artificial Sequence
  dgRNA
  Fam71e2
gtgtcatcacaatct

SEQ ID NO: 12831 - DNA, 15 bp, Artificial Sequence
  dgRNA
  Fam71e2
gtccacaccttattc

SEQ ID NO: 12832 - DNA, 15 bp, Artificial Sequence
  dgRNA
  Fam71e2
caccttattctggaa

SEQ ID NO: 12833 - DNA, 15 bp, Artificial Sequence
  dgRNA
  Fam71e2
ccctaggcagttccc

SEQ ID NO: 12834 - DNA, 15 bp, Artificial Sequence
  dgRNA
  Cfap43
cagggtcccaccgct

SEQ ID NO: 12835 - DNA, 15 bp, Artificial Sequence
  dgRNA
  Cfap43
tcgccgctcgcccat

SEQ ID NO: 12836 - DNA, 15 bp, Artificial Sequence
  dgRNA
  Cfap43
ccgctcgcccatagg

SEQ ID NO: 12837 - DNA, 15 bp, Artificial Sequence
  dgRNA
  Cfap43
gcgcccgccagccaa

SEQ ID NO: 12838 - DNA, 15 bp, Artificial Sequence
  dgRNA
  1700016H13Rik
catcaggcgctcacc

SEQ ID NO: 12839 - DNA, 15 bp, Artificial Sequence
  dgRNA
  1700016H13Rik
ggtgcggggctcatc

SEQ ID NO: 12840 - DNA, 15 bp, Artificial Sequence
  dgRNA
  Ces2h
ccaaaatcagcagac

SEQ ID NO: 12841 - DNA, 15 bp, Artificial Sequence
  dgRNA
  Ces2h
cgactctgagcagac

SEQ ID NO: 12842 - DNA, 15 bp, Artificial Sequence
  dgRNA
  Ppp1r35
atccgtagagtacct

SEQ ID NO: 12843 - DNA, 15 bp, Artificial Sequence
  dgRNA
  Ppp1r35
tccgtagagtaccta

SEQ ID NO: 12844 - DNA, 15 bp, Artificial Sequence
  dgRNA
  Ppp1r35
aacgccccgccttaa

SEQ ID NO: 12845 - DNA, 15 bp, Artificial Sequence
  dgRNA
  Ppp1r35
cgaagttagcgtgtg

SEQ ID NO: 12846 - DNA, 15 bp, Artificial Sequence
  dgRNA
  Dusp8
ggcgcgggggacgga

SEQ ID NO: 12847 - DNA, 15 bp, Artificial Sequence
  dgRNA
  Dusp8
cccacggccgccgcc

SEQ ID NO: 12848 - DNA, 15 bp, Artificial Sequence
  dgRNA
  Dusp8
ccacggccgccgcca

SEQ ID NO: 12849 - DNA, 15 bp, Artificial Sequence
  dgRNA
  Dusp8
tcacctgcccccgag

SEQ ID NO: 12850 - DNA, 15 bp, Artificial Sequence
  dgRNA
  Il17rb
tgcggtcgccccacc

SEQ ID NO: 12851 - DNA, 15 bp, Artificial Sequence
  dgRNA
  Il17rb
acacacctgtgcgcg

SEQ ID NO: 12852 - DNA, 15 bp, Artificial Sequence
  dgRNA
  Il17rb
acgccccgcgcctgc

SEQ ID NO: 12853 - DNA, 15 bp, Artificial Sequence
  dgRNA
  Il17rb
ccccgcgagccccga

SEQ ID NO: 12854 - DNA, 15 bp, Artificial Sequence
  dgRNA
  Prl8a8
atgttgtaataagtc

SEQ ID NO: 12855 - DNA, 15 bp, Artificial Sequence
  dgRNA
  Prl8a8
gctgtacatgccctt

SEQ ID NO: 12856 - DNA, 15 bp, Artificial Sequence
  dgRNA
  Prl8a8
tctaccagaatatat

SEQ ID NO: 12857 - DNA, 15 bp, Artificial Sequence
  dgRNA
  Prl8a8
atacttatgagcatc

SEQ ID NO: 12858 - DNA, 15 bp, Artificial Sequence
  dgRNA
  Lysmd3
ggcggggctgaaatc

SEQ ID NO: 12859 - DNA, 15 bp, Artificial Sequence
  dgRNA
  Lysmd3
aatcaggccccgccc

SEQ ID NO: 12860 - DNA, 15 bp, Artificial Sequence
  dgRNA
  Lysmd3
ccgccccggccgcat

SEQ ID NO: 12861 - DNA, 15 bp, Artificial Sequence
  dgRNA
  Lysmd3
ggcgcgcctgcgtgc

SEQ ID NO: 12862 - DNA, 15 bp, Artificial Sequence
  dgRNA
  Fam107b
aaacccgcacaacag

SEQ ID NO: 12863 - DNA, 15 bp, Artificial Sequence
  dgRNA
  Fam107b
aaggctgaaagctcg

SEQ ID NO: 12864 - DNA, 15 bp, Artificial Sequence
  dgRNA
  Fam107b
aggctgaaagctcgg

SEQ ID NO: 12865 - DNA, 15 bp, Artificial Sequence
  dgRNA
  Fam107b
ggctgaaagctcggg

SEQ ID NO: 12866 - DNA, 15 bp, Artificial Sequence
  dgRNA
  Lace1
actacaagctacaat

SEQ ID NO: 12867 - DNA, 15 bp, Artificial Sequence
  dgRNA
  Lace1
tacaattggtttctc

SEQ ID NO: 12868 - DNA, 15 bp, Artificial Sequence
  dgRNA
  Lace1
aactagggtttcagt

SEQ ID NO: 12869 - DNA, 15 bp, Artificial Sequence
  dgRNA
  Lace1
actagggtttcagtg

SEQ ID NO: 12870 - DNA, 15 bp, Artificial Sequence
  dgRNA
  Phactr3
gcagtccgtgctgca

SEQ ID NO: 12871 - DNA, 15 bp, Artificial Sequence
  dgRNA
  Phactr3
tgccccgagctctag

SEQ ID NO: 12872 - DNA, 15 bp, Artificial Sequence
  dgRNA
  Phactr3
ctgccctaattttgt

SEQ ID NO: 12873 - DNA, 15 bp, Artificial Sequence
  dgRNA
  Phactr3
acaatccatgcagca

SEQ ID NO: 12874 - DNA, 15 bp, Artificial Sequence
  dgRNA
  Myo1e
ggacggctaggacag

SEQ ID NO: 12875 - DNA, 15 bp, Artificial Sequence
  dgRNA
  Myo1e
cagcggcgcgctctg

SEQ ID NO: 12876 - DNA, 15 bp, Artificial Sequence
  dgRNA
  Myo1e
agcggcgcgctctgc

SEQ ID NO: 12877 - DNA, 15 bp, Artificial Sequence
  dgRNA
  Myo1e
gcggcgcgctctgcg

SEQ ID NO: 12878 - DNA, 15 bp, Artificial Sequence
  dgRNA
  Tex264
cggagcgagcgcgag

SEQ ID NO: 12879 - DNA, 15 bp, Artificial Sequence
  dgRNA
  Tex264
ggggcaagcgcacac

SEQ ID NO: 12880 - DNA, 15 bp, Artificial Sequence
  dgRNA
  Tex264
gcccgtccgcgtccg

SEQ ID NO: 12881 - DNA, 15 bp, Artificial Sequence
  dgRNA
  Tex264
cccgtccgcgtccgt

SEQ ID NO: 12882 - DNA, 15 bp, Artificial Sequence
  dgRNA
  Zbtb4
tcgtctgcgctttgc

SEQ ID NO: 12883 - DNA, 15 bp, Artificial Sequence
  dgRNA
  Zbtb4
gcttcctctcagcgg

SEQ ID NO: 12884 - DNA, 15 bp, Artificial Sequence
  dgRNA
  Zbtb4
tctcagcggcggcgc

SEQ ID NO: 12885 - DNA, 15 bp, Artificial Sequence
  dgRNA
  Zbtb4
ctcagcggcggcgct

SEQ ID NO: 12886 - DNA, 15 bp, Artificial Sequence
  dgRNA
  Rapgef3
ccactgacgtagtct

SEQ ID NO: 12887 - DNA, 15 bp, Artificial Sequence
  dgRNA
  Rapgef3
cactgacgtagtctc

SEQ ID NO: 12888 - DNA, 15 bp, Artificial Sequence
  dgRNA
  Rapgef3
gacgtagtctcgggt

SEQ ID NO: 12889 - DNA, 15 bp, Artificial Sequence
  dgRNA
  Rapgef3
acgtagtctcgggta

SEQ ID NO: 12890 - DNA, 15 bp, Artificial Sequence
  dgRNA
  Rab44
ctgaggactacggtt

SEQ ID NO: 12891 - DNA, 15 bp, Artificial Sequence
  dgRNA
  Rab44
tgaggactacggtta

SEQ ID NO: 12892 - DNA, 15 bp, Artificial Sequence
  dgRNA
  Rab44
ctacggttagggata

SEQ ID NO: 12893 - DNA, 15 bp, Artificial Sequence
  dgRNA
  Rab44
gcctttggggacggg

SEQ ID NO: 12894 - DNA, 15 bp, Artificial Sequence
  dgRNA
  Eya1
ttaattgggagctac

SEQ ID NO: 12895 - DNA, 15 bp, Artificial Sequence
  dgRNA
  Eya1
tgggagctactggcg

SEQ ID NO: 12896 - DNA, 15 bp, Artificial Sequence
  dgRNA
  Eya1
gggagctactggcgc

SEQ ID NO: 12897 - DNA, 15 bp, Artificial Sequence
  dgRNA
  Eya1
agctactggcgcggg

SEQ ID NO: 12898 - DNA, 15 bp, Artificial Sequence
  dgRNA
  Cklf
cccgcgctagtgcgc

SEQ ID NO: 12899 - DNA, 15 bp, Artificial Sequence
  dgRNA
  Cklf
aggcgcgcccggact

SEQ ID NO: 12900 - DNA, 15 bp, Artificial Sequence
  dgRNA
  Cklf
gacttggcctgagcg

SEQ ID NO: 12901 - DNA, 15 bp, Artificial Sequence
  dgRNA
  Cklf
tgagcgcggtgccgc

SEQ ID NO: 12902 - DNA, 15 bp, Artificial Sequence
  dgRNA
  Dennd6a
cagcagagatagccg

SEQ ID NO: 12903 - DNA, 15 bp, Artificial Sequence
  dgRNA
  Dennd6a
atagccgcggcttgt

SEQ ID NO: 12904 - DNA, 15 bp, Artificial Sequence
  dgRNA
  Dennd6a
tagccgcggcttgta

SEQ ID NO: 12905 - DNA, 15 bp, Artificial Sequence
  dgRNA
  Dennd6a
gaaccccccgctccc

SEQ ID NO: 12906 - DNA, 15 bp, Artificial Sequence
  dgRNA
  Tmsb4x
ccttaggtgccactc

SEQ ID NO: 12907 - DNA, 15 bp, Artificial Sequence
  dgRNA
  Tmsb4x
ccttaagaacaggtt

SEQ ID NO: 12908 - DNA, 15 bp, Artificial Sequence
  dgRNA
  Tmsb4x
aaaatagacgtcaaa

SEQ ID NO: 12909 - DNA, 15 bp, Artificial Sequence
  dgRNA
  Tmsb4x
aaatagacgtcaaat

SEQ ID NO: 12910 - DNA, 15 bp, Artificial Sequence
  dgRNA
  Krtcap3
gtgcttgcggctcag

SEQ ID NO: 12911 - DNA, 15 bp, Artificial Sequence
  dgRNA
  Krtcap3
tgcttgcggctcagt

SEQ ID NO: 12912 - DNA, 15 bp, Artificial Sequence
  dgRNA
  Krtcap3
ttgcggctcagtggg

SEQ ID NO: 12913 - DNA, 15 bp, Artificial Sequence
  dgRNA
  Krtcap3
gtggcaccgccgctt

SEQ ID NO: 12914 - DNA, 15 bp, Artificial Sequence
  dgRNA
  Kcnv2
caccctccacgtcag

SEQ ID NO: 12915 - DNA, 15 bp, Artificial Sequence
  dgRNA
  Kcnv2
accctccacgtcaga

SEQ ID NO: 12916 - DNA, 15 bp, Artificial Sequence
  dgRNA
  Kcnv2
ccctccacgtcagag

SEQ ID NO: 12917 - DNA, 15 bp, Artificial Sequence
  dgRNA
  Kcnv2
cctccacgtcagagg

SEQ ID NO: 12918 - DNA, 15 bp, Artificial Sequence
  dgRNA
  Fam53a
gggcggggcgtcacg

SEQ ID NO: 12919 - DNA, 15 bp, Artificial Sequence
  dgRNA
  Fam53a
acacccacaacacgc

SEQ ID NO: 12920 - DNA, 15 bp, Artificial Sequence
  dgRNA
  Fam53a
cacccacaacacgcc

SEQ ID NO: 12921 - DNA, 15 bp, Artificial Sequence
  dgRNA
  Fam53a
acgtcgcccgcctag

SEQ ID NO: 12922 - DNA, 15 bp, Artificial Sequence
  dgRNA
  Sdhc
aagcccggaacacaa

SEQ ID NO: 12923 - DNA, 15 bp, Artificial Sequence
  dgRNA
  Sdhc
cccggaacacaaagg

SEQ ID NO: 12924 - DNA, 15 bp, Artificial Sequence
  dgRNA
  Sdhc
tccgcccccaaaggc

SEQ ID NO: 12925 - DNA, 15 bp, Artificial Sequence
  dgRNA
  Sdhc
ggcagggccacacgg

SEQ ID NO: 12926 - DNA, 15 bp, Artificial Sequence
  dgRNA
  Mastl
ttctagctcatgcgg

SEQ ID NO: 12927 - DNA, 15 bp, Artificial Sequence
  dgRNA
  Mastl
tctagctcatgcgga

SEQ ID NO: 12928 - DNA, 15 bp, Artificial Sequence
  dgRNA
  Mastl
agctcatgcggaggg

SEQ ID NO: 12929 - DNA, 15 bp, Artificial Sequence
  dgRNA
  Mastl
gctcatgcggaggga

SEQ ID NO: 12930 - DNA, 15 bp, Artificial Sequence
  dgRNA
  Grip1
tggaggcgagcagcg

SEQ ID NO: 12931 - DNA, 15 bp, Artificial Sequence
  dgRNA
  Grip1
gtcgcctcaatgtat

SEQ ID NO: 12932 - DNA, 15 bp, Artificial Sequence
  dgRNA
  Grip1
tcgcctcaatgtatc

SEQ ID NO: 12933 - DNA, 15 bp, Artificial Sequence
  dgRNA
  Grip1
cgcctcaatgtatcg

SEQ ID NO: 12934 - DNA, 15 bp, Artificial Sequence
  dgRNA
  Ccdc85c
ggccaatcagacctg

SEQ ID NO: 12935 - DNA, 15 bp, Artificial Sequence
  dgRNA
  Ccdc85c
gccaatcagacctgt

SEQ ID NO: 12936 - DNA, 15 bp, Artificial Sequence
  dgRNA
  Ccdc85c
gctcgagcgcgcctc

SEQ ID NO: 12937 - DNA, 15 bp, Artificial Sequence
  dgRNA
  Ccdc85c
gagcgcgcctctggc

SEQ ID NO: 12938 - DNA, 15 bp, Artificial Sequence
  dgRNA
  Il1r1
tatttcataagggcc

SEQ ID NO: 12939 - DNA, 15 bp, Artificial Sequence
  dgRNA
  Il1r1
ggattaaaacccaag

SEQ ID NO: 12940 - DNA, 15 bp, Artificial Sequence
  dgRNA
  Il1r1
gaaatattagtaccc

SEQ ID NO: 12941 - DNA, 15 bp, Artificial Sequence
  dgRNA
  Il1r1
ttcagcaaacgtgcc

SEQ ID NO: 12942 - DNA, 15 bp, Artificial Sequence
  dgRNA
  Slc35b4
ccattccaaccttta

SEQ ID NO: 12943 - DNA, 15 bp, Artificial Sequence
  dgRNA
  Slc35b4
gaacacgaacagcat

SEQ ID NO: 12944 - DNA, 15 bp, Artificial Sequence
  dgRNA
  Slc35b4
aacacgaacagcatt

SEQ ID NO: 12945 - DNA, 15 bp, Artificial Sequence
  dgRNA
  Slc35b4
actcacgcgagcctt

SEQ ID NO: 12946 - DNA, 15 bp, Artificial Sequence
  dgRNA
  Hba-x
ctgacattaggtgac

SEQ ID NO: 12947 - DNA, 15 bp, Artificial Sequence
  dgRNA
  Hba-x
acctcctgacatggc

SEQ ID NO: 12948 - DNA, 15 bp, Artificial Sequence
  dgRNA
  Hba-x
ggcccctatctctcc

SEQ ID NO: 12949 - DNA, 15 bp, Artificial Sequence
  dgRNA
  4930453N24Rik
gaccttcaaaagtac

SEQ ID NO: 12950 - DNA, 15 bp, Artificial Sequence
  dgRNA
  4930453N24Rik
agtacaggggtatga

SEQ ID NO: 12951 - DNA, 15 bp, Artificial Sequence
  dgRNA
  4930453N24Rik
tttaagtcgcccctt

SEQ ID NO: 12952 - DNA, 15 bp, Artificial Sequence
  dgRNA
  4930453N24Rik
aagtcgccccttcgg

SEQ ID NO: 12953 - DNA, 15 bp, Artificial Sequence
  dgRNA
  Thap1
aaacgcgctctcttc

SEQ ID NO: 12954 - DNA, 15 bp, Artificial Sequence
  dgRNA
  Thap1
gctctcttccggcca

SEQ ID NO: 12955 - DNA, 15 bp, Artificial Sequence
  dgRNA
  Thap1
ccggccaaggcgcag

SEQ ID NO: 12956 - DNA, 15 bp, Artificial Sequence
  dgRNA
  Thap1
cggccaaggcgcaga

SEQ ID NO: 12957 - DNA, 15 bp, Artificial Sequence
  dgRNA
  Donson
cgccgacctcgcagc

SEQ ID NO: 12958 - DNA, 15 bp, Artificial Sequence
  dgRNA
  Donson
cgagctgcgcgcgcc

SEQ ID NO: 12959 - DNA, 15 bp, Artificial Sequence
  dgRNA
  Donson
gcgcccggccggaag

SEQ ID NO: 12960 - DNA, 15 bp, Artificial Sequence
  dgRNA
  Donson
gccggaagcggccac

SEQ ID NO: 12961 - DNA, 15 bp, Artificial Sequence
  dgRNA
  Nsmaf
ccgccgccaacgaac

SEQ ID NO: 12962 - DNA, 15 bp, Artificial Sequence
  dgRNA
  Nsmaf
cgccgccaacgaact

SEQ ID NO: 12963 - DNA, 15 bp, Artificial Sequence
  dgRNA
  Nsmaf
gccgccaacgaactg

SEQ ID NO: 12964 - DNA, 15 bp, Artificial Sequence
  dgRNA
  Nsmaf
ccgccaacgaactgg

SEQ ID NO: 12965 - DNA, 15 bp, Artificial Sequence
  dgRNA
  Ugt2a1
aacaaaaggtgtaat

SEQ ID NO: 12966 - DNA, 15 bp, Artificial Sequence
  dgRNA
  Ugt2a1
gtgtaataggtaggt

SEQ ID NO: 12967 - DNA, 15 bp, Artificial Sequence
  dgRNA
  Ugt2a1
gctagacaaggtgat

SEQ ID NO: 12968 - DNA, 15 bp, Artificial Sequence
  dgRNA
  Ddb2
ctgcacacgttactc

SEQ ID NO: 12969 - DNA, 15 bp, Artificial Sequence
  dgRNA
  Ddb2
acgttactccggaag

SEQ ID NO: 12970 - DNA, 15 bp, Artificial Sequence
  dgRNA
  Ddb2
ttactccggaagagg

SEQ ID NO: 12971 - DNA, 15 bp, Artificial Sequence
  dgRNA
  Ddb2
gcgggccgtgcccga

SEQ ID NO: 12972 - DNA, 15 bp, Artificial Sequence
  dgRNA
  Prps1
taccagagagtggtt

SEQ ID NO: 12973 - DNA, 15 bp, Artificial Sequence
  dgRNA
  Prps1
gggcggcaacattac

SEQ ID NO: 12974 - DNA, 15 bp, Artificial Sequence
  dgRNA
  Prps1
tgtaatcccgccccc

SEQ ID NO: 12975 - DNA, 15 bp, Artificial Sequence
  dgRNA
  Prps1
gtaatcccgccccct

SEQ ID NO: 12976 - DNA, 15 bp, Artificial Sequence
  dgRNA
  Pcolce
tgccgagaaagcaac

SEQ ID NO: 12977 - DNA, 15 bp, Artificial Sequence
  dgRNA
  Pcolce
tctcggcatctagag

SEQ ID NO: 12978 - DNA, 15 bp, Artificial Sequence
  dgRNA
  Pcolce
ttctcggcatctaga

SEQ ID NO: 12979 - DNA, 15 bp, Artificial Sequence
  dgRNA
  Pcolce
tttctcggcatctag

SEQ ID NO: 12980 - DNA, 15 bp, Artificial Sequence
  dgRNA
  Efhc1
attagccacgtcctg

SEQ ID NO: 12981 - DNA, 15 bp, Artificial Sequence
  dgRNA
  Efhc1
ctcgactagtgtgtt

SEQ ID NO: 12982 - DNA, 15 bp, Artificial Sequence
  dgRNA
  Efhc1
gtgtttggcgttacc

SEQ ID NO: 12983 - DNA, 15 bp, Artificial Sequence
  dgRNA
  Efhc1
tgtttggcgttacca

SEQ ID NO: 12984 - DNA, 15 bp, Artificial Sequence
  dgRNA
  Letm1
agactcggcgcacgc

SEQ ID NO: 12985 - DNA, 15 bp, Artificial Sequence
  dgRNA
  Letm1
gactcggcgcacgct

SEQ ID NO: 12986 - DNA, 15 bp, Artificial Sequence
  dgRNA
  Letm1
acttgtagtcgggag

SEQ ID NO: 12987 - DNA, 15 bp, Artificial Sequence
  dgRNA
  Letm1
ctcccggatgcacgc

SEQ ID NO: 12988 - DNA, 15 bp, Artificial Sequence
  dgRNA
  Elovl2
ccgcgcgcctcgtcc

SEQ ID NO: 12989 - DNA, 15 bp, Artificial Sequence
  dgRNA
  Elovl2
gcgcctcgtcccgga

SEQ ID NO: 12990 - DNA, 15 bp, Artificial Sequence
  dgRNA
  Elovl2
cctcgtcccggatgg

SEQ ID NO: 12991 - DNA, 15 bp, Artificial Sequence
  dgRNA
  Elovl2
cgtcccggatggcgg

SEQ ID NO: 12992 - DNA, 15 bp, Artificial Sequence
  dgRNA
  Mapk7
cgtgagagcatggtg

SEQ ID NO: 12993 - DNA, 15 bp, Artificial Sequence
  dgRNA
  Mapk7
tgagagcatggtgcg

SEQ ID NO: 12994 - DNA, 15 bp, Artificial Sequence
  dgRNA
  Mapk7
gcgcgcgcacccctg

SEQ ID NO: 12995 - DNA, 15 bp, Artificial Sequence
  dgRNA
  Mapk7
gcacgcatcacccct

SEQ ID NO: 12996 - DNA, 15 bp, Artificial Sequence
  dgRNA
  Dlg3
taactccacagaata

SEQ ID NO: 12997 - DNA, 15 bp, Artificial Sequence
  dgRNA
  Dlg3
atgtgtctgagtccg

SEQ ID NO: 12998 - DNA, 15 bp, Artificial Sequence
  dgRNA
  Dlg3
tgtgtctgagtccgg

SEQ ID NO: 12999 - DNA, 15 bp, Artificial Sequence
  dgRNA
  Dlg3
gtgtctgagtccggg

SEQ ID NO: 13000 - DNA, 15 bp, Artificial Sequence
  dgRNA
  Nmt2
ccgccctgactgagg

SEQ ID NO: 13001 - DNA, 15 bp, Artificial Sequence
  dgRNA
  Nmt2
cgccctgactgaggc

SEQ ID NO: 13002 - DNA, 15 bp, Artificial Sequence
  dgRNA
  Nmt2
ctgactgaggcgggc

SEQ ID NO: 13003 - DNA, 15 bp, Artificial Sequence
  dgRNA
  Nmt2
cgggactgcatagac

SEQ ID NO: 13004 - DNA, 15 bp, Artificial Sequence
  dgRNA
  Inafm1
cagcgcaggtttgcc

SEQ ID NO: 13005 - DNA, 15 bp, Artificial Sequence
  dgRNA
  Inafm1
ggatccctcgcctct

SEQ ID NO: 13006 - DNA, 15 bp, Artificial Sequence
  dgRNA
  Inafm1
gatccctcgcctcta

SEQ ID NO: 13007 - DNA, 15 bp, Artificial Sequence
  dgRNA
  Inafm1
aacagaagtttacgc

SEQ ID NO: 13008 - DNA, 15 bp, Artificial Sequence
  dgRNA
  Rad52
agcccaagagcgctc

SEQ ID NO: 13009 - DNA, 15 bp, Artificial Sequence
  dgRNA
  Rad52
cgacagcctgctttg

SEQ ID NO: 13010 - DNA, 15 bp, Artificial Sequence
  dgRNA
  Rad52
ttatctcaccgcccg

SEQ ID NO: 13011 - DNA, 15 bp, Artificial Sequence
  dgRNA
  Rad52
atcctgagcgctctt

SEQ ID NO: 13012 - DNA, 15 bp, Artificial Sequence
  dgRNA
  Olfr640
aatagtctagtagac

SEQ ID NO: 13013 - DNA, 15 bp, Artificial Sequence
  dgRNA
  Olfr640
atagtctagtagaca

SEQ ID NO: 13014 - DNA, 15 bp, Artificial Sequence
  dgRNA
  Olfr640
ctttacgtcctctct

SEQ ID NO: 13015 - DNA, 15 bp, Artificial Sequence
  dgRNA
  Olfr640
tttacgtcctctctt

SEQ ID NO: 13016 - DNA, 15 bp, Artificial Sequence
  dgRNA
  Insig2
aatccgtattcagaa

SEQ ID NO: 13017 - DNA, 15 bp, Artificial Sequence
  dgRNA
  Insig2
aggcacactccaagg

SEQ ID NO: 13018 - DNA, 15 bp, Artificial Sequence
  dgRNA
  Insig2
gcgggaagaagttgc

SEQ ID NO: 13019 - DNA, 15 bp, Artificial Sequence
  dgRNA
  Insig2
tgcaggcgacaaccg

SEQ ID NO: 13020 - DNA, 15 bp, Artificial Sequence
  dgRNA
  Numb
actaaagcatgatct

SEQ ID NO: 13021 - DNA, 15 bp, Artificial Sequence
  dgRNA
  Numb
aagcatgatctaggc

SEQ ID NO: 13022 - DNA, 15 bp, Artificial Sequence
  dgRNA
  Numb
gatctaggccggtcc

SEQ ID NO: 13023 - DNA, 15 bp, Artificial Sequence
  dgRNA
  Numb
aggccggtccaggtc

SEQ ID NO: 13024 - DNA, 15 bp, Artificial Sequence
  dgRNA
  Slc17a7
cgggtccttcctaca

SEQ ID NO: 13025 - DNA, 15 bp, Artificial Sequence
  dgRNA
  Slc17a7
gggtccttcctacaa

SEQ ID NO: 13026 - DNA, 15 bp, Artificial Sequence
  dgRNA
  Slc17a7
cttcctacaaggggt

SEQ ID NO: 13027 - DNA, 15 bp, Artificial Sequence
  dgRNA
  Slc17a7
ggggcctcctttggt

SEQ ID NO: 13028 - DNA, 15 bp, Artificial Sequence
  dgRNA
  Smarca1
gtgcaccccacagtc

SEQ ID NO: 13029 - DNA, 15 bp, Artificial Sequence
  dgRNA
  Smarca1
ggggagtctcgcgat

SEQ ID NO: 13030 - DNA, 15 bp, Artificial Sequence
  dgRNA
  Smarca1
gtctcgcgattggtg

SEQ ID NO: 13031 - DNA, 15 bp, Artificial Sequence
  dgRNA
  Smarca1
tctcgcgattggtga

SEQ ID NO: 13032 - DNA, 15 bp, Artificial Sequence
  dgRNA
  Pdlim7
aagcggggcacaggc

SEQ ID NO: 13033 - DNA, 15 bp, Artificial Sequence
  dgRNA
  Pdlim7
agcggggcacaggct

SEQ ID NO: 13034 - DNA, 15 bp, Artificial Sequence
  dgRNA
  Pdlim7
gggcagcgacccgac

SEQ ID NO: 13035 - DNA, 15 bp, Artificial Sequence
  dgRNA
  Pdlim7
gcgacccgactggcg

SEQ ID NO: 13036 - DNA, 15 bp, Artificial Sequence
  dgRNA
  Arhgdig
gagggttgcgggcgg

SEQ ID NO: 13037 - DNA, 15 bp, Artificial Sequence
  dgRNA
  Arhgdig
agggttgcgggcgga

SEQ ID NO: 13038 - DNA, 15 bp, Artificial Sequence
  dgRNA
  Arhgdig
gggttgcgggcggag

SEQ ID NO: 13039 - DNA, 15 bp, Artificial Sequence
  dgRNA
  Arhgdig
gccgcttgctgataa

SEQ ID NO: 13040 - DNA, 15 bp, Artificial Sequence
  dgRNA
  Cndp1
cactgttagctcata

SEQ ID NO: 13041 - DNA, 15 bp, Artificial Sequence
  dgRNA
  Cndp1
agggcggctccttga

SEQ ID NO: 13042 - DNA, 15 bp, Artificial Sequence
  dgRNA
  Cndp1
gcggctccttgaagg

SEQ ID NO: 13043 - DNA, 15 bp, Artificial Sequence
  dgRNA
  Cndp1
gccttaactgccccc

SEQ ID NO: 13044 - DNA, 15 bp, Artificial Sequence
  dgRNA
  Trip12
ggatgcgctgtcaat

SEQ ID NO: 13045 - DNA, 15 bp, Artificial Sequence
  dgRNA
  Trip12
gatgcgctgtcaata

SEQ ID NO: 13046 - DNA, 15 bp, Artificial Sequence
  dgRNA
  Trip12
ctgtcaatagggagc

SEQ ID NO: 13047 - DNA, 15 bp, Artificial Sequence
  dgRNA
  Trip12
tgtcaatagggagcg

SEQ ID NO: 13048 - DNA, 15 bp, Artificial Sequence
  dgRNA
  Pdzrn4
cagcggtaagaccgc

SEQ ID NO: 13049 - DNA, 15 bp, Artificial Sequence
  dgRNA
  Pdzrn4
taagaccgctggccc

SEQ ID NO: 13050 - DNA, 15 bp, Artificial Sequence
  dgRNA
  Pdzrn4
ggccctggcgcagct

SEQ ID NO: 13051 - DNA, 15 bp, Artificial Sequence
  dgRNA
  Pdzrn4
gccctggcgcagctt

SEQ ID NO: 13052 - DNA, 15 bp, Artificial Sequence
  dgRNA
  Impg2
ctgctggttaaagag

SEQ ID NO: 13053 - DNA, 15 bp, Artificial Sequence
  dgRNA
  Impg2
gttaaagagaggcga

SEQ ID NO: 13054 - DNA, 15 bp, Artificial Sequence
  dgRNA
  Impg2
aggcgacggttagta

SEQ ID NO: 13055 - DNA, 15 bp, Artificial Sequence
  dgRNA
  Impg2
ggaggtaagctaatt

SEQ ID NO: 13056 - DNA, 15 bp, Artificial Sequence
  dgRNA
  Tnnt3
gggcattcctatact

SEQ ID NO: 13057 - DNA, 15 bp, Artificial Sequence
  dgRNA
  Tnnt3
ttcctatacttggtc

SEQ ID NO: 13058 - DNA, 15 bp, Artificial Sequence
  dgRNA
  Tnnt3
tcctatacttggtca

SEQ ID NO: 13059 - DNA, 15 bp, Artificial Sequence
  dgRNA
  Tnnt3
cactataacatgaag

SEQ ID NO: 13060 - DNA, 15 bp, Artificial Sequence
  dgRNA
  Dchs1
gaggcgcggggaccg

SEQ ID NO: 13061 - DNA, 15 bp, Artificial Sequence
  dgRNA
  Dchs1
gggaccgcggcagcg

SEQ ID NO: 13062 - DNA, 15 bp, Artificial Sequence
  dgRNA
  Dchs1
ggaccgcggcagcgc

SEQ ID NO: 13063 - DNA, 15 bp, Artificial Sequence
  dgRNA
  Dchs1
ccgcggcagcgcggg

SEQ ID NO: 13064 - DNA, 15 bp, Artificial Sequence
  dgRNA
  Pla2g4f
acttcaaacccctcc

SEQ ID NO: 13065 - DNA, 15 bp, Artificial Sequence
  dgRNA
  Pla2g4f
ttgaagtgctccagg

SEQ ID NO: 13066 - DNA, 15 bp, Artificial Sequence
  dgRNA
  Pla2g4f
ctgaggcaccggggc

SEQ ID NO: 13067 - DNA, 15 bp, Artificial Sequence
  dgRNA
  Pla2g4f
taggctgaggcaccg

SEQ ID NO: 13068 - DNA, 15 bp, Artificial Sequence
  dgRNA
  Cbr2
gccttgcatgccatt

SEQ ID NO: 13069 - DNA, 15 bp, Artificial Sequence
  dgRNA
  Cbr2
ccttgcatgccatta

SEQ ID NO: 13070 - DNA, 15 bp, Artificial Sequence
  dgRNA
  Cbr2
ttagggctcaagacc

SEQ ID NO: 13071 - DNA, 15 bp, Artificial Sequence
  dgRNA
  Cbr2
gtcctaacaagcagt

SEQ ID NO: 13072 - DNA, 15 bp, Artificial Sequence
  dgRNA
  Kcnt1
cattactattacttc

SEQ ID NO: 13073 - DNA, 15 bp, Artificial Sequence
  dgRNA
  Kcnt1
actattacttctggt

SEQ ID NO: 13074 - DNA, 15 bp, Artificial Sequence
  dgRNA
  Kcnt1
ttctggtaggagtcg

SEQ ID NO: 13075 - DNA, 15 bp, Artificial Sequence
  dgRNA
  Kcnt1
actgcgtcctccctg

SEQ ID NO: 13076 - DNA, 15 bp, Artificial Sequence
  dgRNA
  Gpr19
atgcgctgggctttt

SEQ ID NO: 13077 - DNA, 15 bp, Artificial Sequence
  dgRNA
  Gpr19
ccccgtcggcccccg

SEQ ID NO: 13078 - DNA, 15 bp, Artificial Sequence
  dgRNA
  Gpr19
cccgtcggcccccga

SEQ ID NO: 13079 - DNA, 15 bp, Artificial Sequence
  dgRNA
  Gpr19
cgagggatgtcagtc

SEQ ID NO: 13080 - DNA, 15 bp, Artificial Sequence
  dgRNA
  Gbp3
gcactttaaggaaac

SEQ ID NO: 13081 - DNA, 15 bp, Artificial Sequence
  dgRNA
  Gbp3
aaggctaggataccc

SEQ ID NO: 13082 - DNA, 15 bp, Artificial Sequence
  dgRNA
  Gbp3
ctccctaaacaaagc

SEQ ID NO: 13083 - DNA, 15 bp, Artificial Sequence
  dgRNA
  Gbp3
aagctggttcatgtc

SEQ ID NO: 13084 - DNA, 15 bp, Artificial Sequence
  dgRNA
  Ctsg
gaattactgcgtgta

SEQ ID NO: 13085 - DNA, 15 bp, Artificial Sequence
  dgRNA
  Ctsg
cgtgtacggtgaact

SEQ ID NO: 13086 - DNA, 15 bp, Artificial Sequence
  dgRNA
  Ctsg
gacctcactcttcgc

SEQ ID NO: 13087 - DNA, 15 bp, Artificial Sequence
  dgRNA
  Ctsg
acacggcaactgtgt

SEQ ID NO: 13088 - DNA, 15 bp, Artificial Sequence
  dgRNA
  Usp7
cctcggcgccgagat

SEQ ID NO: 13089 - DNA, 15 bp, Artificial Sequence
  dgRNA
  Usp7
ctcggcgccgagatt

SEQ ID NO: 13090 - DNA, 15 bp, Artificial Sequence
  dgRNA
  Usp7
gccgcgggccgcccc

SEQ ID NO: 13091 - DNA, 15 bp, Artificial Sequence
  dgRNA
  Usp7
ccgcgggccgccccg

SEQ ID NO: 13092 - DNA, 15 bp, Artificial Sequence
  dgRNA
  Ticam2
tgagaggtattgtaa

SEQ ID NO: 13093 - DNA, 15 bp, Artificial Sequence
  dgRNA
  Ticam2
ggggaaacgccgtgg

SEQ ID NO: 13094 - DNA, 15 bp, Artificial Sequence
  dgRNA
  Ticam2
aggggaaacgccgtg

SEQ ID NO: 13095 - DNA, 15 bp, Artificial Sequence
  dgRNA
  Ticam2
gaggggaaacgccgt

SEQ ID NO: 13096 - DNA, 15 bp, Artificial Sequence
  dgRNA
  Crisp3
atcctgtgtcatact

SEQ ID NO: 13097 - DNA, 15 bp, Artificial Sequence
  dgRNA
  Crisp3
tatgcaaactggtct

SEQ ID NO: 13098 - DNA, 15 bp, Artificial Sequence
  dgRNA
  Htr5a
ctcggagccactgcc

SEQ ID NO: 13099 - DNA, 15 bp, Artificial Sequence
  dgRNA
  Htr5a
agccactgccgggag

SEQ ID NO: 13100 - DNA, 15 bp, Artificial Sequence
  dgRNA
  Htr5a
gccactgccgggaga

SEQ ID NO: 13101 - DNA, 15 bp, Artificial Sequence
  dgRNA
  Htr5a
ccactgccgggagag

SEQ ID NO: 13102 - DNA, 15 bp, Artificial Sequence
  dgRNA
  Casd1
cccggagctgacatc

SEQ ID NO: 13103 - DNA, 15 bp, Artificial Sequence
  dgRNA
  Casd1
ccggagctgacatct

SEQ ID NO: 13104 - DNA, 15 bp, Artificial Sequence
  dgRNA
  Casd1
ctgccgccagtgacc

SEQ ID NO: 13105 - DNA, 15 bp, Artificial Sequence
  dgRNA
  Casd1
acccggtgaccccgg

SEQ ID NO: 13106 - DNA, 15 bp, Artificial Sequence
  dgRNA
  Kif19a
tgcaacagaagcgca

SEQ ID NO: 13107 - DNA, 15 bp, Artificial Sequence
  dgRNA
  Kif19a
gcaacagaagcgcaa

SEQ ID NO: 13108 - DNA, 15 bp, Artificial Sequence
  dgRNA
  Kif19a
caacagaagcgcaag

SEQ ID NO: 13109 - DNA, 15 bp, Artificial Sequence
  dgRNA
  Kif19a
gaagcgcaagggggc

SEQ ID NO: 13110 - DNA, 15 bp, Artificial Sequence
  dgRNA
  Olfr1095
atgttgacgatactc

SEQ ID NO: 13111 - DNA, 15 bp, Artificial Sequence
  dgRNA
  Ebf4
tggctctcaggccgc

SEQ ID NO: 13112 - DNA, 15 bp, Artificial Sequence
  dgRNA
  Ebf4
ggctctcaggccgcg

SEQ ID NO: 13113 - DNA, 15 bp, Artificial Sequence
  dgRNA
  Ebf4
gctctcaggccgcgg

SEQ ID NO: 13114 - DNA, 15 bp, Artificial Sequence
  dgRNA
  Ebf4
cccgcgccccgggag

SEQ ID NO: 13115 - DNA, 15 bp, Artificial Sequence
  dgRNA
  Txn2
gtcccacacattttc

SEQ ID NO: 13116 - DNA, 15 bp, Artificial Sequence
  dgRNA
  Txn2
cgatcccattccttc

SEQ ID NO: 13117 - DNA, 15 bp, Artificial Sequence
  dgRNA
  Txn2
ttccgtcctcctcat

SEQ ID NO: 13118 - DNA, 15 bp, Artificial Sequence
  dgRNA
  Txn2
gtgtgggaccagtga

SEQ ID NO: 13119 - DNA, 15 bp, Artificial Sequence
  dgRNA
  Usp33
accgcgacgagacct

SEQ ID NO: 13120 - DNA, 15 bp, Artificial Sequence
  dgRNA
  Usp33
ccgcgacgagacctt

SEQ ID NO: 13121 - DNA, 15 bp, Artificial Sequence
  dgRNA
  Usp33
gaaatgcggccgaag

SEQ ID NO: 13122 - DNA, 15 bp, Artificial Sequence
  dgRNA
  Usp33
tgtacacgtcagctc

SEQ ID NO: 13123 - DNA, 15 bp, Artificial Sequence
  dgRNA
  Aatk
ccggcagaggaaatg

SEQ ID NO: 13124 - DNA, 15 bp, Artificial Sequence
  dgRNA
  Aatk
ccatctacttccgtc

SEQ ID NO: 13125 - DNA, 15 bp, Artificial Sequence
  dgRNA
  Aatk
catctacttccgtca

SEQ ID NO: 13126 - DNA, 15 bp, Artificial Sequence
  dgRNA
  Aatk
tacttccgtcagggc

SEQ ID NO: 13127 - DNA, 15 bp, Artificial Sequence
  dgRNA
  Slc13a1
gtccttaagtactct

SEQ ID NO: 13128 - DNA, 15 bp, Artificial Sequence
  dgRNA
  Slc13a1
ggcggtaagtaaaga

SEQ ID NO: 13129 - DNA, 15 bp, Artificial Sequence
  dgRNA
  Slc13a1
gttaaataaccagcc

SEQ ID NO: 13130 - DNA, 15 bp, Artificial Sequence
  dgRNA
  Tubb4b
gagcactgcggcgcc

SEQ ID NO: 13131 - DNA, 15 bp, Artificial Sequence
  dgRNA
  Tubb4b
agcactgcggcgcca

SEQ ID NO: 13132 - DNA, 15 bp, Artificial Sequence
  dgRNA
  Tubb4b
actgcggcgccaggg

SEQ ID NO: 13133 - DNA, 15 bp, Artificial Sequence
  dgRNA
  Tubb4b
ctgcggcgccagggc

SEQ ID NO: 13134 - DNA, 15 bp, Artificial Sequence
  dgRNA
  Vmn1r65
tatgctgatttgcac

SEQ ID NO: 13135 - DNA, 15 bp, Artificial Sequence
  dgRNA
  Vmn1r65
atgctgatttgcact

SEQ ID NO: 13136 - DNA, 15 bp, Artificial Sequence
  dgRNA
  Vmn1r65
tgcactggggataag

SEQ ID NO: 13137 - DNA, 15 bp, Artificial Sequence
  dgRNA
  Vmn1r65
taatggactccctga

SEQ ID NO: 13138 - DNA, 15 bp, Artificial Sequence
  dgRNA
  Jmjd4
catctcctgtgtcgg

SEQ ID NO: 13139 - DNA, 15 bp, Artificial Sequence
  dgRNA
  Jmjd4
ctcctgtgtcggtgg

SEQ ID NO: 13140 - DNA, 15 bp, Artificial Sequence
  dgRNA
  Jmjd4
tcctgtgtcggtggc

SEQ ID NO: 13141 - DNA, 15 bp, Artificial Sequence
  dgRNA
  Jmjd4
gtcggtggcgggctc

SEQ ID NO: 13142 - DNA, 15 bp, Artificial Sequence
  dgRNA
  Tceanc
agggaccactctgcg

SEQ ID NO: 13143 - DNA, 15 bp, Artificial Sequence
  dgRNA
  Tceanc
actctgcgaggcccg

SEQ ID NO: 13144 - DNA, 15 bp, Artificial Sequence
  dgRNA
  Tceanc
atcccacgcccacgt

SEQ ID NO: 13145 - DNA, 15 bp, Artificial Sequence
  dgRNA
  Tceanc
cccacgttggctcgc

SEQ ID NO: 13146 - DNA, 15 bp, Artificial Sequence
  dgRNA
  Sh2d1a
accacaaacctttgt

SEQ ID NO: 13147 - DNA, 15 bp, Artificial Sequence
  dgRNA
  Sh2d1a
gttaaactgctgagc

SEQ ID NO: 13148 - DNA, 15 bp, Artificial Sequence
  dgRNA
  Sh2d1a
caacatcctgttgtt

SEQ ID NO: 13149 - DNA, 15 bp, Artificial Sequence
  dgRNA
  Sh2d1a
gggggcacgctgaaa

SEQ ID NO: 13150 - DNA, 15 bp, Artificial Sequence
  dgRNA
  Eid1
cccccgtggaccaag

SEQ ID NO: 13151 - DNA, 15 bp, Artificial Sequence
  dgRNA
  Eid1
acacgcacgccatgc

SEQ ID NO: 13152 - DNA, 15 bp, Artificial Sequence
  dgRNA
  Eid1
cttggtccacggggg

SEQ ID NO: 13153 - DNA, 15 bp, Artificial Sequence
  dgRNA
  Eid1
cgcttggtccacggg

SEQ ID NO: 13154 - DNA, 15 bp, Artificial Sequence
  dgRNA
  Elmo2
gcacatgcgtgctag

SEQ ID NO: 13155 - DNA, 15 bp, Artificial Sequence
  dgRNA
  Elmo2
cacatgcgtgctaga

SEQ ID NO: 13156 - DNA, 15 bp, Artificial Sequence
  dgRNA
  Elmo2
gagggcttccctacg

SEQ ID NO: 13157 - DNA, 15 bp, Artificial Sequence
  dgRNA
  Elmo2
agggcttccctacga

SEQ ID NO: 13158 - DNA, 15 bp, Artificial Sequence
  dgRNA
  Tmprss7
tttctgaactggacc

SEQ ID NO: 13159 - DNA, 15 bp, Artificial Sequence
  dgRNA
  Tmprss7
tgaactggacccggg

SEQ ID NO: 13160 - DNA, 15 bp, Artificial Sequence
  dgRNA
  Tmprss7
agctagctgaacaaa

SEQ ID NO: 13161 - DNA, 15 bp, Artificial Sequence
  dgRNA
  Tmprss7
ggaagcgagtgaaca

SEQ ID NO: 13162 - DNA, 15 bp, Artificial Sequence
  dgRNA
  Pced1a
cggaaggtggggcgt

SEQ ID NO: 13163 - DNA, 15 bp, Artificial Sequence
  dgRNA
  Pced1a
ggcagagtccccgag

SEQ ID NO: 13164 - DNA, 15 bp, Artificial Sequence
  dgRNA
  Pced1a
gtctagtacagctgg

SEQ ID NO: 13165 - DNA, 15 bp, Artificial Sequence
  dgRNA
  Pced1a
cggcaagagtcgccg

SEQ ID NO: 13166 - DNA, 15 bp, Artificial Sequence
  dgRNA
  Hist1h4b
gtcaccgccctgaaa

SEQ ID NO: 13167 - DNA, 15 bp, Artificial Sequence
  dgRNA
  Hist1h4b
tcaccgccctgaaat

SEQ ID NO: 13168 - DNA, 15 bp, Artificial Sequence
  dgRNA
  Hist1h4b
ttgaagttctcaacc

SEQ ID NO: 13169 - DNA, 15 bp, Artificial Sequence
  dgRNA
  Hist1h4b
ctggagtactgtata

SEQ ID NO: 13170 - DNA, 15 bp, Artificial Sequence
  dgRNA
  Mmp19
ggggtggtgatatta

SEQ ID NO: 13171 - DNA, 15 bp, Artificial Sequence
  dgRNA
  Mmp19
gggtggtgatattag

SEQ ID NO: 13172 - DNA, 15 bp, Artificial Sequence
  dgRNA
  Mmp19
tattaggggcatttt

SEQ ID NO: 13173 - DNA, 15 bp, Artificial Sequence
  dgRNA
  Mmp19
gctctttggtagggc

SEQ ID NO: 13174 - DNA, 15 bp, Artificial Sequence
  dgRNA
  Cyp4b1
gctatctccgcccta

SEQ ID NO: 13175 - DNA, 15 bp, Artificial Sequence
  dgRNA
  Cyp4b1
ccgccctatggcact

SEQ ID NO: 13176 - DNA, 15 bp, Artificial Sequence
  dgRNA
  Cyp4b1
tataagacaatccag

SEQ ID NO: 13177 - DNA, 15 bp, Artificial Sequence
  dgRNA
  Cyp4b1
ccgagtgccataggg

SEQ ID NO: 13178 - DNA, 15 bp, Artificial Sequence
  dgRNA
  Dach2
gggcaaggctaagta

SEQ ID NO: 13179 - DNA, 15 bp, Artificial Sequence
  dgRNA
  Calml3
gtcaactcaattagc

SEQ ID NO: 13180 - DNA, 15 bp, Artificial Sequence
  dgRNA
  Calml3
gactcttgtctaaac

SEQ ID NO: 13181 - DNA, 15 bp, Artificial Sequence
  dgRNA
  Calml3
tgtctaaacaggatc

SEQ ID NO: 13182 - DNA, 15 bp, Artificial Sequence
  dgRNA
  Calml3
gcaaccacaggggcg

SEQ ID NO: 13183 - DNA, 15 bp, Artificial Sequence
  dgRNA
  Cacna1h
cggcacggagaaaca

SEQ ID NO: 13184 - DNA, 15 bp, Artificial Sequence
  dgRNA
  Cacna1h
gaccaagggatgttg

SEQ ID NO: 13185 - DNA, 15 bp, Artificial Sequence
  dgRNA
  Cacna1h
accaagggatgttgt

SEQ ID NO: 13186 - DNA, 15 bp, Artificial Sequence
  dgRNA
  Cacna1h
gggatagcttacgtc

SEQ ID NO: 13187 - DNA, 15 bp, Artificial Sequence
  dgRNA
  Tsga8
atggacaagttgtct

SEQ ID NO: 13188 - DNA, 15 bp, Artificial Sequence
  dgRNA
  Tsga8
tctagttttagtagg

SEQ ID NO: 13189 - DNA, 15 bp, Artificial Sequence
  dgRNA
  Tsga8
gagtctagttttagt

SEQ ID NO: 13190 - DNA, 15 bp, Artificial Sequence
  dgRNA
  Abhd15
gcaatcgctgtacaa

SEQ ID NO: 13191 - DNA, 15 bp, Artificial Sequence
  dgRNA
  Abhd15
caatcgctgtacaaa

SEQ ID NO: 13192 - DNA, 15 bp, Artificial Sequence
  dgRNA
  Abhd15
cgctgtacaaagggc

SEQ ID NO: 13193 - DNA, 15 bp, Artificial Sequence
  dgRNA
  Abhd15
gagctcgacccgaac

SEQ ID NO: 13194 - DNA, 15 bp, Artificial Sequence
  dgRNA
  Tm7sf2
ccgctggcgggttca

SEQ ID NO: 13195 - DNA, 15 bp, Artificial Sequence
  dgRNA
  Tm7sf2
gggcgggacccgccc

SEQ ID NO: 13196 - DNA, 15 bp, Artificial Sequence
  dgRNA
  Tm7sf2
gggacccgcccgggt

SEQ ID NO: 13197 - DNA, 15 bp, Artificial Sequence
  dgRNA
  Tm7sf2
ggacccgcccgggtt

SEQ ID NO: 13198 - DNA, 15 bp, Artificial Sequence
  dgRNA
  Acbd6
catttagacacacgg

SEQ ID NO: 13199 - DNA, 15 bp, Artificial Sequence
  dgRNA
  Acbd6
atttagacacacggt

SEQ ID NO: 13200 - DNA, 15 bp, Artificial Sequence
  dgRNA
  Acbd6
tttagacacacggtg

SEQ ID NO: 13201 - DNA, 15 bp, Artificial Sequence
  dgRNA
  Acbd6
gtggttaggaaacgg

SEQ ID NO: 13202 - DNA, 15 bp, Artificial Sequence
  dgRNA
  Pak1ip1
tgtctagacaaccgc

SEQ ID NO: 13203 - DNA, 15 bp, Artificial Sequence
  dgRNA
  Pak1ip1
acaaccgctggccac

SEQ ID NO: 13204 - DNA, 15 bp, Artificial Sequence
  dgRNA
  Pak1ip1
gctggccaccggagc

SEQ ID NO: 13205 - DNA, 15 bp, Artificial Sequence
  dgRNA
  Pak1ip1
accggagccggaagt

SEQ ID NO: 13206 - DNA, 15 bp, Artificial Sequence
  dgRNA
  Pura
ccggggcccagtcct

SEQ ID NO: 13207 - DNA, 15 bp, Artificial Sequence
  dgRNA
  Pura
tcctcggacgcgccc

SEQ ID NO: 13208 - DNA, 15 bp, Artificial Sequence
  dgRNA
  Pura
cctcggacgcgcccc

SEQ ID NO: 13209 - DNA, 15 bp, Artificial Sequence
  dgRNA
  Pura
ctcggacgcgccccg

SEQ ID NO: 13210 - DNA, 15 bp, Artificial Sequence
  dgRNA
  Alox12e
tccactaaaattggg

SEQ ID NO: 13211 - DNA, 15 bp, Artificial Sequence
  dgRNA
  Alox12e
ccactaaaattgggt

SEQ ID NO: 13212 - DNA, 15 bp, Artificial Sequence
  dgRNA
  Alox12e
tgatgtgcttagctc

SEQ ID NO: 13213 - DNA, 15 bp, Artificial Sequence
  dgRNA
  Alox12e
gtgagcttagcatct

SEQ ID NO: 13214 - DNA, 15 bp, Artificial Sequence
  dgRNA
  Itga3
gggcggagtcgcgat

SEQ ID NO: 13215 - DNA, 15 bp, Artificial Sequence
  dgRNA
  Itga3
tcgcgataggagaga

SEQ ID NO: 13216 - DNA, 15 bp, Artificial Sequence
  dgRNA
  Itga3
ccctttaagaggcgg

SEQ ID NO: 13217 - DNA, 15 bp, Artificial Sequence
  dgRNA
  Itga3
tccccggaaggaaag

SEQ ID NO: 13218 - DNA, 15 bp, Artificial Sequence
  dgRNA
  Reep5
aagtcaggcggactc

SEQ ID NO: 13219 - DNA, 15 bp, Artificial Sequence
  dgRNA
  Reep5
agtcaggcggactcc

SEQ ID NO: 13220 - DNA, 15 bp, Artificial Sequence
  dgRNA
  Reep5
aggcggactccgggc

SEQ ID NO: 13221 - DNA, 15 bp, Artificial Sequence
  dgRNA
  Reep5
agctgcttacagcgg

SEQ ID NO: 13222 - DNA, 15 bp, Artificial Sequence
  dgRNA
  Med13l
agtcgcccgccggct

SEQ ID NO: 13223 - DNA, 15 bp, Artificial Sequence
  dgRNA
  Med13l
acaaggcggccgacg

SEQ ID NO: 13224 - DNA, 15 bp, Artificial Sequence
  dgRNA
  Med13l
aggcggccgacgagg

SEQ ID NO: 13225 - DNA, 15 bp, Artificial Sequence
  dgRNA
  Med13l
gccgacgaggcggcg

SEQ ID NO: 13226 - DNA, 15 bp, Artificial Sequence
  dgRNA
  Dcun1d1
cgggcccctcggtgc

SEQ ID NO: 13227 - DNA, 15 bp, Artificial Sequence
  dgRNA
  Dcun1d1
gcccctcggtgctgg

SEQ ID NO: 13228 - DNA, 15 bp, Artificial Sequence
  dgRNA
  Dcun1d1
ctggcgagccggcgt

SEQ ID NO: 13229 - DNA, 15 bp, Artificial Sequence
  dgRNA
  Dcun1d1
cggcgtcggccttgc

SEQ ID NO: 13230 - DNA, 15 bp, Artificial Sequence
  dgRNA
  Stard6
ctgcgctccccgcag

SEQ ID NO: 13231 - DNA, 15 bp, Artificial Sequence
  dgRNA
  Stard6
cgcagaggactcacc

SEQ ID NO: 13232 - DNA, 15 bp, Artificial Sequence
  dgRNA
  Stard6
cgcacttccagactc

SEQ ID NO: 13233 - DNA, 15 bp, Artificial Sequence
  dgRNA
  Stard6
cttccagactccggg

SEQ ID NO: 13234 - DNA, 15 bp, Artificial Sequence
  dgRNA
  Krt73
ctcaattacatgcag

SEQ ID NO: 13235 - DNA, 15 bp, Artificial Sequence
  dgRNA
  Krt73
tcttgagctctataa

SEQ ID NO: 13236 - DNA, 15 bp, Artificial Sequence
  dgRNA
  Krt73
ttgagctctataaag

SEQ ID NO: 13237 - DNA, 15 bp, Artificial Sequence
  dgRNA
  Krt73
gaccaagatcacaag

SEQ ID NO: 13238 - DNA, 15 bp, Artificial Sequence
  dgRNA
  Vcp
attgcctttgtcgat

SEQ ID NO: 13239 - DNA, 15 bp, Artificial Sequence
  dgRNA
  Vcp
actccctatccgtcg

SEQ ID NO: 13240 - DNA, 15 bp, Artificial Sequence
  dgRNA
  Vcp
ggaagcgtagtgctg

SEQ ID NO: 13241 - DNA, 15 bp, Artificial Sequence
  dgRNA
  Vcp
tgcggccaattgacg

SEQ ID NO: 13242 - DNA, 15 bp, Artificial Sequence
  dgRNA
  Ruvbl2
gctgtaggcccaatt

SEQ ID NO: 13243 - DNA, 15 bp, Artificial Sequence
  dgRNA
  Ruvbl2
aggcccaatttggtg

SEQ ID NO: 13244 - DNA, 15 bp, Artificial Sequence
  dgRNA
  Ruvbl2
atcgtggaggacgtg

SEQ ID NO: 13245 - DNA, 15 bp, Artificial Sequence
  dgRNA
  Ruvbl2
ggacttagcagttgc

SEQ ID NO: 13246 - DNA, 15 bp, Artificial Sequence
  dgRNA
  Pdzd8
tggaagcgcgccgag

SEQ ID NO: 13247 - DNA, 15 bp, Artificial Sequence
  dgRNA
  Pdzd8
aagcgcgccgagagg

SEQ ID NO: 13248 - DNA, 15 bp, Artificial Sequence
  dgRNA
  Pdzd8
agcgcgccgagaggt

SEQ ID NO: 13249 - DNA, 15 bp, Artificial Sequence
  dgRNA
  Pdzd8
cgcgtccaagcgcgc

SEQ ID NO: 13250 - DNA, 15 bp, Artificial Sequence
  dgRNA
  Fnbp1l
ctccccgctgccggg

SEQ ID NO: 13251 - DNA, 15 bp, Artificial Sequence
  dgRNA
  Fnbp1l
cccgctgccgggagg

SEQ ID NO: 13252 - DNA, 15 bp, Artificial Sequence
  dgRNA
  Fnbp1l
ccgctgccgggaggc

SEQ ID NO: 13253 - DNA, 15 bp, Artificial Sequence
  dgRNA
  Fnbp1l
cgctgccgggaggcg

SEQ ID NO: 13254 - DNA, 15 bp, Artificial Sequence
  dgRNA
  Adamts3
ccctcactgtcggct

SEQ ID NO: 13255 - DNA, 15 bp, Artificial Sequence
  dgRNA
  Adamts3
cctcactgtcggctt

SEQ ID NO: 13256 - DNA, 15 bp, Artificial Sequence
  dgRNA
  Adamts3
cactgtcggcttggg

SEQ ID NO: 13257 - DNA, 15 bp, Artificial Sequence
  dgRNA
  Adamts3
gtggaaaggaccgac

SEQ ID NO: 13258 - DNA, 15 bp, Artificial Sequence
  dgRNA
  Ost4
agccagctgcgaccc

SEQ ID NO: 13259 - DNA, 15 bp, Artificial Sequence
  dgRNA
  Ost4
cagctgcgacccggg

SEQ ID NO: 13260 - DNA, 15 bp, Artificial Sequence
  dgRNA
  Ost4
agctgcgacccgggc

SEQ ID NO: 13261 - DNA, 15 bp, Artificial Sequence
  dgRNA
  Ost4
cccgcccctgccgag

SEQ ID NO: 13262 - DNA, 15 bp, Artificial Sequence
  dgRNA
  Spink12
agctcagtagcccta

SEQ ID NO: 13263 - DNA, 15 bp, Artificial Sequence
  dgRNA
  Spink12
tactgagctaataac

SEQ ID NO: 13264 - DNA, 15 bp, Artificial Sequence
  dgRNA
  Spink12
tgtaatagagcctta

SEQ ID NO: 13265 - DNA, 15 bp, Artificial Sequence
  dgRNA
  Spink12
aatcaaattcttacc

SEQ ID NO: 13266 - DNA, 15 bp, Artificial Sequence
  dgRNA
  Has2
gactggggaacccgg

SEQ ID NO: 13267 - DNA, 15 bp, Artificial Sequence
  dgRNA
  Has2
agggaggtgtagact

SEQ ID NO: 13268 - DNA, 15 bp, Artificial Sequence
  dgRNA
  Has2
taataggacggagga

SEQ ID NO: 13269 - DNA, 15 bp, Artificial Sequence
  dgRNA
  Has2
ttaataggacggagg

SEQ ID NO: 13270 - DNA, 15 bp, Artificial Sequence
  dgRNA
  Hand2
tcttatggttatgag

SEQ ID NO: 13271 - DNA, 15 bp, Artificial Sequence
  dgRNA
  Hand2
ccgccgccccgggat

SEQ ID NO: 13272 - DNA, 15 bp, Artificial Sequence
  dgRNA
  Hand2
cccgggattggcgtg

SEQ ID NO: 13273 - DNA, 15 bp, Artificial Sequence
  dgRNA
  Hand2
atatattaacccgag

SEQ ID NO: 13274 - DNA, 15 bp, Artificial Sequence
  dgRNA
  Nell1
gacagcaagtacagg

SEQ ID NO: 13275 - DNA, 15 bp, Artificial Sequence
  dgRNA
  Nell1
agcaagtacaggtgg

SEQ ID NO: 13276 - DNA, 15 bp, Artificial Sequence
  dgRNA
  Nell1
gtacaggtggcggtt

SEQ ID NO: 13277 - DNA, 15 bp, Artificial Sequence
  dgRNA
  Nell1
tacaggtggcggttg

SEQ ID NO: 13278 - DNA, 15 bp, Artificial Sequence
  dgRNA
  Trp63
actacttaatgagat

SEQ ID NO: 13279 - DNA, 15 bp, Artificial Sequence
  dgRNA
  Trp63
gaggcctcactccat

SEQ ID NO: 13280 - DNA, 15 bp, Artificial Sequence
  dgRNA
  Trp63
ctcactccattggag

SEQ ID NO: 13281 - DNA, 15 bp, Artificial Sequence
  dgRNA
  Trp63
actccattggagtgg

SEQ ID NO: 13282 - DNA, 15 bp, Artificial Sequence
  dgRNA
  Kcnu1
actgaccacctctgg

SEQ ID NO: 13283 - DNA, 15 bp, Artificial Sequence
  dgRNA
  Kcnu1
tcccctgagtggtta

SEQ ID NO: 13284 - DNA, 15 bp, Artificial Sequence
  dgRNA
  Kcnu1
tcccatcagatcttg

SEQ ID NO: 13285 - DNA, 15 bp, Artificial Sequence
  dgRNA
  Kcnu1
gcgagagaccaccag

SEQ ID NO: 13286 - DNA, 15 bp, Artificial Sequence
  dgRNA
  Ctnnb1
aacctgcgccgtccg

SEQ ID NO: 13287 - DNA, 15 bp, Artificial Sequence
  dgRNA
  Ctnnb1
actccacccggcccg

SEQ ID NO: 13288 - DNA, 15 bp, Artificial Sequence
  dgRNA
  Ctnnb1
ccacccggcccgcgg

SEQ ID NO: 13289 - DNA, 15 bp, Artificial Sequence
  dgRNA
  Ctnnb1
tagtttccaatggag

SEQ ID NO: 13290 - DNA, 15 bp, Artificial Sequence
  dgRNA
  Mrpl52
gtatctcaaccacct

SEQ ID NO: 13291 - DNA, 15 bp, Artificial Sequence
  dgRNA
  Mrpl52
tctcaaccacctcgg

SEQ ID NO: 13292 - DNA, 15 bp, Artificial Sequence
  dgRNA
  Mrpl52
ctcaaccacctcgga

SEQ ID NO: 13293 - DNA, 15 bp, Artificial Sequence
  dgRNA
  Mrpl52
tgcaagatgcacgcg

SEQ ID NO: 13294 - DNA, 15 bp, Artificial Sequence
  dgRNA
  Mycs
gaaagttgctttcgt

SEQ ID NO: 13295 - DNA, 15 bp, Artificial Sequence
  dgRNA
  Mycs
tgacaatcaactgtc

SEQ ID NO: 13296 - DNA, 15 bp, Artificial Sequence
  dgRNA
  Mycs
tcaactgtctggacc

SEQ ID NO: 13297 - DNA, 15 bp, Artificial Sequence
  dgRNA
  Mycs
ttgaatccacccacc

SEQ ID NO: 13298 - DNA, 15 bp, Artificial Sequence
  dgRNA
  Cox7c
ctcataggacagctc

SEQ ID NO: 13299 - DNA, 15 bp, Artificial Sequence
  dgRNA
  Cox7c
ccattgaatcactaa

SEQ ID NO: 13300 - DNA, 15 bp, Artificial Sequence
  dgRNA
  Cox7c
gttatcacttggtgc

SEQ ID NO: 13301 - DNA, 15 bp, Artificial Sequence
  dgRNA
  Cox7c
gtgtgttcaagttaa

SEQ ID NO: 13302 - DNA, 15 bp, Artificial Sequence
  dgRNA
  Trpa1
ggggctatagctgca

SEQ ID NO: 13303 - DNA, 15 bp, Artificial Sequence
  dgRNA
  Trpa1
tgtaggtcccaagtc

SEQ ID NO: 13304 - DNA, 15 bp, Artificial Sequence
  dgRNA
  Trpa1
cggtgccctgtccct

SEQ ID NO: 13305 - DNA, 15 bp, Artificial Sequence
  dgRNA
  Trpa1
ctaggtgccgccttg

SEQ ID NO: 13306 - DNA, 15 bp, Artificial Sequence
  dgRNA
  Dars
gggaagacaattaac

SEQ ID NO: 13307 - DNA, 15 bp, Artificial Sequence
  dgRNA
  Dars
tgaagttagaccaag

SEQ ID NO: 13308 - DNA, 15 bp, Artificial Sequence
  dgRNA
  Dars
gccccatgactcccg

SEQ ID NO: 13309 - DNA, 15 bp, Artificial Sequence
  dgRNA
  Dars
ccccatgactcccgt

SEQ ID NO: 13310 - DNA, 15 bp, Artificial Sequence
  dgRNA
  Vwa5b2
tgctaggctgacgaa

SEQ ID NO: 13311 - DNA, 15 bp, Artificial Sequence
  dgRNA
  Vwa5b2
gctaggctgacgaat

SEQ ID NO: 13312 - DNA, 15 bp, Artificial Sequence
  dgRNA
  Vwa5b2
aggctgacgaatggg

SEQ ID NO: 13313 - DNA, 15 bp, Artificial Sequence
  dgRNA
  Vwa5b2
ctgacgaatgggagg

SEQ ID NO: 13314 - DNA, 15 bp, Artificial Sequence
  dgRNA
  Olfr1298
aggtgagttctaata

SEQ ID NO: 13315 - DNA, 15 bp, Artificial Sequence
  dgRNA
  Olfr1298
ggcattattgaccaa

SEQ ID NO: 13316 - DNA, 15 bp, Artificial Sequence
  dgRNA
  Vmn1r113
tcacttatcaagtga

SEQ ID NO: 13317 - DNA, 15 bp, Artificial Sequence
  dgRNA
  Vmn1r113
gttacacatagttac

SEQ ID NO: 13318 - DNA, 15 bp, Artificial Sequence
  dgRNA
  B3gnt2
ctaggttcggtgttg

SEQ ID NO: 13319 - DNA, 15 bp, Artificial Sequence
  dgRNA
  B3gnt2
taggttcggtgttga

SEQ ID NO: 13320 - DNA, 15 bp, Artificial Sequence
  dgRNA
  B3gnt2
gagggcgtgccgact

SEQ ID NO: 13321 - DNA, 15 bp, Artificial Sequence
  dgRNA
  B3gnt2
gcgtgccgactcggc

SEQ ID NO: 13322 - DNA, 15 bp, Artificial Sequence
  dgRNA
  Tle3
aggaccccttcgccg

SEQ ID NO: 13323 - DNA, 15 bp, Artificial Sequence
  dgRNA
  Tle3
cgaggcttcctatgc

SEQ ID NO: 13324 - DNA, 15 bp, Artificial Sequence
  dgRNA
  Tle3
gcttcctatgccggc

SEQ ID NO: 13325 - DNA, 15 bp, Artificial Sequence
  dgRNA
  Tle3
tgcaccgactgagcc

SEQ ID NO: 13326 - DNA, 15 bp, Artificial Sequence
  dgRNA
  Has1
aggtcctatctgagc

SEQ ID NO: 13327 - DNA, 15 bp, Artificial Sequence
  dgRNA
  Has1
ggtcctatctgagcc

SEQ ID NO: 13328 - DNA, 15 bp, Artificial Sequence
  dgRNA
  Has1
tatctgagccgggga

SEQ ID NO: 13329 - DNA, 15 bp, Artificial Sequence
  dgRNA
  Has1
atctgagccggggat

SEQ ID NO: 13330 - DNA, 15 bp, Artificial Sequence
  dgRNA
  Hmga1
aaaccgcgcgcacag

SEQ ID NO: 13331 - DNA, 15 bp, Artificial Sequence
  dgRNA
  Hmga1
cgagctacccgcgcg

SEQ ID NO: 13332 - DNA, 15 bp, Artificial Sequence
  dgRNA
  Hmga1
gctacccgcgcgcgg

SEQ ID NO: 13333 - DNA, 15 bp, Artificial Sequence
  dgRNA
  Hmga1
acccgcgcgcggcgg

SEQ ID NO: 13334 - DNA, 15 bp, Artificial Sequence
  dgRNA
  Palld
gtgatttgcccaccc

SEQ ID NO: 13335 - DNA, 15 bp, Artificial Sequence
  dgRNA
  Palld
ttcggacgtgtaagc

SEQ ID NO: 13336 - DNA, 15 bp, Artificial Sequence
  dgRNA
  Palld
gaggggcgttatttc

SEQ ID NO: 13337 - DNA, 15 bp, Artificial Sequence
  dgRNA
  Palld
tgtttggaccggggt

SEQ ID NO: 13338 - DNA, 15 bp, Artificial Sequence
  dgRNA
  1700022I11Rik
tcatagttctggtct

SEQ ID NO: 13339 - DNA, 15 bp, Artificial Sequence
  dgRNA
  1700022I11Rik
ctattggattcacgt

SEQ ID NO: 13340 - DNA, 15 bp, Artificial Sequence
  dgRNA
  1700022I11Rik
gattcacgtaggagt

SEQ ID NO: 13341 - DNA, 15 bp, Artificial Sequence
  dgRNA
  1700022I11Rik
attcacgtaggagtc

SEQ ID NO: 13342 - DNA, 15 bp, Artificial Sequence
  dgRNA
  Slc44a1
cgcgcggcgctgcac

SEQ ID NO: 13343 - DNA, 15 bp, Artificial Sequence
  dgRNA
  Slc44a1
gcgcggcgctgcact

SEQ ID NO: 13344 - DNA, 15 bp, Artificial Sequence
  dgRNA
  Slc44a1
cgcggcgctgcactg

SEQ ID NO: 13345 - DNA, 15 bp, Artificial Sequence
  dgRNA
  Slc44a1
gcggcgctgcactgg

SEQ ID NO: 13346 - DNA, 15 bp, Artificial Sequence
  dgRNA
  Tescl
cttcggggattgtga

SEQ ID NO: 13347 - DNA, 15 bp, Artificial Sequence
  dgRNA
  Tescl
gacctgccctaacag

SEQ ID NO: 13348 - DNA, 15 bp, Artificial Sequence
  dgRNA
  Tescl
atcagaacggcagca

SEQ ID NO: 13349 - DNA, 15 bp, Artificial Sequence
  dgRNA
  Tescl
aaggtgagaccgacc

SEQ ID NO: 13350 - DNA, 15 bp, Artificial Sequence
  dgRNA
  Gpr179
catggtactagtgac

SEQ ID NO: 13351 - DNA, 15 bp, Artificial Sequence
  dgRNA
  Gpr179
atggtactagtgaca

SEQ ID NO: 13352 - DNA, 15 bp, Artificial Sequence
  dgRNA
  Gpr179
gtactagtgacaggg

SEQ ID NO: 13353 - DNA, 15 bp, Artificial Sequence
  dgRNA
  Gpr179
tactagtgacagggt

SEQ ID NO: 13354 - DNA, 15 bp, Artificial Sequence
  dgRNA
  Tmcc2
tagtttccaagatcc

SEQ ID NO: 13355 - DNA, 15 bp, Artificial Sequence
  dgRNA
  Tmcc2
ggggattcctggtct

SEQ ID NO: 13356 - DNA, 15 bp, Artificial Sequence
  dgRNA
  Tmcc2
tggtctcggtgattt

SEQ ID NO: 13357 - DNA, 15 bp, Artificial Sequence
  dgRNA
  Tmcc2
tcctagagatagcac

SEQ ID NO: 13358 - DNA, 15 bp, Artificial Sequence
  dgRNA
  Fbxo6
aagcaggcccgaggt

SEQ ID NO: 13359 - DNA, 15 bp, Artificial Sequence
  dgRNA
  Fbxo6
gaaccgcttgtcgcc

SEQ ID NO: 13360 - DNA, 15 bp, Artificial Sequence
  dgRNA
  Fbxo6
ccgcttgtcgcctgg

SEQ ID NO: 13361 - DNA, 15 bp, Artificial Sequence
  dgRNA
  Fbxo6
cgcttgtcgcctgga

SEQ ID NO: 13362 - DNA, 15 bp, Artificial Sequence
  dgRNA
  Fsd2
gcatgtgacctcccc

SEQ ID NO: 13363 - DNA, 15 bp, Artificial Sequence
  dgRNA
  Fsd2
gtggcaaggccgctg

SEQ ID NO: 13364 - DNA, 15 bp, Artificial Sequence
  dgRNA
  Fsd2
caaggccgctgtggc

SEQ ID NO: 13365 - DNA, 15 bp, Artificial Sequence
  dgRNA
  Fsd2
tggcaggcctatatt

SEQ ID NO: 13366 - DNA, 15 bp, Artificial Sequence
  dgRNA
  Hnrnpa3
gccgggcgcgaaccg

SEQ ID NO: 13367 - DNA, 15 bp, Artificial Sequence
  dgRNA
  Hnrnpa3
cgcgaaccgcggcga

SEQ ID NO: 13368 - DNA, 15 bp, Artificial Sequence
  dgRNA
  Hnrnpa3
gaaccgcggcgaagg

SEQ ID NO: 13369 - DNA, 15 bp, Artificial Sequence
  dgRNA
  Hnrnpa3
aaggcggcgctgcgt

SEQ ID NO: 13370 - DNA, 15 bp, Artificial Sequence
  dgRNA
  Atp11b
gcgcggaaacacgga

SEQ ID NO: 13371 - DNA, 15 bp, Artificial Sequence
  dgRNA
  Atp11b
cgcggaaacacggaa

SEQ ID NO: 13372 - DNA, 15 bp, Artificial Sequence
  dgRNA
  Atp11b
gaaacacggaagggt

SEQ ID NO: 13373 - DNA, 15 bp, Artificial Sequence
  dgRNA
  Atp11b
gggtgggcctccgag

SEQ ID NO: 13374 - DNA, 15 bp, Artificial Sequence
  dgRNA
  Plk2
gggcacgcgacgaac

SEQ ID NO: 13375 - DNA, 15 bp, Artificial Sequence
  dgRNA
  Plk2
ggcacgcgacgaact

SEQ ID NO: 13376 - DNA, 15 bp, Artificial Sequence
  dgRNA
  Plk2
gcacgcgacgaactg

SEQ ID NO: 13377 - DNA, 15 bp, Artificial Sequence
  dgRNA
  Plk2
cacgcgacgaactgg

SEQ ID NO: 13378 - DNA, 15 bp, Artificial Sequence
  dgRNA
  Tfap4
gcatccagtcgccct

SEQ ID NO: 13379 - DNA, 15 bp, Artificial Sequence
  dgRNA
  Tfap4
catccagtcgccctg

SEQ ID NO: 13380 - DNA, 15 bp, Artificial Sequence
  dgRNA
  Tfap4
atccagtcgccctgg

SEQ ID NO: 13381 - DNA, 15 bp, Artificial Sequence
  dgRNA
  Tfap4
ccagtcgccctgggg

SEQ ID NO: 13382 - DNA, 15 bp, Artificial Sequence
  dgRNA
  Adgrl1
cccccagcccaacta

SEQ ID NO: 13383 - DNA, 15 bp, Artificial Sequence
  dgRNA
  Adgrl1
ccccagcccaactag

SEQ ID NO: 13384 - DNA, 15 bp, Artificial Sequence
  dgRNA
  Adgrl1
cccagcccaactagg

SEQ ID NO: 13385 - DNA, 15 bp, Artificial Sequence
  dgRNA
  Adgrl1
ggcgagtggaactcc

SEQ ID NO: 13386 - DNA, 15 bp, Artificial Sequence
  dgRNA
  Fstl1
cccccccgctgccgc

SEQ ID NO: 13387 - DNA, 15 bp, Artificial Sequence
  dgRNA
  Fstl1
cgcccctcccgggcg

SEQ ID NO: 13388 - DNA, 15 bp, Artificial Sequence
  dgRNA
  Fstl1
gcccctcccgggcgt

SEQ ID NO: 13389 - DNA, 15 bp, Artificial Sequence
  dgRNA
  Fstl1
ccccgcctttgtttc

SEQ ID NO: 13390 - DNA, 15 bp, Artificial Sequence
  dgRNA
  Chmp5
ttgttcacagcgcag

SEQ ID NO: 13391 - DNA, 15 bp, Artificial Sequence
  dgRNA
  Chmp5
ttcacagcgcagcgg

SEQ ID NO: 13392 - DNA, 15 bp, Artificial Sequence
  dgRNA
  Chmp5
cgcagcggtggctac

SEQ ID NO: 13393 - DNA, 15 bp, Artificial Sequence
  dgRNA
  Chmp5
gcagcggtggctacc

SEQ ID NO: 13394 - DNA, 15 bp, Artificial Sequence
  dgRNA
  Orc3
ccactccgcagcgca

SEQ ID NO: 13395 - DNA, 15 bp, Artificial Sequence
  dgRNA
  Orc3
ctccgcagcgcaagg

SEQ ID NO: 13396 - DNA, 15 bp, Artificial Sequence
  dgRNA
  Orc3
cgcagcgcaaggagg

SEQ ID NO: 13397 - DNA, 15 bp, Artificial Sequence
  dgRNA
  Orc3
aggcagggtcggcct

SEQ ID NO: 13398 - DNA, 15 bp, Artificial Sequence
  dgRNA
  Adamtsl4
atccccttgctggtt

SEQ ID NO: 13399 - DNA, 15 bp, Artificial Sequence
  dgRNA
  Adamtsl4
ccccttgctggttcg

SEQ ID NO: 13400 - DNA, 15 bp, Artificial Sequence
  dgRNA
  Adamtsl4
agcccaggttcttcg

SEQ ID NO: 13401 - DNA, 15 bp, Artificial Sequence
  dgRNA
  Adamtsl4
aggttcttcgaggac

SEQ ID NO: 13402 - DNA, 15 bp, Artificial Sequence
  dgRNA
  Mapt
gaatgcgcgtgcgcg

SEQ ID NO: 13403 - DNA, 15 bp, Artificial Sequence
  dgRNA
  Mapt
cggcggtcagcaccg

SEQ ID NO: 13404 - DNA, 15 bp, Artificial Sequence
  dgRNA
  Mapt
cagcaccgcggcccg

SEQ ID NO: 13405 - DNA, 15 bp, Artificial Sequence
  dgRNA
  Mapt
ccgcggcccgaggcg

SEQ ID NO: 13406 - DNA, 15 bp, Artificial Sequence
  dgRNA
  Mlph
tgctctcaaccggct

SEQ ID NO: 13407 - DNA, 15 bp, Artificial Sequence
  dgRNA
  Mlph
gctctcaaccggctt

SEQ ID NO: 13408 - DNA, 15 bp, Artificial Sequence
  dgRNA
  Mlph
ctctcaaccggcttg

SEQ ID NO: 13409 - DNA, 15 bp, Artificial Sequence
  dgRNA
  Mlph
accggcttggggaca

SEQ ID NO: 13410 - DNA, 15 bp, Artificial Sequence
  dgRNA
  Psmg4
actaacatgcgctcc

SEQ ID NO: 13411 - DNA, 15 bp, Artificial Sequence
  dgRNA
  Psmg4
ctaacatgcgctcct

SEQ ID NO: 13412 - DNA, 15 bp, Artificial Sequence
  dgRNA
  Psmg4
gttcctagagatcgc

SEQ ID NO: 13413 - DNA, 15 bp, Artificial Sequence
  dgRNA
  Psmg4
cgctggcagactcct

SEQ ID NO: 13414 - DNA, 15 bp, Artificial Sequence
  dgRNA
  Zfp317
gtttcacgttataaa

SEQ ID NO: 13415 - DNA, 15 bp, Artificial Sequence
  dgRNA
  Zfp317
gcgagatttcgaaga

SEQ ID NO: 13416 - DNA, 15 bp, Artificial Sequence
  dgRNA
  Zfp317
gaagccattgcttcg

SEQ ID NO: 13417 - DNA, 15 bp, Artificial Sequence
  dgRNA
  Zfp317
gattgaaatggttta

SEQ ID NO: 13418 - DNA, 15 bp, Artificial Sequence
  dgRNA
  Teddm1a
aacgtttcccctctg

SEQ ID NO: 13419 - DNA, 15 bp, Artificial Sequence
  dgRNA
  Teddm1a
ggtgataaaactaag

SEQ ID NO: 13420 - DNA, 15 bp, Artificial Sequence
  dgRNA
  Teddm1a
ctcctctggtgcatt

SEQ ID NO: 13421 - DNA, 15 bp, Artificial Sequence
  dgRNA
  Kdm8
actcattatctgagt

SEQ ID NO: 13422 - DNA, 15 bp, Artificial Sequence
  dgRNA
  Kdm8
attatctgagttgga

SEQ ID NO: 13423 - DNA, 15 bp, Artificial Sequence
  dgRNA
  Kdm8
aagtctttgaaccgg

SEQ ID NO: 13424 - DNA, 15 bp, Artificial Sequence
  dgRNA
  Kdm8
tctttgaaccggagg

SEQ ID NO: 13425 - DNA, 15 bp, Artificial Sequence
  dgRNA
  Pvrl2
attagagtgaccagt

SEQ ID NO: 13426 - DNA, 15 bp, Artificial Sequence
  dgRNA
  Pvrl2
tagagtgaccagtag

SEQ ID NO: 13427 - DNA, 15 bp, Artificial Sequence
  dgRNA
  Pvrl2
cagtagggggcgcag

SEQ ID NO: 13428 - DNA, 15 bp, Artificial Sequence
  dgRNA
  Pvrl2
agtagggggcgcagt

SEQ ID NO: 13429 - DNA, 15 bp, Artificial Sequence
  dgRNA
  Cyhr1
ctaagcaataaccct

SEQ ID NO: 13430 - DNA, 15 bp, Artificial Sequence
  dgRNA
  Cyhr1
ttggaagccccaccc

SEQ ID NO: 13431 - DNA, 15 bp, Artificial Sequence
  dgRNA
  Cyhr1
ccggctcccggggag

SEQ ID NO: 13432 - DNA, 15 bp, Artificial Sequence
  dgRNA
  Cyhr1
tccggctcccgggga

SEQ ID NO: 13433 - DNA, 15 bp, Artificial Sequence
  dgRNA
  Vps33a
attcttaggcatggt

SEQ ID NO: 13434 - DNA, 15 bp, Artificial Sequence
  dgRNA
  Vps33a
ttcttaggcatggta

SEQ ID NO: 13435 - DNA, 15 bp, Artificial Sequence
  dgRNA
  Vps33a
cctcgcatgcgcact

SEQ ID NO: 13436 - DNA, 15 bp, Artificial Sequence
  dgRNA
  Vps33a
gcactaggaccttga

SEQ ID NO: 13437 - DNA, 15 bp, Artificial Sequence
  dgRNA
  Mpeg1
agtagcctggaggcg

SEQ ID NO: 13438 - DNA, 15 bp, Artificial Sequence
  dgRNA
  Mpeg1
ttttactggaaacgc

SEQ ID NO: 13439 - DNA, 15 bp, Artificial Sequence
  dgRNA
  Rbm3
gctcctctcgattcc

SEQ ID NO: 13440 - DNA, 15 bp, Artificial Sequence
  dgRNA
  Rbm3
ctcgattcccggaag

SEQ ID NO: 13441 - DNA, 15 bp, Artificial Sequence
  dgRNA
  Rbm3
ttcccggaagcggcg

SEQ ID NO: 13442 - DNA, 15 bp, Artificial Sequence
  dgRNA
  Rbm3
atgagcacgcacgcc

SEQ ID NO: 13443 - DNA, 15 bp, Artificial Sequence
  dgRNA
  Onecut1
tcggttcatttgtgc

SEQ ID NO: 13444 - DNA, 15 bp, Artificial Sequence
  dgRNA
  Onecut1
cggttcatttgtgct

SEQ ID NO: 13445 - DNA, 15 bp, Artificial Sequence
  dgRNA
  Onecut1
tgtgctgggacgtca

SEQ ID NO: 13446 - DNA, 15 bp, Artificial Sequence
  dgRNA
  Onecut1
gacgtcacggagcgc

SEQ ID NO: 13447 - DNA, 15 bp, Artificial Sequence
  dgRNA
  Csrp3
tctccgggaggctcc

SEQ ID NO: 13448 - DNA, 15 bp, Artificial Sequence
  dgRNA
  Csrp3
cgggaggctcccggc

SEQ ID NO: 13449 - DNA, 15 bp, Artificial Sequence
  dgRNA
  Csrp3
ggctcccggctggca

SEQ ID NO: 13450 - DNA, 15 bp, Artificial Sequence
  dgRNA
  Csrp3
gctcccggctggcat

SEQ ID NO: 13451 - DNA, 15 bp, Artificial Sequence
  dgRNA
  Ttc7
gcacccagtcagcgg

SEQ ID NO: 13452 - DNA, 15 bp, Artificial Sequence
  dgRNA
  Ttc7
acccagtcagcggcg

SEQ ID NO: 13453 - DNA, 15 bp, Artificial Sequence
  dgRNA
  Ttc7
tcagcggcggggagc

SEQ ID NO: 13454 - DNA, 15 bp, Artificial Sequence
  dgRNA
  Ttc7
cggggagccggcgga

SEQ ID NO: 13455 - DNA, 15 bp, Artificial Sequence
  dgRNA
  Cd151
tcttcgctccccacc

SEQ ID NO: 13456 - DNA, 15 bp, Artificial Sequence
  dgRNA
  Cd151
cttcgctccccacct

SEQ ID NO: 13457 - DNA, 15 bp, Artificial Sequence
  dgRNA
  Cd151
tgtctctgggcgagt

SEQ ID NO: 13458 - DNA, 15 bp, Artificial Sequence
  dgRNA
  Cd151
gtctctgggcgagtt

SEQ ID NO: 13459 - DNA, 15 bp, Artificial Sequence
  dgRNA
  Rxrb
ctggccgggacggga

SEQ ID NO: 13460 - DNA, 15 bp, Artificial Sequence
  dgRNA
  Rxrb
tggccgggacgggat

SEQ ID NO: 13461 - DNA, 15 bp, Artificial Sequence
  dgRNA
  Rxrb
cgggatgggcgacag

SEQ ID NO: 13462 - DNA, 15 bp, Artificial Sequence
  dgRNA
  Rxrb
gggatgggcgacagc

SEQ ID NO: 13463 - DNA, 15 bp, Artificial Sequence
  dgRNA
  Tet2
gcgaacgcacggccc

SEQ ID NO: 13464 - DNA, 15 bp, Artificial Sequence
  dgRNA
  Tet2
cgaacgcacggcccc

SEQ ID NO: 13465 - DNA, 15 bp, Artificial Sequence
  dgRNA
  Tet2
cgagcacacggcccc

SEQ ID NO: 13466 - DNA, 15 bp, Artificial Sequence
  dgRNA
  Tet2
gttcgctccctcgcg

SEQ ID NO: 13467 - DNA, 15 bp, Artificial Sequence
  dgRNA
  Chfr
ttctctcatctgcgc

SEQ ID NO: 13468 - DNA, 15 bp, Artificial Sequence
  dgRNA
  Chfr
ccggatagccttttc

SEQ ID NO: 13469 - DNA, 15 bp, Artificial Sequence
  dgRNA
  Chfr
tctagccgtcgctct

SEQ ID NO: 13470 - DNA, 15 bp, Artificial Sequence
  dgRNA
  Chfr
agccgtcgctctcgg

SEQ ID NO: 13471 - DNA, 15 bp, Artificial Sequence
  dgRNA
  Prdm10
aacgcaaggggggtg

SEQ ID NO: 13472 - DNA, 15 bp, Artificial Sequence
  dgRNA
  Prdm10
gaacgcaaggggggt

SEQ ID NO: 13473 - DNA, 15 bp, Artificial Sequence
  dgRNA
  Prdm10
taaagaacgcaaggg

SEQ ID NO: 13474 - DNA, 15 bp, Artificial Sequence
  dgRNA
  Prdm10
gaatttgcacaacta

SEQ ID NO: 13475 - DNA, 15 bp, Artificial Sequence
  dgRNA
  Lrg1
agcctaggagacatt

SEQ ID NO: 13476 - DNA, 15 bp, Artificial Sequence
  dgRNA
  Lrg1
acctcacccttaact

SEQ ID NO: 13477 - DNA, 15 bp, Artificial Sequence
  dgRNA
  Lrg1
gtagcaatgttgacc

SEQ ID NO: 13478 - DNA, 15 bp, Artificial Sequence
  dgRNA
  Lrg1
atgttgacccggccc

SEQ ID NO: 13479 - DNA, 15 bp, Artificial Sequence
  dgRNA
  Lyplal1
ctgcagcaaattctc

SEQ ID NO: 13480 - DNA, 15 bp, Artificial Sequence
  dgRNA
  Lyplal1
cagtcattacaatgg

SEQ ID NO: 13481 - DNA, 15 bp, Artificial Sequence
  dgRNA
  Lyplal1
gaggaacctgaccta

SEQ ID NO: 13482 - DNA, 15 bp, Artificial Sequence
  dgRNA
  Lyplal1
tccttcgtcagattt

SEQ ID NO: 13483 - DNA, 15 bp, Artificial Sequence
  dgRNA
  Sike1
aagttgaactaagac

SEQ ID NO: 13484 - DNA, 15 bp, Artificial Sequence
  dgRNA
  Sike1
acttcgtgaaaaacc

SEQ ID NO: 13485 - DNA, 15 bp, Artificial Sequence
  dgRNA
  Sike1
tgctccaccctagaa

SEQ ID NO: 13486 - DNA, 15 bp, Artificial Sequence
  dgRNA
  Sike1
accctagaaaggcta

SEQ ID NO: 13487 - DNA, 15 bp, Artificial Sequence
  dgRNA
  Rbm10
gcgacacggcgtggg

SEQ ID NO: 13488 - DNA, 15 bp, Artificial Sequence
  dgRNA
  Rbm10
gtagcgacacggcgt

SEQ ID NO: 13489 - DNA, 15 bp, Artificial Sequence
  dgRNA
  Rbm10
ggtagcgacacggcg

SEQ ID NO: 13490 - DNA, 15 bp, Artificial Sequence
  dgRNA
  Rbm10
gattcggtagcgaca

SEQ ID NO: 13491 - DNA, 15 bp, Artificial Sequence
  dgRNA
  Nkx2-2
agagaggcaccgggt

SEQ ID NO: 13492 - DNA, 15 bp, Artificial Sequence
  dgRNA
  Nkx2-2
gcgcccagcgccgcg

SEQ ID NO: 13493 - DNA, 15 bp, Artificial Sequence
  dgRNA
  Nkx2-2
aatgtaggctgtgac

SEQ ID NO: 13494 - DNA, 15 bp, Artificial Sequence
  dgRNA
  Nkx2-2
agcacgcagaaatgt

SEQ ID NO: 13495 - DNA, 15 bp, Artificial Sequence
  dgRNA
  Trim6
attgatagtgagaac

SEQ ID NO: 13496 - DNA, 15 bp, Artificial Sequence
  dgRNA
  Trim6
ttaaacacttgcata

SEQ ID NO: 13497 - DNA, 15 bp, Artificial Sequence
  dgRNA
  Trim6
ttcgcatttctgacc

SEQ ID NO: 13498 - DNA, 15 bp, Artificial Sequence
  dgRNA
  Trim6
cgcatttctgacccg

SEQ ID NO: 13499 - DNA, 15 bp, Artificial Sequence
  dgRNA
  Tsku
ggtggaacccgtgct

SEQ ID NO: 13500 - DNA, 15 bp, Artificial Sequence
  dgRNA
  Tsku
gaacccgtgctcggc

SEQ ID NO: 13501 - DNA, 15 bp, Artificial Sequence
  dgRNA
  Tsku
cccgtgctcggccgg

SEQ ID NO: 13502 - DNA, 15 bp, Artificial Sequence
  dgRNA
  Tsku
ccgtgctcggccggc

SEQ ID NO: 13503 - DNA, 15 bp, Artificial Sequence
  dgRNA
  Srpr
catcggtccgcgcca

SEQ ID NO: 13504 - DNA, 15 bp, Artificial Sequence
  dgRNA
  Srpr
atcggtccgcgccac

SEQ ID NO: 13505 - DNA, 15 bp, Artificial Sequence
  dgRNA
  Srpr
tcggtccgcgccacg

SEQ ID NO: 13506 - DNA, 15 bp, Artificial Sequence
  dgRNA
  Srpr
aacgcgccgattagc

SEQ ID NO: 13507 - DNA, 15 bp, Artificial Sequence
  dgRNA
  Csf1
gattttcgggccttg

SEQ ID NO: 13508 - DNA, 15 bp, Artificial Sequence
  dgRNA
  Csf1
attttcgggccttga

SEQ ID NO: 13509 - DNA, 15 bp, Artificial Sequence
  dgRNA
  Csf1
cgagattgacaagag

SEQ ID NO: 13510 - DNA, 15 bp, Artificial Sequence
  dgRNA
  Csf1
agtggcgagcacaga

SEQ ID NO: 13511 - DNA, 15 bp, Artificial Sequence
  dgRNA
  Pds5a
cgtgcacccgcgcgc

SEQ ID NO: 13512 - DNA, 15 bp, Artificial Sequence
  dgRNA
  Pds5a
ccgcgcgcgggctct

SEQ ID NO: 13513 - DNA, 15 bp, Artificial Sequence
  dgRNA
  Pds5a
cgcgcgggctctcgg

SEQ ID NO: 13514 - DNA, 15 bp, Artificial Sequence
  dgRNA
  Pds5a
ctctcggaggagccg

SEQ ID NO: 13515 - DNA, 15 bp, Artificial Sequence
  dgRNA
  Smad2
acaaccataatatga

SEQ ID NO: 13516 - DNA, 15 bp, Artificial Sequence
  dgRNA
  Smad2
gtaatagatgattct

SEQ ID NO: 13517 - DNA, 15 bp, Artificial Sequence
  dgRNA
  Smad2
ggtatccttccttta

SEQ ID NO: 13518 - DNA, 15 bp, Artificial Sequence
  dgRNA
  Smad2
cctttatggctacta

SEQ ID NO: 13519 - DNA, 15 bp, Artificial Sequence
  dgRNA
  Ipmk
tagacccgctcagtt

SEQ ID NO: 13520 - DNA, 15 bp, Artificial Sequence
  dgRNA
  Ipmk
cgctcagtttggcgc

SEQ ID NO: 13521 - DNA, 15 bp, Artificial Sequence
  dgRNA
  Ipmk
cgctggtctaccttc

SEQ ID NO: 13522 - DNA, 15 bp, Artificial Sequence
  dgRNA
  Ipmk
tctggacgtgttccg

SEQ ID NO: 13523 - DNA, 15 bp, Artificial Sequence
  dgRNA
  Chek2
ttaagggagtcgagg

SEQ ID NO: 13524 - DNA, 15 bp, Artificial Sequence
  dgRNA
  Chek2
aggcgggattagccg

SEQ ID NO: 13525 - DNA, 15 bp, Artificial Sequence
  dgRNA
  Chek2
ggcgggattagccgc

SEQ ID NO: 13526 - DNA, 15 bp, Artificial Sequence
  dgRNA
  Chek2
ccttgagactaatcg

SEQ ID NO: 13527 - DNA, 15 bp, Artificial Sequence
  dgRNA
  Runx1t1
tccccggcggacgcc

SEQ ID NO: 13528 - DNA, 15 bp, Artificial Sequence
  dgRNA
  Runx1t1
cctcgagagcgagcg

SEQ ID NO: 13529 - DNA, 15 bp, Artificial Sequence
  dgRNA
  Runx1t1
ctcgagagcgagcga

SEQ ID NO: 13530 - DNA, 15 bp, Artificial Sequence
  dgRNA
  Runx1t1
cgccgcctgtgacag

SEQ ID NO: 13531 - DNA, 15 bp, Artificial Sequence
  dgRNA
  Dpysl3
ccgcggcttcaccac

SEQ ID NO: 13532 - DNA, 15 bp, Artificial Sequence
  dgRNA
  Dpysl3
gtccctcgcgccctc

SEQ ID NO: 13533 - DNA, 15 bp, Artificial Sequence
  dgRNA
  Dpysl3
gccctctggtggtcg

SEQ ID NO: 13534 - DNA, 15 bp, Artificial Sequence
  dgRNA
  Dpysl3
ctgactccgcggagc

SEQ ID NO: 13535 - DNA, 15 bp, Artificial Sequence
  dgRNA
  Pla2g6
ttgaatgtcgtcacc

SEQ ID NO: 13536 - DNA, 15 bp, Artificial Sequence
  dgRNA
  Pla2g6
gaccctgcttaggac

SEQ ID NO: 13537 - DNA, 15 bp, Artificial Sequence
  dgRNA
  Pla2g6
ccgttaactcctatc

SEQ ID NO: 13538 - DNA, 15 bp, Artificial Sequence
  dgRNA
  Pla2g6
caagacaggggcacc

SEQ ID NO: 13539 - DNA, 15 bp, Artificial Sequence
  dgRNA
  Otud5
tccgtaccgtcccac

SEQ ID NO: 13540 - DNA, 15 bp, Artificial Sequence
  dgRNA
  Otud5
ccgggatctcctcct

SEQ ID NO: 13541 - DNA, 15 bp, Artificial Sequence
  dgRNA
  Otud5
cccgcgtcccgtctg

SEQ ID NO: 13542 - DNA, 15 bp, Artificial Sequence
  dgRNA
  Otud5
ctgcggtcctcgaac

SEQ ID NO: 13543 - DNA, 15 bp, Artificial Sequence
  dgRNA
  Slc35b1
tctattttcgctctg

SEQ ID NO: 13544 - DNA, 15 bp, Artificial Sequence
  dgRNA
  Slc35b1
gccgcgtaatcgcct

SEQ ID NO: 13545 - DNA, 15 bp, Artificial Sequence
  dgRNA
  Slc35b1
tgtcaggcctcggct

SEQ ID NO: 13546 - DNA, 15 bp, Artificial Sequence
  dgRNA
  Slc35b1
ctgtcaggcctcggc

SEQ ID NO: 13547 - DNA, 15 bp, Artificial Sequence
  dgRNA
  Brpf1
accggcgaggaaccg

SEQ ID NO: 13548 - DNA, 15 bp, Artificial Sequence
  dgRNA
  Brpf1
gtctatacagcgcca

SEQ ID NO: 13549 - DNA, 15 bp, Artificial Sequence
  dgRNA
  Brpf1
tctatacagcgccac

SEQ ID NO: 13550 - DNA, 15 bp, Artificial Sequence
  dgRNA
  Brpf1
ggaccacgtttaccc

SEQ ID NO: 13551 - DNA, 15 bp, Artificial Sequence
  dgRNA
  Hnf4a
acagccaaatcctcg

SEQ ID NO: 13552 - DNA, 15 bp, Artificial Sequence
  dgRNA
  Hnf4a
agcctacccagcaac

SEQ ID NO: 13553 - DNA, 15 bp, Artificial Sequence
  dgRNA
  Hnf4a
cctacccagcaacgg

SEQ ID NO: 13554 - DNA, 15 bp, Artificial Sequence
  dgRNA
  Hnf4a
ctaggccaggacgcc

SEQ ID NO: 13555 - DNA, 15 bp, Artificial Sequence
  dgRNA
  Olfr52
acaaaattcgagcac

SEQ ID NO: 13556 - DNA, 15 bp, Artificial Sequence
  dgRNA
  Olfr52
cgagcacaggtgcta

SEQ ID NO: 13557 - DNA, 15 bp, Artificial Sequence
  dgRNA
  Olfr52
caggacatctgtagg

SEQ ID NO: 13558 - DNA, 15 bp, Artificial Sequence
  dgRNA
  Tpm3
accctgtgttccccc

SEQ ID NO: 13559 - DNA, 15 bp, Artificial Sequence
  dgRNA
  Tpm3
cgcaagcacagataa

SEQ ID NO: 13560 - DNA, 15 bp, Artificial Sequence
  dgRNA
  Tpm3
ataaaggttcaaacc

SEQ ID NO: 13561 - DNA, 15 bp, Artificial Sequence
  dgRNA
  Tpm3
cccctgggggaacac

SEQ ID NO: 13562 - DNA, 15 bp, Artificial Sequence
  dgRNA
  Kcnq4
gcgtaataagagagt

SEQ ID NO: 13563 - DNA, 15 bp, Artificial Sequence
  dgRNA
  Kcnq4
agccgccccagtcgc

SEQ ID NO: 13564 - DNA, 15 bp, Artificial Sequence
  dgRNA
  Kcnq4
gccgccccagtcgcc

SEQ ID NO: 13565 - DNA, 15 bp, Artificial Sequence
  dgRNA
  Kcnq4
ccgccccagtcgccg

SEQ ID NO: 13566 - DNA, 15 bp, Artificial Sequence
  dgRNA
  Olfr96
tgggtaagctcccct

SEQ ID NO: 13567 - DNA, 15 bp, Artificial Sequence
  dgRNA
  Olfr96
ctcccctaggccatt

SEQ ID NO: 13568 - DNA, 15 bp, Artificial Sequence
  dgRNA
  Olfr96
ctcctaatggcctag

SEQ ID NO: 13569 - DNA, 15 bp, Artificial Sequence
  dgRNA
  Olfr96
actcctaatggccta

SEQ ID NO: 13570 - DNA, 15 bp, Artificial Sequence
  dgRNA
  Rpl36a
ggataaagcagttac

SEQ ID NO: 13571 - DNA, 15 bp, Artificial Sequence
  dgRNA
  Rpl36a
agcagttactggcgc

SEQ ID NO: 13572 - DNA, 15 bp, Artificial Sequence
  dgRNA
  Rpl36a
gcagttactggcgct

SEQ ID NO: 13573 - DNA, 15 bp, Artificial Sequence
  dgRNA
  Rpl36a
gttactggcgctggg

SEQ ID NO: 13574 - DNA, 15 bp, Artificial Sequence
  dgRNA
  Prkacb
gagaatgtcgtaatg

SEQ ID NO: 13575 - DNA, 15 bp, Artificial Sequence
  dgRNA
  Prkacb
gttggttaaagcttc

SEQ ID NO: 13576 - DNA, 15 bp, Artificial Sequence
  dgRNA
  Prkacb
tacctcttggttaga

SEQ ID NO: 13577 - DNA, 15 bp, Artificial Sequence
  dgRNA
  Prkacb
ggtctaatgttgccg

SEQ ID NO: 13578 - DNA, 15 bp, Artificial Sequence
  dgRNA
  Cplx4
agtgtattaatcata

SEQ ID NO: 13579 - DNA, 15 bp, Artificial Sequence
  dgRNA
  Cplx4
ggttgcgtctgaccg

SEQ ID NO: 13580 - DNA, 15 bp, Artificial Sequence
  dgRNA
  Cplx4
gtgggttttagtaat

SEQ ID NO: 13581 - DNA, 15 bp, Artificial Sequence
  dgRNA
  Cplx4
tcagctaatttcacg

SEQ ID NO: 13582 - DNA, 15 bp, Artificial Sequence
  dgRNA
  Drg2
gatgctcatcgcagc

SEQ ID NO: 13583 - DNA, 15 bp, Artificial Sequence
  dgRNA
  Drg2
catcgcagctggacg

SEQ ID NO: 13584 - DNA, 15 bp, Artificial Sequence
  dgRNA
  Drg2
gcagctggacgaggt

SEQ ID NO: 13585 - DNA, 15 bp, Artificial Sequence
  dgRNA
  Drg2
tggacgaggtaggaa

SEQ ID NO: 13586 - DNA, 15 bp, Artificial Sequence
  dgRNA
  Fstl4
gctctgcttgcgcgc

SEQ ID NO: 13587 - DNA, 15 bp, Artificial Sequence
  dgRNA
  Fstl4
ctctgcttgcgcgcc

SEQ ID NO: 13588 - DNA, 15 bp, Artificial Sequence
  dgRNA
  Fstl4
gctctacacctgccg

SEQ ID NO: 13589 - DNA, 15 bp, Artificial Sequence
  dgRNA
  Fstl4
ctctacacctgccgc

SEQ ID NO: 13590 - DNA, 15 bp, Artificial Sequence
  dgRNA
  Atp4b
ggaccaactgacttc

SEQ ID NO: 13591 - DNA, 15 bp, Artificial Sequence
  dgRNA
  Atp4b
gaccaactgacttct

SEQ ID NO: 13592 - DNA, 15 bp, Artificial Sequence
  dgRNA
  Atp4b
ttctgggacagcgga

SEQ ID NO: 13593 - DNA, 15 bp, Artificial Sequence
  dgRNA
  Atp4b
cccttgtgtttgtag

SEQ ID NO: 13594 - DNA, 15 bp, Artificial Sequence
  dgRNA
  Ccl6
aacaggggcaacgag

SEQ ID NO: 13595 - DNA, 15 bp, Artificial Sequence
  dgRNA
  Ccl6
aaaacaggggcaacg

SEQ ID NO: 13596 - DNA, 15 bp, Artificial Sequence
  dgRNA
  Ccl6
tgcaacaggaagcga

SEQ ID NO: 13597 - DNA, 15 bp, Artificial Sequence
  dgRNA
  Ccl6
atgcaacaggaagcg

SEQ ID NO: 13598 - DNA, 15 bp, Artificial Sequence
  dgRNA
  Fyttd1
tggtgtggaccgtcg

SEQ ID NO: 13599 - DNA, 15 bp, Artificial Sequence
  dgRNA
  Fyttd1
gaccgtcgaggcgct

SEQ ID NO: 13600 - DNA, 15 bp, Artificial Sequence
  dgRNA
  Fyttd1
gacagccgctattcc

SEQ ID NO: 13601 - DNA, 15 bp, Artificial Sequence
  dgRNA
  Fyttd1
ctattcccggcgccc

SEQ ID NO: 13602 - DNA, 15 bp, Artificial Sequence
  dgRNA
  Ak1
tgggaccggttactc

SEQ ID NO: 13603 - DNA, 15 bp, Artificial Sequence
  dgRNA
  Ak1
gggaccggttactca

SEQ ID NO: 13604 - DNA, 15 bp, Artificial Sequence
  dgRNA
  Ak1
ccggttactcagggt

SEQ ID NO: 13605 - DNA, 15 bp, Artificial Sequence
  dgRNA
  Ak1
agaagtaccctcccg

SEQ ID NO: 13606 - DNA, 15 bp, Artificial Sequence
  dgRNA
  Wnk2
tggaacccttgccgc

SEQ ID NO: 13607 - DNA, 15 bp, Artificial Sequence
  dgRNA
  Wnk2
aacccttgccgcagg

SEQ ID NO: 13608 - DNA, 15 bp, Artificial Sequence
  dgRNA
  Wnk2
ccttgccgcaggtgg

SEQ ID NO: 13609 - DNA, 15 bp, Artificial Sequence
  dgRNA
  Wnk2
tggggagcatcccgc

SEQ ID NO: 13610 - DNA, 15 bp, Artificial Sequence
  dgRNA
  Anks1
gaccgcgcctgcgcc

SEQ ID NO: 13611 - DNA, 15 bp, Artificial Sequence
  dgRNA
  Anks1
cgcctgcgccaggct

SEQ ID NO: 13612 - DNA, 15 bp, Artificial Sequence
  dgRNA
  Anks1
cggctccgcacaccg

SEQ ID NO: 13613 - DNA, 15 bp, Artificial Sequence
  dgRNA
  Anks1
ctcccctccgccaag

SEQ ID NO: 13614 - DNA, 15 bp, Artificial Sequence
  dgRNA
  Schip1
ccgaaaagatcttta

SEQ ID NO: 13615 - DNA, 15 bp, Artificial Sequence
  dgRNA
  Schip1
gcaacactagcgggc

SEQ ID NO: 13616 - DNA, 15 bp, Artificial Sequence
  dgRNA
  Schip1
cactagcgggcagga

SEQ ID NO: 13617 - DNA, 15 bp, Artificial Sequence
  dgRNA
  Schip1
atgctgccgcagatt

SEQ ID NO: 13618 - DNA, 15 bp, Artificial Sequence
  dgRNA
  Hbb-bh2
ccagctagtgtaaac

SEQ ID NO: 13619 - DNA, 15 bp, Artificial Sequence
  dgRNA
  Hbb-bh2
aggtaacttgctcat

SEQ ID NO: 13620 - DNA, 15 bp, Artificial Sequence
  dgRNA
  Hbb-bh2
ggtaacttgctcata

SEQ ID NO: 13621 - DNA, 15 bp, Artificial Sequence
  dgRNA
  Hbb-bh2
acttgctcatagggt

SEQ ID NO: 13622 - DNA, 15 bp, Artificial Sequence
  dgRNA
  Trub2
tatcataaacgatcc

SEQ ID NO: 13623 - DNA, 15 bp, Artificial Sequence
  dgRNA
  Trub2
atcataaacgatcct

SEQ ID NO: 13624 - DNA, 15 bp, Artificial Sequence
  dgRNA
  Trub2
atgataggcgcagcc

SEQ ID NO: 13625 - DNA, 15 bp, Artificial Sequence
  dgRNA
  Trub2
aggcgcagccaggtt

SEQ ID NO: 13626 - DNA, 15 bp, Artificial Sequence
  dgRNA
  Mical2
ggctagaaggtactt

SEQ ID NO: 13627 - DNA, 15 bp, Artificial Sequence
  dgRNA
  Mical2
gaccatctccaaata

SEQ ID NO: 13628 - DNA, 15 bp, Artificial Sequence
  dgRNA
  Mical2
caaatatggtccacg

SEQ ID NO: 13629 - DNA, 15 bp, Artificial Sequence
  dgRNA
  Mical2
atggtccacgtggaa

SEQ ID NO: 13630 - DNA, 15 bp, Artificial Sequence
  dgRNA
  Myt1
cctactcccctgctt

SEQ ID NO: 13631 - DNA, 15 bp, Artificial Sequence
  dgRNA
  Myt1
tttggcctgcaggcg

SEQ ID NO: 13632 - DNA, 15 bp, Artificial Sequence
  dgRNA
  Myt1
gcggggcccattgtt

SEQ ID NO: 13633 - DNA, 15 bp, Artificial Sequence
  dgRNA
  Myt1
cggggcccattgttt

SEQ ID NO: 13634 - DNA, 15 bp, Artificial Sequence
  dgRNA
  Taok3
gctccgccaatcccc

SEQ ID NO: 13635 - DNA, 15 bp, Artificial Sequence
  dgRNA
  Taok3
gatccatcgaccgct

SEQ ID NO: 13636 - DNA, 15 bp, Artificial Sequence
  dgRNA
  Taok3
ccgctcggacttccc

SEQ ID NO: 13637 - DNA, 15 bp, Artificial Sequence
  dgRNA
  Taok3
cggacttcccaggca

SEQ ID NO: 13638 - DNA, 15 bp, Artificial Sequence
  dgRNA
  Mterf2
atagaccctgtagtg

SEQ ID NO: 13639 - DNA, 15 bp, Artificial Sequence
  dgRNA
  Mterf2
ctaattggctacgct

SEQ ID NO: 13640 - DNA, 15 bp, Artificial Sequence
  dgRNA
  Mterf2
tggctacgctcggga

SEQ ID NO: 13641 - DNA, 15 bp, Artificial Sequence
  dgRNA
  Mterf2
ctacgctcgggatgg

SEQ ID NO: 13642 - DNA, 15 bp, Artificial Sequence
  dgRNA
  Hacd2
cgctggatgcccaca

SEQ ID NO: 13643 - DNA, 15 bp, Artificial Sequence
  dgRNA
  Hacd2
acacggattgtgcgc

SEQ ID NO: 13644 - DNA, 15 bp, Artificial Sequence
  dgRNA
  Hacd2
ttgtgcgccggaagt

SEQ ID NO: 13645 - DNA, 15 bp, Artificial Sequence
  dgRNA
  Hacd2
tgtgcgccggaagtt

SEQ ID NO: 13646 - DNA, 15 bp, Artificial Sequence
  dgRNA
  Pdgfc
cctgacaaagcgctt

SEQ ID NO: 13647 - DNA, 15 bp, Artificial Sequence
  dgRNA
  Pdgfc
ctgacaaagcgcttt

SEQ ID NO: 13648 - DNA, 15 bp, Artificial Sequence
  dgRNA
  Pdgfc
aaagcgctttgggag

SEQ ID NO: 13649 - DNA, 15 bp, Artificial Sequence
  dgRNA
  Pdgfc
aagcgctttgggagt

SEQ ID NO: 13650 - DNA, 15 bp, Artificial Sequence
  dgRNA
  Lsm12
cttggccgagcagac

SEQ ID NO: 13651 - DNA, 15 bp, Artificial Sequence
  dgRNA
  Lsm12
cgagcagaccggcag

SEQ ID NO: 13652 - DNA, 15 bp, Artificial Sequence
  dgRNA
  Lsm12
ttacgtaggacaaga

SEQ ID NO: 13653 - DNA, 15 bp, Artificial Sequence
  dgRNA
  Lsm12
ctaaatgatttacgt

SEQ ID NO: 13654 - DNA, 15 bp, Artificial Sequence
  dgRNA
  Anapc13
cgtctttggggcatg

SEQ ID NO: 13655 - DNA, 15 bp, Artificial Sequence
  dgRNA
  Anapc13
tttggggcatgcggt

SEQ ID NO: 13656 - DNA, 15 bp, Artificial Sequence
  dgRNA
  Anapc13
tacagagcgcgcccc

SEQ ID NO: 13657 - DNA, 15 bp, Artificial Sequence
  dgRNA
  Anapc13
ggcagagcgcgcctc

SEQ ID NO: 13658 - DNA, 15 bp, Artificial Sequence
  dgRNA
  Pold4
ccaatgagaaacccg

SEQ ID NO: 13659 - DNA, 15 bp, Artificial Sequence
  dgRNA
  Pold4
atgagaaacccgagg

SEQ ID NO: 13660 - DNA, 15 bp, Artificial Sequence
  dgRNA
  Pold4
ctggggcatcttgac

SEQ ID NO: 13661 - DNA, 15 bp, Artificial Sequence
  dgRNA
  Pold4
tctgccgattgccat

SEQ ID NO: 13662 - DNA, 15 bp, Artificial Sequence
  dgRNA
  Olfr58
ttaatgcatgattat

SEQ ID NO: 13663 - DNA, 15 bp, Artificial Sequence
  dgRNA
  Adamts9
caaagcgtaatcgaa

SEQ ID NO: 13664 - DNA, 15 bp, Artificial Sequence
  dgRNA
  Adamts9
aaagcgtaatcgaaa

SEQ ID NO: 13665 - DNA, 15 bp, Artificial Sequence
  dgRNA
  Adamts9
cagtgcagacggctc

SEQ ID NO: 13666 - DNA, 15 bp, Artificial Sequence
  dgRNA
  Adamts9
tctggtgcaataatg

SEQ ID NO: 13667 - DNA, 15 bp, Artificial Sequence
  dgRNA
  Man1b1
gcaggacgcctgcaa

SEQ ID NO: 13668 - DNA, 15 bp, Artificial Sequence
  dgRNA
  Man1b1
acgcctgcaatggag

SEQ ID NO: 13669 - DNA, 15 bp, Artificial Sequence
  dgRNA
  Man1b1
cgattcagcgacgta

SEQ ID NO: 13670 - DNA, 15 bp, Artificial Sequence
  dgRNA
  Man1b1
atgaaataacgtcaa

SEQ ID NO: 13671 - DNA, 15 bp, Artificial Sequence
  dgRNA
  Tfdp2
aggagctttgctgta

SEQ ID NO: 13672 - DNA, 15 bp, Artificial Sequence
  dgRNA
  Psmb7
ctcagcggctttgcc

SEQ ID NO: 13673 - DNA, 15 bp, Artificial Sequence
  dgRNA
  Psmb7
gtccctgatacacgc

SEQ ID NO: 13674 - DNA, 15 bp, Artificial Sequence
  dgRNA
  Psmb7
tctggtctgagcgtc

SEQ ID NO: 13675 - DNA, 15 bp, Artificial Sequence
  dgRNA
  Psmb7
gagcgtcaggagatt

SEQ ID NO: 13676 - DNA, 15 bp, Artificial Sequence
  dgRNA
  Arhgef19
gctaaccccatcttt

SEQ ID NO: 13677 - DNA, 15 bp, Artificial Sequence
  dgRNA
  Arhgef19
ctttaggcagttgtc

SEQ ID NO: 13678 - DNA, 15 bp, Artificial Sequence
  dgRNA
  Arhgef19
cctcttgtacctgac

SEQ ID NO: 13679 - DNA, 15 bp, Artificial Sequence
  dgRNA
  Arhgef19
cctgactggccaaac

SEQ ID NO: 13680 - DNA, 15 bp, Artificial Sequence
  dgRNA
  Ltbp1
catagccccaatatc

SEQ ID NO: 13681 - DNA, 15 bp, Artificial Sequence
  dgRNA
  Ltbp1
cccaatatctggatg

SEQ ID NO: 13682 - DNA, 15 bp, Artificial Sequence
  dgRNA
  Ltbp1
aatatctggatgcgg

SEQ ID NO: 13683 - DNA, 15 bp, Artificial Sequence
  dgRNA
  Ltbp1
atatctggatgcgga

SEQ ID NO: 13684 - DNA, 15 bp, Artificial Sequence
  dgRNA
  Lrrc8c
cgggcccgcctgccc

SEQ ID NO: 13685 - DNA, 15 bp, Artificial Sequence
  dgRNA
  Lrrc8c
cctgccctggacgcc

SEQ ID NO: 13686 - DNA, 15 bp, Artificial Sequence
  dgRNA
  Lrrc8c
gccctggacgcctgg

SEQ ID NO: 13687 - DNA, 15 bp, Artificial Sequence
  dgRNA
  Lrrc8c
gacgcctggtggtct

SEQ ID NO: 13688 - DNA, 15 bp, Artificial Sequence
  dgRNA
  Gba2
tcagattcttacgca

SEQ ID NO: 13689 - DNA, 15 bp, Artificial Sequence
  dgRNA
  Gba2
gattcttacgcatgg

SEQ ID NO: 13690 - DNA, 15 bp, Artificial Sequence
  dgRNA
  Gba2
ccgcccctgcgagac

SEQ ID NO: 13691 - DNA, 15 bp, Artificial Sequence
  dgRNA
  Gba2
cctgcgagaccggct

SEQ ID NO: 13692 - DNA, 15 bp, Artificial Sequence
  dgRNA
  BC048403
aggtggctccgctgc

SEQ ID NO: 13693 - DNA, 15 bp, Artificial Sequence
  dgRNA
  BC048403
tccgctgcaggtctc

SEQ ID NO: 13694 - DNA, 15 bp, Artificial Sequence
  dgRNA
  BC048403
gccctctgcgagccc

SEQ ID NO: 13695 - DNA, 15 bp, Artificial Sequence
  dgRNA
  BC048403
ccctctgcgagcccc

SEQ ID NO: 13696 - DNA, 15 bp, Artificial Sequence
  dgRNA
  Ccdc67
gcccagtctctgcgg

SEQ ID NO: 13697 - DNA, 15 bp, Artificial Sequence
  dgRNA
  Ccdc67
ctgcggtggcgttct

SEQ ID NO: 13698 - DNA, 15 bp, Artificial Sequence
  dgRNA
  Ccdc67
gacccaccggttctc

SEQ ID NO: 13699 - DNA, 15 bp, Artificial Sequence
  dgRNA
  Ccdc67
accggttctctggtt

SEQ ID NO: 13700 - DNA, 15 bp, Artificial Sequence
  dgRNA
  Morc2b
tcaggtgacgctcca

SEQ ID NO: 13701 - DNA, 15 bp, Artificial Sequence
  dgRNA
  Morc2b
ggtgacgctccatgg

SEQ ID NO: 13702 - DNA, 15 bp, Artificial Sequence
  dgRNA
  Morc2b
gacgctccatggagg

SEQ ID NO: 13703 - DNA, 15 bp, Artificial Sequence
  dgRNA
  Morc2b
gctccatggaggcgg

SEQ ID NO: 13704 - DNA, 15 bp, Artificial Sequence
  dgRNA
  Iigp1
gaaggggcataaacc

SEQ ID NO: 13705 - DNA, 15 bp, Artificial Sequence
  dgRNA
  Iigp1
ggggcataaaccagg

SEQ ID NO: 13706 - DNA, 15 bp, Artificial Sequence
  dgRNA
  Mospd3
gatcaagccaatcag

SEQ ID NO: 13707 - DNA, 15 bp, Artificial Sequence
  dgRNA
  Mospd3
aatcagtggtgccaa

SEQ ID NO: 13708 - DNA, 15 bp, Artificial Sequence
  dgRNA
  Mospd3
caaaggaggcgtgtt

SEQ ID NO: 13709 - DNA, 15 bp, Artificial Sequence
  dgRNA
  Mospd3
ccaatcagcgaacat

SEQ ID NO: 13710 - DNA, 15 bp, Artificial Sequence
  dgRNA
  Vamp5
ggtccccaattcacc

SEQ ID NO: 13711 - DNA, 15 bp, Artificial Sequence
  dgRNA
  Vamp5
cccaattcaccaggc

SEQ ID NO: 13712 - DNA, 15 bp, Artificial Sequence
  dgRNA
  Vamp5
ccaattcaccaggct

SEQ ID NO: 13713 - DNA, 15 bp, Artificial Sequence
  dgRNA
  Vamp5
ggtgtcatcggaaat

SEQ ID NO: 13714 - DNA, 15 bp, Artificial Sequence
  dgRNA
  Hist2h4
gtaaggaaccggtag

SEQ ID NO: 13715 - DNA, 15 bp, Artificial Sequence
  dgRNA
  Hist2h4
taaggaaccggtaga

SEQ ID NO: 13716 - DNA, 15 bp, Artificial Sequence
  dgRNA
  Hist2h4
ccggataatttagaa

SEQ ID NO: 13717 - DNA, 15 bp, Artificial Sequence
  dgRNA
  Hist2h4
cctctcatatattag

SEQ ID NO: 13718 - DNA, 15 bp, Artificial Sequence
  dgRNA
  Gm13157
ggtcccgaagtaggt

SEQ ID NO: 13719 - DNA, 15 bp, Artificial Sequence
  dgRNA
  Gm13157
ggctaggcagcatga

SEQ ID NO: 13720 - DNA, 15 bp, Artificial Sequence
  dgRNA
  Gm13157
taagcctacctactt

SEQ ID NO: 13721 - DNA, 15 bp, Artificial Sequence
  dgRNA
  Prps1l3
gtgaagatactccat

SEQ ID NO: 13722 - DNA, 15 bp, Artificial Sequence
  dgRNA
  Prps1l3
ccagttagcgcgcac

SEQ ID NO: 13723 - DNA, 15 bp, Artificial Sequence
  dgRNA
  Prps1l3
cagaacgcgacctcg

SEQ ID NO: 13724 - DNA, 15 bp, Artificial Sequence
  dgRNA
  Prps1l3
agccctccagctcgc

SEQ ID NO: 13725 - DNA, 15 bp, Artificial Sequence
  dgRNA
  Tsg101
gagcgacgcgagccc

SEQ ID NO: 13726 - DNA, 15 bp, Artificial Sequence
  dgRNA
  Tsg101
ccttccgagccgcag

SEQ ID NO: 13727 - DNA, 15 bp, Artificial Sequence
  dgRNA
  Tsg101
cttccgagccgcagc

SEQ ID NO: 13728 - DNA, 15 bp, Artificial Sequence
  dgRNA
  Tsg101
ccgagccgcagcggg

SEQ ID NO: 13729 - DNA, 15 bp, Artificial Sequence
  dgRNA
  Rpgr
caccatatcccctct

SEQ ID NO: 13730 - DNA, 15 bp, Artificial Sequence
  dgRNA
  Rpgr
gtcatttgcaatcct

SEQ ID NO: 13731 - DNA, 15 bp, Artificial Sequence
  dgRNA
  Mapk14
cgtgcgaccacagag

SEQ ID NO: 13732 - DNA, 15 bp, Artificial Sequence
  dgRNA
  Mapk14
gcgcgccccgcgctg

SEQ ID NO: 13733 - DNA, 15 bp, Artificial Sequence
  dgRNA
  Mapk14
ccacccttggcgccc

SEQ ID NO: 13734 - DNA, 15 bp, Artificial Sequence
  dgRNA
  Mapk14
acccttggcgccccg

SEQ ID NO: 13735 - DNA, 15 bp, Artificial Sequence
  dgRNA
  Fzd4
gaggacgccgagcgc

SEQ ID NO: 13736 - DNA, 15 bp, Artificial Sequence
  dgRNA
  Fzd4
aggacgccgagcgcc

SEQ ID NO: 13737 - DNA, 15 bp, Artificial Sequence
  dgRNA
  Fzd4
cgccgggaagccaag

SEQ ID NO: 13738 - DNA, 15 bp, Artificial Sequence
  dgRNA
  Fzd4
gccgggaagccaagc

SEQ ID NO: 13739 - DNA, 15 bp, Artificial Sequence
  dgRNA
  Fam214b
cttatgtggaccaat

SEQ ID NO: 13740 - DNA, 15 bp, Artificial Sequence
  dgRNA
  Fam214b
gtgcgctccttgaag

SEQ ID NO: 13741 - DNA, 15 bp, Artificial Sequence
  dgRNA
  Fam214b
tgcgctccttgaaga

SEQ ID NO: 13742 - DNA, 15 bp, Artificial Sequence
  dgRNA
  Fam214b
cgtgactcacgcttg

SEQ ID NO: 13743 - DNA, 15 bp, Artificial Sequence
  dgRNA
  Tmem88
gtctgccccttagga

SEQ ID NO: 13744 - DNA, 15 bp, Artificial Sequence
  dgRNA
  Tmem88
tctgccccttaggat

SEQ ID NO: 13745 - DNA, 15 bp, Artificial Sequence
  dgRNA
  Tmem88
ctgccccttaggatg

SEQ ID NO: 13746 - DNA, 15 bp, Artificial Sequence
  dgRNA
  Tmem88
ccagagccgcattcc

SEQ ID NO: 13747 - DNA, 15 bp, Artificial Sequence
  dgRNA
  Ckb
ctggggtttcgtctt

SEQ ID NO: 13748 - DNA, 15 bp, Artificial Sequence
  dgRNA
  Ckb
tggggtttcgtctta

SEQ ID NO: 13749 - DNA, 15 bp, Artificial Sequence
  dgRNA
  Ckb
ctgtgcgagcaccac

SEQ ID NO: 13750 - DNA, 15 bp, Artificial Sequence
  dgRNA
  Ckb
gtgcgagcaccaccg

SEQ ID NO: 13751 - DNA, 15 bp, Artificial Sequence
  dgRNA
  Nrf1
tcctggtccgggccc

SEQ ID NO: 13752 - DNA, 15 bp, Artificial Sequence
  dgRNA
  Nrf1
gccgagccgcaccag

SEQ ID NO: 13753 - DNA, 15 bp, Artificial Sequence
  dgRNA
  Nrf1
caccagaggccgacg

SEQ ID NO: 13754 - DNA, 15 bp, Artificial Sequence
  dgRNA
  Nrf1
cagaggccgacgagg

SEQ ID NO: 13755 - DNA, 15 bp, Artificial Sequence
  dgRNA
  Paqr7
ctgtactgtggccgc

SEQ ID NO: 13756 - DNA, 15 bp, Artificial Sequence
  dgRNA
  Paqr7
ggccgcaggaagtcc

SEQ ID NO: 13757 - DNA, 15 bp, Artificial Sequence
  dgRNA
  Paqr7
gccgcaggaagtccc

SEQ ID NO: 13758 - DNA, 15 bp, Artificial Sequence
  dgRNA
  Paqr7
tcccgggatgcgtcg

SEQ ID NO: 13759 - DNA, 15 bp, Artificial Sequence
  dgRNA
  Olfr381
attaggatactagag

SEQ ID NO: 13760 - DNA, 15 bp, Artificial Sequence
  dgRNA
  Olfr381
ctctagtatcctaat

SEQ ID NO: 13761 - DNA, 15 bp, Artificial Sequence
  dgRNA
  Olfr381
tctctagtatcctaa

SEQ ID NO: 13762 - DNA, 15 bp, Artificial Sequence
  dgRNA
  Ang2
tttagactaagtggg

SEQ ID NO: 13763 - DNA, 15 bp, Artificial Sequence
  dgRNA
  Ang2
taatttagactaagt

SEQ ID NO: 13764 - DNA, 15 bp, Artificial Sequence
  dgRNA
  Ang2
ctaatttagactaag

SEQ ID NO: 13765 - DNA, 15 bp, Artificial Sequence
  dgRNA
  Lgr4
cctcttgaccaataa

SEQ ID NO: 13766 - DNA, 15 bp, Artificial Sequence
  dgRNA
  Lgr4
gaccaatagcgctcc

SEQ ID NO: 13767 - DNA, 15 bp, Artificial Sequence
  dgRNA
  Lgr4
atagcgctcccggag

SEQ ID NO: 13768 - DNA, 15 bp, Artificial Sequence
  dgRNA
  Lgr4
tagcgctcccggagc

SEQ ID NO: 13769 - DNA, 15 bp, Artificial Sequence
  dgRNA
  Defb19
aacttcctaggccgg

SEQ ID NO: 13770 - DNA, 15 bp, Artificial Sequence
  dgRNA
  Defb19
gccggaggtcatgtc

SEQ ID NO: 13771 - DNA, 15 bp, Artificial Sequence
  dgRNA
  Defb19
cactgtccttcggac

SEQ ID NO: 13772 - DNA, 15 bp, Artificial Sequence
  dgRNA
  Defb19
cctgctgataaaagg

SEQ ID NO: 13773 - DNA, 15 bp, Artificial Sequence
  dgRNA
  Akna
cacttgtaggaaatc

SEQ ID NO: 13774 - DNA, 15 bp, Artificial Sequence
  dgRNA
  Akna
tgggcgcttcctgca

SEQ ID NO: 13775 - DNA, 15 bp, Artificial Sequence
  dgRNA
  Akna
gcgcttcctgcaagg

SEQ ID NO: 13776 - DNA, 15 bp, Artificial Sequence
  dgRNA
  Akna
agcttaaccctttgc

SEQ ID NO: 13777 - DNA, 15 bp, Artificial Sequence
  dgRNA
  Vmn1r41
ccaatgggaagtcat

SEQ ID NO: 13778 - DNA, 15 bp, Artificial Sequence
  dgRNA
  Vmn1r41
agtatgacatgtttt

SEQ ID NO: 13779 - DNA, 15 bp, Artificial Sequence
  dgRNA
  Icam4
gcaggtatcttcatc

SEQ ID NO: 13780 - DNA, 15 bp, Artificial Sequence
  dgRNA
  Icam4
catcagggccggccg

SEQ ID NO: 13781 - DNA, 15 bp, Artificial Sequence
  dgRNA
  Icam4
ggccgaggcccattc

SEQ ID NO: 13782 - DNA, 15 bp, Artificial Sequence
  dgRNA
  Icam4
gccgaggcccattct

SEQ ID NO: 13783 - DNA, 15 bp, Artificial Sequence
  dgRNA
  Brf1
tcccacggcccgagt

SEQ ID NO: 13784 - DNA, 15 bp, Artificial Sequence
  dgRNA
  Brf1
cccacggcccgagtc

SEQ ID NO: 13785 - DNA, 15 bp, Artificial Sequence
  dgRNA
  Brf1
gcccgagtcgggtcc

SEQ ID NO: 13786 - DNA, 15 bp, Artificial Sequence
  dgRNA
  Brf1
cccgagtcgggtccc

SEQ ID NO: 13787 - DNA, 15 bp, Artificial Sequence
  dgRNA
  Nlrx1
gcgttccttgtttga

SEQ ID NO: 13788 - DNA, 15 bp, Artificial Sequence
  dgRNA
  Nlrx1
tggttacgagaacct

SEQ ID NO: 13789 - DNA, 15 bp, Artificial Sequence
  dgRNA
  Nlrx1
ggttacgagaacctt

SEQ ID NO: 13790 - DNA, 15 bp, Artificial Sequence
  dgRNA
  Nlrx1
aacacggaagtccca

SEQ ID NO: 13791 - DNA, 15 bp, Artificial Sequence
  dgRNA
  Gmpr2
ctgagaccccgcgcg

SEQ ID NO: 13792 - DNA, 15 bp, Artificial Sequence
  dgRNA
  Gmpr2
gcgtggccaccgaac

SEQ ID NO: 13793 - DNA, 15 bp, Artificial Sequence
  dgRNA
  Gmpr2
ccgaactggtgttag

SEQ ID NO: 13794 - DNA, 15 bp, Artificial Sequence
  dgRNA
  Gmpr2
gtgttagcggcgagc

SEQ ID NO: 13795 - DNA, 15 bp, Artificial Sequence
  dgRNA
  Tmem251
ccgcctcccggccga

SEQ ID NO: 13796 - DNA, 15 bp, Artificial Sequence
  dgRNA
  Tmem251
cgcagcaaacgcctc

SEQ ID NO: 13797 - DNA, 15 bp, Artificial Sequence
  dgRNA
  Tmem251
gcagcaaacgcctca

SEQ ID NO: 13798 - DNA, 15 bp, Artificial Sequence
  dgRNA
  Tmem251
acagacaaccgcctc

SEQ ID NO: 13799 - DNA, 15 bp, Artificial Sequence
  dgRNA
  Iqgap2
gcgggtcctcgcaac

SEQ ID NO: 13800 - DNA, 15 bp, Artificial Sequence
  dgRNA
  Iqgap2
cgggtcctcgcaacc

SEQ ID NO: 13801 - DNA, 15 bp, Artificial Sequence
  dgRNA
  Iqgap2
gggcgctgcgctgtg

SEQ ID NO: 13802 - DNA, 15 bp, Artificial Sequence
  dgRNA
  Iqgap2
cgctgtgcggccagt

SEQ ID NO: 13803 - DNA, 15 bp, Artificial Sequence
  dgRNA
  Slc51b
tggggtcattcaccc

SEQ ID NO: 13804 - DNA, 15 bp, Artificial Sequence
  dgRNA
  Slc51b
tcattcaccctggac

SEQ ID NO: 13805 - DNA, 15 bp, Artificial Sequence
  dgRNA
  Slc51b
ggcagagttaccaaa

SEQ ID NO: 13806 - DNA, 15 bp, Artificial Sequence
  dgRNA
  Slc51b
gcagagttaccaaat

SEQ ID NO: 13807 - DNA, 15 bp, Artificial Sequence
  dgRNA
  Cabp7
atccctgcgagcccc

SEQ ID NO: 13808 - DNA, 15 bp, Artificial Sequence
  dgRNA
  Cabp7
ctgcgagcccccggc

SEQ ID NO: 13809 - DNA, 15 bp, Artificial Sequence
  dgRNA
  Cabp7
tgcgagcccccggcc

SEQ ID NO: 13810 - DNA, 15 bp, Artificial Sequence
  dgRNA
  Cabp7
ccgggatcccaacga

SEQ ID NO: 13811 - DNA, 15 bp, Artificial Sequence
  dgRNA
  Awat2
tcacaatcccaactc

SEQ ID NO: 13812 - DNA, 15 bp, Artificial Sequence
  dgRNA
  Awat2
aggctgaactcaaat

SEQ ID NO: 13813 - DNA, 15 bp, Artificial Sequence
  dgRNA
  Awat2
ggccctgcagtctta

SEQ ID NO: 13814 - DNA, 15 bp, Artificial Sequence
  dgRNA
  Awat2
ctgcagtcttagggt

SEQ ID NO: 13815 - DNA, 15 bp, Artificial Sequence
  dgRNA
  Usp21
tggaccatatatgac

SEQ ID NO: 13816 - DNA, 15 bp, Artificial Sequence
  dgRNA
  Usp21
ggaccatatatgact

SEQ ID NO: 13817 - DNA, 15 bp, Artificial Sequence
  dgRNA
  Usp21
ttaaagaccaccatc

SEQ ID NO: 13818 - DNA, 15 bp, Artificial Sequence
  dgRNA
  Usp21
gaccaccatcaggca

SEQ ID NO: 13819 - DNA, 15 bp, Artificial Sequence
  dgRNA
  Lrif1
ggagctcggttttag

SEQ ID NO: 13820 - DNA, 15 bp, Artificial Sequence
  dgRNA
  Lrif1
gagctcggttttagt

SEQ ID NO: 13821 - DNA, 15 bp, Artificial Sequence
  dgRNA
  Lrif1
gcgcagactccgatc

SEQ ID NO: 13822 - DNA, 15 bp, Artificial Sequence
  dgRNA
  Lrif1
gatcaggccctgtcg

SEQ ID NO: 13823 - DNA, 15 bp, Artificial Sequence
  dgRNA
  Gadd45a
ccaccttcgtcccgt

SEQ ID NO: 13824 - DNA, 15 bp, Artificial Sequence
  dgRNA
  Gadd45a
tgctttggtggagcg

SEQ ID NO: 13825 - DNA, 15 bp, Artificial Sequence
  dgRNA
  Gadd45a
gctttggtggagcga

SEQ ID NO: 13826 - DNA, 15 bp, Artificial Sequence
  dgRNA
  Gadd45a
ggtggagcgagggtc

SEQ ID NO: 13827 - DNA, 15 bp, Artificial Sequence
  dgRNA
  Nek7
cgaccgccgtaagcg

SEQ ID NO: 13828 - DNA, 15 bp, Artificial Sequence
  dgRNA
  Nek7
cagttctcgggaaag

SEQ ID NO: 13829 - DNA, 15 bp, Artificial Sequence
  dgRNA
  Nek7
gggaaagtggtagcg

SEQ ID NO: 13830 - DNA, 15 bp, Artificial Sequence
  dgRNA
  Nek7
cgtgggctccggagc

SEQ ID NO: 13831 - DNA, 15 bp, Artificial Sequence
  dgRNA
  Celf1
tgagggctccgcccg

SEQ ID NO: 13832 - DNA, 15 bp, Artificial Sequence
  dgRNA
  Celf1
cgcccgcggccccca

SEQ ID NO: 13833 - DNA, 15 bp, Artificial Sequence
  dgRNA
  Celf1
ccttcactccccggc

SEQ ID NO: 13834 - DNA, 15 bp, Artificial Sequence
  dgRNA
  Celf1
tcactccccggccgg

SEQ ID NO: 13835 - DNA, 15 bp, Artificial Sequence
  dgRNA
  E2f1
gccccgccccgggat

SEQ ID NO: 13836 - DNA, 15 bp, Artificial Sequence
  dgRNA
  E2f1
accaatgctcgccat

SEQ ID NO: 13837 - DNA, 15 bp, Artificial Sequence
  dgRNA
  E2f1
tcgtcacagccgccc

SEQ ID NO: 13838 - DNA, 15 bp, Artificial Sequence
  dgRNA
  E2f1
agccgccccggccaa

SEQ ID NO: 13839 - DNA, 15 bp, Artificial Sequence
  dgRNA
  Gm3286
gttacatggtctaca

SEQ ID NO: 13840 - DNA, 15 bp, Artificial Sequence
  dgRNA
  Gm3286
agttacatggtctac

SEQ ID NO: 13841 - DNA, 15 bp, Artificial Sequence
  dgRNA
  Ikbip
caaattcactcgccc

SEQ ID NO: 13842 - DNA, 15 bp, Artificial Sequence
  dgRNA
  Ikbip
aaattcactcgccca

SEQ ID NO: 13843 - DNA, 15 bp, Artificial Sequence
  dgRNA
  Ikbip
cgtgaccgcaagccc

SEQ ID NO: 13844 - DNA, 15 bp, Artificial Sequence
  dgRNA
  Ikbip
gcgttctcgcatgcg

SEQ ID NO: 13845 - DNA, 15 bp, Artificial Sequence
  dgRNA
  Cby1
ccttagagagtccgc

SEQ ID NO: 13846 - DNA, 15 bp, Artificial Sequence
  dgRNA
  Cby1
cttagagagtccgca

SEQ ID NO: 13847 - DNA, 15 bp, Artificial Sequence
  dgRNA
  Cby1
ggctccgctgcttcg

SEQ ID NO: 13848 - DNA, 15 bp, Artificial Sequence
  dgRNA
  Cby1
tccgctgcttcgcgg

SEQ ID NO: 13849 - DNA, 15 bp, Artificial Sequence
  dgRNA
  1700026L06Rik
tgcgcccagatcata

SEQ ID NO: 13850 - DNA, 15 bp, Artificial Sequence
  dgRNA
  1700026L06Rik
gcgcccagatcatat

SEQ ID NO: 13851 - DNA, 15 bp, Artificial Sequence
  dgRNA
  1700026L06Rik
cgcccagatcatatg

SEQ ID NO: 13852 - DNA, 15 bp, Artificial Sequence
  dgRNA
  1700026L06Rik
gcccagatcatatgg

SEQ ID NO: 13853 - DNA, 15 bp, Artificial Sequence
  dgRNA
  Arid5a
cccctagctgcaaag

SEQ ID NO: 13854 - DNA, 15 bp, Artificial Sequence
  dgRNA
  Arid5a
ccctagctgcaaagt

SEQ ID NO: 13855 - DNA, 15 bp, Artificial Sequence
  dgRNA
  Arid5a
ctcccagacgtcctc

SEQ ID NO: 13856 - DNA, 15 bp, Artificial Sequence
  dgRNA
  Arid5a
acgtcctcgggtcta

SEQ ID NO: 13857 - DNA, 15 bp, Artificial Sequence
  dgRNA
  Olfr382
ttctaattaggatag

SEQ ID NO: 13858 - DNA, 15 bp, Artificial Sequence
  dgRNA
  Paqr8
gtcagtcaacttcct

SEQ ID NO: 13859 - DNA, 15 bp, Artificial Sequence
  dgRNA
  Paqr8
tcaacttcctcggct

SEQ ID NO: 13860 - DNA, 15 bp, Artificial Sequence
  dgRNA
  Paqr8
tcggctgggctgcgg

SEQ ID NO: 13861 - DNA, 15 bp, Artificial Sequence
  dgRNA
  Paqr8
gagtgtgcaccgggc

SEQ ID NO: 13862 - DNA, 15 bp, Artificial Sequence
  dgRNA
  Kctd8
agctctggagtcgcc

SEQ ID NO: 13863 - DNA, 15 bp, Artificial Sequence
  dgRNA
  Kctd8
gctagtagttagcgc

SEQ ID NO: 13864 - DNA, 15 bp, Artificial Sequence
  dgRNA
  Kctd8
agttagcgccggcgc

SEQ ID NO: 13865 - DNA, 15 bp, Artificial Sequence
  dgRNA
  Kctd8
gcgactccagagcta

SEQ ID NO: 13866 - DNA, 15 bp, Artificial Sequence
  dgRNA
  Fam171b
gcctagctaaacgcc

SEQ ID NO: 13867 - DNA, 15 bp, Artificial Sequence
  dgRNA
  Fam171b
cctagctaaacgcct

SEQ ID NO: 13868 - DNA, 15 bp, Artificial Sequence
  dgRNA
  Fam171b
cccgctcgcccctcc

SEQ ID NO: 13869 - DNA, 15 bp, Artificial Sequence
  dgRNA
  Fam171b
gctcgcccctcccgg

SEQ ID NO: 13870 - DNA, 15 bp, Artificial Sequence
  dgRNA
  Krt84
gatgcgggctggagc

SEQ ID NO: 13871 - DNA, 15 bp, Artificial Sequence
  dgRNA
  Krt84
catcaggatgcgggc

SEQ ID NO: 13872 - DNA, 15 bp, Artificial Sequence
  dgRNA
  Krt84
acacctattctcatc

SEQ ID NO: 13873 - DNA, 15 bp, Artificial Sequence
  dgRNA
  Coq7
gtttcctccacgtta

SEQ ID NO: 13874 - DNA, 15 bp, Artificial Sequence
  dgRNA
  Dcn
gctgggcggatgcaa

SEQ ID NO: 13875 - DNA, 15 bp, Artificial Sequence
  dgRNA
  Dcn
ctgggcggatgcaaa

SEQ ID NO: 13876 - DNA, 15 bp, Artificial Sequence
  dgRNA
  Olfr112
aagccttacaaaacc

SEQ ID NO: 13877 - DNA, 15 bp, Artificial Sequence
  dgRNA
  Olfr112
tgacttagaccctgt

SEQ ID NO: 13878 - DNA, 15 bp, Artificial Sequence
  dgRNA
  Olfr112
ttagaccctgttggc

SEQ ID NO: 13879 - DNA, 15 bp, Artificial Sequence
  dgRNA
  Olfr112
tgactagatgctctt

SEQ ID NO: 13880 - DNA, 15 bp, Artificial Sequence
  dgRNA
  Akap12
tgacccgagaagccc

SEQ ID NO: 13881 - DNA, 15 bp, Artificial Sequence
  dgRNA
  Akap12
acccgagaagccctg

SEQ ID NO: 13882 - DNA, 15 bp, Artificial Sequence
  dgRNA
  Akap12
cccgagaagccctgg

SEQ ID NO: 13883 - DNA, 15 bp, Artificial Sequence
  dgRNA
  Akap12
gtcctagcagcctag

SEQ ID NO: 13884 - DNA, 15 bp, Artificial Sequence
  dgRNA
  Dsg4
ttggtgtccaacaaa

SEQ ID NO: 13885 - DNA, 15 bp, Artificial Sequence
  dgRNA
  Dsg4
gagggcaagatttat

SEQ ID NO: 13886 - DNA, 15 bp, Artificial Sequence
  dgRNA
  Dsg4
gcattgttgggctct

SEQ ID NO: 13887 - DNA, 15 bp, Artificial Sequence
  dgRNA
  Cabin1
actgttaagtcctgc

SEQ ID NO: 13888 - DNA, 15 bp, Artificial Sequence
  dgRNA
  Cabin1
cgcacagcgaacccg

SEQ ID NO: 13889 - DNA, 15 bp, Artificial Sequence
  dgRNA
  Cabin1
gcacagcgaacccgt

SEQ ID NO: 13890 - DNA, 15 bp, Artificial Sequence
  dgRNA
  Cabin1
acagcctactccgat

SEQ ID NO: 13891 - DNA, 15 bp, Artificial Sequence
  dgRNA
  Pcdhgb7
cgtttcagattttgg

SEQ ID NO: 13892 - DNA, 15 bp, Artificial Sequence
  dgRNA
  Pcdhgb7
gcgtttcagattttg

SEQ ID NO: 13893 - DNA, 15 bp, Artificial Sequence
  dgRNA
  Pcdhgb7
ggcgtttcagatttt

SEQ ID NO: 13894 - DNA, 15 bp, Artificial Sequence
  dgRNA
  Pcdhgb7
tggcgtttcagattt

SEQ ID NO: 13895 - DNA, 15 bp, Artificial Sequence
  dgRNA
  Psmb3
gatcccaacatgccc

SEQ ID NO: 13896 - DNA, 15 bp, Artificial Sequence
  dgRNA
  Psmb3
catgccccggaccgt

SEQ ID NO: 13897 - DNA, 15 bp, Artificial Sequence
  dgRNA
  Psmb3
tccatacctccgttt

SEQ ID NO: 13898 - DNA, 15 bp, Artificial Sequence
  dgRNA
  Psmb3
ctagtcaatccgagt

SEQ ID NO: 13899 - DNA, 15 bp, Artificial Sequence
  dgRNA
  Pvalb
ccaagggttattaat

SEQ ID NO: 13900 - DNA, 15 bp, Artificial Sequence
  dgRNA
  Pvalb
ggttattaataggcc

SEQ ID NO: 13901 - DNA, 15 bp, Artificial Sequence
  dgRNA
  Pvalb
taggcctggctcaat

SEQ ID NO: 13902 - DNA, 15 bp, Artificial Sequence
  dgRNA
  Pvalb
ctggctcaataggcc

SEQ ID NO: 13903 - DNA, 15 bp, Artificial Sequence
  dgRNA
  Tinagl1
cctgaatcatccctt

SEQ ID NO: 13904 - DNA, 15 bp, Artificial Sequence
  dgRNA
  Tinagl1
ggtcaaggatgtgcc

SEQ ID NO: 13905 - DNA, 15 bp, Artificial Sequence
  dgRNA
  Tinagl1
ctggagggccgggtt

SEQ ID NO: 13906 - DNA, 15 bp, Artificial Sequence
  dgRNA
  Tinagl1
aggctcacggagctc

SEQ ID NO: 13907 - DNA, 15 bp, Artificial Sequence
  dgRNA
  Inpp5d
acgcttctggaggtt

SEQ ID NO: 13908 - DNA, 15 bp, Artificial Sequence
  dgRNA
  Inpp5d
ggttaggtcccattc

SEQ ID NO: 13909 - DNA, 15 bp, Artificial Sequence
  dgRNA
  Inpp5d
gttaggtcccattca

SEQ ID NO: 13910 - DNA, 15 bp, Artificial Sequence
  dgRNA
  Inpp5d
ctatttcccctgaat

SEQ ID NO: 13911 - DNA, 15 bp, Artificial Sequence
  dgRNA
  Aard
gaacttctagtcaca

SEQ ID NO: 13912 - DNA, 15 bp, Artificial Sequence
  dgRNA
  Aard
tccgttgttgctatg

SEQ ID NO: 13913 - DNA, 15 bp, Artificial Sequence
  dgRNA
  Aard
gagcagcgctctgag

SEQ ID NO: 13914 - DNA, 15 bp, Artificial Sequence
  dgRNA
  Aard
agcgctctgagtggc

SEQ ID NO: 13915 - DNA, 15 bp, Artificial Sequence
  dgRNA
  Dnmt3l
gggggcttagtcttc

SEQ ID NO: 13916 - DNA, 15 bp, Artificial Sequence
  dgRNA
  Dnmt3l
ggtgggagcctgcga

SEQ ID NO: 13917 - DNA, 15 bp, Artificial Sequence
  dgRNA
  Dnmt3l
tgggagcctgcgaag

SEQ ID NO: 13918 - DNA, 15 bp, Artificial Sequence
  dgRNA
  Dnmt3l
gagcctgcgaagggg

SEQ ID NO: 13919 - DNA, 15 bp, Artificial Sequence
  dgRNA
  Eef2k
cccttgcagcattgt

SEQ ID NO: 13920 - DNA, 15 bp, Artificial Sequence
  dgRNA
  Eef2k
cagcattgttggttg

SEQ ID NO: 13921 - DNA, 15 bp, Artificial Sequence
  dgRNA
  Eef2k
agcattgttggttga

SEQ ID NO: 13922 - DNA, 15 bp, Artificial Sequence
  dgRNA
  Eef2k
ggtgttggcaggcgt

SEQ ID NO: 13923 - DNA, 15 bp, Artificial Sequence
  dgRNA
  Tpm1
gcggcctcggaggct

SEQ ID NO: 13924 - DNA, 15 bp, Artificial Sequence
  dgRNA
  Tpm1
cggcctcggaggctc

SEQ ID NO: 13925 - DNA, 15 bp, Artificial Sequence
  dgRNA
  Tpm1
atatccaccgtcaac

SEQ ID NO: 13926 - DNA, 15 bp, Artificial Sequence
  dgRNA
  Tpm1
tatccaccgtcaact

SEQ ID NO: 13927 - DNA, 15 bp, Artificial Sequence
  dgRNA
  Hoxb1
tgtcatgctaatgat

SEQ ID NO: 13928 - DNA, 15 bp, Artificial Sequence
  dgRNA
  Hoxb1
gtcatgctaatgatt

SEQ ID NO: 13929 - DNA, 15 bp, Artificial Sequence
  dgRNA
  Hoxb1
gtgatggatgggcgc

SEQ ID NO: 13930 - DNA, 15 bp, Artificial Sequence
  dgRNA
  Hoxb1
tgatggatgggcgct

SEQ ID NO: 13931 - DNA, 15 bp, Artificial Sequence
  dgRNA
  Mtmr14
cgcggtggtttagcc

SEQ ID NO: 13932 - DNA, 15 bp, Artificial Sequence
  dgRNA
  Mtmr14
agcccggcttccccc

SEQ ID NO: 13933 - DNA, 15 bp, Artificial Sequence
  dgRNA
  Mtmr14
gcccggcttcccccg

SEQ ID NO: 13934 - DNA, 15 bp, Artificial Sequence
  dgRNA
  Mtmr14
cccggggaaacccct

SEQ ID NO: 13935 - DNA, 15 bp, Artificial Sequence
  dgRNA
  Vgll1
tgcaggtgcctaacc

SEQ ID NO: 13936 - DNA, 15 bp, Artificial Sequence
  dgRNA
  Vgll1
accaggttgactcgc

SEQ ID NO: 13937 - DNA, 15 bp, Artificial Sequence
  dgRNA
  Vgll1
cacaaccccagctag

SEQ ID NO: 13938 - DNA, 15 bp, Artificial Sequence
  dgRNA
  Vgll1
acaaccccagctaga

SEQ ID NO: 13939 - DNA, 15 bp, Artificial Sequence
  dgRNA
  Cpne5
cctccccgctgcgcc

SEQ ID NO: 13940 - DNA, 15 bp, Artificial Sequence
  dgRNA
  Cpne5
ctccccgctgcgcct

SEQ ID NO: 13941 - DNA, 15 bp, Artificial Sequence
  dgRNA
  Cpne5
cgccccgtttctcct

SEQ ID NO: 13942 - DNA, 15 bp, Artificial Sequence
  dgRNA
  Cpne5
gccccgtttctcctc

SEQ ID NO: 13943 - DNA, 15 bp, Artificial Sequence
  dgRNA
  Anapc11
tggcgggcgcggatt

SEQ ID NO: 13944 - DNA, 15 bp, Artificial Sequence
  dgRNA
  Anapc11
ggcgggcgcggattc

SEQ ID NO: 13945 - DNA, 15 bp, Artificial Sequence
  dgRNA
  Anapc11
cgcggattcgggcct

SEQ ID NO: 13946 - DNA, 15 bp, Artificial Sequence
  dgRNA
  Anapc11
cgcgtcagcacgccg

SEQ ID NO: 13947 - DNA, 15 bp, Artificial Sequence
  dgRNA
  Aff4
cccccgcgctgcctg

SEQ ID NO: 13948 - DNA, 15 bp, Artificial Sequence
  dgRNA
  Aff4
ccccgcgctgcctgc

SEQ ID NO: 13949 - DNA, 15 bp, Artificial Sequence
  dgRNA
  Aff4
cgcgctgcctgcggg

SEQ ID NO: 13950 - DNA, 15 bp, Artificial Sequence
  dgRNA
  Aff4
cgctgcctgcgggag

SEQ ID NO: 13951 - DNA, 15 bp, Artificial Sequence
  dgRNA
  Polr2k
tccccccgcactgcg

SEQ ID NO: 13952 - DNA, 15 bp, Artificial Sequence
  dgRNA
  Polr2k
ccccccgcactgcga

SEQ ID NO: 13953 - DNA, 15 bp, Artificial Sequence
  dgRNA
  Polr2k
cgcactgcgagggag

SEQ ID NO: 13954 - DNA, 15 bp, Artificial Sequence
  dgRNA
  Polr2k
cgtttcgtcataaat

SEQ ID NO: 13955 - DNA, 15 bp, Artificial Sequence
  dgRNA
  Nme3
ttacatgtgtaccgc

SEQ ID NO: 13956 - DNA, 15 bp, Artificial Sequence
  dgRNA
  Nme3
gtgtaccgcaggaca

SEQ ID NO: 13957 - DNA, 15 bp, Artificial Sequence
  dgRNA
  Nme3
tgtaccgcaggacaa

SEQ ID NO: 13958 - DNA, 15 bp, Artificial Sequence
  dgRNA
  Nme3
accgcaggacaaggg

SEQ ID NO: 13959 - DNA, 15 bp, Artificial Sequence
  dgRNA
  Cpne6
ccatgaactcggggc

SEQ ID NO: 13960 - DNA, 15 bp, Artificial Sequence
  dgRNA
  Cpne6
tgcgcatgcatccca

SEQ ID NO: 13961 - DNA, 15 bp, Artificial Sequence
  dgRNA
  Cpne6
gcgcatgcatcccac

SEQ ID NO: 13962 - DNA, 15 bp, Artificial Sequence
  dgRNA
  Cpne6
atcccacgggcagca

SEQ ID NO: 13963 - DNA, 15 bp, Artificial Sequence
  dgRNA
  Cyb561d1
gttgggagctcgatt

SEQ ID NO: 13964 - DNA, 15 bp, Artificial Sequence
  dgRNA
  Cyb561d1
gctcgattaggtcag

SEQ ID NO: 13965 - DNA, 15 bp, Artificial Sequence
  dgRNA
  Cyb561d1
cgattaggtcagtgg

SEQ ID NO: 13966 - DNA, 15 bp, Artificial Sequence
  dgRNA
  Cyb561d1
gtcagtggaggtttc

SEQ ID NO: 13967 - DNA, 15 bp, Artificial Sequence
  dgRNA
  Stam2
ctgccgtgtctgatc

SEQ ID NO: 13968 - DNA, 15 bp, Artificial Sequence
  dgRNA
  Stam2
tgtctgatcaggcgt

SEQ ID NO: 13969 - DNA, 15 bp, Artificial Sequence
  dgRNA
  Stam2
gatcaggcgtcggat

SEQ ID NO: 13970 - DNA, 15 bp, Artificial Sequence
  dgRNA
  Stam2
atcaggcgtcggatc

SEQ ID NO: 13971 - DNA, 15 bp, Artificial Sequence
  dgRNA
  Cyp2c50
aggtaagatctctta

SEQ ID NO: 13972 - DNA, 15 bp, Artificial Sequence
  dgRNA
  Cyp2c50
accgcataaagaaca

SEQ ID NO: 13973 - DNA, 15 bp, Artificial Sequence
  dgRNA
  Cyp2c50
tgttccaaagtgcaa

SEQ ID NO: 13974 - DNA, 15 bp, Artificial Sequence
  dgRNA
  Cnnm2
cacctcccgtgccat

SEQ ID NO: 13975 - DNA, 15 bp, Artificial Sequence
  dgRNA
  Cnnm2
cccgtgccattggtg

SEQ ID NO: 13976 - DNA, 15 bp, Artificial Sequence
  dgRNA
  Cnnm2
gcacccgctcttgat

SEQ ID NO: 13977 - DNA, 15 bp, Artificial Sequence
  dgRNA
  Cnnm2
ccgctcttgattggc

SEQ ID NO: 13978 - DNA, 15 bp, Artificial Sequence
  dgRNA
  Enpp2
aagtgtctgttcaag

SEQ ID NO: 13979 - DNA, 15 bp, Artificial Sequence
  dgRNA
  Enpp2
tgtctgttcaagggg

SEQ ID NO: 13980 - DNA, 15 bp, Artificial Sequence
  dgRNA
  Enpp2
tctgttcaaggggag

SEQ ID NO: 13981 - DNA, 15 bp, Artificial Sequence
  dgRNA
  Enpp2
ggaggggccggtcgg

SEQ ID NO: 13982 - DNA, 15 bp, Artificial Sequence
  dgRNA
  Mxi1
gctgtctacgcagct

SEQ ID NO: 13983 - DNA, 15 bp, Artificial Sequence
  dgRNA
  Mxi1
cgcagctaggatttg

SEQ ID NO: 13984 - DNA, 15 bp, Artificial Sequence
  dgRNA
  Mxi1
ctaggatttgcggag

SEQ ID NO: 13985 - DNA, 15 bp, Artificial Sequence
  dgRNA
  Mxi1
gatttgcggagaggc

SEQ ID NO: 13986 - DNA, 15 bp, Artificial Sequence
  dgRNA
  Stxbp5l
agtggagcttgtgat

SEQ ID NO: 13987 - DNA, 15 bp, Artificial Sequence
  dgRNA
  Stxbp5l
gatgtcccgcccccc

SEQ ID NO: 13988 - DNA, 15 bp, Artificial Sequence
  dgRNA
  Stxbp5l
agagtgccccgcccc

SEQ ID NO: 13989 - DNA, 15 bp, Artificial Sequence
  dgRNA
  Stxbp5l
cccggcgcgagagtc

SEQ ID NO: 13990 - DNA, 15 bp, Artificial Sequence
  dgRNA
  Ncf2
tgaccagcccacggc

SEQ ID NO: 13991 - DNA, 15 bp, Artificial Sequence
  dgRNA
  Ncf2
tcagttcctgaacga

SEQ ID NO: 13992 - DNA, 15 bp, Artificial Sequence
  dgRNA
  Ncf2
cagttcctgaacgat

SEQ ID NO: 13993 - DNA, 15 bp, Artificial Sequence
  dgRNA
  Ncf2
agttcctgaacgatg

SEQ ID NO: 13994 - DNA, 15 bp, Artificial Sequence
  dgRNA
  Ipo8
catggcggccgtctg

SEQ ID NO: 13995 - DNA, 15 bp, Artificial Sequence
  dgRNA
  Ipo8
atggcggccgtctgc

SEQ ID NO: 13996 - DNA, 15 bp, Artificial Sequence
  dgRNA
  Ipo8
ccgtctgcgggagtc

SEQ ID NO: 13997 - DNA, 15 bp, Artificial Sequence
  dgRNA
  Ipo8
cgggagtctggtgtt

SEQ ID NO: 13998 - DNA, 15 bp, Artificial Sequence
  dgRNA
  Fgf17
gggtgcaacaggttg

SEQ ID NO: 13999 - DNA, 15 bp, Artificial Sequence
  dgRNA
  Fgf17
aacagtgggtgcaac

SEQ ID NO: 14000 - DNA, 15 bp, Artificial Sequence
  dgRNA
  Fgf17
cccttgccactagga

SEQ ID NO: 14001 - DNA, 15 bp, Artificial Sequence
  dgRNA
  Fgf17
agcagccttaaaagg

SEQ ID NO: 14002 - DNA, 15 bp, Artificial Sequence
  dgRNA
  Tfcp2l1
aggcacagctccggc

SEQ ID NO: 14003 - DNA, 15 bp, Artificial Sequence
  dgRNA
  Tfcp2l1
ggccgtgctagccgt

SEQ ID NO: 14004 - DNA, 15 bp, Artificial Sequence
  dgRNA
  Tfcp2l1
gccgtgctagccgta

SEQ ID NO: 14005 - DNA, 15 bp, Artificial Sequence
  dgRNA
  Tfcp2l1
tgctagccgtaggga

SEQ ID NO: 14006 - DNA, 15 bp, Artificial Sequence
  dgRNA
  Olfr402
tttgtaacgtgtagc

SEQ ID NO: 14007 - DNA, 15 bp, Artificial Sequence
  dgRNA
  Trap1a
tcctgatcactcatt

SEQ ID NO: 14008 - DNA, 15 bp, Artificial Sequence
  dgRNA
  Trap1a
agcttactgttctcg

SEQ ID NO: 14009 - DNA, 15 bp, Artificial Sequence
  dgRNA
  Trap1a
gcttactgttctcgt

SEQ ID NO: 14010 - DNA, 15 bp, Artificial Sequence
  dgRNA
  Trap1a
cttactgttctcgtg

SEQ ID NO: 14011 - DNA, 15 bp, Artificial Sequence
  dgRNA
  4930579F01Rik
atccctgccatacaa

SEQ ID NO: 14012 - DNA, 15 bp, Artificial Sequence
  dgRNA
  4930579F01Rik
caacactagaatgtg

SEQ ID NO: 14013 - DNA, 15 bp, Artificial Sequence
  dgRNA
  4930579F01Rik
ggggcttaacaggac

SEQ ID NO: 14014 - DNA, 15 bp, Artificial Sequence
  dgRNA
  4930579F01Rik
ctcatggggcttaac

SEQ ID NO: 14015 - DNA, 15 bp, Artificial Sequence
  dgRNA
  Asb5
agccagaaccgaaag

SEQ ID NO: 14016 - DNA, 15 bp, Artificial Sequence
  dgRNA
  Asb5
gccagaaccgaaaga

SEQ ID NO: 14017 - DNA, 15 bp, Artificial Sequence
  dgRNA
  Asb5
ttgcgaaacgtgatt

SEQ ID NO: 14018 - DNA, 15 bp, Artificial Sequence
  dgRNA
  Asb5
attcggctgctccca

SEQ ID NO: 14019 - DNA, 15 bp, Artificial Sequence
  dgRNA
  Mettl23
tcgtagtagttgtgc

SEQ ID NO: 14020 - DNA, 15 bp, Artificial Sequence
  dgRNA
  Mettl23
cgtagtagttgtgcc

SEQ ID NO: 14021 - DNA, 15 bp, Artificial Sequence
  dgRNA
  Mettl23
cgagtccttgagctc

SEQ ID NO: 14022 - DNA, 15 bp, Artificial Sequence
  dgRNA
  Mettl23
gccgcgcacttcgct

SEQ ID NO: 14023 - DNA, 15 bp, Artificial Sequence
  dgRNA
  Lrrc6
cccattaggaagtaa

SEQ ID NO: 14024 - DNA, 15 bp, Artificial Sequence
  dgRNA
  Lrrc6
ccgcaggaggtcagg

SEQ ID NO: 14025 - DNA, 15 bp, Artificial Sequence
  dgRNA
  Lrrc6
cagccgcaggaggtc

SEQ ID NO: 14026 - DNA, 15 bp, Artificial Sequence
  dgRNA
  Wtap
cgcgtctcgggtgag

SEQ ID NO: 14027 - DNA, 15 bp, Artificial Sequence
  dgRNA
  Wtap
gcgtctcgggtgagt

SEQ ID NO: 14028 - DNA, 15 bp, Artificial Sequence
  dgRNA
  Wtap
cgggtgagtgggcca

SEQ ID NO: 14029 - DNA, 15 bp, Artificial Sequence
  dgRNA
  Wtap
tgagtgggccacggg

SEQ ID NO: 14030 - DNA, 15 bp, Artificial Sequence
  dgRNA
  9430015G10Rik
tttcccagtcagcgc

SEQ ID NO: 14031 - DNA, 15 bp, Artificial Sequence
  dgRNA
  9430015G10Rik
ttcccagtcagcgct

SEQ ID NO: 14032 - DNA, 15 bp, Artificial Sequence
  dgRNA
  9430015G10Rik
cgcaaacccgctgcc

SEQ ID NO: 14033 - DNA, 15 bp, Artificial Sequence
  dgRNA
  9430015G10Rik
aacccgctgccagga

SEQ ID NO: 14034 - DNA, 15 bp, Artificial Sequence
  dgRNA
  Fat2
actgtacttaatgac

SEQ ID NO: 14035 - DNA, 15 bp, Artificial Sequence
  dgRNA
  Fhl1
cctacatccaccgcc

SEQ ID NO: 14036 - DNA, 15 bp, Artificial Sequence
  dgRNA
  Fhl1
tccaccgcccggccg

SEQ ID NO: 14037 - DNA, 15 bp, Artificial Sequence
  dgRNA
  Fhl1
ccaccgcccggccga

SEQ ID NO: 14038 - DNA, 15 bp, Artificial Sequence
  dgRNA
  Fhl1
caccgcccggccgag

SEQ ID NO: 14039 - DNA, 15 bp, Artificial Sequence
  dgRNA
  Hdac7
tcggggcttcagggt

SEQ ID NO: 14040 - DNA, 15 bp, Artificial Sequence
  dgRNA
  Hdac7
ttcggggcttcaggg

SEQ ID NO: 14041 - DNA, 15 bp, Artificial Sequence
  dgRNA
  Hdac7
aggtgtgcagcttcg

SEQ ID NO: 14042 - DNA, 15 bp, Artificial Sequence
  dgRNA
  Hdac7
agcggggtcgggtga

SEQ ID NO: 14043 - DNA, 15 bp, Artificial Sequence
  dgRNA
  Arpp21
atgtgggtcctaaca

SEQ ID NO: 14044 - DNA, 15 bp, Artificial Sequence
  dgRNA
  Arpp21
tgtgggtcctaacat

SEQ ID NO: 14045 - DNA, 15 bp, Artificial Sequence
  dgRNA
  Arpp21
gggtcctaacatggg

SEQ ID NO: 14046 - DNA, 15 bp, Artificial Sequence
  dgRNA
  Arpp21
ggtcctaacatgggt

SEQ ID NO: 14047 - DNA, 15 bp, Artificial Sequence
  dgRNA
  Dpp6
gtgccaccgctacag

SEQ ID NO: 14048 - DNA, 15 bp, Artificial Sequence
  dgRNA
  Dpp6
tgccaccgctacagc

SEQ ID NO: 14049 - DNA, 15 bp, Artificial Sequence
  dgRNA
  Dpp6
cgctacagcgggagc

SEQ ID NO: 14050 - DNA, 15 bp, Artificial Sequence
  dgRNA
  Dpp6
gctaccctactgaga

SEQ ID NO: 14051 - DNA, 15 bp, Artificial Sequence
  dgRNA
  Tjp1
cgacggcacgtctct

SEQ ID NO: 14052 - DNA, 15 bp, Artificial Sequence
  dgRNA
  Tjp1
cggcacgtctctcgg

SEQ ID NO: 14053 - DNA, 15 bp, Artificial Sequence
  dgRNA
  Tjp1
ggcggccgcgcgttc

SEQ ID NO: 14054 - DNA, 15 bp, Artificial Sequence
  dgRNA
  Tjp1
gcggccgcgcgttcc

SEQ ID NO: 14055 - DNA, 15 bp, Artificial Sequence
  dgRNA
  1700080E11Rik
ccaaaccccgagtag

SEQ ID NO: 14056 - DNA, 15 bp, Artificial Sequence
  dgRNA
  1700080E11Rik
tcctaactatgactt

SEQ ID NO: 14057 - DNA, 15 bp, Artificial Sequence
  dgRNA
  1700080E11Rik
acgccctagtccgat

SEQ ID NO: 14058 - DNA, 15 bp, Artificial Sequence
  dgRNA
  1700080E11Rik
actcggggtttggac

SEQ ID NO: 14059 - DNA, 15 bp, Artificial Sequence
  dgRNA
  Azin1
acctgccaggcccgg

SEQ ID NO: 14060 - DNA, 15 bp, Artificial Sequence
  dgRNA
  Azin1
ggtggtcccgccctt

SEQ ID NO: 14061 - DNA, 15 bp, Artificial Sequence
  dgRNA
  Azin1
tcccacattccccgg

SEQ ID NO: 14062 - DNA, 15 bp, Artificial Sequence
  dgRNA
  Azin1
attccccggcggcac

SEQ ID NO: 14063 - DNA, 15 bp, Artificial Sequence
  dgRNA
  Foxn4
tgaccgccccacccc

SEQ ID NO: 14064 - DNA, 15 bp, Artificial Sequence
  dgRNA
  Foxn4
agggccgggagccgc

SEQ ID NO: 14065 - DNA, 15 bp, Artificial Sequence
  dgRNA
  Foxn4
gccgcggggcgcacg

SEQ ID NO: 14066 - DNA, 15 bp, Artificial Sequence
  dgRNA
  Foxn4
acgaggctgacttgc

SEQ ID NO: 14067 - DNA, 15 bp, Artificial Sequence
  dgRNA
  Slc2a7
tgggaggccaacctc

SEQ ID NO: 14068 - DNA, 15 bp, Artificial Sequence
  dgRNA
  Slc2a7
aacagtagacccagc

SEQ ID NO: 14069 - DNA, 15 bp, Artificial Sequence
  dgRNA
  Slc2a7
agggccccgtagcat

SEQ ID NO: 14070 - DNA, 15 bp, Artificial Sequence
  dgRNA
  Slc2a7
cccgtagcatcggag

SEQ ID NO: 14071 - DNA, 15 bp, Artificial Sequence
  dgRNA
  Chst14
cgtgttaaagagaca

SEQ ID NO: 14072 - DNA, 15 bp, Artificial Sequence
  dgRNA
  Chst14
ttctctcccgggcta

SEQ ID NO: 14073 - DNA, 15 bp, Artificial Sequence
  dgRNA
  Chst14
gctagggtccgcctg

SEQ ID NO: 14074 - DNA, 15 bp, Artificial Sequence
  dgRNA
  Chst14
ccgcaactagctcct

SEQ ID NO: 14075 - DNA, 15 bp, Artificial Sequence
  dgRNA
  Grik3
ggtgggaagcccgcg

SEQ ID NO: 14076 - DNA, 15 bp, Artificial Sequence
  dgRNA
  Grik3
gtgggaagcccgcgc

SEQ ID NO: 14077 - DNA, 15 bp, Artificial Sequence
  dgRNA
  Grik3
cgagccgacgcgagc

SEQ ID NO: 14078 - DNA, 15 bp, Artificial Sequence
  dgRNA
  Grik3
gcagccgagtccgag

SEQ ID NO: 14079 - DNA, 15 bp, Artificial Sequence
  dgRNA
  Kcnj15
tagggctgagcttgc

SEQ ID NO: 14080 - DNA, 15 bp, Artificial Sequence
  dgRNA
  Kcnj15
agattagtattcatt

SEQ ID NO: 14081 - DNA, 15 bp, Artificial Sequence
  dgRNA
  Kcnj15
gtcagactctaccca

SEQ ID NO: 14082 - DNA, 15 bp, Artificial Sequence
  dgRNA
  Kcnj15
ggtcagactctaccc

SEQ ID NO: 14083 - DNA, 15 bp, Artificial Sequence
  dgRNA
  Syt12
tgtcggtaagtgacc

SEQ ID NO: 14084 - DNA, 15 bp, Artificial Sequence
  dgRNA
  Syt12
atcacaactcaatca

SEQ ID NO: 14085 - DNA, 15 bp, Artificial Sequence
  dgRNA
  Syt12
caactcaatcatgga

SEQ ID NO: 14086 - DNA, 15 bp, Artificial Sequence
  dgRNA
  Syt12
agaagggaatactgc

SEQ ID NO: 14087 - DNA, 15 bp, Artificial Sequence
  dgRNA
  Mtmr11
gggttaagggaatct

SEQ ID NO: 14088 - DNA, 15 bp, Artificial Sequence
  dgRNA
  Mtmr11
gcgtattctccttta

SEQ ID NO: 14089 - DNA, 15 bp, Artificial Sequence
  dgRNA
  Mtmr11
cgtattctcctttaa

SEQ ID NO: 14090 - DNA, 15 bp, Artificial Sequence
  dgRNA
  Mtmr11
ttcgtgaatattagt

SEQ ID NO: 14091 - DNA, 15 bp, Artificial Sequence
  dgRNA
  Tmem53
aagacagtaggggcg

SEQ ID NO: 14092 - DNA, 15 bp, Artificial Sequence
  dgRNA
  Tmem53
cggggcgcggttgct

SEQ ID NO: 14093 - DNA, 15 bp, Artificial Sequence
  dgRNA
  Tmem53
ggggcgcggttgcta

SEQ ID NO: 14094 - DNA, 15 bp, Artificial Sequence
  dgRNA
  Tmem53
cgcggttgctagggc

SEQ ID NO: 14095 - DNA, 15 bp, Artificial Sequence
  dgRNA
  Son
gcagctctaccccgg

SEQ ID NO: 14096 - DNA, 15 bp, Artificial Sequence
  dgRNA
  Son
gcggctcagaaacag

SEQ ID NO: 14097 - DNA, 15 bp, Artificial Sequence
  dgRNA
  Son
gctcagaaacagcgg

SEQ ID NO: 14098 - DNA, 15 bp, Artificial Sequence
  dgRNA
  Son
cggaggagagcgggc

SEQ ID NO: 14099 - DNA, 15 bp, Artificial Sequence
  dgRNA
  Mnda
gaccacagtatttac

SEQ ID NO: 14100 - DNA, 15 bp, Artificial Sequence
  dgRNA
  Mnda
aacgaaactgggagt

SEQ ID NO: 14101 - DNA, 15 bp, Artificial Sequence
  dgRNA
  Uspl1
tatgggagcccgtcg

SEQ ID NO: 14102 - DNA, 15 bp, Artificial Sequence
  dgRNA
  Uspl1
tggcgtccgccatga

SEQ ID NO: 14103 - DNA, 15 bp, Artificial Sequence
  dgRNA
  Uspl1
ccatgacggcccgcc

SEQ ID NO: 14104 - DNA, 15 bp, Artificial Sequence
  dgRNA
  Uspl1
catgacggcccgcca

SEQ ID NO: 14105 - DNA, 15 bp, Artificial Sequence
  dgRNA
  Tshr
cgaggttgggtgtct

SEQ ID NO: 14106 - DNA, 15 bp, Artificial Sequence
  dgRNA
  Tshr
gtgtctcggaacaga

SEQ ID NO: 14107 - DNA, 15 bp, Artificial Sequence
  dgRNA
  Tshr
acagaaggcgctgcg

SEQ ID NO: 14108 - DNA, 15 bp, Artificial Sequence
  dgRNA
  Tshr
tgaagtgccgcaagc

SEQ ID NO: 14109 - DNA, 15 bp, Artificial Sequence
  dgRNA
  Casc4
cgcgagtaccagcgc

SEQ ID NO: 14110 - DNA, 15 bp, Artificial Sequence
  dgRNA
  Casc4
cccgcttccctgcgg

SEQ ID NO: 14111 - DNA, 15 bp, Artificial Sequence
  dgRNA
  Casc4
ccgcttccctgcggc

SEQ ID NO: 14112 - DNA, 15 bp, Artificial Sequence
  dgRNA
  Casc4
gccttcgactctcgg

SEQ ID NO: 14113 - DNA, 15 bp, Artificial Sequence
  dgRNA
  Dnmt3a
cgcgcccctcgggcc

SEQ ID NO: 14114 - DNA, 15 bp, Artificial Sequence
  dgRNA
  Dnmt3a
gcgcccctcgggccc

SEQ ID NO: 14115 - DNA, 15 bp, Artificial Sequence
  dgRNA
  Dnmt3a
cctcgggcccgggtg

SEQ ID NO: 14116 - DNA, 15 bp, Artificial Sequence
  dgRNA
  Dnmt3a
ctcgggcccgggtga

SEQ ID NO: 14117 - DNA, 15 bp, Artificial Sequence
  dgRNA
  Tmem74b
tgcaccgggctccac

SEQ ID NO: 14118 - DNA, 15 bp, Artificial Sequence
  dgRNA
  Tmem74b
gctcaagagtgtgcg

SEQ ID NO: 14119 - DNA, 15 bp, Artificial Sequence
  dgRNA
  Tmem74b
gagtgtgcgtggccg

SEQ ID NO: 14120 - DNA, 15 bp, Artificial Sequence
  dgRNA
  Tmem74b
ccggtgcaggtgcac

SEQ ID NO: 14121 - DNA, 15 bp, Artificial Sequence
  dgRNA
  Tfe3
ccgcctcccggggcg

SEQ ID NO: 14122 - DNA, 15 bp, Artificial Sequence
  dgRNA
  Tfe3
cggggcgtggcctaa

SEQ ID NO: 14123 - DNA, 15 bp, Artificial Sequence
  dgRNA
  Tfe3
aaggcccttttccga

SEQ ID NO: 14124 - DNA, 15 bp, Artificial Sequence
  dgRNA
  Tfe3
aggcccttttccgaa

SEQ ID NO: 14125 - DNA, 15 bp, Artificial Sequence
  dgRNA
  Tlk2
ccgccggcggctgcc

SEQ ID NO: 14126 - DNA, 15 bp, Artificial Sequence
  dgRNA
  Tlk2
cgccggcggctgccc

SEQ ID NO: 14127 - DNA, 15 bp, Artificial Sequence
  dgRNA
  Tlk2
cggctgcccgggcgg

SEQ ID NO: 14128 - DNA, 15 bp, Artificial Sequence
  dgRNA
  Tlk2
ggggttgcggcgctc

SEQ ID NO: 14129 - DNA, 15 bp, Artificial Sequence
  dgRNA
  Cnot7
ttattgaaaaaacct

SEQ ID NO: 14130 - DNA, 15 bp, Artificial Sequence
  dgRNA
  Cnot7
ttggattgtgattga

SEQ ID NO: 14131 - DNA, 15 bp, Artificial Sequence
  dgRNA
  Cnot7
taatgtagagctgtg

SEQ ID NO: 14132 - DNA, 15 bp, Artificial Sequence
  dgRNA
  Cnot7
taaatagaagtcgga

SEQ ID NO: 14133 - DNA, 15 bp, Artificial Sequence
  dgRNA
  Vmn1r224
cagaattctccgttt

SEQ ID NO: 14134 - DNA, 15 bp, Artificial Sequence
  dgRNA
  Vmn1r224
tgcaatctagagccc

SEQ ID NO: 14135 - DNA, 15 bp, Artificial Sequence
  dgRNA
  Vmn1r224
ttcacatcaacaacc

SEQ ID NO: 14136 - DNA, 15 bp, Artificial Sequence
  dgRNA
  Vmn1r224
caagtcaataaccca

SEQ ID NO: 14137 - DNA, 15 bp, Artificial Sequence
  dgRNA
  Iqck
gcagcaccttcctcg

SEQ ID NO: 14138 - DNA, 15 bp, Artificial Sequence
  dgRNA
  Iqck
ccacccgcactcacc

SEQ ID NO: 14139 - DNA, 15 bp, Artificial Sequence
  dgRNA
  Iqck
acctggttcgctagc

SEQ ID NO: 14140 - DNA, 15 bp, Artificial Sequence
  dgRNA
  Iqck
cgcgcagccgcgatc

SEQ ID NO: 14141 - DNA, 15 bp, Artificial Sequence
  dgRNA
  Rab32
tctgaccactacccc

SEQ ID NO: 14142 - DNA, 15 bp, Artificial Sequence
  dgRNA
  Rab32
ggttacttgacatca

SEQ ID NO: 14143 - DNA, 15 bp, Artificial Sequence
  dgRNA
  Rab32
atcatggaccagccc

SEQ ID NO: 14144 - DNA, 15 bp, Artificial Sequence
  dgRNA
  Rab32
cgctgtggaccgctc

SEQ ID NO: 14145 - DNA, 15 bp, Artificial Sequence
  dgRNA
  4732456N10Rik
cccaccgtgattagc

SEQ ID NO: 14146 - DNA, 15 bp, Artificial Sequence
  dgRNA
  4732456N10Rik
ccgtgattagcaggc

SEQ ID NO: 14147 - DNA, 15 bp, Artificial Sequence
  dgRNA
  4732456N10Rik
ggccagacatgccat

SEQ ID NO: 14148 - DNA, 15 bp, Artificial Sequence
  dgRNA
  4732456N10Rik
gccagacatgccatt

SEQ ID NO: 14149 - DNA, 15 bp, Artificial Sequence
  dgRNA
  Efhd1
gtctcagcttatgag

SEQ ID NO: 14150 - DNA, 15 bp, Artificial Sequence
  dgRNA
  Efhd1
gcaaacgcgacccct

SEQ ID NO: 14151 - DNA, 15 bp, Artificial Sequence
  dgRNA
  Efhd1
cgccccgcctaccca

SEQ ID NO: 14152 - DNA, 15 bp, Artificial Sequence
  dgRNA
  Efhd1
gttcttttcaaccgc

SEQ ID NO: 14153 - DNA, 15 bp, Artificial Sequence
  dgRNA
  Nr1d1
aaatcccaacaatcc

SEQ ID NO: 14154 - DNA, 15 bp, Artificial Sequence
  dgRNA
  Nr1d1
atcctggcggtgcgc

SEQ ID NO: 14155 - DNA, 15 bp, Artificial Sequence
  dgRNA
  Nr1d1
cagatctcaacgtgc

SEQ ID NO: 14156 - DNA, 15 bp, Artificial Sequence
  dgRNA
  Nr1d1
caacgtgccggctgc

SEQ ID NO: 14157 - DNA, 15 bp, Artificial Sequence
  dgRNA
  Ccnb3
tttgaccccgtccct

SEQ ID NO: 14158 - DNA, 15 bp, Artificial Sequence
  dgRNA
  Ccnb3
ttaaagtccaactga

SEQ ID NO: 14159 - DNA, 15 bp, Artificial Sequence
  dgRNA
  Ccnb3
gcctgccggtgaaaa

SEQ ID NO: 14160 - DNA, 15 bp, Artificial Sequence
  dgRNA
  Ccnb3
ccggtgaaaatggta

SEQ ID NO: 14161 - DNA, 15 bp, Artificial Sequence
  dgRNA
  Wdr20
ttgcgcacgcccctc

SEQ ID NO: 14162 - DNA, 15 bp, Artificial Sequence
  dgRNA
  Wdr20
tgcgcacgcccctcc

SEQ ID NO: 14163 - DNA, 15 bp, Artificial Sequence
  dgRNA
  Wdr20
gcacgcccctccggg

SEQ ID NO: 14164 - DNA, 15 bp, Artificial Sequence
  dgRNA
  Wdr20
cgggtggagcgcgcc

SEQ ID NO: 14165 - DNA, 15 bp, Artificial Sequence
  dgRNA
  Scfd1
aagagtagcgacctc

SEQ ID NO: 14166 - DNA, 15 bp, Artificial Sequence
  dgRNA
  Scfd1
agtagcgacctcggg

SEQ ID NO: 14167 - DNA, 15 bp, Artificial Sequence
  dgRNA
  Scfd1
agttagaaacgctgc

SEQ ID NO: 14168 - DNA, 15 bp, Artificial Sequence
  dgRNA
  Scfd1
gttagaaacgctgct

SEQ ID NO: 14169 - DNA, 15 bp, Artificial Sequence
  dgRNA
  Cep55
cgcccttcgccaagc

SEQ ID NO: 14170 - DNA, 15 bp, Artificial Sequence
  dgRNA
  Cep55
cccgccctacagccg

SEQ ID NO: 14171 - DNA, 15 bp, Artificial Sequence
  dgRNA
  Cep55
ccgccctacagccgc

SEQ ID NO: 14172 - DNA, 15 bp, Artificial Sequence
  dgRNA
  Cep55
cgggattcaaactcc

SEQ ID NO: 14173 - DNA, 15 bp, Artificial Sequence
  dgRNA
  Fip1l1
ctaagctagaatcct

SEQ ID NO: 14174 - DNA, 15 bp, Artificial Sequence
  dgRNA
  Fip1l1
gaggagccaatcgcg

SEQ ID NO: 14175 - DNA, 15 bp, Artificial Sequence
  dgRNA
  Fip1l1
cgcttgcgcaatgag

SEQ ID NO: 14176 - DNA, 15 bp, Artificial Sequence
  dgRNA
  Fip1l1
cgcaatgagaggccc

SEQ ID NO: 14177 - DNA, 15 bp, Artificial Sequence
  dgRNA
  Tmed4
ctgggcagcttcatt

SEQ ID NO: 14178 - DNA, 15 bp, Artificial Sequence
  dgRNA
  Tmed4
gcagcttcattgggc

SEQ ID NO: 14179 - DNA, 15 bp, Artificial Sequence
  dgRNA
  Tmed4
aggctagtttacgct

SEQ ID NO: 14180 - DNA, 15 bp, Artificial Sequence
  dgRNA
  Tmed4
ggctagtttacgcta

SEQ ID NO: 14181 - DNA, 15 bp, Artificial Sequence
  dgRNA
  Parvg
gacacgacacactgc

SEQ ID NO: 14182 - DNA, 15 bp, Artificial Sequence
  dgRNA
  Parvg
ctcaggcccatcacg

SEQ ID NO: 14183 - DNA, 15 bp, Artificial Sequence
  dgRNA
  Parvg
cccatcacgaggacg

SEQ ID NO: 14184 - DNA, 15 bp, Artificial Sequence
  dgRNA
  Parvg
atcacgaggacgagg

SEQ ID NO: 14185 - DNA, 15 bp, Artificial Sequence
  dgRNA
  Meikin
ccacctaaggagctt

SEQ ID NO: 14186 - DNA, 15 bp, Artificial Sequence
  dgRNA
  Meikin
ggttcagtagtccat

SEQ ID NO: 14187 - DNA, 15 bp, Artificial Sequence
  dgRNA
  Meikin
aaggccctacttgac

SEQ ID NO: 14188 - DNA, 15 bp, Artificial Sequence
  dgRNA
  Meikin
cgcggccgtaaaaag

SEQ ID NO: 14189 - DNA, 15 bp, Artificial Sequence
  dgRNA
  Btla
ctctcacaaatcctt

SEQ ID NO: 14190 - DNA, 15 bp, Artificial Sequence
  dgRNA
  Btla
tgaagatctctaggg

SEQ ID NO: 14191 - DNA, 15 bp, Artificial Sequence
  dgRNA
  Btla
gtgtgagtagtccga

SEQ ID NO: 14192 - DNA, 15 bp, Artificial Sequence
  dgRNA
  Olfr355
aggttttgacgacac

SEQ ID NO: 14193 - DNA, 15 bp, Artificial Sequence
  dgRNA
  Olfr355
tgacgacacaggttt

SEQ ID NO: 14194 - DNA, 15 bp, Artificial Sequence
  dgRNA
  Olfr355
ggactaaagccttgc

SEQ ID NO: 14195 - DNA, 15 bp, Artificial Sequence
  dgRNA
  Olfr355
gactaaagccttgct

SEQ ID NO: 14196 - DNA, 15 bp, Artificial Sequence
  dgRNA
  Pbp2
gggagtcattcattg

SEQ ID NO: 14197 - DNA, 15 bp, Artificial Sequence
  dgRNA
  Pbp2
aactgtgtgctcccg

SEQ ID NO: 14198 - DNA, 15 bp, Artificial Sequence
  dgRNA
  Mtmr1
cctgattgctcaggc

SEQ ID NO: 14199 - DNA, 15 bp, Artificial Sequence
  dgRNA
  Mtmr1
gggttggcgacccgc

SEQ ID NO: 14200 - DNA, 15 bp, Artificial Sequence
  dgRNA
  Mtmr1
cgacccgcaggttcc

SEQ ID NO: 14201 - DNA, 15 bp, Artificial Sequence
  dgRNA
  Mtmr1
gacccgcaggttcct

SEQ ID NO: 14202 - DNA, 15 bp, Artificial Sequence
  dgRNA
  Cyb561
tgtgcagatgcggaa

SEQ ID NO: 14203 - DNA, 15 bp, Artificial Sequence
  dgRNA
  Cyb561
cagatgcggaagggc

SEQ ID NO: 14204 - DNA, 15 bp, Artificial Sequence
  dgRNA
  Cyb561
ccatctccgcccacg

SEQ ID NO: 14205 - DNA, 15 bp, Artificial Sequence
  dgRNA
  Cyb561
catctccgcccacga

SEQ ID NO: 14206 - DNA, 15 bp, Artificial Sequence
  dgRNA
  Lrp12
cgcgctcagtctggc

SEQ ID NO: 14207 - DNA, 15 bp, Artificial Sequence
  dgRNA
  Lrp12
gctcagtctggcggg

SEQ ID NO: 14208 - DNA, 15 bp, Artificial Sequence
  dgRNA
  Lrp12
cgccggctggttgtg

SEQ ID NO: 14209 - DNA, 15 bp, Artificial Sequence
  dgRNA
  Lrp12
tggttgtgcggcgcg

SEQ ID NO: 14210 - DNA, 15 bp, Artificial Sequence
  dgRNA
  B3gnt5
gctcaggtgcacatt

SEQ ID NO: 14211 - DNA, 15 bp, Artificial Sequence
  dgRNA
  B3gnt5
gaggcaatcgcttcc

SEQ ID NO: 14212 - DNA, 15 bp, Artificial Sequence
  dgRNA
  B3gnt5
cacagatagcacttt

SEQ ID NO: 14213 - DNA, 15 bp, Artificial Sequence
  dgRNA
  B3gnt5
acagatagcacttta

SEQ ID NO: 14214 - DNA, 15 bp, Artificial Sequence
  dgRNA
  Actrt2
ttatcaacatcaccc

SEQ ID NO: 14215 - DNA, 15 bp, Artificial Sequence
  dgRNA
  Actrt2
tatcaacatcaccca

SEQ ID NO: 14216 - DNA, 15 bp, Artificial Sequence
  dgRNA
  Actrt2
atagagccacactgc

SEQ ID NO: 14217 - DNA, 15 bp, Artificial Sequence
  dgRNA
  Actrt2
caattgttacttcac

SEQ ID NO: 14218 - DNA, 15 bp, Artificial Sequence
  dgRNA
  Gprin3
gcgggactcagccac

SEQ ID NO: 14219 - DNA, 15 bp, Artificial Sequence
  dgRNA
  Gprin3
cgggactcagccact

SEQ ID NO: 14220 - DNA, 15 bp, Artificial Sequence
  dgRNA
  Gprin3
gcctggtcacagcgg

SEQ ID NO: 14221 - DNA, 15 bp, Artificial Sequence
  dgRNA
  Gprin3
ctggtcacagcggag

SEQ ID NO: 14222 - DNA, 15 bp, Artificial Sequence
  dgRNA
  Iqcf6
gcatgccccaaggat

SEQ ID NO: 14223 - DNA, 15 bp, Artificial Sequence
  dgRNA
  Iqcf6
cttgaccaatccaga

SEQ ID NO: 14224 - DNA, 15 bp, Artificial Sequence
  dgRNA
  Iqcf6
gtgactaatagttga

SEQ ID NO: 14225 - DNA, 15 bp, Artificial Sequence
  dgRNA
  Iqcf6
actaatagttgaggg

SEQ ID NO: 14226 - DNA, 15 bp, Artificial Sequence
  dgRNA
  Dhrs3
gggagccacaccgag

SEQ ID NO: 14227 - DNA, 15 bp, Artificial Sequence
  dgRNA
  Dhrs3
cggcaactcccagcc

SEQ ID NO: 14228 - DNA, 15 bp, Artificial Sequence
  dgRNA
  Dhrs3
ccgggctgcaagaga

SEQ ID NO: 14229 - DNA, 15 bp, Artificial Sequence
  dgRNA
  Dhrs3
agcgggcgcgcgcga

SEQ ID NO: 14230 - DNA, 15 bp, Artificial Sequence
  dgRNA
  Cd53
aaaccagcttagaat

SEQ ID NO: 14231 - DNA, 15 bp, Artificial Sequence
  dgRNA
  Cd53
cagcttagaataggc

SEQ ID NO: 14232 - DNA, 15 bp, Artificial Sequence
  dgRNA
  Cd53
agcttagaataggct

SEQ ID NO: 14233 - DNA, 15 bp, Artificial Sequence
  dgRNA
  Cd53
ctacaaaatacccgt

SEQ ID NO: 14234 - DNA, 15 bp, Artificial Sequence
  dgRNA
  Pou6f1
cctgaccgccgcccc

SEQ ID NO: 14235 - DNA, 15 bp, Artificial Sequence
  dgRNA
  Pou6f1
gaccgccgcccccgg

SEQ ID NO: 14236 - DNA, 15 bp, Artificial Sequence
  dgRNA
  Pou6f1
gccgcccccggcggc

SEQ ID NO: 14237 - DNA, 15 bp, Artificial Sequence
  dgRNA
  Pou6f1
ccccggcggctggcg

SEQ ID NO: 14238 - DNA, 15 bp, Artificial Sequence
  dgRNA
  Mcm8
tttgctccagccgct

SEQ ID NO: 14239 - DNA, 15 bp, Artificial Sequence
  dgRNA
  Mcm8
cagccgctaggagcc

SEQ ID NO: 14240 - DNA, 15 bp, Artificial Sequence
  dgRNA
  Mcm8
gagcccggcacgacc

SEQ ID NO: 14241 - DNA, 15 bp, Artificial Sequence
  dgRNA
  Mcm8
cccggcacgaccagg

SEQ ID NO: 14242 - DNA, 15 bp, Artificial Sequence
  dgRNA
  Ap1b1
accctttcgattcca

SEQ ID NO: 14243 - DNA, 15 bp, Artificial Sequence
  dgRNA
  Ap1b1
ctgaacttagccgct

SEQ ID NO: 14244 - DNA, 15 bp, Artificial Sequence
  dgRNA
  Ap1b1
ccgcttggcccgccc

SEQ ID NO: 14245 - DNA, 15 bp, Artificial Sequence
  dgRNA
  Ap1b1
aagccggctctgcta

SEQ ID NO: 14246 - DNA, 15 bp, Artificial Sequence
  dgRNA
  Suv420h2
agctgtttgttacgc

SEQ ID NO: 14247 - DNA, 15 bp, Artificial Sequence
  dgRNA
  Suv420h2
ttgttacgccggccg

SEQ ID NO: 14248 - DNA, 15 bp, Artificial Sequence
  dgRNA
  Suv420h2
tgttacgccggccga

SEQ ID NO: 14249 - DNA, 15 bp, Artificial Sequence
  dgRNA
  Suv420h2
gttacgccggccgag

SEQ ID NO: 14250 - DNA, 15 bp, Artificial Sequence
  dgRNA
  Kdelr2
aaatcgctggcacct

SEQ ID NO: 14251 - DNA, 15 bp, Artificial Sequence
  dgRNA
  Kdelr2
tcgctggcacctagg

SEQ ID NO: 14252 - DNA, 15 bp, Artificial Sequence
  dgRNA
  Kdelr2
cctaggcggaaaccc

SEQ ID NO: 14253 - DNA, 15 bp, Artificial Sequence
  dgRNA
  Kdelr2
agacggaaattgcgg

SEQ ID NO: 14254 - DNA, 15 bp, Artificial Sequence
  dgRNA
  Gtf2a1l
tcccttagctaaagt

SEQ ID NO: 14255 - DNA, 15 bp, Artificial Sequence
  dgRNA
  Gtf2a1l
ctaacctttcttgcc

SEQ ID NO: 14256 - DNA, 15 bp, Artificial Sequence
  dgRNA
  Gtf2a1l
cagctccgcccccag

SEQ ID NO: 14257 - DNA, 15 bp, Artificial Sequence
  dgRNA
  Gtf2a1l
ggttgcgcagcaacg

SEQ ID NO: 14258 - DNA, 15 bp, Artificial Sequence
  dgRNA
  Sipa1l3
cgtgtctgatgagta

SEQ ID NO: 14259 - DNA, 15 bp, Artificial Sequence
  dgRNA
  Sipa1l3
ccccaaagggaatat

SEQ ID NO: 14260 - DNA, 15 bp, Artificial Sequence
  dgRNA
  Sipa1l3
gaatattggcagaac

SEQ ID NO: 14261 - DNA, 15 bp, Artificial Sequence
  dgRNA
  Sipa1l3
ggaactccggtaagc

SEQ ID NO: 14262 - DNA, 15 bp, Artificial Sequence
  dgRNA
  Tsn
aaccgcgccactcgc

SEQ ID NO: 14263 - DNA, 15 bp, Artificial Sequence
  dgRNA
  Tsn
atgcataaactgaat

SEQ ID NO: 14264 - DNA, 15 bp, Artificial Sequence
  dgRNA
  Tsn
tacttcaagcaaggg

SEQ ID NO: 14265 - DNA, 15 bp, Artificial Sequence
  dgRNA
  Tsn
gtgtacttcaagcaa

SEQ ID NO: 14266 - DNA, 15 bp, Artificial Sequence
  dgRNA
  Commd7
tattcagggtctccc

SEQ ID NO: 14267 - DNA, 15 bp, Artificial Sequence
  dgRNA
  Commd7
gacttggaatcttac

SEQ ID NO: 14268 - DNA, 15 bp, Artificial Sequence
  dgRNA
  Commd7
acttggaatcttact

SEQ ID NO: 14269 - DNA, 15 bp, Artificial Sequence
  dgRNA
  Commd7
gctcagagcggttcc

SEQ ID NO: 14270 - DNA, 15 bp, Artificial Sequence
  dgRNA
  Satl1
ccaccagtgaattag

SEQ ID NO: 14271 - DNA, 15 bp, Artificial Sequence
  dgRNA
  Satl1
ttaattaccgtcttc

SEQ ID NO: 14272 - DNA, 15 bp, Artificial Sequence
  dgRNA
  Satl1
tgagttaagacaaac

SEQ ID NO: 14273 - DNA, 15 bp, Artificial Sequence
  dgRNA
  Satl1
gatagtcctctctca

SEQ ID NO: 14274 - DNA, 15 bp, Artificial Sequence
  dgRNA
  Tamm41
gctaggctctatagc

SEQ ID NO: 14275 - DNA, 15 bp, Artificial Sequence
  dgRNA
  Tamm41
atagcaggttgtcac

SEQ ID NO: 14276 - DNA, 15 bp, Artificial Sequence
  dgRNA
  Tamm41
aatgtgctcctccgc

SEQ ID NO: 14277 - DNA, 15 bp, Artificial Sequence
  dgRNA
  Tamm41
tcctccgccggctag

SEQ ID NO: 14278 - DNA, 15 bp, Artificial Sequence
  dgRNA
  Slc30a6
atccgcccacttccc

SEQ ID NO: 14279 - DNA, 15 bp, Artificial Sequence
  dgRNA
  Slc30a6
ccacttcccaggcgg

SEQ ID NO: 14280 - DNA, 15 bp, Artificial Sequence
  dgRNA
  Slc30a6
aaaagacggcgacct

SEQ ID NO: 14281 - DNA, 15 bp, Artificial Sequence
  dgRNA
  Slc30a6
aaagacggcgaccta

SEQ ID NO: 14282 - DNA, 15 bp, Artificial Sequence
  dgRNA
  Crem
aacacttgagctacg

SEQ ID NO: 14283 - DNA, 15 bp, Artificial Sequence
  dgRNA
  Crem
gagctacgaggtgca

SEQ ID NO: 14284 - DNA, 15 bp, Artificial Sequence
  dgRNA
  Crem
agctacgaggtgcac

SEQ ID NO: 14285 - DNA, 15 bp, Artificial Sequence
  dgRNA
  Crem
cgaggtgcacgggat

SEQ ID NO: 14286 - DNA, 15 bp, Artificial Sequence
  dgRNA
  9030624G23Rik
gagcggaagtcgcca

SEQ ID NO: 14287 - DNA, 15 bp, Artificial Sequence
  dgRNA
  Lmbr1
gcagcacgcgtcaga

SEQ ID NO: 14288 - DNA, 15 bp, Artificial Sequence
  dgRNA
  Lmbr1
gcgcctagcgacctt

SEQ ID NO: 14289 - DNA, 15 bp, Artificial Sequence
  dgRNA
  Lmbr1
gcgccccacgcgcag

SEQ ID NO: 14290 - DNA, 15 bp, Artificial Sequence
  dgRNA
  Lmbr1
ctcttctctgacgta

SEQ ID NO: 14291 - DNA, 15 bp, Artificial Sequence
  dgRNA
  Wbscr16
taagtcccctactca

SEQ ID NO: 14292 - DNA, 15 bp, Artificial Sequence
  dgRNA
  Wbscr16
ctactcatggataga

SEQ ID NO: 14293 - DNA, 15 bp, Artificial Sequence
  dgRNA
  Wbscr16
agccagtagtaagca

SEQ ID NO: 14294 - DNA, 15 bp, Artificial Sequence
  dgRNA
  Wbscr16
gtatctacttccgcc

SEQ ID NO: 14295 - DNA, 15 bp, Artificial Sequence
  dgRNA
  Hdac7
tcggtgtctgccgcc

SEQ ID NO: 14296 - DNA, 15 bp, Artificial Sequence
  dgRNA
  Hdac7
ctgctgagcgaagcc

SEQ ID NO: 14297 - DNA, 15 bp, Artificial Sequence
  dgRNA
  Hdac7
tgctgagcgaagccc

SEQ ID NO: 14298 - DNA, 15 bp, Artificial Sequence
  dgRNA
  Hdac7
tgagcgaagcccggg

SEQ ID NO: 14299 - DNA, 15 bp, Artificial Sequence
  dgRNA
  G2e3
ccaccccgaaagcca

SEQ ID NO: 14300 - DNA, 15 bp, Artificial Sequence
  dgRNA
  G2e3
gcgtccacttccccg

SEQ ID NO: 14301 - DNA, 15 bp, Artificial Sequence
  dgRNA
  G2e3
tccacttccccgggg

SEQ ID NO: 14302 - DNA, 15 bp, Artificial Sequence
  dgRNA
  G2e3
cacttccccggggag

SEQ ID NO: 14303 - DNA, 15 bp, Artificial Sequence
  dgRNA
  Ldb3
tagctgcgtgagtca

SEQ ID NO: 14304 - DNA, 15 bp, Artificial Sequence
  dgRNA
  Ldb3
ctgcgtgagtcatgg

SEQ ID NO: 14305 - DNA, 15 bp, Artificial Sequence
  dgRNA
  Ldb3
tcatggtggaccggc

SEQ ID NO: 14306 - DNA, 15 bp, Artificial Sequence
  dgRNA
  Ldb3
ggtggaccggctggg

SEQ ID NO: 14307 - DNA, 15 bp, Artificial Sequence
  dgRNA
  Tnfrsf22
tgttaataacgtcat

SEQ ID NO: 14308 - DNA, 15 bp, Artificial Sequence
  dgRNA
  Tnfrsf22
agcactgattgtggt

SEQ ID NO: 14309 - DNA, 15 bp, Artificial Sequence
  dgRNA
  Tnfrsf22
cccgcccacgagata

SEQ ID NO: 14310 - DNA, 15 bp, Artificial Sequence
  dgRNA
  Tnfrsf22
ggaaccaatccgctg

SEQ ID NO: 14311 - DNA, 15 bp, Artificial Sequence
  dgRNA
  Slc9a8
agtccggatgtccca

SEQ ID NO: 14312 - DNA, 15 bp, Artificial Sequence
  dgRNA
  Slc9a8
gatcgtcacacagcc

SEQ ID NO: 14313 - DNA, 15 bp, Artificial Sequence
  dgRNA
  Slc9a8
ggtcgtcccactccc

SEQ ID NO: 14314 - DNA, 15 bp, Artificial Sequence
  dgRNA
  Slc9a8
cgcagagggtcgccc

SEQ ID NO: 14315 - DNA, 15 bp, Artificial Sequence
  dgRNA
  Gpam
acgaagcatgcagct

SEQ ID NO: 14316 - DNA, 15 bp, Artificial Sequence
  dgRNA
  Gpam
cgaagcatgcagctt

SEQ ID NO: 14317 - DNA, 15 bp, Artificial Sequence
  dgRNA
  Gpam
gccttacgctaagcc

SEQ ID NO: 14318 - DNA, 15 bp, Artificial Sequence
  dgRNA
  Gpam
ttacgctaagcctgg

SEQ ID NO: 14319 - DNA, 15 bp, Artificial Sequence
  dgRNA
  Rrp12
tcttggcggtgcatc

SEQ ID NO: 14320 - DNA, 15 bp, Artificial Sequence
  dgRNA
  Rrp12
gatcgcaaagcaaat

SEQ ID NO: 14321 - DNA, 15 bp, Artificial Sequence
  dgRNA
  Rrp12
agaacggatgttgat

SEQ ID NO: 14322 - DNA, 15 bp, Artificial Sequence
  dgRNA
  Rrp12
taacagattggagac

SEQ ID NO: 14323 - DNA, 15 bp, Artificial Sequence
  dgRNA
  Stxbp1
tacacagcctcgctt

SEQ ID NO: 14324 - DNA, 15 bp, Artificial Sequence
  dgRNA
  Stxbp1
agtcgcgcccccgcg

SEQ ID NO: 14325 - DNA, 15 bp, Artificial Sequence
  dgRNA
  Stxbp1
agcgaggctgtgtag

SEQ ID NO: 14326 - DNA, 15 bp, Artificial Sequence
  dgRNA
  Stxbp1
actcgggccaaagcg

SEQ ID NO: 14327 - DNA, 15 bp, Artificial Sequence
  dgRNA
  Cpne7
ctctccgctccagtg

SEQ ID NO: 14328 - DNA, 15 bp, Artificial Sequence
  dgRNA
  Cpne7
tctccgctccagtga

SEQ ID NO: 14329 - DNA, 15 bp, Artificial Sequence
  dgRNA
  Cpne7
ctccgctccagtgag

SEQ ID NO: 14330 - DNA, 15 bp, Artificial Sequence
  dgRNA
  Cpne7
cgaaacccctcttca

SEQ ID NO: 14331 - DNA, 15 bp, Artificial Sequence
  dgRNA
  Gpkow
gaactgaattcatag

SEQ ID NO: 14332 - DNA, 15 bp, Artificial Sequence
  dgRNA
  Gpkow
agcggttgaataccg

SEQ ID NO: 14333 - DNA, 15 bp, Artificial Sequence
  dgRNA
  Gpkow
tcccaggatgccgta

SEQ ID NO: 14334 - DNA, 15 bp, Artificial Sequence
  dgRNA
  Gpkow
tttcccacggctaca

SEQ ID NO: 14335 - DNA, 15 bp, Artificial Sequence
  dgRNA
  Grn
tgaacgcgtgccctc

SEQ ID NO: 14336 - DNA, 15 bp, Artificial Sequence
  dgRNA
  Grn
gaacgcgtgccctca

SEQ ID NO: 14337 - DNA, 15 bp, Artificial Sequence
  dgRNA
  Grn
gtgcccttaggcatg

SEQ ID NO: 14338 - DNA, 15 bp, Artificial Sequence
  dgRNA
  Grn
aaggtcgtttactgg

SEQ ID NO: 14339 - DNA, 15 bp, Artificial Sequence
  dgRNA
  Smim4
tctaggcgcgtgcgc

SEQ ID NO: 14340 - DNA, 15 bp, Artificial Sequence
  dgRNA
  Smim4
ccgccacattctgat

SEQ ID NO: 14341 - DNA, 15 bp, Artificial Sequence
  dgRNA
  Smim4
ccacattctgattgg

SEQ ID NO: 14342 - DNA, 15 bp, Artificial Sequence
  dgRNA
  Smim4
ttggcggagccgacc

SEQ ID NO: 14343 - DNA, 15 bp, Artificial Sequence
  dgRNA
  Olfr926
tggaatcgtgattga

SEQ ID NO: 14344 - DNA, 15 bp, Artificial Sequence
  dgRNA
  Prkrir
aattccttccttgcg

SEQ ID NO: 14345 - DNA, 15 bp, Artificial Sequence
  dgRNA
  Prkrir
cttccttgcgcgggt

SEQ ID NO: 14346 - DNA, 15 bp, Artificial Sequence
  dgRNA
  Prkrir
ttccttgcgcgggtt

SEQ ID NO: 14347 - DNA, 15 bp, Artificial Sequence
  dgRNA
  Prkrir
ttgagactacgcagc

SEQ ID NO: 14348 - DNA, 15 bp, Artificial Sequence
  dgRNA
  Nfatc1
cgcttgcccagcgaa

SEQ ID NO: 14349 - DNA, 15 bp, Artificial Sequence
  dgRNA
  Nfatc1
agccgctgcgcacag

SEQ ID NO: 14350 - DNA, 15 bp, Artificial Sequence
  dgRNA
  Nfatc1
gccgctgcgcacaga

SEQ ID NO: 14351 - DNA, 15 bp, Artificial Sequence
  dgRNA
  Nfatc1
gctgcgcacagaggg

SEQ ID NO: 14352 - DNA, 15 bp, Artificial Sequence
  dgRNA
  Iqsec1
tggcaacgagcactt

SEQ ID NO: 14353 - DNA, 15 bp, Artificial Sequence
  dgRNA
  Iqsec1
gagcactttggcgat

SEQ ID NO: 14354 - DNA, 15 bp, Artificial Sequence
  dgRNA
  Iqsec1
gcgattggtccagcg

SEQ ID NO: 14355 - DNA, 15 bp, Artificial Sequence
  dgRNA
  Iqsec1
gcactacgttgctcc

SEQ ID NO: 14356 - DNA, 15 bp, Artificial Sequence
  dgRNA
  Tmem8c
aataagttgtctgct

SEQ ID NO: 14357 - DNA, 15 bp, Artificial Sequence
  dgRNA
  Tmem8c
attcaactacgagtc

SEQ ID NO: 14358 - DNA, 15 bp, Artificial Sequence
  dgRNA
  Tmem8c
ttcaactacgagtca

SEQ ID NO: 14359 - DNA, 15 bp, Artificial Sequence
  dgRNA
  Tmem8c
cacctgctggcatat

SEQ ID NO: 14360 - DNA, 15 bp, Artificial Sequence
  dgRNA
  Ptms
ggaagcccctcccgt

SEQ ID NO: 14361 - DNA, 15 bp, Artificial Sequence
  dgRNA
  Ptms
gaagcccctcccgtc

SEQ ID NO: 14362 - DNA, 15 bp, Artificial Sequence
  dgRNA
  Ptms
gcgccgccttaaaag

SEQ ID NO: 14363 - DNA, 15 bp, Artificial Sequence
  dgRNA
  Ptms
cgccgccttaaaagc

SEQ ID NO: 14364 - DNA, 15 bp, Artificial Sequence
  dgRNA
  Ndufa13
gacgcggcgctcgtc

SEQ ID NO: 14365 - DNA, 15 bp, Artificial Sequence
  dgRNA
  Ndufa13
acgcggcgctcgtca

SEQ ID NO: 14366 - DNA, 15 bp, Artificial Sequence
  dgRNA
  Ndufa13
acgttttcgcacttg

SEQ ID NO: 14367 - DNA, 15 bp, Artificial Sequence
  dgRNA
  Ndufa13
tcgcacttgaggtcg

SEQ ID NO: 14368 - DNA, 15 bp, Artificial Sequence
  dgRNA
  Ms4a1
cacctgcttacaggg

SEQ ID NO: 14369 - DNA, 15 bp, Artificial Sequence
  dgRNA
  Ms4a1
tagagcttcactttt

SEQ ID NO: 14370 - DNA, 15 bp, Artificial Sequence
  dgRNA
  Ms4a1
gatggtgggtcccta

SEQ ID NO: 14371 - DNA, 15 bp, Artificial Sequence
  dgRNA
  Zfp958
ggaaaggtcggtcct

SEQ ID NO: 14372 - DNA, 15 bp, Artificial Sequence
  dgRNA
  Zfp958
ggtcggtcctcggcg

SEQ ID NO: 14373 - DNA, 15 bp, Artificial Sequence
  dgRNA
  Zfp958
ctcggcgtggaagcc

SEQ ID NO: 14374 - DNA, 15 bp, Artificial Sequence
  dgRNA
  Zfp958
caggcttccacgccg

SEQ ID NO: 14375 - DNA, 15 bp, Artificial Sequence
  dgRNA
  Onecut3
gtgctccaaggggtt

SEQ ID NO: 14376 - DNA, 15 bp, Artificial Sequence
  dgRNA
  Onecut3
ctccaaggggtttgg

SEQ ID NO: 14377 - DNA, 15 bp, Artificial Sequence
  dgRNA
  Onecut3
tccaaggggtttggc

SEQ ID NO: 14378 - DNA, 15 bp, Artificial Sequence
  dgRNA
  Onecut3
gggtttggcgggtgc

SEQ ID NO: 14379 - DNA, 15 bp, Artificial Sequence
  dgRNA
  Sycp2
cactcccctatggcc

SEQ ID NO: 14380 - DNA, 15 bp, Artificial Sequence
  dgRNA
  Sycp2
actcccctatggcct

SEQ ID NO: 14381 - DNA, 15 bp, Artificial Sequence
  dgRNA
  Sycp2
aggattgcctagttg

SEQ ID NO: 14382 - DNA, 15 bp, Artificial Sequence
  dgRNA
  Sycp2
ggattgcctagttga

SEQ ID NO: 14383 - DNA, 15 bp, Artificial Sequence
  dgRNA
  Lsm2
cagccgaggttttcg

SEQ ID NO: 14384 - DNA, 15 bp, Artificial Sequence
  dgRNA
  Lsm2
gtcttgcttcacgcg

SEQ ID NO: 14385 - DNA, 15 bp, Artificial Sequence
  dgRNA
  Lsm2
tcttgcttcacgcgc

SEQ ID NO: 14386 - DNA, 15 bp, Artificial Sequence
  dgRNA
  Lsm2
cgcgggctcgcgctc

SEQ ID NO: 14387 - DNA, 15 bp, Artificial Sequence
  dgRNA
  Gbp3
agtctaaatccaaga

SEQ ID NO: 14388 - DNA, 15 bp, Artificial Sequence
  dgRNA
  Gbp3
attagtagtgttccc

SEQ ID NO: 14389 - DNA, 15 bp, Artificial Sequence
  dgRNA
  Gbp3
tttttgcatcggtga

SEQ ID NO: 14390 - DNA, 15 bp, Artificial Sequence
  dgRNA
  Gbp3
gtcattgcgttttct

SEQ ID NO: 14391 - DNA, 15 bp, Artificial Sequence
  dgRNA
  Pja1
caccccaattcacag

SEQ ID NO: 14392 - DNA, 15 bp, Artificial Sequence
  dgRNA
  Pja1
acccccgccacatca

SEQ ID NO: 14393 - DNA, 15 bp, Artificial Sequence
  dgRNA
  Pja1
cccccgccacatcaa

SEQ ID NO: 14394 - DNA, 15 bp, Artificial Sequence
  dgRNA
  Pja1
ccccgccacatcaag

SEQ ID NO: 14395 - DNA, 15 bp, Artificial Sequence
  dgRNA
  Hoxb13
cccctgcaatttctg

SEQ ID NO: 14396 - DNA, 15 bp, Artificial Sequence
  dgRNA
  Hoxb13
tgcaatttctgcggg

SEQ ID NO: 14397 - DNA, 15 bp, Artificial Sequence
  dgRNA
  Hoxb13
atcagcgctcatgcc

SEQ ID NO: 14398 - DNA, 15 bp, Artificial Sequence
  dgRNA
  Hoxb13
tcagcgctcatgccc

SEQ ID NO: 14399 - DNA, 15 bp, Artificial Sequence
  dgRNA
  Fam120b
gcgtgcaggcgtcct

SEQ ID NO: 14400 - DNA, 15 bp, Artificial Sequence
  dgRNA
  Fam120b
tcctaggctattccc

SEQ ID NO: 14401 - DNA, 15 bp, Artificial Sequence
  dgRNA
  Fam120b
tattccccggttgct

SEQ ID NO: 14402 - DNA, 15 bp, Artificial Sequence
  dgRNA
  Fam120b
ccggttgctaggcaa

SEQ ID NO: 14403 - DNA, 15 bp, Artificial Sequence
  dgRNA
  Sgsm1
agttctgaacgtccc

SEQ ID NO: 14404 - DNA, 15 bp, Artificial Sequence
  dgRNA
  Sgsm1
gttctgaacgtccct

SEQ ID NO: 14405 - DNA, 15 bp, Artificial Sequence
  dgRNA
  Sgsm1
gtgccaatcctgaat

SEQ ID NO: 14406 - DNA, 15 bp, Artificial Sequence
  dgRNA
  Sgsm1
attggtcactgtgac

SEQ ID NO: 14407 - DNA, 15 bp, Artificial Sequence
  dgRNA
  Pik3cd
gcctacccagcaaag

SEQ ID NO: 14408 - DNA, 15 bp, Artificial Sequence
  dgRNA
  Pik3cd
cctacccagcaaagt

SEQ ID NO: 14409 - DNA, 15 bp, Artificial Sequence
  dgRNA
  Pik3cd
ctacccagcaaagtg

SEQ ID NO: 14410 - DNA, 15 bp, Artificial Sequence
  dgRNA
  Pik3cd
ggttgtcttacaaga

SEQ ID NO: 14411 - DNA, 15 bp, Artificial Sequence
  dgRNA
  Nol9
tgtctccaacccggc

SEQ ID NO: 14412 - DNA, 15 bp, Artificial Sequence
  dgRNA
  Nol9
gtctccaacccggca

SEQ ID NO: 14413 - DNA, 15 bp, Artificial Sequence
  dgRNA
  Nol9
ccaacccggcagggt

SEQ ID NO: 14414 - DNA, 15 bp, Artificial Sequence
  dgRNA
  Nol9
ttgcataatgtaaat

SEQ ID NO: 14415 - DNA, 15 bp, Artificial Sequence
  dgRNA
  Ctnna3
ccttcagcgcgaacg

SEQ ID NO: 14416 - DNA, 15 bp, Artificial Sequence
  dgRNA
  Ctnna3
cttcagcgcgaacgt

SEQ ID NO: 14417 - DNA, 15 bp, Artificial Sequence
  dgRNA
  Ctnna3
ttttgcgtggcctcg

SEQ ID NO: 14418 - DNA, 15 bp, Artificial Sequence
  dgRNA
  Ctnna3
cgcgctcaaacccgt

SEQ ID NO: 14419 - DNA, 15 bp, Artificial Sequence
  dgRNA
  Zzz3
tccgggaaggtagag

SEQ ID NO: 14420 - DNA, 15 bp, Artificial Sequence
  dgRNA
  Zzz3
cagcacgcagcgggc

SEQ ID NO: 14421 - DNA, 15 bp, Artificial Sequence
  dgRNA
  Zzz3
aatcctcccgcccgc

SEQ ID NO: 14422 - DNA, 15 bp, Artificial Sequence
  dgRNA
  Zzz3
gccggccggccgggt

SEQ ID NO: 14423 - DNA, 15 bp, Artificial Sequence
  dgRNA
  Trim47
agggtcgtgctcccc

SEQ ID NO: 14424 - DNA, 15 bp, Artificial Sequence
  dgRNA
  Trim47
gtcgtgctcccctgg

SEQ ID NO: 14425 - DNA, 15 bp, Artificial Sequence
  dgRNA
  Trim47
tcgtgctcccctgga

SEQ ID NO: 14426 - DNA, 15 bp, Artificial Sequence
  dgRNA
  Trim47
ggctggccggcctcg

SEQ ID NO: 14427 - DNA, 15 bp, Artificial Sequence
  dgRNA
  Rp1
cagaatgatcctagc

SEQ ID NO: 14428 - DNA, 15 bp, Artificial Sequence
  dgRNA
  Rp1
ctttgtttcatcaag

SEQ ID NO: 14429 - DNA, 15 bp, Artificial Sequence
  dgRNA
  Dstyk
gagcccgcgcagcga

SEQ ID NO: 14430 - DNA, 15 bp, Artificial Sequence
  dgRNA
  Dstyk
ctgtgagctcgtccc

SEQ ID NO: 14431 - DNA, 15 bp, Artificial Sequence
  dgRNA
  Dstyk
cgtccctggctccgc

SEQ ID NO: 14432 - DNA, 15 bp, Artificial Sequence
  dgRNA
  Dstyk
ggctccgctggggag

SEQ ID NO: 14433 - DNA, 15 bp, Artificial Sequence
  dgRNA
  Cast
ctagccctccattta

SEQ ID NO: 14434 - DNA, 15 bp, Artificial Sequence
  dgRNA
  Cast
gggaccacgctagct

SEQ ID NO: 14435 - DNA, 15 bp, Artificial Sequence
  dgRNA
  Cast
ggaccacgctagctt

SEQ ID NO: 14436 - DNA, 15 bp, Artificial Sequence
  dgRNA
  Cast
ccacgctagcttggg

SEQ ID NO: 14437 - DNA, 15 bp, Artificial Sequence
  dgRNA
  Olfr1461
atttgcattaagttc

SEQ ID NO: 14438 - DNA, 15 bp, Artificial Sequence
  dgRNA
  Olfr1461
tagtaacaacttgtt

SEQ ID NO: 14439 - DNA, 15 bp, Artificial Sequence
  dgRNA
  St18
ttttctttgtgcgat

SEQ ID NO: 14440 - DNA, 15 bp, Artificial Sequence
  dgRNA
  Cpn2
ttaggcatctgtcta

SEQ ID NO: 14441 - DNA, 15 bp, Artificial Sequence
  dgRNA
  Cpn2
ctatgggaaccattc

SEQ ID NO: 14442 - DNA, 15 bp, Artificial Sequence
  dgRNA
  Cpn2
ttgcccaagtgacct

SEQ ID NO: 14443 - DNA, 15 bp, Artificial Sequence
  dgRNA
  Cpn2
accttggtgacattc

SEQ ID NO: 14444 - DNA, 15 bp, Artificial Sequence
  dgRNA
  Grin2c
tggtgtttttctccg

SEQ ID NO: 14445 - DNA, 15 bp, Artificial Sequence
  dgRNA
  Grin2c
tctgagcgtcgagtc

SEQ ID NO: 14446 - DNA, 15 bp, Artificial Sequence
  dgRNA
  Grin2c
ctgagcgtcgagtct

SEQ ID NO: 14447 - DNA, 15 bp, Artificial Sequence
  dgRNA
  Grin2c
gtcgagtctgggcac

SEQ ID NO: 14448 - DNA, 15 bp, Artificial Sequence
  dgRNA
  Pecr
gaaaaaaatcgaacg

SEQ ID NO: 14449 - DNA, 15 bp, Artificial Sequence
  dgRNA
  Pecr
ggatgcagacggctg

SEQ ID NO: 14450 - DNA, 15 bp, Artificial Sequence
  dgRNA
  Pecr
gatgcagacggctgc

SEQ ID NO: 14451 - DNA, 15 bp, Artificial Sequence
  dgRNA
  Pecr
gcagacggctgcggg

SEQ ID NO: 14452 - DNA, 15 bp, Artificial Sequence
  dgRNA
  Olfr576
gacttagagtatctt

SEQ ID NO: 14453 - DNA, 15 bp, Artificial Sequence
  dgRNA
  Calm1
gggctgtgcgcgggc

SEQ ID NO: 14454 - DNA, 15 bp, Artificial Sequence
  dgRNA
  Calm1
gccacagctgcaccg

SEQ ID NO: 14455 - DNA, 15 bp, Artificial Sequence
  dgRNA
  Calm1
ccaacgcgccgcacc

SEQ ID NO: 14456 - DNA, 15 bp, Artificial Sequence
  dgRNA
  Calm1
caacgcgccgcaccc

SEQ ID NO: 14457 - DNA, 15 bp, Artificial Sequence
  dgRNA
  Fam198b
actttacaccaaact

SEQ ID NO: 14458 - DNA, 15 bp, Artificial Sequence
  dgRNA
  Fam198b
taaaagtcatcaacc

SEQ ID NO: 14459 - DNA, 15 bp, Artificial Sequence
  dgRNA
  Fam198b
atgcggaagcaagat

SEQ ID NO: 14460 - DNA, 15 bp, Artificial Sequence
  dgRNA
  Polr3gl
ccatctagttcggtc

SEQ ID NO: 14461 - DNA, 15 bp, Artificial Sequence
  dgRNA
  Polr3gl
catctagttcggtct

SEQ ID NO: 14462 - DNA, 15 bp, Artificial Sequence
  dgRNA
  Polr3gl
cggtctgggcataag

SEQ ID NO: 14463 - DNA, 15 bp, Artificial Sequence
  dgRNA
  Polr3gl
tccgctctcgtcgat

SEQ ID NO: 14464 - DNA, 15 bp, Artificial Sequence
  dgRNA
  Nlrp9b
gatgcaagttcctgc

SEQ ID NO: 14465 - DNA, 15 bp, Artificial Sequence
  dgRNA
  Nlrp9b
tctggcctatttaac

SEQ ID NO: 14466 - DNA, 15 bp, Artificial Sequence
  dgRNA
  Nlrp9b
gactagtctcacttg

SEQ ID NO: 14467 - DNA, 15 bp, Artificial Sequence
  dgRNA
  Nlrp9b
actagtctcacttgt

SEQ ID NO: 14468 - DNA, 15 bp, Artificial Sequence
  dgRNA
  S100a7a
tgacgatgtcattcc

SEQ ID NO: 14469 - DNA, 15 bp, Artificial Sequence
  dgRNA
  S100a7a
aatgcagttaaggtt

SEQ ID NO: 14470 - DNA, 15 bp, Artificial Sequence
  dgRNA
  S100a7a
ctgtagaagaacccg

SEQ ID NO: 14471 - DNA, 15 bp, Artificial Sequence
  dgRNA
  S100a7a
gcaggatgtctagca

SEQ ID NO: 14472 - DNA, 15 bp, Artificial Sequence
  dgRNA
  Ubald2
gagttgagttcaaac

SEQ ID NO: 14473 - DNA, 15 bp, Artificial Sequence
  dgRNA
  Ubald2
gttcaaacaggccta

SEQ ID NO: 14474 - DNA, 15 bp, Artificial Sequence
  dgRNA
  Ubald2
aaacaggcctacggt

SEQ ID NO: 14475 - DNA, 15 bp, Artificial Sequence
  dgRNA
  Ubald2
cgccccgcctcccga

SEQ ID NO: 14476 - DNA, 15 bp, Artificial Sequence
  dgRNA
  Tarm1
aatttgaaacggaag

SEQ ID NO: 14477 - DNA, 15 bp, Artificial Sequence
  dgRNA
  Tarm1
atagtcactagacgt

SEQ ID NO: 14478 - DNA, 15 bp, Artificial Sequence
  dgRNA
  Tarm1
taacactgggcttgc

SEQ ID NO: 14479 - DNA, 15 bp, Artificial Sequence
  dgRNA
  Tarm1
aaagggcctaacact

SEQ ID NO: 14480 - DNA, 15 bp, Artificial Sequence
  dgRNA
  Ssxb1
atacaacactctact

SEQ ID NO: 14481 - DNA, 15 bp, Artificial Sequence
  dgRNA
  Ssxb1
tatacaacactctac

SEQ ID NO: 14482 - DNA, 15 bp, Artificial Sequence
  dgRNA
  Pfdn6
cgagccgagtctttt

SEQ ID NO: 14483 - DNA, 15 bp, Artificial Sequence
  dgRNA
  Pfdn6
tgttccagcatgtat

SEQ ID NO: 14484 - DNA, 15 bp, Artificial Sequence
  dgRNA
  Pfdn6
tcggaatgtaacttc

SEQ ID NO: 14485 - DNA, 15 bp, Artificial Sequence
  dgRNA
  Pfdn6
agttaacaagattcg

SEQ ID NO: 14486 - DNA, 15 bp, Artificial Sequence
  dgRNA
  Ptgdr2
ctccttggagaatcg

SEQ ID NO: 14487 - DNA, 15 bp, Artificial Sequence
  dgRNA
  Ptgdr2
gagaatcgtggtgtc

SEQ ID NO: 14488 - DNA, 15 bp, Artificial Sequence
  dgRNA
  Ptgdr2
agaatcgtggtgtct

SEQ ID NO: 14489 - DNA, 15 bp, Artificial Sequence
  dgRNA
  Ptgdr2
gaatcgtggtgtctg

SEQ ID NO: 14490 - DNA, 15 bp, Artificial Sequence
  dgRNA
  Ryr1
tttgtgctgtgggcg

SEQ ID NO: 14491 - DNA, 15 bp, Artificial Sequence
  dgRNA
  Ryr1
ggcggggttctgaac

SEQ ID NO: 14492 - DNA, 15 bp, Artificial Sequence
  dgRNA
  Ryr1
gcggggttctgaaca

SEQ ID NO: 14493 - DNA, 15 bp, Artificial Sequence
  dgRNA
  Ryr1
cggggttctgaacag

SEQ ID NO: 14494 - DNA, 15 bp, Artificial Sequence
  dgRNA
  Zfr
ccatcgcttaggata

SEQ ID NO: 14495 - DNA, 15 bp, Artificial Sequence
  dgRNA
  Zfr
cgcttaggataaggc

SEQ ID NO: 14496 - DNA, 15 bp, Artificial Sequence
  dgRNA
  Zfr
gcttaggataaggcc

SEQ ID NO: 14497 - DNA, 15 bp, Artificial Sequence
  dgRNA
  Zfr
aaatccgctcctcgg

SEQ ID NO: 14498 - DNA, 15 bp, Artificial Sequence
  dgRNA
  C1rl
tctcacgtgttttaa

SEQ ID NO: 14499 - DNA, 15 bp, Artificial Sequence
  dgRNA
  C1rl
ctcaccataattgaa

SEQ ID NO: 14500 - DNA, 15 bp, Artificial Sequence
  dgRNA
  Il1f6
gattactgctctcac

SEQ ID NO: 14501 - DNA, 15 bp, Artificial Sequence
  dgRNA
  Il1f6
accagcaattatcta

SEQ ID NO: 14502 - DNA, 15 bp, Artificial Sequence
  dgRNA
  Il1f6
gtcctaggtgcactg

SEQ ID NO: 14503 - DNA, 15 bp, Artificial Sequence
  dgRNA
  Il1f6
gtgagagcagtaatc

SEQ ID NO: 14504 - DNA, 15 bp, Artificial Sequence
  dgRNA
  Lrrc74a
accagagccaccaaa

SEQ ID NO: 14505 - DNA, 15 bp, Artificial Sequence
  dgRNA
  Lrrc74a
gagacccgctgttgc

SEQ ID NO: 14506 - DNA, 15 bp, Artificial Sequence
  dgRNA
  Lrrc74a
agacccgctgttgcc

SEQ ID NO: 14507 - DNA, 15 bp, Artificial Sequence
  dgRNA
  Lrrc74a
ccgggtccaccctcg

SEQ ID NO: 14508 - DNA, 15 bp, Artificial Sequence
  dgRNA
  Angpt1
tgcttagatgttagt

SEQ ID NO: 14509 - DNA, 15 bp, Artificial Sequence
  dgRNA
  Angpt1
cacccgaacctatta

SEQ ID NO: 14510 - DNA, 15 bp, Artificial Sequence
  dgRNA
  Angpt1
ccgaacctattaagg

SEQ ID NO: 14511 - DNA, 15 bp, Artificial Sequence
  dgRNA
  Angpt1
tccgtgcatctgcta

SEQ ID NO: 14512 - DNA, 15 bp, Artificial Sequence
  dgRNA
  Ccdc167
tgcacatcttatacc

SEQ ID NO: 14513 - DNA, 15 bp, Artificial Sequence
  dgRNA
  Ccdc167
acatcttatacccgg

SEQ ID NO: 14514 - DNA, 15 bp, Artificial Sequence
  dgRNA
  Ccdc167
cgcccctcacaaaca

SEQ ID NO: 14515 - DNA, 15 bp, Artificial Sequence
  dgRNA
  Ccdc167
aaacatggccgctgc

SEQ ID NO: 14516 - DNA, 15 bp, Artificial Sequence
  dgRNA
  Ccnd3
ggagcaaccccgccc

SEQ ID NO: 14517 - DNA, 15 bp, Artificial Sequence
  dgRNA
  Ccnd3
cccgatgaatagagt

SEQ ID NO: 14518 - DNA, 15 bp, Artificial Sequence
  dgRNA
  Ccnd3
ccgatgaatagagta

SEQ ID NO: 14519 - DNA, 15 bp, Artificial Sequence
  dgRNA
  Ccnd3
tcgtgcctgcttcgc

SEQ ID NO: 14520 - DNA, 15 bp, Artificial Sequence
  dgRNA
  Btf3
tccgcggcctttccc

SEQ ID NO: 14521 - DNA, 15 bp, Artificial Sequence
  dgRNA
  Btf3
tcccaggaccgcgga

SEQ ID NO: 14522 - DNA, 15 bp, Artificial Sequence
  dgRNA
  Btf3
cgcggacggcgaccg

SEQ ID NO: 14523 - DNA, 15 bp, Artificial Sequence
  dgRNA
  Btf3
gcggacggcgaccgc

SEQ ID NO: 14524 - DNA, 15 bp, Artificial Sequence
  dgRNA
  Paqr4
aggcatgggcggtct

SEQ ID NO: 14525 - DNA, 15 bp, Artificial Sequence
  dgRNA
  Paqr4
ggcatgggcggtctc

SEQ ID NO: 14526 - DNA, 15 bp, Artificial Sequence
  dgRNA
  Paqr4
gcatgggcggtctcg

SEQ ID NO: 14527 - DNA, 15 bp, Artificial Sequence
  dgRNA
  Paqr4
tgggcggtctcgggg

SEQ ID NO: 14528 - DNA, 15 bp, Artificial Sequence
  dgRNA
  Rnase1
gtgctgattcccaag

SEQ ID NO: 14529 - DNA, 15 bp, Artificial Sequence
  dgRNA
  Rnase1
agggcattgaaacct

SEQ ID NO: 14530 - DNA, 15 bp, Artificial Sequence
  dgRNA
  Rnase1
gggcggagtaaatct

SEQ ID NO: 14531 - DNA, 15 bp, Artificial Sequence
  dgRNA
  Rnase1
tgggcggagtaaatc

SEQ ID NO: 14532 - DNA, 15 bp, Artificial Sequence
  dgRNA
  Ube2q2
tgacttcaacaaaca

SEQ ID NO: 14533 - DNA, 15 bp, Artificial Sequence
  dgRNA
  Ube2q2
aaacatggtccattc

SEQ ID NO: 14534 - DNA, 15 bp, Artificial Sequence
  dgRNA
  Ube2q2
aacatggtccattct

SEQ ID NO: 14535 - DNA, 15 bp, Artificial Sequence
  dgRNA
  Ube2q2
gattgaaatgatgat

SEQ ID NO: 14536 - DNA, 15 bp, Artificial Sequence
  dgRNA
  Nek3
gaatttgccaaaaca

SEQ ID NO: 14537 - DNA, 15 bp, Artificial Sequence
  dgRNA
  Nek3
aagacagagtcgttt

SEQ ID NO: 14538 - DNA, 15 bp, Artificial Sequence
  dgRNA
  Nek3
gaagacagagtcgtt

SEQ ID NO: 14539 - DNA, 15 bp, Artificial Sequence
  dgRNA
  Ppp1r12c
tcccagctcgctacg

SEQ ID NO: 14540 - DNA, 15 bp, Artificial Sequence
  dgRNA
  Ppp1r12c
cccagctcgctacga

SEQ ID NO: 14541 - DNA, 15 bp, Artificial Sequence
  dgRNA
  Ppp1r12c
ccagctcgctacgag

SEQ ID NO: 14542 - DNA, 15 bp, Artificial Sequence
  dgRNA
  Ppp1r12c
agctacgcaagtctc

SEQ ID NO: 14543 - DNA, 15 bp, Artificial Sequence
  dgRNA
  Hp1bp3
acgcaggacgcagcc

SEQ ID NO: 14544 - DNA, 15 bp, Artificial Sequence
  dgRNA
  Hp1bp3
ccctgcgcgcccgcc

SEQ ID NO: 14545 - DNA, 15 bp, Artificial Sequence
  dgRNA
  Hp1bp3
ggggacccacttggc

SEQ ID NO: 14546 - DNA, 15 bp, Artificial Sequence
  dgRNA
  Hp1bp3
cttggcgggcgcgcg

SEQ ID NO: 14547 - DNA, 15 bp, Artificial Sequence
  dgRNA
  Prkd1
aggactgccctgaat

SEQ ID NO: 14548 - DNA, 15 bp, Artificial Sequence
  dgRNA
  Prkd1
gaatgggcgggtccg

SEQ ID NO: 14549 - DNA, 15 bp, Artificial Sequence
  dgRNA
  Prkd1
ttagagtccgccgag

SEQ ID NO: 14550 - DNA, 15 bp, Artificial Sequence
  dgRNA
  Prkd1
tagagtccgccgagt

SEQ ID NO: 14551 - DNA, 15 bp, Artificial Sequence
  dgRNA
  Serf1
aaaggtgcaatgagc

SEQ ID NO: 14552 - DNA, 15 bp, Artificial Sequence
  dgRNA
  Serf1
gtaaagcccaccttc

SEQ ID NO: 14553 - DNA, 15 bp, Artificial Sequence
  dgRNA
  Serf1
ggctgctaagtaagg

SEQ ID NO: 14554 - DNA, 15 bp, Artificial Sequence
  dgRNA
  Serf1
aggcgagtgcgcgcg

SEQ ID NO: 14555 - DNA, 15 bp, Artificial Sequence
  dgRNA
  1700018B08Rik
cacccaggcgacgag

SEQ ID NO: 14556 - DNA, 15 bp, Artificial Sequence
  dgRNA
  1700018B08Rik
ggcgacgagaggata

SEQ ID NO: 14557 - DNA, 15 bp, Artificial Sequence
  dgRNA
  1700018B08Rik
acgacagctcccgat

SEQ ID NO: 14558 - DNA, 15 bp, Artificial Sequence
  dgRNA
  1700018B08Rik
ccgattggctgatcg

SEQ ID NO: 14559 - DNA, 15 bp, Artificial Sequence
  dgRNA
  Lrpap1
agcgtgaaaatacct

SEQ ID NO: 14560 - DNA, 15 bp, Artificial Sequence
  dgRNA
  Lrpap1
gcgtgaaaatacctt

SEQ ID NO: 14561 - DNA, 15 bp, Artificial Sequence
  dgRNA
  Lrpap1
ccagagaccgaaaag

SEQ ID NO: 14562 - DNA, 15 bp, Artificial Sequence
  dgRNA
  Lrpap1
cagagaccgaaaagt

SEQ ID NO: 14563 - DNA, 15 bp, Artificial Sequence
  dgRNA
  Ddx55
ttggggtcccgggcg

SEQ ID NO: 14564 - DNA, 15 bp, Artificial Sequence
  dgRNA
  Ddx55
cgcccttccgccttc

SEQ ID NO: 14565 - DNA, 15 bp, Artificial Sequence
  dgRNA
  Ddx55
gcccttccgccttct

SEQ ID NO: 14566 - DNA, 15 bp, Artificial Sequence
  dgRNA
  Ddx55
ccttctgggcgacct

SEQ ID NO: 14567 - DNA, 15 bp, Artificial Sequence
  dgRNA
  Lsm3
cgccccgcccggagg

SEQ ID NO: 14568 - DNA, 15 bp, Artificial Sequence
  dgRNA
  Lsm3
gaggcgggccacgcc

SEQ ID NO: 14569 - DNA, 15 bp, Artificial Sequence
  dgRNA
  Lsm3
cgcgcccccagccca

SEQ ID NO: 14570 - DNA, 15 bp, Artificial Sequence
  dgRNA
  Lsm3
ggaccacgccctcga

SEQ ID NO: 14571 - DNA, 15 bp, Artificial Sequence
  dgRNA
  Irak3
ctcttagatccatcg

SEQ ID NO: 14572 - DNA, 15 bp, Artificial Sequence
  dgRNA
  Irak3
agatccatcgtggcc

SEQ ID NO: 14573 - DNA, 15 bp, Artificial Sequence
  dgRNA
  Irak3
gggtggcggctttcc

SEQ ID NO: 14574 - DNA, 15 bp, Artificial Sequence
  dgRNA
  Irak3
ccgccctcattttct

SEQ ID NO: 14575 - DNA, 15 bp, Artificial Sequence
  dgRNA
  A3galt2
ccttcccttaatggg

SEQ ID NO: 14576 - DNA, 15 bp, Artificial Sequence
  dgRNA
  A3galt2
tcccttaatgggagg

SEQ ID NO: 14577 - DNA, 15 bp, Artificial Sequence
  dgRNA
  A3galt2
cgtggacatagtggc

SEQ ID NO: 14578 - DNA, 15 bp, Artificial Sequence
  dgRNA
  A3galt2
tgtacgtggacatag

SEQ ID NO: 14579 - DNA, 15 bp, Artificial Sequence
  dgRNA
  Cflar
ggtatgtgcggtctt

SEQ ID NO: 14580 - DNA, 15 bp, Artificial Sequence
  dgRNA
  Cflar
gtatgtgcggtcttt

SEQ ID NO: 14581 - DNA, 15 bp, Artificial Sequence
  dgRNA
  Cflar
tatgtgcggtctttg

SEQ ID NO: 14582 - DNA, 15 bp, Artificial Sequence
  dgRNA
  Cflar
tttttgagccttgac

SEQ ID NO: 14583 - DNA, 15 bp, Artificial Sequence
  dgRNA
  Zc3hav1
cccaagtgcggagtt

SEQ ID NO: 14584 - DNA, 15 bp, Artificial Sequence
  dgRNA
  Zc3hav1
aatatccatgtccta

SEQ ID NO: 14585 - DNA, 15 bp, Artificial Sequence
  dgRNA
  Zc3hav1
atccatgtcctaagg

SEQ ID NO: 14586 - DNA, 15 bp, Artificial Sequence
  dgRNA
  Zc3hav1
catgtcctaaggtgg

SEQ ID NO: 14587 - DNA, 15 bp, Artificial Sequence
  dgRNA
  Leprotl1
tctccgactcccaag

SEQ ID NO: 14588 - DNA, 15 bp, Artificial Sequence
  dgRNA
  Leprotl1
ctcgttgactccctg

SEQ ID NO: 14589 - DNA, 15 bp, Artificial Sequence
  dgRNA
  Leprotl1
tcgttgactccctgc

SEQ ID NO: 14590 - DNA, 15 bp, Artificial Sequence
  dgRNA
  Leprotl1
cgttgactccctgcg

SEQ ID NO: 14591 - DNA, 15 bp, Artificial Sequence
  dgRNA
  Nyap1
ggtaaacacaaaccc

SEQ ID NO: 14592 - DNA, 15 bp, Artificial Sequence
  dgRNA
  Nyap1
gacataaaggggcac

SEQ ID NO: 14593 - DNA, 15 bp, Artificial Sequence
  dgRNA
  Nyap1
agacactgagcgatc

SEQ ID NO: 14594 - DNA, 15 bp, Artificial Sequence
  dgRNA
  Shisa6
ccgcccgcgcctcga

SEQ ID NO: 14595 - DNA, 15 bp, Artificial Sequence
  dgRNA
  Shisa6
cctttccagcccgcc

SEQ ID NO: 14596 - DNA, 15 bp, Artificial Sequence
  dgRNA
  Shisa6
gccgccctcggagcc

SEQ ID NO: 14597 - DNA, 15 bp, Artificial Sequence
  dgRNA
  Shisa6
agcccggccagccgc

SEQ ID NO: 14598 - DNA, 15 bp, Artificial Sequence
  dgRNA
  Slc39a6
aaccatgatgctagg

SEQ ID NO: 14599 - DNA, 15 bp, Artificial Sequence
  dgRNA
  Slc39a6
atgctaggtggtcaa

SEQ ID NO: 14600 - DNA, 15 bp, Artificial Sequence
  dgRNA
  Slc39a6
acttccgccccagag

SEQ ID NO: 14601 - DNA, 15 bp, Artificial Sequence
  dgRNA
  Slc39a6
tactctacccagccg

SEQ ID NO: 14602 - DNA, 15 bp, Artificial Sequence
  dgRNA
  Usp43
aggcctgttccaagg

SEQ ID NO: 14603 - DNA, 15 bp, Artificial Sequence
  dgRNA
  Usp43
tgttccaaggcggga

SEQ ID NO: 14604 - DNA, 15 bp, Artificial Sequence
  dgRNA
  Usp43
gcggggaagtccact

SEQ ID NO: 14605 - DNA, 15 bp, Artificial Sequence
  dgRNA
  Usp43
gggaagtccactagg

SEQ ID NO: 14606 - DNA, 15 bp, Artificial Sequence
  dgRNA
  Nupl1
cgcatggcttttgac

SEQ ID NO: 14607 - DNA, 15 bp, Artificial Sequence
  dgRNA
  Nupl1
ccgaagccgcactcc

SEQ ID NO: 14608 - DNA, 15 bp, Artificial Sequence
  dgRNA
  Nupl1
cgaagccgcactcca

SEQ ID NO: 14609 - DNA, 15 bp, Artificial Sequence
  dgRNA
  Nupl1
tcccgcgagactctc

SEQ ID NO: 14610 - DNA, 15 bp, Artificial Sequence
  dgRNA
  Tmub1
cagggtccttcccgt

SEQ ID NO: 14611 - DNA, 15 bp, Artificial Sequence
  dgRNA
  Tmub1
cccatcgacgatcca

SEQ ID NO: 14612 - DNA, 15 bp, Artificial Sequence
  dgRNA
  Tmub1
ccatcgacgatccaa

SEQ ID NO: 14613 - DNA, 15 bp, Artificial Sequence
  dgRNA
  Tmub1
acgatccaagggtac

SEQ ID NO: 14614 - DNA, 15 bp, Artificial Sequence
  dgRNA
  Cadm3
acacccgagtgatgc

SEQ ID NO: 14615 - DNA, 15 bp, Artificial Sequence
  dgRNA
  Cadm3
cccgagtgatgctgg

SEQ ID NO: 14616 - DNA, 15 bp, Artificial Sequence
  dgRNA
  Cadm3
tggaggagctcccgg

SEQ ID NO: 14617 - DNA, 15 bp, Artificial Sequence
  dgRNA
  Cadm3
ggcaccacaaaagcg

SEQ ID NO: 14618 - DNA, 15 bp, Artificial Sequence
  dgRNA
  Spag8
actaatcaatcaagt

SEQ ID NO: 14619 - DNA, 15 bp, Artificial Sequence
  dgRNA
  Spag8
ctaatcaatcaagtt

SEQ ID NO: 14620 - DNA, 15 bp, Artificial Sequence
  dgRNA
  Spag8
ccaagtgaggccgat

SEQ ID NO: 14621 - DNA, 15 bp, Artificial Sequence
  dgRNA
  Spag8
gaggccgattggagc

SEQ ID NO: 14622 - DNA, 15 bp, Artificial Sequence
  dgRNA
  Lsmem1
ttcgtatcttaaact

SEQ ID NO: 14623 - DNA, 15 bp, Artificial Sequence
  dgRNA
  Lsmem1
actcggacatgagag

SEQ ID NO: 14624 - DNA, 15 bp, Artificial Sequence
  dgRNA
  Lsmem1
agcggaagccactgc

SEQ ID NO: 14625 - DNA, 15 bp, Artificial Sequence
  dgRNA
  Lsmem1
gcggaagccactgca

SEQ ID NO: 14626 - DNA, 15 bp, Artificial Sequence
  dgRNA
  Arsa
gaatgacgagtaaac

SEQ ID NO: 14627 - DNA, 15 bp, Artificial Sequence
  dgRNA
  Arsa
gttgaaggtgccctc

SEQ ID NO: 14628 - DNA, 15 bp, Artificial Sequence
  dgRNA
  Ino80b
ggcgccggaagtagc

SEQ ID NO: 14629 - DNA, 15 bp, Artificial Sequence
  dgRNA
  Ino80b
agccggttattttgc

SEQ ID NO: 14630 - DNA, 15 bp, Artificial Sequence
  dgRNA
  Ino80b
gattccgttcttccg

SEQ ID NO: 14631 - DNA, 15 bp, Artificial Sequence
  dgRNA
  Ino80b
attccgttcttccgc

SEQ ID NO: 14632 - DNA, 15 bp, Artificial Sequence
  dgRNA
  Dnm2
tcgtgccttttttat

SEQ ID NO: 14633 - DNA, 15 bp, Artificial Sequence
  dgRNA
  Dnm2
gctcacgttcttgag

SEQ ID NO: 14634 - DNA, 15 bp, Artificial Sequence
  dgRNA
  Dnm2
ccgggttgtcagacc

SEQ ID NO: 14635 - DNA, 15 bp, Artificial Sequence
  dgRNA
  Dnm2
accgggttgtcagac

SEQ ID NO: 14636 - DNA, 15 bp, Artificial Sequence
  dgRNA
  Grb10
cctgcgcccaggccg

SEQ ID NO: 14637 - DNA, 15 bp, Artificial Sequence
  dgRNA
  Grb10
ctcctcccgcgctgg

SEQ ID NO: 14638 - DNA, 15 bp, Artificial Sequence
  dgRNA
  Grb10
ctggcggccgccgag

SEQ ID NO: 14639 - DNA, 15 bp, Artificial Sequence
  dgRNA
  Grb10
ggccgccgagcggtc

SEQ ID NO: 14640 - DNA, 15 bp, Artificial Sequence
  dgRNA
  Cyp4f40
cctctctcctacatt

SEQ ID NO: 14641 - DNA, 15 bp, Artificial Sequence
  dgRNA
  Cyp4f40
cacctgatttgacat

SEQ ID NO: 14642 - DNA, 15 bp, Artificial Sequence
  dgRNA
  Cyp4f40
acctgatttgacatc

SEQ ID NO: 14643 - DNA, 15 bp, Artificial Sequence
  dgRNA
  Cyp4f40
cctgatttgacatcg

SEQ ID NO: 14644 - DNA, 15 bp, Artificial Sequence
  dgRNA
  Prdx1
gtgagcgtttccccc

SEQ ID NO: 14645 - DNA, 15 bp, Artificial Sequence
  dgRNA
  Prdx1
tgagtcatcccccgt

SEQ ID NO: 14646 - DNA, 15 bp, Artificial Sequence
  dgRNA
  Prdx1
tcatcccccgtaggc

SEQ ID NO: 14647 - DNA, 15 bp, Artificial Sequence
  dgRNA
  Prdx1
ccccgtaggccggcc

SEQ ID NO: 14648 - DNA, 15 bp, Artificial Sequence
  dgRNA
  Slc7a3
atcccatgacgttac

SEQ ID NO: 14649 - DNA, 15 bp, Artificial Sequence
  dgRNA
  Slc7a3
ctcccggtgaatata

SEQ ID NO: 14650 - DNA, 15 bp, Artificial Sequence
  dgRNA
  Slc7a3
tcccggtgaatataa

SEQ ID NO: 14651 - DNA, 15 bp, Artificial Sequence
  dgRNA
  Slc7a3
cccggtgaatataag

SEQ ID NO: 14652 - DNA, 15 bp, Artificial Sequence
  dgRNA
  1190002N15Rik
agcttctcgagtgtg

SEQ ID NO: 14653 - DNA, 15 bp, Artificial Sequence
  dgRNA
  1190002N15Rik
cgagtgtgaggcgtc

SEQ ID NO: 14654 - DNA, 15 bp, Artificial Sequence
  dgRNA
  1190002N15Rik
gagtgtgaggcgtcc

SEQ ID NO: 14655 - DNA, 15 bp, Artificial Sequence
  dgRNA
  1190002N15Rik
cgcgcgctgctcgcc

SEQ ID NO: 14656 - DNA, 15 bp, Artificial Sequence
  dgRNA
  Sfxn4
gcgcctgataagcgc

SEQ ID NO: 14657 - DNA, 15 bp, Artificial Sequence
  dgRNA
  Sfxn4
taagcgcaggcgtga

SEQ ID NO: 14658 - DNA, 15 bp, Artificial Sequence
  dgRNA
  Sfxn4
ggtctccgccccaag

SEQ ID NO: 14659 - DNA, 15 bp, Artificial Sequence
  dgRNA
  Sfxn4
gaacgcctctgtacc

SEQ ID NO: 14660 - DNA, 15 bp, Artificial Sequence
  dgRNA
  Oxtr
gaggtacctcaaact

SEQ ID NO: 14661 - DNA, 15 bp, Artificial Sequence
  dgRNA
  Oxtr
gcgcagctccaaggc

SEQ ID NO: 14662 - DNA, 15 bp, Artificial Sequence
  dgRNA
  Oxtr
ggtgcactgagactc

SEQ ID NO: 14663 - DNA, 15 bp, Artificial Sequence
  dgRNA
  Oxtr
ttcaaattcccaggg

SEQ ID NO: 14664 - DNA, 15 bp, Artificial Sequence
  dgRNA
  Trps1
cttcccacccggcac

SEQ ID NO: 14665 - DNA, 15 bp, Artificial Sequence
  dgRNA
  Trps1
ttcccacccggcacc

SEQ ID NO: 14666 - DNA, 15 bp, Artificial Sequence
  dgRNA
  Trps1
tgcccggtgccgggt

SEQ ID NO: 14667 - DNA, 15 bp, Artificial Sequence
  dgRNA
  Trps1
gtgcccggtgccggg

SEQ ID NO: 14668 - DNA, 15 bp, Artificial Sequence
  dgRNA
  Tespa1
tttacacctagggag

SEQ ID NO: 14669 - DNA, 15 bp, Artificial Sequence
  dgRNA
  Tespa1
tttttacacctaggg

SEQ ID NO: 14670 - DNA, 15 bp, Artificial Sequence
  dgRNA
  Tespa1
cagttttttacacct

SEQ ID NO: 14671 - DNA, 15 bp, Artificial Sequence
  dgRNA
  Tespa1
cacccataagcttac

SEQ ID NO: 14672 - DNA, 15 bp, Artificial Sequence
  dgRNA
  Olfr76
gattattattaaccc

SEQ ID NO: 14673 - DNA, 15 bp, Artificial Sequence
  dgRNA
  Olfr76
acattatggatgcta

SEQ ID NO: 14674 - DNA, 15 bp, Artificial Sequence
  dgRNA
  Olfr76
taatcatccacatta

SEQ ID NO: 14675 - DNA, 15 bp, Artificial Sequence
  dgRNA
  Cdk18
ccctgtacttagttt

SEQ ID NO: 14676 - DNA, 15 bp, Artificial Sequence
  dgRNA
  Cdk18
cctgtacttagttta

SEQ ID NO: 14677 - DNA, 15 bp, Artificial Sequence
  dgRNA
  Cdk18
gggccagcttatgag

SEQ ID NO: 14678 - DNA, 15 bp, Artificial Sequence
  dgRNA
  Cdk18
gcttatgaggggaac

SEQ ID NO: 14679 - DNA, 15 bp, Artificial Sequence
  dgRNA
  Lrrtm2
ccaaattctcaaatc

SEQ ID NO: 14680 - DNA, 15 bp, Artificial Sequence
  dgRNA
  Lrrtm2
aaaagacacgtcacc

SEQ ID NO: 14681 - DNA, 15 bp, Artificial Sequence
  dgRNA
  Lrrtm2
acgtgtcttttgttt

SEQ ID NO: 14682 - DNA, 15 bp, Artificial Sequence
  dgRNA
  Lrrtm2
gacgtgtcttttgtt

SEQ ID NO: 14683 - DNA, 15 bp, Artificial Sequence
  dgRNA
  Faah
gctgagacgttgata

SEQ ID NO: 14684 - DNA, 15 bp, Artificial Sequence
  dgRNA
  Faah
gcttagcccagtttt

SEQ ID NO: 14685 - DNA, 15 bp, Artificial Sequence
  dgRNA
  Faah
ccagttttcggctgt

SEQ ID NO: 14686 - DNA, 15 bp, Artificial Sequence
  dgRNA
  Faah
cagttttcggctgta

SEQ ID NO: 14687 - DNA, 15 bp, Artificial Sequence
  dgRNA
  Hnf4g
gaggtccaaacccga

SEQ ID NO: 14688 - DNA, 15 bp, Artificial Sequence
  dgRNA
  Hnf4g
ggaaaagattgcgcc

SEQ ID NO: 14689 - DNA, 15 bp, Artificial Sequence
  dgRNA
  Hnf4g
gaaaagattgcgccc

SEQ ID NO: 14690 - DNA, 15 bp, Artificial Sequence
  dgRNA
  Hnf4g
aagattgcgcccggg

SEQ ID NO: 14691 - DNA, 15 bp, Artificial Sequence
  dgRNA
  Pkp1
cccctggacgtcacc

SEQ ID NO: 14692 - DNA, 15 bp, Artificial Sequence
  dgRNA
  Pkp1
ggacgtcacctggag

SEQ ID NO: 14693 - DNA, 15 bp, Artificial Sequence
  dgRNA
  Pkp1
ggagcattgcacacc

SEQ ID NO: 14694 - DNA, 15 bp, Artificial Sequence
  dgRNA
  Pkp1
cagctcgcgtctgag

SEQ ID NO: 14695 - DNA, 15 bp, Artificial Sequence
  dgRNA
  Stat3
cgcgtcccttggtcg

SEQ ID NO: 14696 - DNA, 15 bp, Artificial Sequence
  dgRNA
  Stat3
gtcccttggtcgcgg

SEQ ID NO: 14697 - DNA, 15 bp, Artificial Sequence
  dgRNA
  Stat3
tcccttggtcgcgga

SEQ ID NO: 14698 - DNA, 15 bp, Artificial Sequence
  dgRNA
  Stat3
cttggtcgcggaggg

SEQ ID NO: 14699 - DNA, 15 bp, Artificial Sequence
  dgRNA
  Bcar1
gtctaataataagtc

SEQ ID NO: 14700 - DNA, 15 bp, Artificial Sequence
  dgRNA
  Bcar1
ttggaaggacgtgca

SEQ ID NO: 14701 - DNA, 15 bp, Artificial Sequence
  dgRNA
  Bcar1
aggacgtgcaaggtg

SEQ ID NO: 14702 - DNA, 15 bp, Artificial Sequence
  dgRNA
  Bcar1
ggacgtgcaaggtgt

SEQ ID NO: 14703 - DNA, 15 bp, Artificial Sequence
  dgRNA
  Zfp74
acattagggtctcat

SEQ ID NO: 14704 - DNA, 15 bp, Artificial Sequence
  dgRNA
  Zfp74
cacattagggtctca

SEQ ID NO: 14705 - DNA, 15 bp, Artificial Sequence
  dgRNA
  Nipsnap3b
gagaaggctcgctga

SEQ ID NO: 14706 - DNA, 15 bp, Artificial Sequence
  dgRNA
  Nipsnap3b
ccacgccctacattc

SEQ ID NO: 14707 - DNA, 15 bp, Artificial Sequence
  dgRNA
  Nipsnap3b
gaagaggtaatgccc

SEQ ID NO: 14708 - DNA, 15 bp, Artificial Sequence
  dgRNA
  Nipsnap3b
aagaggtaatgcccc

SEQ ID NO: 14709 - DNA, 15 bp, Artificial Sequence
  dgRNA
  Arhgap15
taactacatgtaccc

SEQ ID NO: 14710 - DNA, 15 bp, Artificial Sequence
  dgRNA
  Arhgap15
aaaggcgggggcaaa

SEQ ID NO: 14711 - DNA, 15 bp, Artificial Sequence
  dgRNA
  Arhgap15
aaaaggcgggggcaa

SEQ ID NO: 14712 - DNA, 15 bp, Artificial Sequence
  dgRNA
  Arhgap15
acgtgtcctaagggg

SEQ ID NO: 14713 - DNA, 15 bp, Artificial Sequence
  dgRNA
  Msl1
ccctcccggagtagg

SEQ ID NO: 14714 - DNA, 15 bp, Artificial Sequence
  dgRNA
  Msl1
cctcccggagtagga

SEQ ID NO: 14715 - DNA, 15 bp, Artificial Sequence
  dgRNA
  Msl1
cccgaggaggagcaa

SEQ ID NO: 14716 - DNA, 15 bp, Artificial Sequence
  dgRNA
  Msl1
ctgaggcgagctccg

SEQ ID NO: 14717 - DNA, 15 bp, Artificial Sequence
  dgRNA
  Pln
ataagttctaaggtt

SEQ ID NO: 14718 - DNA, 15 bp, Artificial Sequence
  dgRNA
  Pln
gttgtgataagaaca

SEQ ID NO: 14719 - DNA, 15 bp, Artificial Sequence
  dgRNA
  Pln
attctaacatgtgat

SEQ ID NO: 14720 - DNA, 15 bp, Artificial Sequence
  dgRNA
  Myo1h
cagatccacaatcga

SEQ ID NO: 14721 - DNA, 15 bp, Artificial Sequence
  dgRNA
  Myo1h
cacaatcgacggttc

SEQ ID NO: 14722 - DNA, 15 bp, Artificial Sequence
  dgRNA
  Myo1h
gatctggcgcccgcc

SEQ ID NO: 14723 - DNA, 15 bp, Artificial Sequence
  dgRNA
  Myo1h
cgtcgattgtggatc

SEQ ID NO: 14724 - DNA, 15 bp, Artificial Sequence
  dgRNA
  Serpina9
tcataatgaagctgt

SEQ ID NO: 14725 - DNA, 15 bp, Artificial Sequence
  dgRNA
  Serpina9
cggggtgagatctgt

SEQ ID NO: 14726 - DNA, 15 bp, Artificial Sequence
  dgRNA
  Serpina9
agatctgtcggagag

SEQ ID NO: 14727 - DNA, 15 bp, Artificial Sequence
  dgRNA
  Serpina9
cttacaaggatgagc

SEQ ID NO: 14728 - DNA, 15 bp, Artificial Sequence
  dgRNA
  Kcnma1
gcaatctccacagct

SEQ ID NO: 14729 - DNA, 15 bp, Artificial Sequence
  dgRNA
  Kcnma1
gattctttatgggta

SEQ ID NO: 14730 - DNA, 15 bp, Artificial Sequence
  dgRNA
  Kcnma1
cctatgtctcaactc

SEQ ID NO: 14731 - DNA, 15 bp, Artificial Sequence
  dgRNA
  Abcc5
cagcccccgtgacta

SEQ ID NO: 14732 - DNA, 15 bp, Artificial Sequence
  dgRNA
  Abcc5
atcagaaaccgggga

SEQ ID NO: 14733 - DNA, 15 bp, Artificial Sequence
  dgRNA
  Abcc5
aaaccggggaaggat

SEQ ID NO: 14734 - DNA, 15 bp, Artificial Sequence
  dgRNA
  Abcc5
aaccggggaaggatg

SEQ ID NO: 14735 - DNA, 15 bp, Artificial Sequence
  dgRNA
  Tenm4
ggtatccctttcagc

SEQ ID NO: 14736 - DNA, 15 bp, Artificial Sequence
  dgRNA
  Tenm4
gacgatttctgcact

SEQ ID NO: 14737 - DNA, 15 bp, Artificial Sequence
  dgRNA
  Tenm4
acgatttctgcactt

SEQ ID NO: 14738 - DNA, 15 bp, Artificial Sequence
  dgRNA
  Tenm4
acgagagttttgctc

SEQ ID NO: 14739 - DNA, 15 bp, Artificial Sequence
  dgRNA
  Tmem116
ctctttggtacaatt

SEQ ID NO: 14740 - DNA, 15 bp, Artificial Sequence
  dgRNA
  Tmem116
agcctcctgccctta

SEQ ID NO: 14741 - DNA, 15 bp, Artificial Sequence
  dgRNA
  Tmem116
ctgcccttaaggtac

SEQ ID NO: 14742 - DNA, 15 bp, Artificial Sequence
  dgRNA
  Tmem116
tgcccttaaggtaca

SEQ ID NO: 14743 - DNA, 15 bp, Artificial Sequence
  dgRNA
  Ubap2l
cccggggtgtcagtg

SEQ ID NO: 14744 - DNA, 15 bp, Artificial Sequence
  dgRNA
  Tnfaip8l1
aacactttcccgcca

SEQ ID NO: 14745 - DNA, 15 bp, Artificial Sequence
  dgRNA
  Tnfaip8l1
cggcatcccttgcgc

SEQ ID NO: 14746 - DNA, 15 bp, Artificial Sequence
  dgRNA
  Tnfaip8l1
ggcatcccttgcgct

SEQ ID NO: 14747 - DNA, 15 bp, Artificial Sequence
  dgRNA
  Tnfaip8l1
ctgggcacccagcgc

SEQ ID NO: 14748 - DNA, 15 bp, Artificial Sequence
  dgRNA
  Ceacam9
cacagatcatagcct

SEQ ID NO: 14749 - DNA, 15 bp, Artificial Sequence
  dgRNA
  Ceacam9
gtcaactcttcttgc

SEQ ID NO: 14750 - DNA, 15 bp, Artificial Sequence
  dgRNA
  Hgd
gtcaatgtttatatc

SEQ ID NO: 14751 - DNA, 15 bp, Artificial Sequence
  dgRNA
  Hgd
tcgatgtaagcacat

SEQ ID NO: 14752 - DNA, 15 bp, Artificial Sequence
  dgRNA
  Uhrf1
ggccaatcgcatgcg

SEQ ID NO: 14753 - DNA, 15 bp, Artificial Sequence
  dgRNA
  Uhrf1
caatcgcatgcgagg

SEQ ID NO: 14754 - DNA, 15 bp, Artificial Sequence
  dgRNA
  Uhrf1
aatcgcatgcgagga

SEQ ID NO: 14755 - DNA, 15 bp, Artificial Sequence
  dgRNA
  Uhrf1
cgcatgcgaggaggg

SEQ ID NO: 14756 - DNA, 15 bp, Artificial Sequence
  dgRNA
  Plekhn1
gctcctggtccaatc

SEQ ID NO: 14757 - DNA, 15 bp, Artificial Sequence
  dgRNA
  Plekhn1
acctattctacccca

SEQ ID NO: 14758 - DNA, 15 bp, Artificial Sequence
  dgRNA
  Plekhn1
tgggcctaggaaacc

SEQ ID NO: 14759 - DNA, 15 bp, Artificial Sequence
  dgRNA
  Plekhn1
aggtttccctcaaaa

SEQ ID NO: 14760 - DNA, 15 bp, Artificial Sequence
  dgRNA
  Cyr61
aggtgcaacggagcc

SEQ ID NO: 14761 - DNA, 15 bp, Artificial Sequence
  dgRNA
  Cyr61
ggtgcaacggagcca

SEQ ID NO: 14762 - DNA, 15 bp, Artificial Sequence
  dgRNA
  Cyr61
gtgcaacggagccag

SEQ ID NO: 14763 - DNA, 15 bp, Artificial Sequence
  dgRNA
  Cyr61
cgtcactgcaacacg

SEQ ID NO: 14764 - DNA, 15 bp, Artificial Sequence
  dgRNA
  Nrap
acgcatgcgtgctga

SEQ ID NO: 14765 - DNA, 15 bp, Artificial Sequence
  dgRNA
  Nrap
tgtcacttgagtaag

SEQ ID NO: 14766 - DNA, 15 bp, Artificial Sequence
  dgRNA
  Nrap
ggcggtcagatgctt

SEQ ID NO: 14767 - DNA, 15 bp, Artificial Sequence
  dgRNA
  Nrap
gggcggtcagatgct

SEQ ID NO: 14768 - DNA, 15 bp, Artificial Sequence
  dgRNA
  Cela3b
cacttgtgcaatcac

SEQ ID NO: 14769 - DNA, 15 bp, Artificial Sequence
  dgRNA
  Cela3b
ctctctaatctacag

SEQ ID NO: 14770 - DNA, 15 bp, Artificial Sequence
  dgRNA
  Cela3b
ttaatatagtgccgg

SEQ ID NO: 14771 - DNA, 15 bp, Artificial Sequence
  dgRNA
  Erap1
aatgcattccctatc

SEQ ID NO: 14772 - DNA, 15 bp, Artificial Sequence
  dgRNA
  Erap1
gagttcccgaagccc

SEQ ID NO: 14773 - DNA, 15 bp, Artificial Sequence
  dgRNA
  Erap1
ttttagcgccttagc

SEQ ID NO: 14774 - DNA, 15 bp, Artificial Sequence
  dgRNA
  Erap1
ccccacgtgccctgc

SEQ ID NO: 14775 - DNA, 15 bp, Artificial Sequence
  dgRNA
  Scrn3
ctcccggagcttcac

SEQ ID NO: 14776 - DNA, 15 bp, Artificial Sequence
  dgRNA
  Scrn3
ttcaccggaactgct

SEQ ID NO: 14777 - DNA, 15 bp, Artificial Sequence
  dgRNA
  Scrn3
actgctaggcaagtt

SEQ ID NO: 14778 - DNA, 15 bp, Artificial Sequence
  dgRNA
  Scrn3
ctgctaggcaagttt

SEQ ID NO: 14779 - DNA, 15 bp, Artificial Sequence
  dgRNA
  Arfgef3
tccgcccgtggatct

SEQ ID NO: 14780 - DNA, 15 bp, Artificial Sequence
  dgRNA
  Arfgef3
ctcggtgatttccct

SEQ ID NO: 14781 - DNA, 15 bp, Artificial Sequence
  dgRNA
  Arfgef3
tcggtgatttcccta

SEQ ID NO: 14782 - DNA, 15 bp, Artificial Sequence
  dgRNA
  Arfgef3
gaagcttggtacccc

SEQ ID NO: 14783 - DNA, 15 bp, Artificial Sequence
  dgRNA
  Cant1
cggcgctcagtgcgc

SEQ ID NO: 14784 - DNA, 15 bp, Artificial Sequence
  dgRNA
  Cant1
gctgccgggaagacg

SEQ ID NO: 14785 - DNA, 15 bp, Artificial Sequence
  dgRNA
  Cant1
aggcaaccgagagtg

SEQ ID NO: 14786 - DNA, 15 bp, Artificial Sequence
  dgRNA
  Cant1
ccgagagtgcggcgc

SEQ ID NO: 14787 - DNA, 15 bp, Artificial Sequence
  dgRNA
  Parp3
tcaccgggcaaataa

SEQ ID NO: 14788 - DNA, 15 bp, Artificial Sequence
  dgRNA
  Parp3
gtcaaagctgcatga

SEQ ID NO: 14789 - DNA, 15 bp, Artificial Sequence
  dgRNA
  Parp3
gccagtcagtccgag

SEQ ID NO: 14790 - DNA, 15 bp, Artificial Sequence
  dgRNA
  Parp3
cagtccgagcggctt

SEQ ID NO: 14791 - DNA, 15 bp, Artificial Sequence
  dgRNA
  Sri
ttagaaactgtacgg

SEQ ID NO: 14792 - DNA, 15 bp, Artificial Sequence
  dgRNA
  Sri
actgtacggaggaga

SEQ ID NO: 14793 - DNA, 15 bp, Artificial Sequence
  dgRNA
  Sri
caactgatacagctc

SEQ ID NO: 14794 - DNA, 15 bp, Artificial Sequence
  dgRNA
  Sri
aactgatacagctcc

SEQ ID NO: 14795 - DNA, 15 bp, Artificial Sequence
  dgRNA
  Wasf3
actaccctatttaat

SEQ ID NO: 14796 - DNA, 15 bp, Artificial Sequence
  dgRNA
  Wasf3
ggctgtgtgtctcgt

SEQ ID NO: 14797 - DNA, 15 bp, Artificial Sequence
  dgRNA
  Wasf3
tgtgtgtctcgtagg

SEQ ID NO: 14798 - DNA, 15 bp, Artificial Sequence
  dgRNA
  Wasf3
gtgtgtctcgtaggt

SEQ ID NO: 14799 - DNA, 15 bp, Artificial Sequence
  dgRNA
  Lair1
gctacatctaaacat

SEQ ID NO: 14800 - DNA, 15 bp, Artificial Sequence
  dgRNA
  Lair1
ctacatctaaacata

SEQ ID NO: 14801 - DNA, 15 bp, Artificial Sequence
  dgRNA
  Lair1
gttccccacatggag

SEQ ID NO: 14802 - DNA, 15 bp, Artificial Sequence
  dgRNA
  Lair1
ctaaggttccccaca

SEQ ID NO: 14803 - DNA, 15 bp, Artificial Sequence
  dgRNA
  Cops3
gtgcactacaatgaa

SEQ ID NO: 14804 - DNA, 15 bp, Artificial Sequence
  dgRNA
  Cops3
ctacaatgaaaggcg

SEQ ID NO: 14805 - DNA, 15 bp, Artificial Sequence
  dgRNA
  Cops3
tacaatgaaaggcga

SEQ ID NO: 14806 - DNA, 15 bp, Artificial Sequence
  dgRNA
  Cops3
acttccggcgactag

SEQ ID NO: 14807 - DNA, 15 bp, Artificial Sequence
  dgRNA
  BC027072
tgagaagttctatat

SEQ ID NO: 14808 - DNA, 15 bp, Artificial Sequence
  dgRNA
  BC027072
acgccgagtactgac

SEQ ID NO: 14809 - DNA, 15 bp, Artificial Sequence
  dgRNA
  BC027072
cgagtactgactggc

SEQ ID NO: 14810 - DNA, 15 bp, Artificial Sequence
  dgRNA
  BC027072
ccatccgcatctgtc

SEQ ID NO: 14811 - DNA, 15 bp, Artificial Sequence
  dgRNA
  Adgrb2
acttgcgactgtccc

SEQ ID NO: 14812 - DNA, 15 bp, Artificial Sequence
  dgRNA
  Adgrb2
ctgtgaccttacacc

SEQ ID NO: 14813 - DNA, 15 bp, Artificial Sequence
  dgRNA
  Adgrb2
aagtagtgggacctg

SEQ ID NO: 14814 - DNA, 15 bp, Artificial Sequence
  dgRNA
  Adgrb2
acagtcgcaagtagt

SEQ ID NO: 14815 - DNA, 15 bp, Artificial Sequence
  dgRNA
  Tspan5
ggtctgtgagctacg

SEQ ID NO: 14816 - DNA, 15 bp, Artificial Sequence
  dgRNA
  Tspan5
cctcgtctctctcgg

SEQ ID NO: 14817 - DNA, 15 bp, Artificial Sequence
  dgRNA
  Tspan5
tctctctcggcggca

SEQ ID NO: 14818 - DNA, 15 bp, Artificial Sequence
  dgRNA
  Tspan5
ctctctcggcggcaa

SEQ ID NO: 14819 - DNA, 15 bp, Artificial Sequence
  dgRNA
  Ankrd60
caagaggttccccac

SEQ ID NO: 14820 - DNA, 15 bp, Artificial Sequence
  dgRNA
  Ankrd60
ccccacagggctagc

SEQ ID NO: 14821 - DNA, 15 bp, Artificial Sequence
  dgRNA
  Ankrd60
gctagcaggctggcg

SEQ ID NO: 14822 - DNA, 15 bp, Artificial Sequence
  dgRNA
  Ankrd60
ggctggcgaggaccg

SEQ ID NO: 14823 - DNA, 15 bp, Artificial Sequence
  dgRNA
  1700001K19Rik
cagaactcggggcac

SEQ ID NO: 14824 - DNA, 15 bp, Artificial Sequence
  dgRNA
  1700001K19Rik
agaactcggggcaca

SEQ ID NO: 14825 - DNA, 15 bp, Artificial Sequence
  dgRNA
  1700001K19Rik
gtggtttagggccta

SEQ ID NO: 14826 - DNA, 15 bp, Artificial Sequence
  dgRNA
  1700001K19Rik
ttagggcctatggtc

SEQ ID NO: 14827 - DNA, 15 bp, Artificial Sequence
  dgRNA
  Tprn
actgggtccgccaat

SEQ ID NO: 14828 - DNA, 15 bp, Artificial Sequence
  dgRNA
  Tprn
ctgggtccgccaata

SEQ ID NO: 14829 - DNA, 15 bp, Artificial Sequence
  dgRNA
  Tprn
tccgccaatagggtc

SEQ ID NO: 14830 - DNA, 15 bp, Artificial Sequence
  dgRNA
  Tprn
caatgagaacgctga

SEQ ID NO: 14831 - DNA, 15 bp, Artificial Sequence
  dgRNA
  Otop2
ctacggtctgagcct

SEQ ID NO: 14832 - DNA, 15 bp, Artificial Sequence
  dgRNA
  Otop2
agctccccaggcggc

SEQ ID NO: 14833 - DNA, 15 bp, Artificial Sequence
  dgRNA
  Otop2
tcagtagcccccttt

SEQ ID NO: 14834 - DNA, 15 bp, Artificial Sequence
  dgRNA
  Otop2
ctcagtagccccctt

SEQ ID NO: 14835 - DNA, 15 bp, Artificial Sequence
  dgRNA
  Umad1
atccacgggagcatc

SEQ ID NO: 14836 - DNA, 15 bp, Artificial Sequence
  dgRNA
  Umad1
ctggttcgctcgcac

SEQ ID NO: 14837 - DNA, 15 bp, Artificial Sequence
  dgRNA
  Umad1
tggttcgctcgcacc

SEQ ID NO: 14838 - DNA, 15 bp, Artificial Sequence
  dgRNA
  Umad1
tcgctcgcaccgggc

SEQ ID NO: 14839 - DNA, 15 bp, Artificial Sequence
  dgRNA
  H2-K1
aaagtcttagtcgcc

SEQ ID NO: 14840 - DNA, 15 bp, Artificial Sequence
  dgRNA
  H2-K1
agtcgccaggcagtg

SEQ ID NO: 14841 - DNA, 15 bp, Artificial Sequence
  dgRNA
  H2-K1
agctcttacccccat

SEQ ID NO: 14842 - DNA, 15 bp, Artificial Sequence
  dgRNA
  H2-K1
gctcttacccccatt

SEQ ID NO: 14843 - DNA, 15 bp, Artificial Sequence
  dgRNA
  Zscan4d
cgactaacggaagcc

SEQ ID NO: 14844 - DNA, 15 bp, Artificial Sequence
  dgRNA
  Ccdc115
cgccctcaaccaaaa

SEQ ID NO: 14845 - DNA, 15 bp, Artificial Sequence
  dgRNA
  Ccdc115
caaaaaggcctttag

SEQ ID NO: 14846 - DNA, 15 bp, Artificial Sequence
  dgRNA
  Ccdc115
actcgattccactgc

SEQ ID NO: 14847 - DNA, 15 bp, Artificial Sequence
  dgRNA
  Ccdc115
tgccccatcttaaga

SEQ ID NO: 14848 - DNA, 15 bp, Artificial Sequence
  dgRNA
  Usp2
ccactaggcatcggg

SEQ ID NO: 14849 - DNA, 15 bp, Artificial Sequence
  dgRNA
  Usp2
taggcatcgggtgga

SEQ ID NO: 14850 - DNA, 15 bp, Artificial Sequence
  dgRNA
  Usp2
gcatcgggtggacgg

SEQ ID NO: 14851 - DNA, 15 bp, Artificial Sequence
  dgRNA
  Usp2
catcgggtggacggt

SEQ ID NO: 14852 - DNA, 15 bp, Artificial Sequence
  dgRNA
  Eml6
cttgtagtacactag

SEQ ID NO: 14853 - DNA, 15 bp, Artificial Sequence
  dgRNA
  Eml6
gctcgcctcagcagc

SEQ ID NO: 14854 - DNA, 15 bp, Artificial Sequence
  dgRNA
  Eml6
gcagctggtttacag

SEQ ID NO: 14855 - DNA, 15 bp, Artificial Sequence
  dgRNA
  Eml6
agatgcatagggaac

SEQ ID NO: 14856 - DNA, 15 bp, Artificial Sequence
  dgRNA
  Olfr44
tttctcagcgagagt

SEQ ID NO: 14857 - DNA, 15 bp, Artificial Sequence
  dgRNA
  Olfr44
tgcagccatgatatt

SEQ ID NO: 14858 - DNA, 15 bp, Artificial Sequence
  dgRNA
  Olfr44
atacattggtggtaa

SEQ ID NO: 14859 - DNA, 15 bp, Artificial Sequence
  dgRNA
  Olfr44
tcgctgagaaaactt

SEQ ID NO: 14860 - DNA, 15 bp, Artificial Sequence
  dgRNA
  N6amt2
actaattggtttgaa

SEQ ID NO: 14861 - DNA, 15 bp, Artificial Sequence
  dgRNA
  N6amt2
aagccggaagctgac

SEQ ID NO: 14862 - DNA, 15 bp, Artificial Sequence
  dgRNA
  N6amt2
agccggaagctgact

SEQ ID NO: 14863 - DNA, 15 bp, Artificial Sequence
  dgRNA
  N6amt2
cggaagctgactggg

SEQ ID NO: 14864 - DNA, 15 bp, Artificial Sequence
  dgRNA
  Ivl
aggaagttgaccaac

SEQ ID NO: 14865 - DNA, 15 bp, Artificial Sequence
  dgRNA
  Ivl
gttgaccaactggag

SEQ ID NO: 14866 - DNA, 15 bp, Artificial Sequence
  dgRNA
  Ivl
gctagaacaatataa

SEQ ID NO: 14867 - DNA, 15 bp, Artificial Sequence
  dgRNA
  Ivl
tttcaccactccagt

SEQ ID NO: 14868 - DNA, 15 bp, Artificial Sequence
  dgRNA
  Epn3
acctacttctagcag

SEQ ID NO: 14869 - DNA, 15 bp, Artificial Sequence
  dgRNA
  Epn3
gttaactcacttgaa

SEQ ID NO: 14870 - DNA, 15 bp, Artificial Sequence
  dgRNA
  Epn3
caccggctgacaaac

SEQ ID NO: 14871 - DNA, 15 bp, Artificial Sequence
  dgRNA
  Epn3
cctgaaggcaccgcc

SEQ ID NO: 14872 - DNA, 15 bp, Artificial Sequence
  dgRNA
  Myoz1
ggaggcacacccctt

SEQ ID NO: 14873 - DNA, 15 bp, Artificial Sequence
  dgRNA
  Myoz1
cggctgactgatccc

SEQ ID NO: 14874 - DNA, 15 bp, Artificial Sequence
  dgRNA
  Myoz1
gaacctcaggcaaag

SEQ ID NO: 14875 - DNA, 15 bp, Artificial Sequence
  dgRNA
  Myoz1
aggctctcggttcca

SEQ ID NO: 14876 - DNA, 15 bp, Artificial Sequence
  dgRNA
  Rassf9
tattaccatgcctgt

SEQ ID NO: 14877 - DNA, 15 bp, Artificial Sequence
  dgRNA
  Rassf9
gcctgtagggttggc

SEQ ID NO: 14878 - DNA, 15 bp, Artificial Sequence
  dgRNA
  Rassf9
tagagtttagctagt

SEQ ID NO: 14879 - DNA, 15 bp, Artificial Sequence
  dgRNA
  Rassf9
gaattgcactcgact

SEQ ID NO: 14880 - DNA, 15 bp, Artificial Sequence
  dgRNA
  Aldh1l2
ctctgcctaactccg

SEQ ID NO: 14881 - DNA, 15 bp, Artificial Sequence
  dgRNA
  Aldh1l2
tctgcctaactccgc

SEQ ID NO: 14882 - DNA, 15 bp, Artificial Sequence
  dgRNA
  Aldh1l2
ggtctgagtaattta

SEQ ID NO: 14883 - DNA, 15 bp, Artificial Sequence
  dgRNA
  Aldh1l2
ctctagcgaacactt

SEQ ID NO: 14884 - DNA, 15 bp, Artificial Sequence
  dgRNA
  Zfp3
gcgcaccctaaatct

SEQ ID NO: 14885 - DNA, 15 bp, Artificial Sequence
  dgRNA
  Zfp3
cctaaatctaggaac

SEQ ID NO: 14886 - DNA, 15 bp, Artificial Sequence
  dgRNA
  Zfp3
ctcttggaaagcggg

SEQ ID NO: 14887 - DNA, 15 bp, Artificial Sequence
  dgRNA
  Zfp3
ggtgaggcacaaacg

SEQ ID NO: 14888 - DNA, 15 bp, Artificial Sequence
  dgRNA
  P2ry14
ggagggaaccagcgg

SEQ ID NO: 14889 - DNA, 15 bp, Artificial Sequence
  dgRNA
  P2ry14
caacccattatctcg

SEQ ID NO: 14890 - DNA, 15 bp, Artificial Sequence
  dgRNA
  P2ry14
caggctgtcctccgc

SEQ ID NO: 14891 - DNA, 15 bp, Artificial Sequence
  dgRNA
  P2ry14
atctgcgtgagtgtc

SEQ ID NO: 14892 - DNA, 15 bp, Artificial Sequence
  dgRNA
  Rassf4
cgcctgtgtagaccg

SEQ ID NO: 14893 - DNA, 15 bp, Artificial Sequence
  dgRNA
  Rassf4
gcctgtgtagaccga

SEQ ID NO: 14894 - DNA, 15 bp, Artificial Sequence
  dgRNA
  Rassf4
tagaccgagggcccc

SEQ ID NO: 14895 - DNA, 15 bp, Artificial Sequence
  dgRNA
  Rassf4
agaccgagggcccct

SEQ ID NO: 14896 - DNA, 15 bp, Artificial Sequence
  dgRNA
  Tmem62
aatttccacaagata

SEQ ID NO: 14897 - DNA, 15 bp, Artificial Sequence
  dgRNA
  Tmem62
ttatgttattcgtga

SEQ ID NO: 14898 - DNA, 15 bp, Artificial Sequence
  dgRNA
  Tmem62
cttgttatggtattg

SEQ ID NO: 14899 - DNA, 15 bp, Artificial Sequence
  dgRNA
  Tmem62
acgggcggctcactc

SEQ ID NO: 14900 - DNA, 15 bp, Artificial Sequence
  dgRNA
  Malsu1
tcggcctaccaagtg

SEQ ID NO: 14901 - DNA, 15 bp, Artificial Sequence
  dgRNA
  Malsu1
cttaaactactcccc

SEQ ID NO: 14902 - DNA, 15 bp, Artificial Sequence
  dgRNA
  Malsu1
ctaaatcaccgtttc

SEQ ID NO: 14903 - DNA, 15 bp, Artificial Sequence
  dgRNA
  Malsu1
ctttccgcacttggt

SEQ ID NO: 14904 - DNA, 15 bp, Artificial Sequence
  dgRNA
  Ppfibp2
ggaccttgagatgtt

SEQ ID NO: 14905 - DNA, 15 bp, Artificial Sequence
  dgRNA
  Ppfibp2
tggaagggcatagta

SEQ ID NO: 14906 - DNA, 15 bp, Artificial Sequence
  dgRNA
  Ppfibp2
ggaagggcatagtaa

SEQ ID NO: 14907 - DNA, 15 bp, Artificial Sequence
  dgRNA
  Ppfibp2
cctgggcagtaaccc

SEQ ID NO: 14908 - DNA, 15 bp, Artificial Sequence
  dgRNA
  Lyn
tcccaacttgcggtc

SEQ ID NO: 14909 - DNA, 15 bp, Artificial Sequence
  dgRNA
  Lyn
cccaacttgcggtct

SEQ ID NO: 14910 - DNA, 15 bp, Artificial Sequence
  dgRNA
  Lyn
taaaaccctgagcga

SEQ ID NO: 14911 - DNA, 15 bp, Artificial Sequence
  dgRNA
  Lyn
ccaaataccaaacct

SEQ ID NO: 14912 - DNA, 15 bp, Artificial Sequence
  dgRNA
  Pabpc4l
atcccgatctttgct

SEQ ID NO: 14913 - DNA, 15 bp, Artificial Sequence
  dgRNA
  Pabpc4l
tcccgatctttgctt

SEQ ID NO: 14914 - DNA, 15 bp, Artificial Sequence
  dgRNA
  Pabpc4l
cgatctttgcttggg

SEQ ID NO: 14915 - DNA, 15 bp, Artificial Sequence
  dgRNA
  Pabpc4l
gacaaaacagaccgg

SEQ ID NO: 14916 - DNA, 15 bp, Artificial Sequence
  dgRNA
  Glt6d1
gagagctaaccaaag

SEQ ID NO: 14917 - DNA, 15 bp, Artificial Sequence
  dgRNA
  Glt6d1
gtgctattgtgatgc

SEQ ID NO: 14918 - DNA, 15 bp, Artificial Sequence
  dgRNA
  Glt6d1
gacatcattaacagt

SEQ ID NO: 14919 - DNA, 15 bp, Artificial Sequence
  dgRNA
  Glt6d1
accaggtacttcagt

SEQ ID NO: 14920 - DNA, 15 bp, Artificial Sequence
  dgRNA
  Pdzd2
gacttgggtccccac

SEQ ID NO: 14921 - DNA, 15 bp, Artificial Sequence
  dgRNA
  Pdzd2
gtccccacggggtcc

SEQ ID NO: 14922 - DNA, 15 bp, Artificial Sequence
  dgRNA
  Pdzd2
tccccacggggtcca

SEQ ID NO: 14923 - DNA, 15 bp, Artificial Sequence
  dgRNA
  Pdzd2
cccacggggtccagg

SEQ ID NO: 14924 - DNA, 15 bp, Artificial Sequence
  dgRNA
  Cxcl15
tgaactcgaggcata

SEQ ID NO: 14925 - DNA, 15 bp, Artificial Sequence
  dgRNA
  Cxcl15
gttgagatgaactcg

SEQ ID NO: 14926 - DNA, 15 bp, Artificial Sequence
  dgRNA
  Ttc7b
tcggggtggctgccc

SEQ ID NO: 14927 - DNA, 15 bp, Artificial Sequence
  dgRNA
  Ttc7b
gtccggcctccgccc

SEQ ID NO: 14928 - DNA, 15 bp, Artificial Sequence
  dgRNA
  Ttc7b
cgccccggcccgctg

SEQ ID NO: 14929 - DNA, 15 bp, Artificial Sequence
  dgRNA
  Ttc7b
ggcccgctgcggctc

SEQ ID NO: 14930 - DNA, 15 bp, Artificial Sequence
  dgRNA
  Olfr1448
cattctgatccaagc

SEQ ID NO: 14931 - DNA, 15 bp, Artificial Sequence
  dgRNA
  Smox
tcccttttgcgagat

SEQ ID NO: 14932 - DNA, 15 bp, Artificial Sequence
  dgRNA
  Smox
cccttttgcgagata

SEQ ID NO: 14933 - DNA, 15 bp, Artificial Sequence
  dgRNA
  Smox
ccttttgcgagatag

SEQ ID NO: 14934 - DNA, 15 bp, Artificial Sequence
  dgRNA
  Smox
gccgcgggcaactcc

SEQ ID NO: 14935 - DNA, 15 bp, Artificial Sequence
  dgRNA
  Cul9
acacaagtccggtga

SEQ ID NO: 14936 - DNA, 15 bp, Artificial Sequence
  dgRNA
  Cul9
cacaagtccggtgat

SEQ ID NO: 14937 - DNA, 15 bp, Artificial Sequence
  dgRNA
  Cul9
ccggtgatgggagta

SEQ ID NO: 14938 - DNA, 15 bp, Artificial Sequence
  dgRNA
  Cul9
cggtgatgggagtat

SEQ ID NO: 14939 - DNA, 15 bp, Artificial Sequence
  dgRNA
  Fgfr3
ctcggcattgcttca

SEQ ID NO: 14940 - DNA, 15 bp, Artificial Sequence
  dgRNA
  Fgfr3
tcggcattgcttcaa

SEQ ID NO: 14941 - DNA, 15 bp, Artificial Sequence
  dgRNA
  Fgfr3
cggcattgcttcaag

SEQ ID NO: 14942 - DNA, 15 bp, Artificial Sequence
  dgRNA
  Fgfr3
ctgctccgccccagc

SEQ ID NO: 14943 - DNA, 15 bp, Artificial Sequence
  dgRNA
  Cnbd2
cgcctgcgtctgcac

SEQ ID NO: 14944 - DNA, 15 bp, Artificial Sequence
  dgRNA
  Cnbd2
tgcgtctgcaccgga

SEQ ID NO: 14945 - DNA, 15 bp, Artificial Sequence
  dgRNA
  Cnbd2
gtctgcaccggaagg

SEQ ID NO: 14946 - DNA, 15 bp, Artificial Sequence
  dgRNA
  Cnbd2
acagagggccgctga

SEQ ID NO: 14947 - DNA, 15 bp, Artificial Sequence
  dgRNA
  Nxf2
ttgactatacataac

SEQ ID NO: 14948 - DNA, 15 bp, Artificial Sequence
  dgRNA
  Nxf2
tgactatacataaca

SEQ ID NO: 14949 - DNA, 15 bp, Artificial Sequence
  dgRNA
  Nxf2
gactatacataacag

SEQ ID NO: 14950 - DNA, 15 bp, Artificial Sequence
  dgRNA
  Nxf2
cctgcaatgatcacg

SEQ ID NO: 14951 - DNA, 15 bp, Artificial Sequence
  dgRNA
  Hist2h2ab
gagggcctttaaatg

SEQ ID NO: 14952 - DNA, 15 bp, Artificial Sequence
  dgRNA
  Hist2h2ab
gtggctctcatcgat

SEQ ID NO: 14953 - DNA, 15 bp, Artificial Sequence
  dgRNA
  Hist2h2ab
catcgtaggatttta

SEQ ID NO: 14954 - DNA, 15 bp, Artificial Sequence
  dgRNA
  Hist2h2ab
cctcacttacatcgt

SEQ ID NO: 14955 - DNA, 15 bp, Artificial Sequence
  dgRNA
  Col5a1
gccctcggcgcccag

SEQ ID NO: 14956 - DNA, 15 bp, Artificial Sequence
  dgRNA
  Col5a1
ccctcggcgcccagt

SEQ ID NO: 14957 - DNA, 15 bp, Artificial Sequence
  dgRNA
  Col5a1
tcggcgcccagtggg

SEQ ID NO: 14958 - DNA, 15 bp, Artificial Sequence
  dgRNA
  Col5a1
gcgcccagtgggagg

SEQ ID NO: 14959 - DNA, 15 bp, Artificial Sequence
  dgRNA
  Olfr38
ataggcttcagtttc

SEQ ID NO: 14960 - DNA, 15 bp, Artificial Sequence
  dgRNA
  Vmn1r15
ttgtgattcattgga

SEQ ID NO: 14961 - DNA, 15 bp, Artificial Sequence
  dgRNA
  Dag1
ggcgtgacaggccaa

SEQ ID NO: 14962 - DNA, 15 bp, Artificial Sequence
  dgRNA
  Dag1
gcgtgacaggccaat

SEQ ID NO: 14963 - DNA, 15 bp, Artificial Sequence
  dgRNA
  Dag1
gcctgtgcgcgggtg

SEQ ID NO: 14964 - DNA, 15 bp, Artificial Sequence
  dgRNA
  Dag1
gggtgcggcgcgctg

SEQ ID NO: 14965 - DNA, 15 bp, Artificial Sequence
  dgRNA
  Olfr419
tctacccttatattc

SEQ ID NO: 14966 - DNA, 15 bp, Artificial Sequence
  dgRNA
  Olfr419
agatgtgagtgatac

SEQ ID NO: 14967 - DNA, 15 bp, Artificial Sequence
  dgRNA
  Reg3g
aactcccgcttttga

SEQ ID NO: 14968 - DNA, 15 bp, Artificial Sequence
  dgRNA
  Reg3g
actcccgcttttgat

SEQ ID NO: 14969 - DNA, 15 bp, Artificial Sequence
  dgRNA
  Reg3g
ccctgctgaattgtc

SEQ ID NO: 14970 - DNA, 15 bp, Artificial Sequence
  dgRNA
  Reg3g
gtttcccatcaaaag

SEQ ID NO: 14971 - DNA, 15 bp, Artificial Sequence
  dgRNA
  Slc7a15
ttctaaaccacgccc

SEQ ID NO: 14972 - DNA, 15 bp, Artificial Sequence
  dgRNA
  Slc7a15
atcattaatgccttc

SEQ ID NO: 14973 - DNA, 15 bp, Artificial Sequence
  dgRNA
  Slc7a15
aaacccacgaacatt

SEQ ID NO: 14974 - DNA, 15 bp, Artificial Sequence
  dgRNA
  Slc7a15
atctattggagccac

SEQ ID NO: 14975 - DNA, 15 bp, Artificial Sequence
  dgRNA
  Abi2
ctcgtcgcgcgccgt

SEQ ID NO: 14976 - DNA, 15 bp, Artificial Sequence
  dgRNA
  Abi2
tcgtcgcgcgccgta

SEQ ID NO: 14977 - DNA, 15 bp, Artificial Sequence
  dgRNA
  Abi2
gccgtagggtgtgtg

SEQ ID NO: 14978 - DNA, 15 bp, Artificial Sequence
  dgRNA
  Abi2
gcgcgacgagggagg

SEQ ID NO: 14979 - DNA, 15 bp, Artificial Sequence
  dgRNA
  Cd44
acacccaaagcgagg

SEQ ID NO: 14980 - DNA, 15 bp, Artificial Sequence
  dgRNA
  Cd44
cacacccaaagcgag

SEQ ID NO: 14981 - DNA, 15 bp, Artificial Sequence
  dgRNA
  Cd44
gacacacccaaagcg

SEQ ID NO: 14982 - DNA, 15 bp, Artificial Sequence
  dgRNA
  Cd44
gtgagtgacctaaga

SEQ ID NO: 14983 - DNA, 15 bp, Artificial Sequence
  dgRNA
  Olfr221
cacaggcgacacact

SEQ ID NO: 14984 - DNA, 15 bp, Artificial Sequence
  dgRNA
  Olfr221
gacacctaacgtctc

SEQ ID NO: 14985 - DNA, 15 bp, Artificial Sequence
  dgRNA
  Olfr221
gtgtcgcctgtggga

SEQ ID NO: 14986 - DNA, 15 bp, Artificial Sequence
  dgRNA
  Olfr221
aagtgtgtcgcctgt

SEQ ID NO: 14987 - DNA, 15 bp, Artificial Sequence
  dgRNA
  Cela1
aagaggcgtataaag

SEQ ID NO: 14988 - DNA, 15 bp, Artificial Sequence
  dgRNA
  Cela1
agaggcgtataaaga

SEQ ID NO: 14989 - DNA, 15 bp, Artificial Sequence
  dgRNA
  Cela1
cgtataaagagggct

SEQ ID NO: 14990 - DNA, 15 bp, Artificial Sequence
  dgRNA
  Cela1
agagggctcggttca

SEQ ID NO: 14991 - DNA, 15 bp, Artificial Sequence
  dgRNA
  Rp1
agagacaatctaata

SEQ ID NO: 14992 - DNA, 15 bp, Artificial Sequence
  dgRNA
  Rp1
gaggtgagctacttc

SEQ ID NO: 14993 - DNA, 15 bp, Artificial Sequence
  dgRNA
  Rp1
agattaacatcacct

SEQ ID NO: 14994 - DNA, 15 bp, Artificial Sequence
  dgRNA
  Rp1
agtagctcacctcaa

SEQ ID NO: 14995 - DNA, 15 bp, Artificial Sequence
  dgRNA
  Tcof1
atcatggcggcccag

SEQ ID NO: 14996 - DNA, 15 bp, Artificial Sequence
  dgRNA
  Tcof1
tcatggcggcccaga

SEQ ID NO: 14997 - DNA, 15 bp, Artificial Sequence
  dgRNA
  Tcof1
tggcggcccagaggg

SEQ ID NO: 14998 - DNA, 15 bp, Artificial Sequence
  dgRNA
  Tcof1
agggcgggtctagat

SEQ ID NO: 14999 - DNA, 15 bp, Artificial Sequence
  dgRNA
  Ttll4
ctctaggctgcacaa

SEQ ID NO: 15000 - DNA, 15 bp, Artificial Sequence
  dgRNA
  Ttll4
tcggcgcgcttgcct

SEQ ID NO: 15001 - DNA, 15 bp, Artificial Sequence
  dgRNA
  Ttll4
cggcgcgcttgcctc

SEQ ID NO: 15002 - DNA, 15 bp, Artificial Sequence
  dgRNA
  Ttll4
cttagatctgtccgc

SEQ ID NO: 15003 - DNA, 15 bp, Artificial Sequence
  dgRNA
  Relb
gcagcgactcgcacc

SEQ ID NO: 15004 - DNA, 15 bp, Artificial Sequence
  dgRNA
  Relb
gtcacgtgagcagcg

SEQ ID NO: 15005 - DNA, 15 bp, Artificial Sequence
  dgRNA
  Relb
tcacgtgagcagcgg

SEQ ID NO: 15006 - DNA, 15 bp, Artificial Sequence
  dgRNA
  Relb
tttgacgtgacgtca

SEQ ID NO: 15007 - DNA, 15 bp, Artificial Sequence
  dgRNA
  Glt8d2
caggacgagcacatc

SEQ ID NO: 15008 - DNA, 15 bp, Artificial Sequence
  dgRNA
  Glt8d2
aaacccgagccattc

SEQ ID NO: 15009 - DNA, 15 bp, Artificial Sequence
  dgRNA
  Glt8d2
caacgcaagcgcaag

SEQ ID NO: 15010 - DNA, 15 bp, Artificial Sequence
  dgRNA
  Glt8d2
cgcaagcgcaagcgg

SEQ ID NO: 15011 - DNA, 15 bp, Artificial Sequence
  dgRNA
  Sap30
gacttgcccggtgct

SEQ ID NO: 15012 - DNA, 15 bp, Artificial Sequence
  dgRNA
  Sap30
gcccggtgcttggaa

SEQ ID NO: 15013 - DNA, 15 bp, Artificial Sequence
  dgRNA
  Sap30
ccacgcgacgcatgc

SEQ ID NO: 15014 - DNA, 15 bp, Artificial Sequence
  dgRNA
  Sap30
cacgcgacgcatgct

SEQ ID NO: 15015 - DNA, 15 bp, Artificial Sequence
  dgRNA
  E330021D16Rik
gctgcggtccagaag

SEQ ID NO: 15016 - DNA, 15 bp, Artificial Sequence
  dgRNA
  E330021D16Rik
ctgaggtttgctact

SEQ ID NO: 15017 - DNA, 15 bp, Artificial Sequence
  dgRNA
  E330021D16Rik
aaggctgcacaaact

SEQ ID NO: 15018 - DNA, 15 bp, Artificial Sequence
  dgRNA
  Hoxc12
tccccgtctgcgtta

SEQ ID NO: 15019 - DNA, 15 bp, Artificial Sequence
  dgRNA
  Hoxc12
atctccacccaggat

SEQ ID NO: 15020 - DNA, 15 bp, Artificial Sequence
  dgRNA
  Hoxc12
agtagagttggtgcg

SEQ ID NO: 15021 - DNA, 15 bp, Artificial Sequence
  dgRNA
  Hoxc12
tggtgcggggaatgt

SEQ ID NO: 15022 - DNA, 15 bp, Artificial Sequence
  dgRNA
  Gfpt1
tcggctcgccctcag

SEQ ID NO: 15023 - DNA, 15 bp, Artificial Sequence
  dgRNA
  Gfpt1
cggctcgccctcagc

SEQ ID NO: 15024 - DNA, 15 bp, Artificial Sequence
  dgRNA
  Gfpt1
ctcgccctcagcggg

SEQ ID NO: 15025 - DNA, 15 bp, Artificial Sequence
  dgRNA
  Gfpt1
tcagcgggcggctcc

SEQ ID NO: 15026 - DNA, 15 bp, Artificial Sequence
  dgRNA
  3830417A13Rik
gtctcacataaagtc

SEQ ID NO: 15027 - DNA, 15 bp, Artificial Sequence
  dgRNA
  3830417A13Rik
tctcacataaagtcg

SEQ ID NO: 15028 - DNA, 15 bp, Artificial Sequence
  dgRNA
  3830417A13Rik
cacataaagtcgggg

SEQ ID NO: 15029 - DNA, 15 bp, Artificial Sequence
  dgRNA
  3830417A13Rik
acttgtgacaatatc

SEQ ID NO: 15030 - DNA, 15 bp, Artificial Sequence
  dgRNA
  Plscr1
tgatgcataaaatgc

SEQ ID NO: 15031 - DNA, 15 bp, Artificial Sequence
  dgRNA
  Plscr1
tgcataaaatgcagg

SEQ ID NO: 15032 - DNA, 15 bp, Artificial Sequence
  dgRNA
  Plscr1
gcataaaatgcaggc

SEQ ID NO: 15033 - DNA, 15 bp, Artificial Sequence
  dgRNA
  Plscr1
cataaaatgcaggcg

SEQ ID NO: 15034 - DNA, 15 bp, Artificial Sequence
  dgRNA
  Olfr1042
tgataaatctaccta

SEQ ID NO: 15035 - DNA, 15 bp, Artificial Sequence
  dgRNA
  Olfr1042
ttcatgagtccgaat

SEQ ID NO: 15036 - DNA, 15 bp, Artificial Sequence
  dgRNA
  Olfr1042
tcggcttctgaattt

SEQ ID NO: 15037 - DNA, 15 bp, Artificial Sequence
  dgRNA
  Olfr1042
actggcacgtgccat

SEQ ID NO: 15038 - DNA, 15 bp, Artificial Sequence
  dgRNA
  Paf1
cgacagattagccaa

SEQ ID NO: 15039 - DNA, 15 bp, Artificial Sequence
  dgRNA
  Paf1
gacagattagccaat

SEQ ID NO: 15040 - DNA, 15 bp, Artificial Sequence
  dgRNA
  Paf1
gccctcccaaatccg

SEQ ID NO: 15041 - DNA, 15 bp, Artificial Sequence
  dgRNA
  Paf1
atccgaggccatgag

SEQ ID NO: 15042 - DNA, 15 bp, Artificial Sequence
  dgRNA
  Sox17
aaatctctagtgttg

SEQ ID NO: 15043 - DNA, 15 bp, Artificial Sequence
  dgRNA
  Sox17
aatctctagtgttga

SEQ ID NO: 15044 - DNA, 15 bp, Artificial Sequence
  dgRNA
  Sox17
tgcaggaagccgctc

SEQ ID NO: 15045 - DNA, 15 bp, Artificial Sequence
  dgRNA
  Sox17
ataacgtcgtgagct

SEQ ID NO: 15046 - DNA, 15 bp, Artificial Sequence
  dgRNA
  Kirrel3
gatagctaccattcc

SEQ ID NO: 15047 - DNA, 15 bp, Artificial Sequence
  dgRNA
  Kirrel3
agctaccattcccgg

SEQ ID NO: 15048 - DNA, 15 bp, Artificial Sequence
  dgRNA
  Kirrel3
gtatcaccccctaga

SEQ ID NO: 15049 - DNA, 15 bp, Artificial Sequence
  dgRNA
  Kirrel3
ttggatgcgcactac

SEQ ID NO: 15050 - DNA, 15 bp, Artificial Sequence
  dgRNA
  Aasdhppt
agacgtacaggttgg

SEQ ID NO: 15051 - DNA, 15 bp, Artificial Sequence
  dgRNA
  Aasdhppt
gggcgaagctgcgtc

SEQ ID NO: 15052 - DNA, 15 bp, Artificial Sequence
  dgRNA
  Aasdhppt
tcaaccctgaactaa

SEQ ID NO: 15053 - DNA, 15 bp, Artificial Sequence
  dgRNA
  Aasdhppt
ccctgaactaaaggt

SEQ ID NO: 15054 - DNA, 15 bp, Artificial Sequence
  dgRNA
  Kctd7
gatcgaggtcgtcag

SEQ ID NO: 15055 - DNA, 15 bp, Artificial Sequence
  dgRNA
  Kctd7
atcgaggtcgtcagt

SEQ ID NO: 15056 - DNA, 15 bp, Artificial Sequence
  dgRNA
  Kctd7
gcgatcacctcccct

SEQ ID NO: 15057 - DNA, 15 bp, Artificial Sequence
  dgRNA
  Kctd7
ccctcggccaaaccc

SEQ ID NO: 15058 - DNA, 15 bp, Artificial Sequence
  dgRNA
  Zfp950
gaaaaccttttgccc

SEQ ID NO: 15059 - DNA, 15 bp, Artificial Sequence
  dgRNA
  Zfp950
cacgctcttacccta

SEQ ID NO: 15060 - DNA, 15 bp, Artificial Sequence
  dgRNA
  Zfp950
acgctcttaccctaa

SEQ ID NO: 15061 - DNA, 15 bp, Artificial Sequence
  dgRNA
  Zfp950
ggaggaggattcatc

SEQ ID NO: 15062 - DNA, 15 bp, Artificial Sequence
  dgRNA
  Ipcef1
ctagttctctgagcg

SEQ ID NO: 15063 - DNA, 15 bp, Artificial Sequence
  dgRNA
  Ipcef1
tatcaacctgagaac

SEQ ID NO: 15064 - DNA, 15 bp, Artificial Sequence
  dgRNA
  Ipcef1
tttcaactacttatg

SEQ ID NO: 15065 - DNA, 15 bp, Artificial Sequence
  dgRNA
  Fam69a
caggcggatttgtgt

SEQ ID NO: 15066 - DNA, 15 bp, Artificial Sequence
  dgRNA
  Fam69a
gcggatttgtgtcgg

SEQ ID NO: 15067 - DNA, 15 bp, Artificial Sequence
  dgRNA
  Fam69a
gtgtcggcggacgcg

SEQ ID NO: 15068 - DNA, 15 bp, Artificial Sequence
  dgRNA
  Fam69a
ctcgactccccttta

SEQ ID NO: 15069 - DNA, 15 bp, Artificial Sequence
  dgRNA
  Nufip2
gttgcatagggtaag

SEQ ID NO: 15070 - DNA, 15 bp, Artificial Sequence
  dgRNA
  Nufip2
tagggtaagtggcgt

SEQ ID NO: 15071 - DNA, 15 bp, Artificial Sequence
  dgRNA
  Nufip2
taagtggcgttggcc

SEQ ID NO: 15072 - DNA, 15 bp, Artificial Sequence
  dgRNA
  Nufip2
gtggcgttggccagg

SEQ ID NO: 15073 - DNA, 15 bp, Artificial Sequence
  dgRNA
  Mroh1
gaagtaggtgtacct

SEQ ID NO: 15074 - DNA, 15 bp, Artificial Sequence
  dgRNA
  Mroh1
tacctaggcgctcca

SEQ ID NO: 15075 - DNA, 15 bp, Artificial Sequence
  dgRNA
  Mroh1
aggcgctccatggag

SEQ ID NO: 15076 - DNA, 15 bp, Artificial Sequence
  dgRNA
  Mroh1
ggcggagttaacgtg

SEQ ID NO: 15077 - DNA, 15 bp, Artificial Sequence
  dgRNA
  Olfr506
tatcgaacaaaattt

SEQ ID NO: 15078 - DNA, 15 bp, Artificial Sequence
  dgRNA
  Olfr506
tcaattcaaccatga

SEQ ID NO: 15079 - DNA, 15 bp, Artificial Sequence
  dgRNA
  Tfpt
cgtttacgacatttc

SEQ ID NO: 15080 - DNA, 15 bp, Artificial Sequence
  dgRNA
  Tfpt
cggaagccaagctac

SEQ ID NO: 15081 - DNA, 15 bp, Artificial Sequence
  dgRNA
  Tfpt
aagcggtgagtgtga

SEQ ID NO: 15082 - DNA, 15 bp, Artificial Sequence
  dgRNA
  Tfpt
gtgagaggatcgaag

SEQ ID NO: 15083 - DNA, 15 bp, Artificial Sequence
  dgRNA
  Cpa4
acatgaatctgcctc

SEQ ID NO: 15084 - DNA, 15 bp, Artificial Sequence
  dgRNA
  Cpa4
gggaatgtcttaccc

SEQ ID NO: 15085 - DNA, 15 bp, Artificial Sequence
  dgRNA
  Cpa4
acttgctccgcaggc

SEQ ID NO: 15086 - DNA, 15 bp, Artificial Sequence
  dgRNA
  Cpa4
aggaacttgctccgc

SEQ ID NO: 15087 - DNA, 15 bp, Artificial Sequence
  dgRNA
  Dnajc4
caagtgcctagcggg

SEQ ID NO: 15088 - DNA, 15 bp, Artificial Sequence
  dgRNA
  Dnajc4
tggtccagacttgga

SEQ ID NO: 15089 - DNA, 15 bp, Artificial Sequence
  dgRNA
  Dnajc4
agagcaccccttgtc

SEQ ID NO: 15090 - DNA, 15 bp, Artificial Sequence
  dgRNA
  Dnajc4
tggttcttagtaaag

SEQ ID NO: 15091 - DNA, 15 bp, Artificial Sequence
  dgRNA
  Elovl6
acaaaactatccccc

SEQ ID NO: 15092 - DNA, 15 bp, Artificial Sequence
  dgRNA
  Elovl6
caaaactatccccca

SEQ ID NO: 15093 - DNA, 15 bp, Artificial Sequence
  dgRNA
  Elovl6
tatcccccagggcga

SEQ ID NO: 15094 - DNA, 15 bp, Artificial Sequence
  dgRNA
  Elovl6
atcccccagggcgat

SEQ ID NO: 15095 - DNA, 15 bp, Artificial Sequence
  dgRNA
  Dok5
ctctaaacgacaggc

SEQ ID NO: 15096 - DNA, 15 bp, Artificial Sequence
  dgRNA
  Dok5
atgtctgctatgcgc

SEQ ID NO: 15097 - DNA, 15 bp, Artificial Sequence
  dgRNA
  Dok5
tgtctgctatgcgca

SEQ ID NO: 15098 - DNA, 15 bp, Artificial Sequence
  dgRNA
  Dok5
acgcgcagccgcccc

SEQ ID NO: 15099 - DNA, 15 bp, Artificial Sequence
  dgRNA
  Ccnd2
atcgtgtttgaagtt

SEQ ID NO: 15100 - DNA, 15 bp, Artificial Sequence
  dgRNA
  Ccnd2
ctccttaataacaag

SEQ ID NO: 15101 - DNA, 15 bp, Artificial Sequence
  dgRNA
  Ccnd2
ggggagggacgctag

SEQ ID NO: 15102 - DNA, 15 bp, Artificial Sequence
  dgRNA
  Ccnd2
gagggacgctagagg

SEQ ID NO: 15103 - DNA, 15 bp, Artificial Sequence
  dgRNA
  Gucy1b2
gcttatttaagcatg

SEQ ID NO: 15104 - DNA, 15 bp, Artificial Sequence
  dgRNA
  Gucy1b2
tgtttctcatcgcac

SEQ ID NO: 15105 - DNA, 15 bp, Artificial Sequence
  dgRNA
  Gucy1b2
aaggatctgcgcggg

SEQ ID NO: 15106 - DNA, 15 bp, Artificial Sequence
  dgRNA
  Gucy1b2
gggcaaggatctgcg

SEQ ID NO: 15107 - DNA, 15 bp, Artificial Sequence
  dgRNA
  Cbfb
cggcaacggctgagg

SEQ ID NO: 15108 - DNA, 15 bp, Artificial Sequence
  dgRNA
  Cbfb
ggcaacggctgaggc

SEQ ID NO: 15109 - DNA, 15 bp, Artificial Sequence
  dgRNA
  Cbfb
cgggcggcggtagcg

SEQ ID NO: 15110 - DNA, 15 bp, Artificial Sequence
  dgRNA
  Cbfb
gggcggcggtagcgt

SEQ ID NO: 15111 - DNA, 15 bp, Artificial Sequence
  dgRNA
  Dnmt3a
ggagcgcgacagcga

SEQ ID NO: 15112 - DNA, 15 bp, Artificial Sequence
  dgRNA
  Dnmt3a
gcgcgacagcgacgg

SEQ ID NO: 15113 - DNA, 15 bp, Artificial Sequence
  dgRNA
  Dnmt3a
cgcgacagcgacgga

SEQ ID NO: 15114 - DNA, 15 bp, Artificial Sequence
  dgRNA
  Dnmt3a
gacagcgacggaggg

SEQ ID NO: 15115 - DNA, 15 bp, Artificial Sequence
  dgRNA
  Hmgxb4
gccactaggcagggt

SEQ ID NO: 15116 - DNA, 15 bp, Artificial Sequence
  dgRNA
  Hmgxb4
ccctcacgtctgtaa

SEQ ID NO: 15117 - DNA, 15 bp, Artificial Sequence
  dgRNA
  Hmgxb4
ggcatcaaagtacac

SEQ ID NO: 15118 - DNA, 15 bp, Artificial Sequence
  dgRNA
  Hmgxb4
ttagctgattaggga

SEQ ID NO: 15119 - DNA, 15 bp, Artificial Sequence
  dgRNA
  Dnajb2
ctcctaagtcccacc

SEQ ID NO: 15120 - DNA, 15 bp, Artificial Sequence
  dgRNA
  Dnajb2
tcctaagtcccacct

SEQ ID NO: 15121 - DNA, 15 bp, Artificial Sequence
  dgRNA
  Dnajb2
gggaatgacgtcgcc

SEQ ID NO: 15122 - DNA, 15 bp, Artificial Sequence
  dgRNA
  Dnajb2
ggaatgacgtcgcct

SEQ ID NO: 15123 - DNA, 15 bp, Artificial Sequence
  dgRNA
  Nup214
gcacgcagcatccaa

SEQ ID NO: 15124 - DNA, 15 bp, Artificial Sequence
  dgRNA
  Nup214
aaggaaggcggactc

SEQ ID NO: 15125 - DNA, 15 bp, Artificial Sequence
  dgRNA
  Nup214
ccggcccgcgcctca

SEQ ID NO: 15126 - DNA, 15 bp, Artificial Sequence
  dgRNA
  Nup214
cccactgcgcggaac

SEQ ID NO: 15127 - DNA, 15 bp, Artificial Sequence
  dgRNA
  Mthfsd
tccagcggtgacctc

SEQ ID NO: 15128 - DNA, 15 bp, Artificial Sequence
  dgRNA
  Mthfsd
ggtcctctaatgcgt

SEQ ID NO: 15129 - DNA, 15 bp, Artificial Sequence
  dgRNA
  Mthfsd
cggtgctactactgc

SEQ ID NO: 15130 - DNA, 15 bp, Artificial Sequence
  dgRNA
  Mthfsd
cgtgcgcgaaccttg

SEQ ID NO: 15131 - DNA, 15 bp, Artificial Sequence
  dgRNA
  Syt2
gcgtgctgcgcaccg

SEQ ID NO: 15132 - DNA, 15 bp, Artificial Sequence
  dgRNA
  Syt2
tcccgcgccgcccgc

SEQ ID NO: 15133 - DNA, 15 bp, Artificial Sequence
  dgRNA
  Syt2
caagtcttgcggcaa

SEQ ID NO: 15134 - DNA, 15 bp, Artificial Sequence
  dgRNA
  Syt2
ggtgcgcagcacgct

SEQ ID NO: 15135 - DNA, 15 bp, Artificial Sequence
  dgRNA
  Gprasp1
gtaatcgcctgcttg

SEQ ID NO: 15136 - DNA, 15 bp, Artificial Sequence
  dgRNA
  Gprasp1
taatcgcctgcttgc

SEQ ID NO: 15137 - DNA, 15 bp, Artificial Sequence
  dgRNA
  Gprasp1
tgcgggtgcttggcg

SEQ ID NO: 15138 - DNA, 15 bp, Artificial Sequence
  dgRNA
  Gprasp1
cggttttccctagtt

SEQ ID NO: 15139 - DNA, 15 bp, Artificial Sequence
  dgRNA
  Tnfaip3
accgcgatttccaca

SEQ ID NO: 15140 - DNA, 15 bp, Artificial Sequence
  dgRNA
  Tnfaip3
cacatggatgtgacg

SEQ ID NO: 15141 - DNA, 15 bp, Artificial Sequence
  dgRNA
  Tnfaip3
tggatgtgacgtgga

SEQ ID NO: 15142 - DNA, 15 bp, Artificial Sequence
  dgRNA
  Tnfaip3
gcttccgaaatgccc

SEQ ID NO: 15143 - DNA, 15 bp, Artificial Sequence
  dgRNA
  Rps4x
ttgcgggcagttatc

SEQ ID NO: 15144 - DNA, 15 bp, Artificial Sequence
  dgRNA
  Rps4x
gttatctggtgcgat

SEQ ID NO: 15145 - DNA, 15 bp, Artificial Sequence
  dgRNA
  Rps4x
ctggtgcgattggtc

SEQ ID NO: 15146 - DNA, 15 bp, Artificial Sequence
  dgRNA
  Rps4x
tggtgcgattggtct

SEQ ID NO: 15147 - DNA, 15 bp, Artificial Sequence
  dgRNA
  Hpse
ggcctccgaggatct

SEQ ID NO: 15148 - DNA, 15 bp, Artificial Sequence
  dgRNA
  Hpse
cacctccgcaccctt

SEQ ID NO: 15149 - DNA, 15 bp, Artificial Sequence
  dgRNA
  Hpse
tccgcaccctttgga

SEQ ID NO: 15150 - DNA, 15 bp, Artificial Sequence
  dgRNA
  Hpse
ccgcaccctttggat

SEQ ID NO: 15151 - DNA, 15 bp, Artificial Sequence
  dgRNA
  Ksr1
cgggcggggccccga

SEQ ID NO: 15152 - DNA, 15 bp, Artificial Sequence
  dgRNA
  Ksr1
agcagatgcgatgcg

SEQ ID NO: 15153 - DNA, 15 bp, Artificial Sequence
  dgRNA
  Ksr1
tcccagaatgcgtcg

SEQ ID NO: 15154 - DNA, 15 bp, Artificial Sequence
  dgRNA
  Ksr1
gtcgcggccccgatc

SEQ ID NO: 15155 - DNA, 15 bp, Artificial Sequence
  dgRNA
  Fxyd2
aggtcccctaactgc

SEQ ID NO: 15156 - DNA, 15 bp, Artificial Sequence
  dgRNA
  Fxyd2
ggtcccctaactgca

SEQ ID NO: 15157 - DNA, 15 bp, Artificial Sequence
  dgRNA
  Fxyd2
tcccctaccctcacg

SEQ ID NO: 15158 - DNA, 15 bp, Artificial Sequence
  dgRNA
  Fxyd2
cccctaccctcacgt

SEQ ID NO: 15159 - DNA, 15 bp, Artificial Sequence
  dgRNA
  Tmem255a
gtggataactaggat

SEQ ID NO: 15160 - DNA, 15 bp, Artificial Sequence
  dgRNA
  Tmem255a
ataactaggatgggg

SEQ ID NO: 15161 - DNA, 15 bp, Artificial Sequence
  dgRNA
  Tmem255a
gcgcacgctgctgca

SEQ ID NO: 15162 - DNA, 15 bp, Artificial Sequence
  dgRNA
  Tmem255a
tgcctcccggagcag

SEQ ID NO: 15163 - DNA, 15 bp, Artificial Sequence
  dgRNA
  Far2
ggcgatgccatcctc

SEQ ID NO: 15164 - DNA, 15 bp, Artificial Sequence
  dgRNA
  Far2
gcgatgccatcctcg

SEQ ID NO: 15165 - DNA, 15 bp, Artificial Sequence
  dgRNA
  Far2
gggcctgtgcgtccg

SEQ ID NO: 15166 - DNA, 15 bp, Artificial Sequence
  dgRNA
  Far2
gtgcgtccgaggccc

SEQ ID NO: 15167 - DNA, 15 bp, Artificial Sequence
  dgRNA
  Spock3
cccaaggccttatgg

SEQ ID NO: 15168 - DNA, 15 bp, Artificial Sequence
  dgRNA
  Spock3
ccaccataaggcctt

SEQ ID NO: 15169 - DNA, 15 bp, Artificial Sequence
  dgRNA
  Spock3
accaccataaggcct

SEQ ID NO: 15170 - DNA, 15 bp, Artificial Sequence
  dgRNA
  Spock3
ctaaagaccaccata

SEQ ID NO: 15171 - DNA, 15 bp, Artificial Sequence
  dgRNA
  Olfr389
atcagtgaccatcaa

SEQ ID NO: 15172 - DNA, 15 bp, Artificial Sequence
  dgRNA
  Olfr389
aacggctcccatctc

SEQ ID NO: 15173 - DNA, 15 bp, Artificial Sequence
  dgRNA
  Olfr389
acggctcccatctca

SEQ ID NO: 15174 - DNA, 15 bp, Artificial Sequence
  dgRNA
  Olfr389
gttctatataggtct

SEQ ID NO: 15175 - DNA, 15 bp, Artificial Sequence
  dgRNA
  Tlr6
gcaaagatttataga

SEQ ID NO: 15176 - DNA, 15 bp, Artificial Sequence
  dgRNA
  Tlr6
agggttttatacacg

SEQ ID NO: 15177 - DNA, 15 bp, Artificial Sequence
  dgRNA
  Tlr6
cactcctaagtaccg

SEQ ID NO: 15178 - DNA, 15 bp, Artificial Sequence
  dgRNA
  Tlr6
agtaccgtggttccc

SEQ ID NO: 15179 - DNA, 15 bp, Artificial Sequence
  dgRNA
  Pdxdc1
cgatagtattttacc

SEQ ID NO: 15180 - DNA, 15 bp, Artificial Sequence
  dgRNA
  Pdxdc1
tagtattttacctgg

SEQ ID NO: 15181 - DNA, 15 bp, Artificial Sequence
  dgRNA
  Pdxdc1
gatatctcattgcga

SEQ ID NO: 15182 - DNA, 15 bp, Artificial Sequence
  dgRNA
  Pdxdc1
tgcgacggtcgtcac

SEQ ID NO: 15183 - DNA, 15 bp, Artificial Sequence
  dgRNA
  Taf9b
cagctggcttacgag

SEQ ID NO: 15184 - DNA, 15 bp, Artificial Sequence
  dgRNA
  Taf9b
agctggcttacgagt

SEQ ID NO: 15185 - DNA, 15 bp, Artificial Sequence
  dgRNA
  Taf9b
gctggcttacgagtg

SEQ ID NO: 15186 - DNA, 15 bp, Artificial Sequence
  dgRNA
  Taf9b
ggggaaaagacgcta

SEQ ID NO: 15187 - DNA, 15 bp, Artificial Sequence
  dgRNA
  Tnfrsf9
agttacttctgctac

SEQ ID NO: 15188 - DNA, 15 bp, Artificial Sequence
  dgRNA
  Tnfrsf9
cataagttctgggcc

SEQ ID NO: 15189 - DNA, 15 bp, Artificial Sequence
  dgRNA
  Tnfrsf9
taatggtccctttgt

SEQ ID NO: 15190 - DNA, 15 bp, Artificial Sequence
  dgRNA
  Tnfrsf9
gcgggccggtgggtg

SEQ ID NO: 15191 - DNA, 15 bp, Artificial Sequence
  dgRNA
  Ppp1r26
gattgaccaggtagc

SEQ ID NO: 15192 - DNA, 15 bp, Artificial Sequence
  dgRNA
  Ppp1r26
ggggctttaaactgg

SEQ ID NO: 15193 - DNA, 15 bp, Artificial Sequence
  dgRNA
  Ppp1r26
attggggctttaaac

SEQ ID NO: 15194 - DNA, 15 bp, Artificial Sequence
  dgRNA
  Ppp1r26
gttggtccagctacc

SEQ ID NO: 15195 - DNA, 15 bp, Artificial Sequence
  dgRNA
  Hs2st1
gtaaatcgaaccgaa

SEQ ID NO: 15196 - DNA, 15 bp, Artificial Sequence
  dgRNA
  Hs2st1
taaatcgaaccgaaa

SEQ ID NO: 15197 - DNA, 15 bp, Artificial Sequence
  dgRNA
  Hs2st1
cgaaagggcgagaag

SEQ ID NO: 15198 - DNA, 15 bp, Artificial Sequence
  dgRNA
  Hs2st1
gaagcggcctctctt

SEQ ID NO: 15199 - DNA, 15 bp, Artificial Sequence
  dgRNA
  Olfr665
ttaggagtgtacagg

SEQ ID NO: 15200 - DNA, 15 bp, Artificial Sequence
  dgRNA
  Olfr665
gtcacactctatgct

SEQ ID NO: 15201 - DNA, 15 bp, Artificial Sequence
  dgRNA
  Phospho1
cgcacccacgctcct

SEQ ID NO: 15202 - DNA, 15 bp, Artificial Sequence
  dgRNA
  Phospho1
cccacgctcctcgga

SEQ ID NO: 15203 - DNA, 15 bp, Artificial Sequence
  dgRNA
  Phospho1
ccacgctcctcggac

SEQ ID NO: 15204 - DNA, 15 bp, Artificial Sequence
  dgRNA
  Phospho1
gcccgcccagtctca

SEQ ID NO: 15205 - DNA, 15 bp, Artificial Sequence
  dgRNA
  Nccrp1
aactccttaaggagg

SEQ ID NO: 15206 - DNA, 15 bp, Artificial Sequence
  dgRNA
  Nccrp1
cttgacattagcccc

SEQ ID NO: 15207 - DNA, 15 bp, Artificial Sequence
  dgRNA
  Nccrp1
ttagccccaggggtc

SEQ ID NO: 15208 - DNA, 15 bp, Artificial Sequence
  dgRNA
  Nccrp1
ggcgaggtcctcagc

SEQ ID NO: 15209 - DNA, 15 bp, Artificial Sequence
  dgRNA
  Nfatc2
cctaggaatcgggaa

SEQ ID NO: 15210 - DNA, 15 bp, Artificial Sequence
  dgRNA
  Nfatc2
agcgagtggtcccta

SEQ ID NO: 15211 - DNA, 15 bp, Artificial Sequence
  dgRNA
  Nfatc2
taaggtagagctcgc

SEQ ID NO: 15212 - DNA, 15 bp, Artificial Sequence
  dgRNA
  Nfatc2
cttctgaccggaccc

SEQ ID NO: 15213 - DNA, 15 bp, Artificial Sequence
  dgRNA
  Samt3
tactgtaatatctga

SEQ ID NO: 15214 - DNA, 15 bp, Artificial Sequence
  dgRNA
  Samt3
actacaagggcataa

SEQ ID NO: 15215 - DNA, 15 bp, Artificial Sequence
  dgRNA
  Cacna1f
accttaatctctcta

SEQ ID NO: 15216 - DNA, 15 bp, Artificial Sequence
  dgRNA
  Cacna1f
taatctctctaaggc

SEQ ID NO: 15217 - DNA, 15 bp, Artificial Sequence
  dgRNA
  Cacna1f
atatctgcaccaagc

SEQ ID NO: 15218 - DNA, 15 bp, Artificial Sequence
  dgRNA
  Cacna1f
acagggggagcaaat

SEQ ID NO: 15219 - DNA, 15 bp, Artificial Sequence
  dgRNA
  Etfa
aagctgcgtacaaca

SEQ ID NO: 15220 - DNA, 15 bp, Artificial Sequence
  dgRNA
  Etfa
aagtccgagaccgtc

SEQ ID NO: 15221 - DNA, 15 bp, Artificial Sequence
  dgRNA
  Etfa
agtccgagaccgtca

SEQ ID NO: 15222 - DNA, 15 bp, Artificial Sequence
  dgRNA
  Etfa
cgcatgccagcgtct

SEQ ID NO: 15223 - DNA, 15 bp, Artificial Sequence
  dgRNA
  Cap1
gctccttattggtct

SEQ ID NO: 15224 - DNA, 15 bp, Artificial Sequence
  dgRNA
  Cap1
tattggtctgggcct

SEQ ID NO: 15225 - DNA, 15 bp, Artificial Sequence
  dgRNA
  Cap1
attggtctgggcctc

SEQ ID NO: 15226 - DNA, 15 bp, Artificial Sequence
  dgRNA
  Cap1
ttggtctgggcctcg

SEQ ID NO: 15227 - DNA, 15 bp, Artificial Sequence
  dgRNA
  Adamts8
tcttatgtcaaagcc

SEQ ID NO: 15228 - DNA, 15 bp, Artificial Sequence
  dgRNA
  Adamts8
atgtcaaagccggga

SEQ ID NO: 15229 - DNA, 15 bp, Artificial Sequence
  dgRNA
  Adamts8
gaagtataaatacga

SEQ ID NO: 15230 - DNA, 15 bp, Artificial Sequence
  dgRNA
  Adamts8
aagtataaatacgaa

SEQ ID NO: 15231 - DNA, 15 bp, Artificial Sequence
  dgRNA
  Sox4
gattattattgcatc

SEQ ID NO: 15232 - DNA, 15 bp, Artificial Sequence
  dgRNA
  Sox4
cgggttccaagccaa

SEQ ID NO: 15233 - DNA, 15 bp, Artificial Sequence
  dgRNA
  Sox4
gggttccaagccaat

SEQ ID NO: 15234 - DNA, 15 bp, Artificial Sequence
  dgRNA
  Sox4
aagcgttagttacag

SEQ ID NO: 15235 - DNA, 15 bp, Artificial Sequence
  dgRNA
  Kcns2
cctacagacccggcg

SEQ ID NO: 15236 - DNA, 15 bp, Artificial Sequence
  dgRNA
  Kcns2
ctacagacccggcga

SEQ ID NO: 15237 - DNA, 15 bp, Artificial Sequence
  dgRNA
  Kcns2
cagacccggcgaggg

SEQ ID NO: 15238 - DNA, 15 bp, Artificial Sequence
  dgRNA
  Kcns2
aataacagctgtccc

SEQ ID NO: 15239 - DNA, 15 bp, Artificial Sequence
  dgRNA
  Dnajc1
acagataggcgttct

SEQ ID NO: 15240 - DNA, 15 bp, Artificial Sequence
  dgRNA
  Dnajc1
aggcgttcttggccc

SEQ ID NO: 15241 - DNA, 15 bp, Artificial Sequence
  dgRNA
  Dnajc1
cgttcttggcccagg

SEQ ID NO: 15242 - DNA, 15 bp, Artificial Sequence
  dgRNA
  Dnajc1
agaacgcctatctgt

SEQ ID NO: 15243 - DNA, 15 bp, Artificial Sequence
  dgRNA
  Hdac1
cgatggtacggcccc

SEQ ID NO: 15244 - DNA, 15 bp, Artificial Sequence
  dgRNA
  Hdac1
ctccgcgccggactt

SEQ ID NO: 15245 - DNA, 15 bp, Artificial Sequence
  dgRNA
  Hdac1
gccggactttggtac

SEQ ID NO: 15246 - DNA, 15 bp, Artificial Sequence
  dgRNA
  Hdac1
ctttggtacaggccc

SEQ ID NO: 15247 - DNA, 15 bp, Artificial Sequence
  dgRNA
  Dpysl3
ccgaggagttacagc

SEQ ID NO: 15248 - DNA, 15 bp, Artificial Sequence
  dgRNA
  Dpysl3
gggcggtcccggtcc

SEQ ID NO: 15249 - DNA, 15 bp, Artificial Sequence
  dgRNA
  Dpysl3
ggcggtcccggtccc

SEQ ID NO: 15250 - DNA, 15 bp, Artificial Sequence
  dgRNA
  Dpysl3
gcggtcccggtcccg

SEQ ID NO: 15251 - DNA, 15 bp, Artificial Sequence
  dgRNA
  Cstf2
cttatgacgtcgtct

SEQ ID NO: 15252 - DNA, 15 bp, Artificial Sequence
  dgRNA
  Cstf2
ttatgacgtcgtctc

SEQ ID NO: 15253 - DNA, 15 bp, Artificial Sequence
  dgRNA
  Cstf2
acgtcgtctcgggcc

SEQ ID NO: 15254 - DNA, 15 bp, Artificial Sequence
  dgRNA
  Cstf2
gttgcccctcccccg

SEQ ID NO: 15255 - DNA, 15 bp, Artificial Sequence
  dgRNA
  Zdhhc9
ttgtagcaaggagat

SEQ ID NO: 15256 - DNA, 15 bp, Artificial Sequence
  dgRNA
  Zdhhc9
tgggcggagggattc

SEQ ID NO: 15257 - DNA, 15 bp, Artificial Sequence
  dgRNA
  Zdhhc9
gttcgaagtagccaa

SEQ ID NO: 15258 - DNA, 15 bp, Artificial Sequence
  dgRNA
  Zdhhc9
aatggtagtacgcgt

SEQ ID NO: 15259 - DNA, 15 bp, Artificial Sequence
  dgRNA
  Tceal1
aaaggtaagaatccc

SEQ ID NO: 15260 - DNA, 15 bp, Artificial Sequence
  dgRNA
  Tceal1
aaggtaagaatcccg

SEQ ID NO: 15261 - DNA, 15 bp, Artificial Sequence
  dgRNA
  Tceal1
gaggtaaggcgattc

SEQ ID NO: 15262 - DNA, 15 bp, Artificial Sequence
  dgRNA
  Tceal1
gattctggcaagtgc

SEQ ID NO: 15263 - DNA, 15 bp, Artificial Sequence
  dgRNA
  Nsun6
ttgggcacgaacaga

SEQ ID NO: 15264 - DNA, 15 bp, Artificial Sequence
  dgRNA
  Nsun6
cacgaacagaaggct

SEQ ID NO: 15265 - DNA, 15 bp, Artificial Sequence
  dgRNA
  Nsun6
ctgggcatcgagtgc

SEQ ID NO: 15266 - DNA, 15 bp, Artificial Sequence
  dgRNA
  Nsun6
ggaagtgacgaaccc

SEQ ID NO: 15267 - DNA, 15 bp, Artificial Sequence
  dgRNA
  Prss54
ctcagaatccagcgc

SEQ ID NO: 15268 - DNA, 15 bp, Artificial Sequence
  dgRNA
  Prss54
tcagaatccagcgct

SEQ ID NO: 15269 - DNA, 15 bp, Artificial Sequence
  dgRNA
  Prss54
cagaatccagcgctg

SEQ ID NO: 15270 - DNA, 15 bp, Artificial Sequence
  dgRNA
  Prss54
cgctggggatgtgac

SEQ ID NO: 15271 - DNA, 15 bp, Artificial Sequence
  dgRNA
  Churc1
tgcaccctccttacc

SEQ ID NO: 15272 - DNA, 15 bp, Artificial Sequence
  dgRNA
  Churc1
taacaaccgttgcta

SEQ ID NO: 15273 - DNA, 15 bp, Artificial Sequence
  dgRNA
  Churc1
aacaaccgttgctat

SEQ ID NO: 15274 - DNA, 15 bp, Artificial Sequence
  dgRNA
  Churc1
aaccgttgctatggg

SEQ ID NO: 15275 - DNA, 15 bp, Artificial Sequence
  dgRNA
  Ppil6
tcttaggtccttcgg

SEQ ID NO: 15276 - DNA, 15 bp, Artificial Sequence
  dgRNA
  Ppil6
cttaggtccttcggt

SEQ ID NO: 15277 - DNA, 15 bp, Artificial Sequence
  dgRNA
  Ppil6
gggttctccgcaccg

SEQ ID NO: 15278 - DNA, 15 bp, Artificial Sequence
  dgRNA
  Ppil6
cgcaccgcggcctac

SEQ ID NO: 15279 - DNA, 15 bp, Artificial Sequence
  dgRNA
  Bap1
gaggcgagcgtgctg

SEQ ID NO: 15280 - DNA, 15 bp, Artificial Sequence
  dgRNA
  Bap1
aggcgagcgtgctga

SEQ ID NO: 15281 - DNA, 15 bp, Artificial Sequence
  dgRNA
  Bap1
ggcgagcgtgctgag

SEQ ID NO: 15282 - DNA, 15 bp, Artificial Sequence
  dgRNA
  Bap1
gcgagcgtgctgagg

SEQ ID NO: 15283 - DNA, 15 bp, Artificial Sequence
  dgRNA
  Csf1
accaggcggcccgct

SEQ ID NO: 15284 - DNA, 15 bp, Artificial Sequence
  dgRNA
  Csf1
ccaggcggcccgctt

SEQ ID NO: 15285 - DNA, 15 bp, Artificial Sequence
  dgRNA
  Csf1
caggcggcccgcttg

SEQ ID NO: 15286 - DNA, 15 bp, Artificial Sequence
  dgRNA
  Csf1
aggcggcccgcttgg

SEQ ID NO: 15287 - DNA, 15 bp, Artificial Sequence
  dgRNA
  Elp4
aatcaagaatgccga

SEQ ID NO: 15288 - DNA, 15 bp, Artificial Sequence
  dgRNA
  Elp4
aagaatgccgaagga

SEQ ID NO: 15289 - DNA, 15 bp, Artificial Sequence
  dgRNA
  Elp4
gacggtacccacctg

SEQ ID NO: 15290 - DNA, 15 bp, Artificial Sequence
  dgRNA
  Elp4
ggactcagacggacc

SEQ ID NO: 15291 - DNA, 15 bp, Artificial Sequence
  dgRNA
  Setbp1
gaatgtgattactcc

SEQ ID NO: 15292 - DNA, 15 bp, Artificial Sequence
  dgRNA
  Setbp1
ggactcctcgggctc

SEQ ID NO: 15293 - DNA, 15 bp, Artificial Sequence
  dgRNA
  Setbp1
tctctctccgtaaat

SEQ ID NO: 15294 - DNA, 15 bp, Artificial Sequence
  dgRNA
  Setbp1
ctctccgtaaatcgg

SEQ ID NO: 15295 - DNA, 15 bp, Artificial Sequence
  dgRNA
  Hsd3b3
gagttgatagtttat

SEQ ID NO: 15296 - DNA, 15 bp, Artificial Sequence
  dgRNA
  Hsd3b3
tttattggtacctat

SEQ ID NO: 15297 - DNA, 15 bp, Artificial Sequence
  dgRNA
  Hsd3b3
cctattggaatacgt

SEQ ID NO: 15298 - DNA, 15 bp, Artificial Sequence
  dgRNA
  Hsd3b3
cgttggtgtgtgatg

SEQ ID NO: 15299 - DNA, 15 bp, Artificial Sequence
  dgRNA
  Nsun7
ctaccagttcccact

SEQ ID NO: 15300 - DNA, 15 bp, Artificial Sequence
  dgRNA
  Nsun7
cccctcccgttgcca

SEQ ID NO: 15301 - DNA, 15 bp, Artificial Sequence
  dgRNA
  Nsun7
gatccgggcaccctg

SEQ ID NO: 15302 - DNA, 15 bp, Artificial Sequence
  dgRNA
  Nsun7
atccgggcaccctga

SEQ ID NO: 15303 - DNA, 15 bp, Artificial Sequence
  dgRNA
  Slc10a5
tagatagttttatac

SEQ ID NO: 15304 - DNA, 15 bp, Artificial Sequence
  dgRNA
  Slc10a5
acccttgtatttaac

SEQ ID NO: 15305 - DNA, 15 bp, Artificial Sequence
  dgRNA
  Slc10a5
ggttggtcaaagtcc

SEQ ID NO: 15306 - DNA, 15 bp, Artificial Sequence
  dgRNA
  Slc10a5
ggtaacagctgggtt

SEQ ID NO: 15307 - DNA, 15 bp, Artificial Sequence
  dgRNA
  Mab21l1
ttcaacctgtctagg

SEQ ID NO: 15308 - DNA, 15 bp, Artificial Sequence
  dgRNA
  Mab21l1
gcagtttcctacctt

SEQ ID NO: 15309 - DNA, 15 bp, Artificial Sequence
  dgRNA
  Mab21l1
atgcttctatccacg

SEQ ID NO: 15310 - DNA, 15 bp, Artificial Sequence
  dgRNA
  Mab21l1
tgcttctatccacga

SEQ ID NO: 15311 - DNA, 15 bp, Artificial Sequence
  dgRNA
  Rhox7a
aggaggtctccctat

SEQ ID NO: 15312 - DNA, 15 bp, Artificial Sequence
  dgRNA
  Rhox7a
gaggaggtctcccta

SEQ ID NO: 15313 - DNA, 15 bp, Artificial Sequence
  dgRNA
  Vezt
aaaaatccgcgctcc

SEQ ID NO: 15314 - DNA, 15 bp, Artificial Sequence
  dgRNA
  Vezt
cgccccctagtagtc

SEQ ID NO: 15315 - DNA, 15 bp, Artificial Sequence
  dgRNA
  Vezt
gccccctagtagtca

SEQ ID NO: 15316 - DNA, 15 bp, Artificial Sequence
  dgRNA
  Vezt
ctccaataggagctc

SEQ ID NO: 15317 - DNA, 15 bp, Artificial Sequence
  dgRNA
  Zcchc12
aagagtcacaatcgc

SEQ ID NO: 15318 - DNA, 15 bp, Artificial Sequence
  dgRNA
  Zcchc12
gagtcacaatcgcag

SEQ ID NO: 15319 - DNA, 15 bp, Artificial Sequence
  dgRNA
  Zcchc12
ctcgcccagcaccac

SEQ ID NO: 15320 - DNA, 15 bp, Artificial Sequence
  dgRNA
  Zcchc12
cccacccgaaccctt

SEQ ID NO: 15321 - DNA, 15 bp, Artificial Sequence
  dgRNA
  Dsg2
cagccttgcgacccc

SEQ ID NO: 15322 - DNA, 15 bp, Artificial Sequence
  dgRNA
  Dsg2
cgctccttagatctt

SEQ ID NO: 15323 - DNA, 15 bp, Artificial Sequence
  dgRNA
  Dsg2
aaggctctccaatcg

SEQ ID NO: 15324 - DNA, 15 bp, Artificial Sequence
  dgRNA
  Dsg2
tcgaggtgatcccag

SEQ ID NO: 15325 - DNA, 15 bp, Artificial Sequence
  dgRNA
  Dpy30
ttccaggtgccacga

SEQ ID NO: 15326 - DNA, 15 bp, Artificial Sequence
  dgRNA
  Dpy30
agaaagatctacggc

SEQ ID NO: 15327 - DNA, 15 bp, Artificial Sequence
  dgRNA
  Dpy30
gaaagatctacggca

SEQ ID NO: 15328 - DNA, 15 bp, Artificial Sequence
  dgRNA
  Dpy30
agatctacggcaggg

SEQ ID NO: 15329 - DNA, 15 bp, Artificial Sequence
  dgRNA
  Hnrnpr
tgcatgcccccgccc

SEQ ID NO: 15330 - DNA, 15 bp, Artificial Sequence
  dgRNA
  Hnrnpr
atgcccccgccccgg

SEQ ID NO: 15331 - DNA, 15 bp, Artificial Sequence
  dgRNA
  Hnrnpr
aggcgccgcagccag

SEQ ID NO: 15332 - DNA, 15 bp, Artificial Sequence
  dgRNA
  Hnrnpr
gctgagacccctcat

SEQ ID NO: 15333 - DNA, 15 bp, Artificial Sequence
  dgRNA
  Gpatch4
ggggacccgaaacag

SEQ ID NO: 15334 - DNA, 15 bp, Artificial Sequence
  dgRNA
  Gpatch4
cccgaaacagaggtt

SEQ ID NO: 15335 - DNA, 15 bp, Artificial Sequence
  dgRNA
  Gpatch4
ccgaaacagaggtta

SEQ ID NO: 15336 - DNA, 15 bp, Artificial Sequence
  dgRNA
  Gpatch4
gttagggcggcgcat

SEQ ID NO: 15337 - DNA, 15 bp, Artificial Sequence
  dgRNA
  Tmem203
cggcaacctagccgc

SEQ ID NO: 15338 - DNA, 15 bp, Artificial Sequence
  dgRNA
  Tmem203
cctagccgccggcgc

SEQ ID NO: 15339 - DNA, 15 bp, Artificial Sequence
  dgRNA
  Tmem203
ctagccgccggcgcc

SEQ ID NO: 15340 - DNA, 15 bp, Artificial Sequence
  dgRNA
  Tmem203
cggcgccgggcctca

SEQ ID NO: 15341 - DNA, 15 bp, Artificial Sequence
  dgRNA
  Slc35g3
ggtatttacactcat

SEQ ID NO: 15342 - DNA, 15 bp, Artificial Sequence
  dgRNA
  Slc35g3
gctttactatgaggt

SEQ ID NO: 15343 - DNA, 15 bp, Artificial Sequence
  dgRNA
  Slc35g3
ctttactatgaggtg

SEQ ID NO: 15344 - DNA, 15 bp, Artificial Sequence
  dgRNA
  Vps18
gttactggacgccgc

SEQ ID NO: 15345 - DNA, 15 bp, Artificial Sequence
  dgRNA
  Vps18
ttactggacgccgct

SEQ ID NO: 15346 - DNA, 15 bp, Artificial Sequence
  dgRNA
  Vps18
gccgctgggaaatcc

SEQ ID NO: 15347 - DNA, 15 bp, Artificial Sequence
  dgRNA
  Vps18
ccgctgggaaatccc

SEQ ID NO: 15348 - DNA, 15 bp, Artificial Sequence
  dgRNA
  Daam2
cctgctgtgtaccgg

SEQ ID NO: 15349 - DNA, 15 bp, Artificial Sequence
  dgRNA
  Daam2
ccaagttgctgccat

SEQ ID NO: 15350 - DNA, 15 bp, Artificial Sequence
  dgRNA
  Daam2
atcggatcagcacct

SEQ ID NO: 15351 - DNA, 15 bp, Artificial Sequence
  dgRNA
  Daam2
tcggatcagcaccta

SEQ ID NO: 15352 - DNA, 15 bp, Artificial Sequence
  dgRNA
  Slamf8
agcacgtgtgccatg

SEQ ID NO: 15353 - DNA, 15 bp, Artificial Sequence
  dgRNA
  Slamf8
gcacgtgtgccatgt

SEQ ID NO: 15354 - DNA, 15 bp, Artificial Sequence
  dgRNA
  Slamf8
ctgacttacaagaac

SEQ ID NO: 15355 - DNA, 15 bp, Artificial Sequence
  dgRNA
  Slamf8
aacttccactttacc

SEQ ID NO: 15356 - DNA, 15 bp, Artificial Sequence
  dgRNA
  Olfr1062
aacatcagagtacta

SEQ ID NO: 15357 - DNA, 15 bp, Artificial Sequence
  dgRNA
  Sacs
agtgatccacaacac

SEQ ID NO: 15358 - DNA, 15 bp, Artificial Sequence
  dgRNA
  Sacs
gtaaaaagtcacgat

SEQ ID NO: 15359 - DNA, 15 bp, Artificial Sequence
  dgRNA
  Sacs
ggtaaaaagtcacga

SEQ ID NO: 15360 - DNA, 15 bp, Artificial Sequence
  dgRNA
  Lrrc20
aagcggttcctccct

SEQ ID NO: 15361 - DNA, 15 bp, Artificial Sequence
  dgRNA
  Lrrc20
tcccgagcgcgcagg

SEQ ID NO: 15362 - DNA, 15 bp, Artificial Sequence
  dgRNA
  Lrrc20
gagttgcgcgctgat

SEQ ID NO: 15363 - DNA, 15 bp, Artificial Sequence
  dgRNA
  Lrrc20
gctgattggtgcgcg

SEQ ID NO: 15364 - DNA, 15 bp, Artificial Sequence
  dgRNA
  Reep3
ctctcaccgcccgcc

SEQ ID NO: 15365 - DNA, 15 bp, Artificial Sequence
  dgRNA
  Reep3
ccgcccggagtcccc

SEQ ID NO: 15366 - DNA, 15 bp, Artificial Sequence
  dgRNA
  Reep3
cggagtcccccggcc

SEQ ID NO: 15367 - DNA, 15 bp, Artificial Sequence
  dgRNA
  Reep3
ggagtcccccggccc

SEQ ID NO: 15368 - DNA, 15 bp, Artificial Sequence
  dgRNA
  Bpifb9a
ggtcgagtactcttc

SEQ ID NO: 15369 - DNA, 15 bp, Artificial Sequence
  dgRNA
  Bpifb9a
caacacatctacctc

SEQ ID NO: 15370 - DNA, 15 bp, Artificial Sequence
  dgRNA
  Bpifb9a
catgacctttcaagg

SEQ ID NO: 15371 - DNA, 15 bp, Artificial Sequence
  dgRNA
  Bpifb9a
aggggacacatgttc

SEQ ID NO: 15372 - DNA, 15 bp, Artificial Sequence
  dgRNA
  Irak1
ctcggttctcccatt

SEQ ID NO: 15373 - DNA, 15 bp, Artificial Sequence
  dgRNA
  Irak1
tcggttctcccatta

SEQ ID NO: 15374 - DNA, 15 bp, Artificial Sequence
  dgRNA
  Irak1
tccttccccgcgtca

SEQ ID NO: 15375 - DNA, 15 bp, Artificial Sequence
  dgRNA
  Irak1
ccttccccgcgtcaa

SEQ ID NO: 15376 - DNA, 15 bp, Artificial Sequence
  dgRNA
  Stx16
cttgtggatccgagc

SEQ ID NO: 15377 - DNA, 15 bp, Artificial Sequence
  dgRNA
  Stx16
ttgtggatccgagct

SEQ ID NO: 15378 - DNA, 15 bp, Artificial Sequence
  dgRNA
  Stx16
gatccgagctgggat

SEQ ID NO: 15379 - DNA, 15 bp, Artificial Sequence
  dgRNA
  Stx16
atccgagctgggatt

SEQ ID NO: 15380 - DNA, 15 bp, Artificial Sequence
  dgRNA
  St3gal4
gcgccctccctctct

SEQ ID NO: 15381 - DNA, 15 bp, Artificial Sequence
  dgRNA
  St3gal4
gccctccctccagcg

SEQ ID NO: 15382 - DNA, 15 bp, Artificial Sequence
  dgRNA
  St3gal4
ggcgttcgcggctgt

SEQ ID NO: 15383 - DNA, 15 bp, Artificial Sequence
  dgRNA
  St3gal4
gtgcgcaagcgtgtc

SEQ ID NO: 15384 - DNA, 15 bp, Artificial Sequence
  dgRNA
  Gpsm3
tgcgaggaatgcatc

SEQ ID NO: 15385 - DNA, 15 bp, Artificial Sequence
  dgRNA
  Gpsm3
gcgaggaatgcatcc

SEQ ID NO: 15386 - DNA, 15 bp, Artificial Sequence
  dgRNA
  Gpsm3
cgaggaatgcatccg

SEQ ID NO: 15387 - DNA, 15 bp, Artificial Sequence
  dgRNA
  Gpsm3
ggtcaaatcctaatc

SEQ ID NO: 15388 - DNA, 15 bp, Artificial Sequence
  dgRNA
  Susd6
tccccccgccgccag

SEQ ID NO: 15389 - DNA, 15 bp, Artificial Sequence
  dgRNA
  Susd6
ggggcgtgtcagaca

SEQ ID NO: 15390 - DNA, 15 bp, Artificial Sequence
  dgRNA
  Susd6
gtgcgcgtgactcct

SEQ ID NO: 15391 - DNA, 15 bp, Artificial Sequence
  dgRNA
  Susd6
tgcgcgtgactcctc

SEQ ID NO: 15392 - DNA, 15 bp, Artificial Sequence
  dgRNA
  Cir1
gagacctcgcttgtt

SEQ ID NO: 15393 - DNA, 15 bp, Artificial Sequence
  dgRNA
  Cir1
agacctcgcttgttc

SEQ ID NO: 15394 - DNA, 15 bp, Artificial Sequence
  dgRNA
  Cir1
cgggctgaccgcgct

SEQ ID NO: 15395 - DNA, 15 bp, Artificial Sequence
  dgRNA
  Cir1
gcgagcatcgcgcac

SEQ ID NO: 15396 - DNA, 15 bp, Artificial Sequence
  dgRNA
  Clec5a
aaagtttcccctgaa

SEQ ID NO: 15397 - DNA, 15 bp, Artificial Sequence
  dgRNA
  Clec5a
ttgtagcatgggatt

SEQ ID NO: 15398 - DNA, 15 bp, Artificial Sequence
  dgRNA
  Clec5a
ggaaggttcctttca

SEQ ID NO: 15399 - DNA, 15 bp, Artificial Sequence
  dgRNA
  Clec5a
tcttgtcaaaggagc

SEQ ID NO: 15400 - DNA, 15 bp, Artificial Sequence
  dgRNA
  Urb1
gagacacgccccaga

SEQ ID NO: 15401 - DNA, 15 bp, Artificial Sequence
  dgRNA
  Urb1
cacgcccccttcagc

SEQ ID NO: 15402 - DNA, 15 bp, Artificial Sequence
  dgRNA
  Urb1
ttctcacccgaagac

SEQ ID NO: 15403 - DNA, 15 bp, Artificial Sequence
  dgRNA
  Urb1
gaccggctcttttac

SEQ ID NO: 15404 - DNA, 15 bp, Artificial Sequence
  dgRNA
  Olfr1384
aacttaatttagctc

SEQ ID NO: 15405 - DNA, 15 bp, Artificial Sequence
  dgRNA
  Olfr1384
acaggttttgtaggc

SEQ ID NO: 15406 - DNA, 15 bp, Artificial Sequence
  dgRNA
  Tnfrsf18
cttcttaacgaggca

SEQ ID NO: 15407 - DNA, 15 bp, Artificial Sequence
  dgRNA
  Tnfrsf18
ctggactcctctcgc

SEQ ID NO: 15408 - DNA, 15 bp, Artificial Sequence
  dgRNA
  Tnfrsf18
ataaggggtgcccac

SEQ ID NO: 15409 - DNA, 15 bp, Artificial Sequence
  dgRNA
  Tnfrsf18
gtggcacatgtgaat

SEQ ID NO: 15410 - DNA, 15 bp, Artificial Sequence
  dgRNA
  Ltbp4
gagaactcaccgccc

SEQ ID NO: 15411 - DNA, 15 bp, Artificial Sequence
  dgRNA
  Ltbp4
atgtcgcttaccgat

SEQ ID NO: 15412 - DNA, 15 bp, Artificial Sequence
  dgRNA
  Ltbp4
ccgattggcctcact

SEQ ID NO: 15413 - DNA, 15 bp, Artificial Sequence
  dgRNA
  Ltbp4
gagcgctgacagtgc

SEQ ID NO: 15414 - DNA, 15 bp, Artificial Sequence
  dgRNA
  Prrt3
cgggctgtagctaga

SEQ ID NO: 15415 - DNA, 15 bp, Artificial Sequence
  dgRNA
  Prrt3
agagaccgttcccaa

SEQ ID NO: 15416 - DNA, 15 bp, Artificial Sequence
  dgRNA
  Prrt3
ccgttcccaaaggaa

SEQ ID NO: 15417 - DNA, 15 bp, Artificial Sequence
  dgRNA
  Prrt3
tatcccgcgctcctg

SEQ ID NO: 15418 - DNA, 15 bp, Artificial Sequence
  dgRNA
  Capg
aatccatgggttgta

SEQ ID NO: 15419 - DNA, 15 bp, Artificial Sequence
  dgRNA
  Capg
atccatgggttgtat

SEQ ID NO: 15420 - DNA, 15 bp, Artificial Sequence
  dgRNA
  Capg
gttttcccatagtat

SEQ ID NO: 15421 - DNA, 15 bp, Artificial Sequence
  dgRNA
  Capg
tagctttaccggccc

SEQ ID NO: 15422 - DNA, 15 bp, Artificial Sequence
  dgRNA
  Haus6
tccggaactaaggcc

SEQ ID NO: 15423 - DNA, 15 bp, Artificial Sequence
  dgRNA
  Haus6
ggaactaaggccggg

SEQ ID NO: 15424 - DNA, 15 bp, Artificial Sequence
  dgRNA
  Haus6
gaactaaggccggga

SEQ ID NO: 15425 - DNA, 15 bp, Artificial Sequence
  dgRNA
  Haus6
aaaacacccggtttc

SEQ ID NO: 15426 - DNA, 15 bp, Artificial Sequence
  dgRNA
  Rad52
accagggaccctcgc

SEQ ID NO: 15427 - DNA, 15 bp, Artificial Sequence
  dgRNA
  Rad52
ccagggaccctcgca

SEQ ID NO: 15428 - DNA, 15 bp, Artificial Sequence
  dgRNA
  Rad52
ctcgcagggcgccta

SEQ ID NO: 15429 - DNA, 15 bp, Artificial Sequence
  dgRNA
  Rad52
cggctgggtgacgcc

SEQ ID NO: 15430 - DNA, 15 bp, Artificial Sequence
  dgRNA
  Sec61b
cataaaagaagcgaa

SEQ ID NO: 15431 - DNA, 15 bp, Artificial Sequence
  dgRNA
  Sec61b
cggcccagttgttgt

SEQ ID NO: 15432 - DNA, 15 bp, Artificial Sequence
  dgRNA
  Sec61b
cggcgtaatctttac

SEQ ID NO: 15433 - DNA, 15 bp, Artificial Sequence
  dgRNA
  Sec61b
tccaagagtctgcga

SEQ ID NO: 15434 - DNA, 15 bp, Artificial Sequence
  dgRNA
  Defb42
ggcccacactccttg

SEQ ID NO: 15435 - DNA, 15 bp, Artificial Sequence
  dgRNA
  Defb42
taggcccacactcct

SEQ ID NO: 15436 - DNA, 15 bp, Artificial Sequence
  dgRNA
  Defb42
tgaacagtagttctc

SEQ ID NO: 15437 - DNA, 15 bp, Artificial Sequence
  dgRNA
  Defb42
gcctagatccagagg

SEQ ID NO: 15438 - DNA, 15 bp, Artificial Sequence
  dgRNA
  Ciz1
agagggcgctctgcg

SEQ ID NO: 15439 - DNA, 15 bp, Artificial Sequence
  dgRNA
  Ciz1
gagggcgctctgcgc

SEQ ID NO: 15440 - DNA, 15 bp, Artificial Sequence
  dgRNA
  Ciz1
cgctctgcgcgggag

SEQ ID NO: 15441 - DNA, 15 bp, Artificial Sequence
  dgRNA
  Ciz1
ggagtggccagccgc

SEQ ID NO: 15442 - DNA, 15 bp, Artificial Sequence
  dgRNA
  Cutc
gtacagcgccactgc

SEQ ID NO: 15443 - DNA, 15 bp, Artificial Sequence
  dgRNA
  Cutc
cgccccagcgagctg

SEQ ID NO: 15444 - DNA, 15 bp, Artificial Sequence
  dgRNA
  Cutc
aagcacttccgggtc

SEQ ID NO: 15445 - DNA, 15 bp, Artificial Sequence
  dgRNA
  Cutc
gcgccccctcgcgct

SEQ ID NO: 15446 - DNA, 15 bp, Artificial Sequence
  dgRNA
  Olfr301
tatctaaattacctc

SEQ ID NO: 15447 - DNA, 15 bp, Artificial Sequence
  dgRNA
  Olfr301
gcctttgcactcaag

SEQ ID NO: 15448 - DNA, 15 bp, Artificial Sequence
  dgRNA
  Olfr301
agaggtaatttagat

SEQ ID NO: 15449 - DNA, 15 bp, Artificial Sequence
  dgRNA
  Lpgat1
ggtaaacctggggcg

SEQ ID NO: 15450 - DNA, 15 bp, Artificial Sequence
  dgRNA
  Lpgat1
aaacctggggcgcgg

SEQ ID NO: 15451 - DNA, 15 bp, Artificial Sequence
  dgRNA
  Lpgat1
aacctggggcgcggc

SEQ ID NO: 15452 - DNA, 15 bp, Artificial Sequence
  dgRNA
  Lpgat1
ggcccgggaggcgct

SEQ ID NO: 15453 - DNA, 15 bp, Artificial Sequence
  dgRNA
  Arx
cgctttgcgctttgc

SEQ ID NO: 15454 - DNA, 15 bp, Artificial Sequence
  dgRNA
  Arx
ttgcgctttgccggc

SEQ ID NO: 15455 - DNA, 15 bp, Artificial Sequence
  dgRNA
  Arx
caggcctacgcagcc

SEQ ID NO: 15456 - DNA, 15 bp, Artificial Sequence
  dgRNA
  Arx
gcgcctctcagcacg

SEQ ID NO: 15457 - DNA, 15 bp, Artificial Sequence
  dgRNA
  6030498E09Rik
ttttccctcgctttc

SEQ ID NO: 15458 - DNA, 15 bp, Artificial Sequence
  dgRNA
  6030498E09Rik
cgctttcaggatttc

SEQ ID NO: 15459 - DNA, 15 bp, Artificial Sequence
  dgRNA
  6030498E09Rik
tgttctccgtgtcag

SEQ ID NO: 15460 - DNA, 15 bp, Artificial Sequence
  dgRNA
  6030498E09Rik
aacctgatagcaaaa

SEQ ID NO: 15461 - DNA, 15 bp, Artificial Sequence
  dgRNA
  Tspan2
gggtgagacccgaac

SEQ ID NO: 15462 - DNA, 15 bp, Artificial Sequence
  dgRNA
  Tspan2
tgagacccgaaccgg

SEQ ID NO: 15463 - DNA, 15 bp, Artificial Sequence
  dgRNA
  Tspan2
gagacccgaaccggc

SEQ ID NO: 15464 - DNA, 15 bp, Artificial Sequence
  dgRNA
  Tspan2
cccgaaccggcgggc

SEQ ID NO: 15465 - DNA, 15 bp, Artificial Sequence
  dgRNA
  Chrdl2
gcaccccgcagatcc

SEQ ID NO: 15466 - DNA, 15 bp, Artificial Sequence
  dgRNA
  Chrdl2
gtgtccctgtggcgc

SEQ ID NO: 15467 - DNA, 15 bp, Artificial Sequence
  dgRNA
  Chrdl2
ggggtgcggtcaccg

SEQ ID NO: 15468 - DNA, 15 bp, Artificial Sequence
  dgRNA
  Chrdl2
gcggggtgcggtcac

SEQ ID NO: 15469 - DNA, 15 bp, Artificial Sequence
  dgRNA
  Phc3
aaatagagggtgtct

SEQ ID NO: 15470 - DNA, 15 bp, Artificial Sequence
  dgRNA
  Phc3
gggaaggaccactta

SEQ ID NO: 15471 - DNA, 15 bp, Artificial Sequence
  dgRNA
  Phc3
gagcctggcagtcgc

SEQ ID NO: 15472 - DNA, 15 bp, Artificial Sequence
  dgRNA
  Phc3
ccagatcccgcccct

SEQ ID NO: 15473 - DNA, 15 bp, Artificial Sequence
  dgRNA
  Dlgap4
cgcagaggaccgtga

SEQ ID NO: 15474 - DNA, 15 bp, Artificial Sequence
  dgRNA
  Dlgap4
gcagaggaccgtgat

SEQ ID NO: 15475 - DNA, 15 bp, Artificial Sequence
  dgRNA
  Dlgap4
gaggaccgtgatggg

SEQ ID NO: 15476 - DNA, 15 bp, Artificial Sequence
  dgRNA
  Dlgap4
aggaccgtgatggga

SEQ ID NO: 15477 - DNA, 15 bp, Artificial Sequence
  dgRNA
  Sh2b1
caactgccgaagcca

SEQ ID NO: 15478 - DNA, 15 bp, Artificial Sequence
  dgRNA
  Sh2b1
aactgccgaagccac

SEQ ID NO: 15479 - DNA, 15 bp, Artificial Sequence
  dgRNA
  Sh2b1
cggcgccgagaacga

SEQ ID NO: 15480 - DNA, 15 bp, Artificial Sequence
  dgRNA
  Sh2b1
cgccgagaacgatgg

SEQ ID NO: 15481 - DNA, 15 bp, Artificial Sequence
  dgRNA
  Cacna2d1
gccggagccccgctc

SEQ ID NO: 15482 - DNA, 15 bp, Artificial Sequence
  dgRNA
  Cacna2d1
tctcctcggcgaccg

SEQ ID NO: 15483 - DNA, 15 bp, Artificial Sequence
  dgRNA
  Cacna2d1
gaccgcggataaatc

SEQ ID NO: 15484 - DNA, 15 bp, Artificial Sequence
  dgRNA
  Cacna2d1
accgcggataaatca

SEQ ID NO: 15485 - DNA, 15 bp, Artificial Sequence
  dgRNA
  Tmem217
caacaccgttgccat

SEQ ID NO: 15486 - DNA, 15 bp, Artificial Sequence
  dgRNA
  Tmem217
caccgttgccattgg

SEQ ID NO: 15487 - DNA, 15 bp, Artificial Sequence
  dgRNA
  Tmem217
accgttgccattggt

SEQ ID NO: 15488 - DNA, 15 bp, Artificial Sequence
  dgRNA
  Tmem217
attggtgggctgagc

SEQ ID NO: 15489 - DNA, 15 bp, Artificial Sequence
  dgRNA
  Brix1
gatacgcaaccacct

SEQ ID NO: 15490 - DNA, 15 bp, Artificial Sequence
  dgRNA
  Brix1
agtctacctcgagac

SEQ ID NO: 15491 - DNA, 15 bp, Artificial Sequence
  dgRNA
  Brix1
cggaagcgagcgcct

SEQ ID NO: 15492 - DNA, 15 bp, Artificial Sequence
  dgRNA
  Brix1
cgagcgccttggagc

SEQ ID NO: 15493 - DNA, 15 bp, Artificial Sequence
  dgRNA
  Zfp536
ttagcgtggagaccc

SEQ ID NO: 15494 - DNA, 15 bp, Artificial Sequence
  dgRNA
  Zfp536
gcttcgctcactgct

SEQ ID NO: 15495 - DNA, 15 bp, Artificial Sequence
  dgRNA
  Zfp536
cttcgctcactgctt

SEQ ID NO: 15496 - DNA, 15 bp, Artificial Sequence
  dgRNA
  Arl4c
taaaagacgcgtcac

SEQ ID NO: 15497 - DNA, 15 bp, Artificial Sequence
  dgRNA
  Arl4c
gacgcgtcaccggat

SEQ ID NO: 15498 - DNA, 15 bp, Artificial Sequence
  dgRNA
  Arl4c
acgcgtcaccggatt

SEQ ID NO: 15499 - DNA, 15 bp, Artificial Sequence
  dgRNA
  Arl4c
cgcgtcaccggattg

SEQ ID NO: 15500 - DNA, 15 bp, Artificial Sequence
  dgRNA
  Klk1b16
ctacgtagactaaga

SEQ ID NO: 15501 - DNA, 15 bp, Artificial Sequence
  dgRNA
  Parp12
cgccactcgcctcac

SEQ ID NO: 15502 - DNA, 15 bp, Artificial Sequence
  dgRNA
  Parp12
acgctgctgcctcga

SEQ ID NO: 15503 - DNA, 15 bp, Artificial Sequence
  dgRNA
  Parp12
cgctgctgcctcgaa

SEQ ID NO: 15504 - DNA, 15 bp, Artificial Sequence
  dgRNA
  Parp12
ctgcctcgaagggag

SEQ ID NO: 15505 - DNA, 15 bp, Artificial Sequence
  dgRNA
  Mgat4b
tagccgcgactttcc

SEQ ID NO: 15506 - DNA, 15 bp, Artificial Sequence
  dgRNA
  Mgat4b
agccgcgactttcct

SEQ ID NO: 15507 - DNA, 15 bp, Artificial Sequence
  dgRNA
  Mgat4b
gccgcgactttcctg

SEQ ID NO: 15508 - DNA, 15 bp, Artificial Sequence
  dgRNA
  Mgat4b
ccaaggcgggcccgc

SEQ ID NO: 15509 - DNA, 15 bp, Artificial Sequence
  dgRNA
  Vmn1r231
aattgcatttcaaac

SEQ ID NO: 15510 - DNA, 15 bp, Artificial Sequence
  dgRNA
  Vmn1r231
ttatattgtctccac

SEQ ID NO: 15511 - DNA, 15 bp, Artificial Sequence
  dgRNA
  Vmn1r231
tcatccactgcctaa

SEQ ID NO: 15512 - DNA, 15 bp, Artificial Sequence
  dgRNA
  Vmn1r231
tttaccattaggcag

SEQ ID NO: 15513 - DNA, 15 bp, Artificial Sequence
  dgRNA
  Dync1i1
tgccaggctggcccg

SEQ ID NO: 15514 - DNA, 15 bp, Artificial Sequence
  dgRNA
  Dync1i1
caggctggcccgagg

SEQ ID NO: 15515 - DNA, 15 bp, Artificial Sequence
  dgRNA
  Dync1i1
cggtgctgcgctgtg

SEQ ID NO: 15516 - DNA, 15 bp, Artificial Sequence
  dgRNA
  Dync1i1
tgctgcgctgtgcgg

SEQ ID NO: 15517 - DNA, 15 bp, Artificial Sequence
  dgRNA
  Prl3b1
atctgttagtatata

SEQ ID NO: 15518 - DNA, 15 bp, Artificial Sequence
  dgRNA
  Prl3b1
gttagtatatatggg

SEQ ID NO: 15519 - DNA, 15 bp, Artificial Sequence
  dgRNA
  Prl3b1
gtttgcaagagtgca

SEQ ID NO: 15520 - DNA, 15 bp, Artificial Sequence
  dgRNA
  Mcm6
catggcgtatgcttt

SEQ ID NO: 15521 - DNA, 15 bp, Artificial Sequence
  dgRNA
  Mcm6
cgcgaaaagtgcgtg

SEQ ID NO: 15522 - DNA, 15 bp, Artificial Sequence
  dgRNA
  Mcm6
gaaaagtgcgtgcgg

SEQ ID NO: 15523 - DNA, 15 bp, Artificial Sequence
  dgRNA
  Mcm6
aaaagtgcgtgcggt

SEQ ID NO: 15524 - DNA, 15 bp, Artificial Sequence
  dgRNA
  Tmem185b
gaccccaaacccctg

SEQ ID NO: 15525 - DNA, 15 bp, Artificial Sequence
  dgRNA
  Tmem185b
ccccaaacccctgcg

SEQ ID NO: 15526 - DNA, 15 bp, Artificial Sequence
  dgRNA
  Tmem185b
aacccctgcggggac

SEQ ID NO: 15527 - DNA, 15 bp, Artificial Sequence
  dgRNA
  Tmem185b
cgcccccgagcctgc

SEQ ID NO: 15528 - DNA, 15 bp, Artificial Sequence
  dgRNA
  Tprgl
gcttccggcccagga

SEQ ID NO: 15529 - DNA, 15 bp, Artificial Sequence
  dgRNA
  Tprgl
cttccggcccaggag

SEQ ID NO: 15530 - DNA, 15 bp, Artificial Sequence
  dgRNA
  Tprgl
cgccgtaatcatgaa

SEQ ID NO: 15531 - DNA, 15 bp, Artificial Sequence
  dgRNA
  Tprgl
gcgagacgcagtcga

SEQ ID NO: 15532 - DNA, 15 bp, Artificial Sequence
  dgRNA
  Gjb1
cggcgatggaccggg

SEQ ID NO: 15533 - DNA, 15 bp, Artificial Sequence
  dgRNA
  Gjb1
ggcgatggaccgggc

SEQ ID NO: 15534 - DNA, 15 bp, Artificial Sequence
  dgRNA
  Gjb1
cgggcacagaacagg

SEQ ID NO: 15535 - DNA, 15 bp, Artificial Sequence
  dgRNA
  Gjb1
ctgggtgtccggcgc

SEQ ID NO: 15536 - DNA, 15 bp, Artificial Sequence
  dgRNA
  Tmem19
cgctgttcccagcct

SEQ ID NO: 15537 - DNA, 15 bp, Artificial Sequence
  dgRNA
  Tmem19
cttggttcgcttgcc

SEQ ID NO: 15538 - DNA, 15 bp, Artificial Sequence
  dgRNA
  Tmem19
ttggttcgcttgccc

SEQ ID NO: 15539 - DNA, 15 bp, Artificial Sequence
  dgRNA
  Tmem19
tgcccgggcagcgta

SEQ ID NO: 15540 - DNA, 15 bp, Artificial Sequence
  dgRNA
  Snx7
accgctctcccgccc

SEQ ID NO: 15541 - DNA, 15 bp, Artificial Sequence
  dgRNA
  Snx7
tctcccgccccggcc

SEQ ID NO: 15542 - DNA, 15 bp, Artificial Sequence
  dgRNA
  Snx7
ccggcccggcgccgc

SEQ ID NO: 15543 - DNA, 15 bp, Artificial Sequence
  dgRNA
  Snx7
ttccgcgtctgcgca

SEQ ID NO: 15544 - DNA, 15 bp, Artificial Sequence
  dgRNA
  Glra1
cttcccgcccgcagc

SEQ ID NO: 15545 - DNA, 15 bp, Artificial Sequence
  dgRNA
  Glra1
ttcccgcccgcagcc

SEQ ID NO: 15546 - DNA, 15 bp, Artificial Sequence
  dgRNA
  Glra1
cgcccgcagccgggc

SEQ ID NO: 15547 - DNA, 15 bp, Artificial Sequence
  dgRNA
  Glra1
gctggacgctctccg

SEQ ID NO: 15548 - DNA, 15 bp, Artificial Sequence
  dgRNA
  Mis18a
ctcagcagcggcgga

SEQ ID NO: 15549 - DNA, 15 bp, Artificial Sequence
  dgRNA
  Mis18a
caccagctttcgctc

SEQ ID NO: 15550 - DNA, 15 bp, Artificial Sequence
  dgRNA
  Mis18a
gctcaggaagaccgc

SEQ ID NO: 15551 - DNA, 15 bp, Artificial Sequence
  dgRNA
  Mis18a
caagcgcagtgagcg

SEQ ID NO: 15552 - DNA, 15 bp, Artificial Sequence
  dgRNA
  Cnga3
agttactccgcctgc

SEQ ID NO: 15553 - DNA, 15 bp, Artificial Sequence
  dgRNA
  Cnga3
gaccatgccggagac

SEQ ID NO: 15554 - DNA, 15 bp, Artificial Sequence
  dgRNA
  Cnga3
accatgccggagaca

SEQ ID NO: 15555 - DNA, 15 bp, Artificial Sequence
  dgRNA
  Cnga3
gcttgtattcagagg

SEQ ID NO: 15556 - DNA, 15 bp, Artificial Sequence
  dgRNA
  Unc119
gtcaaaaagttcaca

SEQ ID NO: 15557 - DNA, 15 bp, Artificial Sequence
  dgRNA
  Unc119
ttcacaaggaccccc

SEQ ID NO: 15558 - DNA, 15 bp, Artificial Sequence
  dgRNA
  Unc119
cccgctggagacgcc

SEQ ID NO: 15559 - DNA, 15 bp, Artificial Sequence
  dgRNA
  Unc119
gctggagacgccagg

SEQ ID NO: 15560 - DNA, 15 bp, Artificial Sequence
  dgRNA
  Anapc5
ggaacctggtcgcct

SEQ ID NO: 15561 - DNA, 15 bp, Artificial Sequence
  dgRNA
  Anapc5
gttgagcgtttctgt

SEQ ID NO: 15562 - DNA, 15 bp, Artificial Sequence
  dgRNA
  Anapc5
ttgagcgtttctgta

SEQ ID NO: 15563 - DNA, 15 bp, Artificial Sequence
  dgRNA
  Anapc5
acccccgctcactac

SEQ ID NO: 15564 - DNA, 15 bp, Artificial Sequence
  dgRNA
  Rasip1
tggcccatgagtgag

SEQ ID NO: 15565 - DNA, 15 bp, Artificial Sequence
  dgRNA
  Rasip1
ccagaatcaaggcgc

SEQ ID NO: 15566 - DNA, 15 bp, Artificial Sequence
  dgRNA
  Rasip1
atcaaggcgcaggcc

SEQ ID NO: 15567 - DNA, 15 bp, Artificial Sequence
  dgRNA
  Rasip1
tcaaggcgcaggcca

SEQ ID NO: 15568 - DNA, 15 bp, Artificial Sequence
  dgRNA
  Hapln1
tccggatctgagcag

SEQ ID NO: 15569 - DNA, 15 bp, Artificial Sequence
  dgRNA
  Hapln1
ccggatctgagcaga

SEQ ID NO: 15570 - DNA, 15 bp, Artificial Sequence
  dgRNA
  Hapln1
cccctgaagtttgca

SEQ ID NO: 15571 - DNA, 15 bp, Artificial Sequence
  dgRNA
  Hapln1
gcatggagtgcagtt

SEQ ID NO: 15572 - DNA, 15 bp, Artificial Sequence
  dgRNA
  Bicd1
cattccgcctcagcg

SEQ ID NO: 15573 - DNA, 15 bp, Artificial Sequence
  dgRNA
  Bicd1
ttcctcagctagttc

SEQ ID NO: 15574 - DNA, 15 bp, Artificial Sequence
  dgRNA
  Bicd1
ctgtgctgcgctgcg

SEQ ID NO: 15575 - DNA, 15 bp, Artificial Sequence
  dgRNA
  Bicd1
ctgcgctgcgaggct

SEQ ID NO: 15576 - DNA, 15 bp, Artificial Sequence
  dgRNA
  Atp6v1g3
ctctttgatccaatc

SEQ ID NO: 15577 - DNA, 15 bp, Artificial Sequence
  dgRNA
  Atp6v1g3
ccaatcaggcaagtt

SEQ ID NO: 15578 - DNA, 15 bp, Artificial Sequence
  dgRNA
  Atp6v1g3
acaaggcaactatac

SEQ ID NO: 15579 - DNA, 15 bp, Artificial Sequence
  dgRNA
  Atp6v1g3
agctctgtattaaca

SEQ ID NO: 15580 - DNA, 15 bp, Artificial Sequence
  dgRNA
  Ccl4
cgtgatgtcactgct

SEQ ID NO: 15581 - DNA, 15 bp, Artificial Sequence
  dgRNA
  Ccl4
gagtccctataaaga

SEQ ID NO: 15582 - DNA, 15 bp, Artificial Sequence
  dgRNA
  Ccl4
gcctaagacaagggt

SEQ ID NO: 15583 - DNA, 15 bp, Artificial Sequence
  dgRNA
  Ccl4
tctttatagggactc

SEQ ID NO: 15584 - DNA, 15 bp, Artificial Sequence
  dgRNA
  Slc36a4
tttctgcgtggtccg

SEQ ID NO: 15585 - DNA, 15 bp, Artificial Sequence
  dgRNA
  Slc36a4
ccggcatgcgaagcc

SEQ ID NO: 15586 - DNA, 15 bp, Artificial Sequence
  dgRNA
  Slc36a4
cggcatgcgaagccc

SEQ ID NO: 15587 - DNA, 15 bp, Artificial Sequence
  dgRNA
  Slc36a4
ggcatgcgaagcccg

SEQ ID NO: 15588 - DNA, 15 bp, Artificial Sequence
  dgRNA
  Trpd52l3
ctctcgattataatc

SEQ ID NO: 15589 - DNA, 15 bp, Artificial Sequence
  dgRNA
  Trpd52l3
tctcgattataatct

SEQ ID NO: 15590 - DNA, 15 bp, Artificial Sequence
  dgRNA
  Trpd52l3
gacccccagcccttt

SEQ ID NO: 15591 - DNA, 15 bp, Artificial Sequence
  dgRNA
  Trpd52l3
ctatgggagtgtttc

SEQ ID NO: 15592 - DNA, 15 bp, Artificial Sequence
  dgRNA
  Gcnt1
tgtgtcgcttgcctg

SEQ ID NO: 15593 - DNA, 15 bp, Artificial Sequence
  dgRNA
  Gcnt1
gcagacataacatga

SEQ ID NO: 15594 - DNA, 15 bp, Artificial Sequence
  dgRNA
  Gcnt1
gcaagcgacacagga

SEQ ID NO: 15595 - DNA, 15 bp, Artificial Sequence
  dgRNA
  Gcnt1
tcaggcaagcgacac

SEQ ID NO: 15596 - DNA, 15 bp, Artificial Sequence
  dgRNA
  Dnajc11
ccggcctcggccgcg

SEQ ID NO: 15597 - DNA, 15 bp, Artificial Sequence
  dgRNA
  Dnajc11
cggcctcggccgcgc

SEQ ID NO: 15598 - DNA, 15 bp, Artificial Sequence
  dgRNA
  Dnajc11
ggcctcggccgcgcg

SEQ ID NO: 15599 - DNA, 15 bp, Artificial Sequence
  dgRNA
  Dnajc11
gcctcggccgcgcgg

SEQ ID NO: 15600 - DNA, 15 bp, Artificial Sequence
  dgRNA
  Tmem239
aatggtaggcttgct

SEQ ID NO: 15601 - DNA, 15 bp, Artificial Sequence
  dgRNA
  Tmem239
gggaccattaagtaa

SEQ ID NO: 15602 - DNA, 15 bp, Artificial Sequence
  dgRNA
  Tmem239
cttaatggtccctcc

SEQ ID NO: 15603 - DNA, 15 bp, Artificial Sequence
  dgRNA
  Tmem239
acccggactggggtg

SEQ ID NO: 15604 - DNA, 15 bp, Artificial Sequence
  dgRNA
  Phtf1
cgagggttacacgcg

SEQ ID NO: 15605 - DNA, 15 bp, Artificial Sequence
  dgRNA
  Phtf1
gggttacacgcgagg

SEQ ID NO: 15606 - DNA, 15 bp, Artificial Sequence
  dgRNA
  Phtf1
acgcgaggcggctgt

SEQ ID NO: 15607 - DNA, 15 bp, Artificial Sequence
  dgRNA
  Phtf1
tccgggcagccagag

SEQ ID NO: 15608 - DNA, 15 bp, Artificial Sequence
  dgRNA
  Prrx1
agtgactgcgggttt

SEQ ID NO: 15609 - DNA, 15 bp, Artificial Sequence
  dgRNA
  Prrx1
gtgactgcgggtttc

SEQ ID NO: 15610 - DNA, 15 bp, Artificial Sequence
  dgRNA
  Prrx1
gtgatactactgcaa

SEQ ID NO: 15611 - DNA, 15 bp, Artificial Sequence
  dgRNA
  Prrx1
agtcactttaaaacg

SEQ ID NO: 15612 - DNA, 15 bp, Artificial Sequence
  dgRNA
  Fam168b
taactactttctaca

SEQ ID NO: 15613 - DNA, 15 bp, Artificial Sequence
  dgRNA
  Fam168b
cagcccggttttagc

SEQ ID NO: 15614 - DNA, 15 bp, Artificial Sequence
  dgRNA
  Fam168b
ccggagcttgagcgg

SEQ ID NO: 15615 - DNA, 15 bp, Artificial Sequence
  dgRNA
  Fam168b
ggaggctcgcagtct

SEQ ID NO: 15616 - DNA, 15 bp, Artificial Sequence
  dgRNA
  Bdnf
gagagcccttaccac

SEQ ID NO: 15617 - DNA, 15 bp, Artificial Sequence
  dgRNA
  Bdnf
ctctccacgcaaatt

SEQ ID NO: 15618 - DNA, 15 bp, Artificial Sequence
  dgRNA
  Bdnf
cacgcaaatttggac

SEQ ID NO: 15619 - DNA, 15 bp, Artificial Sequence
  dgRNA
  Bdnf
acgcaaatttggacc

SEQ ID NO: 15620 - DNA, 15 bp, Artificial Sequence
  dgRNA
  Hes5
cccgcgccaattcac

SEQ ID NO: 15621 - DNA, 15 bp, Artificial Sequence
  dgRNA
  Hes5
tttagcgtgcgctaa

SEQ ID NO: 15622 - DNA, 15 bp, Artificial Sequence
  dgRNA
  Hes5
ttagcgtgcgctaat

SEQ ID NO: 15623 - DNA, 15 bp, Artificial Sequence
  dgRNA
  Hes5
cgtgcgctaatgggc

SEQ ID NO: 15624 - DNA, 15 bp, Artificial Sequence
  dgRNA
  Csnk2b
cttccggtggcgcct

SEQ ID NO: 15625 - DNA, 15 bp, Artificial Sequence
  dgRNA
  Csnk2b
aggcggcttcctcta

SEQ ID NO: 15626 - DNA, 15 bp, Artificial Sequence
  dgRNA
  Csnk2b
tcctctagggcctcg

SEQ ID NO: 15627 - DNA, 15 bp, Artificial Sequence
  dgRNA
  Csnk2b
ttagagagtcatgcg

SEQ ID NO: 15628 - DNA, 15 bp, Artificial Sequence
  dgRNA
  Cep250
tttggagagcgacct

SEQ ID NO: 15629 - DNA, 15 bp, Artificial Sequence
  dgRNA
  Cep250
tgccagtacttaata

SEQ ID NO: 15630 - DNA, 15 bp, Artificial Sequence
  dgRNA
  Cep250
acttaatatggcgag

SEQ ID NO: 15631 - DNA, 15 bp, Artificial Sequence
  dgRNA
  Cep250
gcgagaggtttgcag

SEQ ID NO: 15632 - DNA, 15 bp, Artificial Sequence
  dgRNA
  Tpm2
tgcccctacaaggtt

SEQ ID NO: 15633 - DNA, 15 bp, Artificial Sequence
  dgRNA
  Tpm2
gcccctacaaggttt

SEQ ID NO: 15634 - DNA, 15 bp, Artificial Sequence
  dgRNA
  Tpm2
ggtttgggccttggt

SEQ ID NO: 15635 - DNA, 15 bp, Artificial Sequence
  dgRNA
  Tpm2
tcccccggctccgcc

SEQ ID NO: 15636 - DNA, 15 bp, Artificial Sequence
  dgRNA
  Anks1b
attattgaaaatgcg

SEQ ID NO: 15637 - DNA, 15 bp, Artificial Sequence
  dgRNA
  Anks1b
atgcgaggtgtagcc

SEQ ID NO: 15638 - DNA, 15 bp, Artificial Sequence
  dgRNA
  Anks1b
tgcgaggtgtagcct

SEQ ID NO: 15639 - DNA, 15 bp, Artificial Sequence
  dgRNA
  Plxnb1
gccatgactaccgcc

SEQ ID NO: 15640 - DNA, 15 bp, Artificial Sequence
  dgRNA
  Plxnb1
ccatgactaccgccc

SEQ ID NO: 15641 - DNA, 15 bp, Artificial Sequence
  dgRNA
  Plxnb1
cccccatttaatgag

SEQ ID NO: 15642 - DNA, 15 bp, Artificial Sequence
  dgRNA
  Plxnb1
gttgatcaccccccc

SEQ ID NO: 15643 - DNA, 15 bp, Artificial Sequence
  dgRNA
  Ggt1
tattcaaaaacaccc

SEQ ID NO: 15644 - DNA, 15 bp, Artificial Sequence
  dgRNA
  Ggt1
caaaaacaccccggc

SEQ ID NO: 15645 - DNA, 15 bp, Artificial Sequence
  dgRNA
  Ggt1
accccggcaggcaag

SEQ ID NO: 15646 - DNA, 15 bp, Artificial Sequence
  dgRNA
  Ggt1
ccggcaggcaagtgg

SEQ ID NO: 15647 - DNA, 15 bp, Artificial Sequence
  dgRNA
  Fcer1g
aggttggtccctgaa

SEQ ID NO: 15648 - DNA, 15 bp, Artificial Sequence
  dgRNA
  Fcer1g
ggttggtccctgaaa

SEQ ID NO: 15649 - DNA, 15 bp, Artificial Sequence
  dgRNA
  Fcer1g
agggctgagtcttag

SEQ ID NO: 15650 - DNA, 15 bp, Artificial Sequence
  dgRNA
  Fcer1g
ccaaaatggcccttc

SEQ ID NO: 15651 - DNA, 15 bp, Artificial Sequence
  dgRNA
  4930524N10Rik
gtgcccatttgaatt

SEQ ID NO: 15652 - DNA, 15 bp, Artificial Sequence
  dgRNA
  4930524N10Rik
atttggtcattgctc

SEQ ID NO: 15653 - DNA, 15 bp, Artificial Sequence
  dgRNA
  4930524N10Rik
gcagtatttagtgat

SEQ ID NO: 15654 - DNA, 15 bp, Artificial Sequence
  dgRNA
  4930524N10Rik
ctagaactaggtgat

SEQ ID NO: 15655 - DNA, 15 bp, Artificial Sequence
  dgRNA
  Limd2
gctgtgaaagcgatg

SEQ ID NO: 15656 - DNA, 15 bp, Artificial Sequence
  dgRNA
  Limd2
ctgtgaaagcgatgt

SEQ ID NO: 15657 - DNA, 15 bp, Artificial Sequence
  dgRNA
  Limd2
tgtgaaagcgatgtg

SEQ ID NO: 15658 - DNA, 15 bp, Artificial Sequence
  dgRNA
  Limd2
gtgaaagcgatgtgg

SEQ ID NO: 15659 - DNA, 15 bp, Artificial Sequence
  dgRNA
  Krtap13
tgggtgttgtaacaa

SEQ ID NO: 15660 - DNA, 15 bp, Artificial Sequence
  dgRNA
  Nrip2
ctctactgcaatctc

SEQ ID NO: 15661 - DNA, 15 bp, Artificial Sequence
  dgRNA
  Nrip2
gagcgaggttccggc

SEQ ID NO: 15662 - DNA, 15 bp, Artificial Sequence
  dgRNA
  Nrip2
gagggagcgaggttc

SEQ ID NO: 15663 - DNA, 15 bp, Artificial Sequence
  dgRNA
  Gm17677
cctaccagcaataaa

SEQ ID NO: 15664 - DNA, 15 bp, Artificial Sequence
  dgRNA
  Gm17677
gatcactcacagagt

SEQ ID NO: 15665 - DNA, 15 bp, Artificial Sequence
  dgRNA
  Gm17677
aggcccatttattgc

SEQ ID NO: 15666 - DNA, 15 bp, Artificial Sequence
  dgRNA
  Cela2a
ttgctattgtcgttt

SEQ ID NO: 15667 - DNA, 15 bp, Artificial Sequence
  dgRNA
  Cela2a
tgctattgtcgtttt

SEQ ID NO: 15668 - DNA, 15 bp, Artificial Sequence
  dgRNA
  Cela2a
gctattgtcgttttg

SEQ ID NO: 15669 - DNA, 15 bp, Artificial Sequence
  dgRNA
  Cela2a
ctattgtcgttttgg

SEQ ID NO: 15670 - DNA, 15 bp, Artificial Sequence
  dgRNA
  Tlr12
aacaaactgagctcg

SEQ ID NO: 15671 - DNA, 15 bp, Artificial Sequence
  dgRNA
  Tlr12
acaaactgagctcgt

SEQ ID NO: 15672 - DNA, 15 bp, Artificial Sequence
  dgRNA
  Tlr12
gctcgtgggacagcc

SEQ ID NO: 15673 - DNA, 15 bp, Artificial Sequence
  dgRNA
  Tlr12
ccccctacgttgccc

SEQ ID NO: 15674 - DNA, 15 bp, Artificial Sequence
  dgRNA
  Echdc2
tcctagccgtgcatt

SEQ ID NO: 15675 - DNA, 15 bp, Artificial Sequence
  dgRNA
  Echdc2
tcccagatttcacga

SEQ ID NO: 15676 - DNA, 15 bp, Artificial Sequence
  dgRNA
  Echdc2
cgaaggagctgaact

SEQ ID NO: 15677 - DNA, 15 bp, Artificial Sequence
  dgRNA
  Echdc2
gggtctgcaggctcg

SEQ ID NO: 15678 - DNA, 15 bp, Artificial Sequence
  dgRNA
  Ddx31
ctcgccaccttgccc

SEQ ID NO: 15679 - DNA, 15 bp, Artificial Sequence
  dgRNA
  Ddx31
ccgttcactccccgc

SEQ ID NO: 15680 - DNA, 15 bp, Artificial Sequence
  dgRNA
  Ddx31
gaccccgtcgttgct

SEQ ID NO: 15681 - DNA, 15 bp, Artificial Sequence
  dgRNA
  Ddx31
cgccaccctgctaga

SEQ ID NO: 15682 - DNA, 15 bp, Artificial Sequence
  dgRNA
  Ankra2
tacaagaaagcgccc

SEQ ID NO: 15683 - DNA, 15 bp, Artificial Sequence
  dgRNA
  Ankra2
aagaaagcgccctgg

SEQ ID NO: 15684 - DNA, 15 bp, Artificial Sequence
  dgRNA
  Ankra2
agaaagcgccctggt

SEQ ID NO: 15685 - DNA, 15 bp, Artificial Sequence
  dgRNA
  Ankra2
aagcgccctggtggg

SEQ ID NO: 15686 - DNA, 15 bp, Artificial Sequence
  dgRNA
  Ndufaf4
ggattttgcaaccgt

SEQ ID NO: 15687 - DNA, 15 bp, Artificial Sequence
  dgRNA
  Ndufaf4
agactccggagtcgc

SEQ ID NO: 15688 - DNA, 15 bp, Artificial Sequence
  dgRNA
  Ndufaf4
tccggagtcgccggc

SEQ ID NO: 15689 - DNA, 15 bp, Artificial Sequence
  dgRNA
  Ndufaf4
gcgcatgcgcctgtg

SEQ ID NO: 15690 - DNA, 15 bp, Artificial Sequence
  dgRNA
  Olfr913
gaggtagttggaatc

SEQ ID NO: 15691 - DNA, 15 bp, Artificial Sequence
  dgRNA
  Olfr913
aggtagttggaatct

SEQ ID NO: 15692 - DNA, 15 bp, Artificial Sequence
  dgRNA
  Olfr913
gtataagcatctaaa

SEQ ID NO: 15693 - DNA, 15 bp, Artificial Sequence
  dgRNA
  Olfr913
acaactatacttcct

SEQ ID NO: 15694 - DNA, 15 bp, Artificial Sequence
  dgRNA
  Sec24c
agactgcgtccatga

SEQ ID NO: 15695 - DNA, 15 bp, Artificial Sequence
  dgRNA
  Sec24c
gactgcgtccatgac

SEQ ID NO: 15696 - DNA, 15 bp, Artificial Sequence
  dgRNA
  Sec24c
cgcatgcgcaacatc

SEQ ID NO: 15697 - DNA, 15 bp, Artificial Sequence
  dgRNA
  Sec24c
gcatgcgcaacatcc

SEQ ID NO: 15698 - DNA, 15 bp, Artificial Sequence
  dgRNA
  Aim1l
tgaatggccatcagg

SEQ ID NO: 15699 - DNA, 15 bp, Artificial Sequence
  dgRNA
  Aim1l
gggcctagaatggca

SEQ ID NO: 15700 - DNA, 15 bp, Artificial Sequence
  dgRNA
  Aim1l
catggagctgattgc

SEQ ID NO: 15701 - DNA, 15 bp, Artificial Sequence
  dgRNA
  Aim1l
atggagctgattgct

SEQ ID NO: 15702 - DNA, 15 bp, Artificial Sequence
  dgRNA
  Mapk12
gtctagcgagggtgt

SEQ ID NO: 15703 - DNA, 15 bp, Artificial Sequence
  dgRNA
  Mapk12
agcgagggtgtaggc

SEQ ID NO: 15704 - DNA, 15 bp, Artificial Sequence
  dgRNA
  Mapk12
gtcgagactgagcta

SEQ ID NO: 15705 - DNA, 15 bp, Artificial Sequence
  dgRNA
  Mapk12
tccgcccaaccccgg

SEQ ID NO: 15706 - DNA, 15 bp, Artificial Sequence
  dgRNA
  Oxld1
cgccatgactacccc

SEQ ID NO: 15707 - DNA, 15 bp, Artificial Sequence
  dgRNA
  Oxld1
ccggacagcgcaggt

SEQ ID NO: 15708 - DNA, 15 bp, Artificial Sequence
  dgRNA
  Oxld1
ctgcccggacagcgc

SEQ ID NO: 15709 - DNA, 15 bp, Artificial Sequence
  dgRNA
  Oxld1
tcgggacagccgcag

SEQ ID NO: 15710 - DNA, 15 bp, Artificial Sequence
  dgRNA
  Exd1
gtttctcttgcggcc

SEQ ID NO: 15711 - DNA, 15 bp, Artificial Sequence
  dgRNA
  Exd1
tttctcttgcggccc

SEQ ID NO: 15712 - DNA, 15 bp, Artificial Sequence
  dgRNA
  Exd1
ttctcttgcggcccg

SEQ ID NO: 15713 - DNA, 15 bp, Artificial Sequence
  dgRNA
  Exd1
caaggggtggagcgc

SEQ ID NO: 15714 - DNA, 15 bp, Artificial Sequence
  dgRNA
  Pparg
ggtgtgaggaaagcg

SEQ ID NO: 15715 - DNA, 15 bp, Artificial Sequence
  dgRNA
  Pparg
gggtcactgtcgcca

SEQ ID NO: 15716 - DNA, 15 bp, Artificial Sequence
  dgRNA
  Pparg
ctcttcaatctaagc

SEQ ID NO: 15717 - DNA, 15 bp, Artificial Sequence
  dgRNA
  Pparg
tcttcaatctaagca

SEQ ID NO: 15718 - DNA, 15 bp, Artificial Sequence
  dgRNA
  Arhgap8
gtttcccctctcacc

SEQ ID NO: 15719 - DNA, 15 bp, Artificial Sequence
  dgRNA
  Arhgap8
ggcgcatctcaaatg

SEQ ID NO: 15720 - DNA, 15 bp, Artificial Sequence
  dgRNA
  Arhgap8
gcgcatctcaaatgc

SEQ ID NO: 15721 - DNA, 15 bp, Artificial Sequence
  dgRNA
  Arhgap8
atgcgggtaaaagtg

SEQ ID NO: 15722 - DNA, 15 bp, Artificial Sequence
  dgRNA
  Stk17b
aagtcttcaggcgct

SEQ ID NO: 15723 - DNA, 15 bp, Artificial Sequence
  dgRNA
  Stk17b
cacagcacgcgctgc

SEQ ID NO: 15724 - DNA, 15 bp, Artificial Sequence
  dgRNA
  Stk17b
cgtaatcgctccgat

SEQ ID NO: 15725 - DNA, 15 bp, Artificial Sequence
  dgRNA
  Stk17b
gctccgattggctct

SEQ ID NO: 15726 - DNA, 15 bp, Artificial Sequence
  dgRNA
  Gnptg
cgagcaactttcttg

SEQ ID NO: 15727 - DNA, 15 bp, Artificial Sequence
  dgRNA
  Gnptg
cgctcgcacagcttc

SEQ ID NO: 15728 - DNA, 15 bp, Artificial Sequence
  dgRNA
  Gnptg
cagcttccggttttg

SEQ ID NO: 15729 - DNA, 15 bp, Artificial Sequence
  dgRNA
  Gnptg
agcttccggttttga

SEQ ID NO: 15730 - DNA, 15 bp, Artificial Sequence
  dgRNA
  Ucp2
tgccccgggaataga

SEQ ID NO: 15731 - DNA, 15 bp, Artificial Sequence
  dgRNA
  Ucp2
gccccgggaatagaa

SEQ ID NO: 15732 - DNA, 15 bp, Artificial Sequence
  dgRNA
  Ucp2
ccccgggaatagaag

SEQ ID NO: 15733 - DNA, 15 bp, Artificial Sequence
  dgRNA
  Ucp2
ctctggggggaccta

SEQ ID NO: 15734 - DNA, 15 bp, Artificial Sequence
  dgRNA
  Abhd17a
acccaatccgcttcg

SEQ ID NO: 15735 - DNA, 15 bp, Artificial Sequence
  dgRNA
  Abhd17a
cccataaacagccag

SEQ ID NO: 15736 - DNA, 15 bp, Artificial Sequence
  dgRNA
  Abhd17a
cggggctttatatgg

SEQ ID NO: 15737 - DNA, 15 bp, Artificial Sequence
  dgRNA
  Abhd17a
gcggggctttatatg

SEQ ID NO: 15738 - DNA, 15 bp, Artificial Sequence
  dgRNA
  Mea1
cacgtcgcacgcctg

SEQ ID NO: 15739 - DNA, 15 bp, Artificial Sequence
  dgRNA
  Mea1
acgtcgcacgcctga

SEQ ID NO: 15740 - DNA, 15 bp, Artificial Sequence
  dgRNA
  Mea1
acgcctgagggtcac

SEQ ID NO: 15741 - DNA, 15 bp, Artificial Sequence
  dgRNA
  Mea1
cgcctgagggtcact

SEQ ID NO: 15742 - DNA, 15 bp, Artificial Sequence
  dgRNA
  Pofut2
ggcgtgactgcgctg

SEQ ID NO: 15743 - DNA, 15 bp, Artificial Sequence
  dgRNA
  Pofut2
acacgcccattcccc

SEQ ID NO: 15744 - DNA, 15 bp, Artificial Sequence
  dgRNA
  Pofut2
tactcagacgaagag

SEQ ID NO: 15745 - DNA, 15 bp, Artificial Sequence
  dgRNA
  Pofut2
ggcgcgtgcgcaccg

SEQ ID NO: 15746 - DNA, 15 bp, Artificial Sequence
  dgRNA
  Synj1
gagcacgaatcaaca

SEQ ID NO: 15747 - DNA, 15 bp, Artificial Sequence
  dgRNA
  Synj1
agcacgaatcaacac

SEQ ID NO: 15748 - DNA, 15 bp, Artificial Sequence
  dgRNA
  Synj1
cctccctgtcgcccg

SEQ ID NO: 15749 - DNA, 15 bp, Artificial Sequence
  dgRNA
  Synj1
ctccctgtcgcccgc

SEQ ID NO: 15750 - DNA, 15 bp, Artificial Sequence
  dgRNA
  Ercc3
tcccgcccgatctat

SEQ ID NO: 15751 - DNA, 15 bp, Artificial Sequence
  dgRNA
  Ercc3
cccgcccgatctata

SEQ ID NO: 15752 - DNA, 15 bp, Artificial Sequence
  dgRNA
  Ercc3
gggcaaataagctca

SEQ ID NO: 15753 - DNA, 15 bp, Artificial Sequence
  dgRNA
  Ercc3
tcctagaagtacgta

SEQ ID NO: 15754 - DNA, 15 bp, Artificial Sequence
  dgRNA
  D7Ertd443e
gattgagtccctcac

SEQ ID NO: 15755 - DNA, 15 bp, Artificial Sequence
  dgRNA
  D7Ertd443e
agctcttatccctat

SEQ ID NO: 15756 - DNA, 15 bp, Artificial Sequence
  dgRNA
  D7Ertd443e
aatgtttgccgagct

SEQ ID NO: 15757 - DNA, 15 bp, Artificial Sequence
  dgRNA
  D7Ertd443e
aaatgtttgccgagc

SEQ ID NO: 15758 - DNA, 15 bp, Artificial Sequence
  dgRNA
  Rpp38
tccgcatcgtcattt

SEQ ID NO: 15759 - DNA, 15 bp, Artificial Sequence
  dgRNA
  Rpp38
ggacgaccagtcaga

SEQ ID NO: 15760 - DNA, 15 bp, Artificial Sequence
  dgRNA
  Rpp38
gacgaccagtcagaa

SEQ ID NO: 15761 - DNA, 15 bp, Artificial Sequence
  dgRNA
  Rpp38
cctgacgtccctgac

SEQ ID NO: 15762 - DNA, 15 bp, Artificial Sequence
  dgRNA
  Gm4788
gactgaccaaaaaac

SEQ ID NO: 15763 - DNA, 15 bp, Artificial Sequence
  dgRNA
  Gm4788
ttactcttggcgtat

SEQ ID NO: 15764 - DNA, 15 bp, Artificial Sequence
  dgRNA
  Optn
ggggcgtgaccgagt

SEQ ID NO: 15765 - DNA, 15 bp, Artificial Sequence
  dgRNA
  Optn
gtgaccgagtgggcg

SEQ ID NO: 15766 - DNA, 15 bp, Artificial Sequence
  dgRNA
  Optn
cgagtgggcgtggtc

SEQ ID NO: 15767 - DNA, 15 bp, Artificial Sequence
  dgRNA
  Optn
gaaatttcttggcta

SEQ ID NO: 15768 - DNA, 15 bp, Artificial Sequence
  dgRNA
  Cldn9
ccctaactaaccccg

SEQ ID NO: 15769 - DNA, 15 bp, Artificial Sequence
  dgRNA
  Cldn9
cctaactaaccccga

SEQ ID NO: 15770 - DNA, 15 bp, Artificial Sequence
  dgRNA
  Cldn9
ggtgccaagaccaaa

SEQ ID NO: 15771 - DNA, 15 bp, Artificial Sequence
  dgRNA
  Cldn9
gggttagttagggtc

SEQ ID NO: 15772 - DNA, 15 bp, Artificial Sequence
  dgRNA
  Sec31b
tagcatgtactggtg

SEQ ID NO: 15773 - DNA, 15 bp, Artificial Sequence
  dgRNA
  Sec31b
ctgcgctatcgctct

SEQ ID NO: 15774 - DNA, 15 bp, Artificial Sequence
  dgRNA
  Sec31b
cagctaggcgagcag

SEQ ID NO: 15775 - DNA, 15 bp, Artificial Sequence
  dgRNA
  Sec31b
agctaggcgagcaga

SEQ ID NO: 15776 - DNA, 15 bp, Artificial Sequence
  dgRNA
  Zmym5
gggccggcaggcccg

SEQ ID NO: 15777 - DNA, 15 bp, Artificial Sequence
  dgRNA
  Zmym5
ggccggcaggcccga

SEQ ID NO: 15778 - DNA, 15 bp, Artificial Sequence
  dgRNA
  Zmym5
gcaggcccgagggcg

SEQ ID NO: 15779 - DNA, 15 bp, Artificial Sequence
  dgRNA
  Zmym5
cgccctcgggcctgc

SEQ ID NO: 15780 - DNA, 15 bp, Artificial Sequence
  dgRNA
  Scg3
cccaagactgcggca

SEQ ID NO: 15781 - DNA, 15 bp, Artificial Sequence
  dgRNA
  Scg3
cccgctccgttcccg

SEQ ID NO: 15782 - DNA, 15 bp, Artificial Sequence
  dgRNA
  Scg3
ccgctccgttcccgc

SEQ ID NO: 15783 - DNA, 15 bp, Artificial Sequence
  dgRNA
  Scg3
ccgttcccgcgggat

SEQ ID NO: 15784 - DNA, 15 bp, Artificial Sequence
  dgRNA
  Acaa1a
aaggttgtgcaaact

SEQ ID NO: 15785 - DNA, 15 bp, Artificial Sequence
  dgRNA
  Acaa1a
agtgcgcattacgat

SEQ ID NO: 15786 - DNA, 15 bp, Artificial Sequence
  dgRNA
  Acaa1a
acgattggcttccgt

SEQ ID NO: 15787 - DNA, 15 bp, Artificial Sequence
  dgRNA
  Acaa1a
tggcttccgtaggat

SEQ ID NO: 15788 - DNA, 15 bp, Artificial Sequence
  dgRNA
  Trim41
aaacgcccagtccag

SEQ ID NO: 15789 - DNA, 15 bp, Artificial Sequence
  dgRNA
  Trim41
aacgcccagtccagc

SEQ ID NO: 15790 - DNA, 15 bp, Artificial Sequence
  dgRNA
  Trim41
gcccagtccagcggg

SEQ ID NO: 15791 - DNA, 15 bp, Artificial Sequence
  dgRNA
  Trim41
cccagtccagcggga

SEQ ID NO: 15792 - DNA, 15 bp, Artificial Sequence
  dgRNA
  Olfr849
ataacaaggttatgg

SEQ ID NO: 15793 - DNA, 15 bp, Artificial Sequence
  dgRNA
  Hmgn3
ggatactagttgaac

SEQ ID NO: 15794 - DNA, 15 bp, Artificial Sequence
  dgRNA
  Hmgn3
gatactagttgaact

SEQ ID NO: 15795 - DNA, 15 bp, Artificial Sequence
  dgRNA
  Hmgn3
gcatgctcagtcgcc

SEQ ID NO: 15796 - DNA, 15 bp, Artificial Sequence
  dgRNA
  Hmgn3
tacaactgcgcgtac

SEQ ID NO: 15797 - DNA, 15 bp, Artificial Sequence
  dgRNA
  S100a16
tttgctaggctgatt

SEQ ID NO: 15798 - DNA, 15 bp, Artificial Sequence
  dgRNA
  S100a16
gctaggctgatttgg

SEQ ID NO: 15799 - DNA, 15 bp, Artificial Sequence
  dgRNA
  Prkcg
atagagcctgcggaa

SEQ ID NO: 15800 - DNA, 15 bp, Artificial Sequence
  dgRNA
  Prkcg
ggcatctgtcccggg

SEQ ID NO: 15801 - DNA, 15 bp, Artificial Sequence
  dgRNA
  Prkcg
gcatctgtcccgggc

SEQ ID NO: 15802 - DNA, 15 bp, Artificial Sequence
  dgRNA
  Prkcg
atctgtcccgggcgg

SEQ ID NO: 15803 - DNA, 15 bp, Artificial Sequence
  dgRNA
  Ogfod2
caccccgctgtgact

SEQ ID NO: 15804 - DNA, 15 bp, Artificial Sequence
  dgRNA
  Ogfod2
accccgctgtgactc

SEQ ID NO: 15805 - DNA, 15 bp, Artificial Sequence
  dgRNA
  Ogfod2
ccccgctgtgactcg

SEQ ID NO: 15806 - DNA, 15 bp, Artificial Sequence
  dgRNA
  Ogfod2
cccgctgtgactcgg

SEQ ID NO: 15807 - DNA, 15 bp, Artificial Sequence
  dgRNA
  C1qtnf1
tgacgtgtttctcag

SEQ ID NO: 15808 - DNA, 15 bp, Artificial Sequence
  dgRNA
  C1qtnf1
aagttggctatgcat

SEQ ID NO: 15809 - DNA, 15 bp, Artificial Sequence
  dgRNA
  C1qtnf1
ataagccccgccctg

SEQ ID NO: 15810 - DNA, 15 bp, Artificial Sequence
  dgRNA
  C1qtnf1
aataagccccgccct

SEQ ID NO: 15811 - DNA, 15 bp, Artificial Sequence
  dgRNA
  Serpina3c
ttggtggggataaac

SEQ ID NO: 15812 - DNA, 15 bp, Artificial Sequence
  dgRNA
  Serpina3c
gtaatatggatttat

SEQ ID NO: 15813 - DNA, 15 bp, Artificial Sequence
  dgRNA
  Serpina3c
tgtttatccccacca

SEQ ID NO: 15814 - DNA, 15 bp, Artificial Sequence
  dgRNA
  Zfp251
agtacagatcttagc

SEQ ID NO: 15815 - DNA, 15 bp, Artificial Sequence
  dgRNA
  Zfp251
ctggttgaaccagag

SEQ ID NO: 15816 - DNA, 15 bp, Artificial Sequence
  dgRNA
  Zfp251
gcccagtccgtgcgt

SEQ ID NO: 15817 - DNA, 15 bp, Artificial Sequence
  dgRNA
  Zfp251
cccagtccgtgcgta

SEQ ID NO: 15818 - DNA, 15 bp, Artificial Sequence
  dgRNA
  Slc39a14
agctaggatgcgagc

SEQ ID NO: 15819 - DNA, 15 bp, Artificial Sequence
  dgRNA
  Slc39a14
gctaggatgcgagcc

SEQ ID NO: 15820 - DNA, 15 bp, Artificial Sequence
  dgRNA
  Slc39a14
ctaggatgcgagccg

SEQ ID NO: 15821 - DNA, 15 bp, Artificial Sequence
  dgRNA
  Slc39a14
ggggatgcacaacgc

SEQ ID NO: 15822 - DNA, 15 bp, Artificial Sequence
  dgRNA
  Med1
cacccttagacgcca

SEQ ID NO: 15823 - DNA, 15 bp, Artificial Sequence
  dgRNA
  Med1
gaattctgagccaat

SEQ ID NO: 15824 - DNA, 15 bp, Artificial Sequence
  dgRNA
  Med1
tgagccaatcggagc

SEQ ID NO: 15825 - DNA, 15 bp, Artificial Sequence
  dgRNA
  Med1
gagccaatcggagcc

SEQ ID NO: 15826 - DNA, 15 bp, Artificial Sequence
  dgRNA
  Aqp9
ggttacttgactatt

SEQ ID NO: 15827 - DNA, 15 bp, Artificial Sequence
  dgRNA
  Aqp9
gccaagacagttgat

SEQ ID NO: 15828 - DNA, 15 bp, Artificial Sequence
  dgRNA
  Aqp9
acattgcttcccatt

SEQ ID NO: 15829 - DNA, 15 bp, Artificial Sequence
  dgRNA
  Aqp9
gaacgaagctcttaa

SEQ ID NO: 15830 - DNA, 15 bp, Artificial Sequence
  dgRNA
  Nutf2
tagaccacaattctc

SEQ ID NO: 15831 - DNA, 15 bp, Artificial Sequence
  dgRNA
  Nutf2
agaccacaattctca

SEQ ID NO: 15832 - DNA, 15 bp, Artificial Sequence
  dgRNA
  Nutf2
ccgcgctgcgagccg

SEQ ID NO: 15833 - DNA, 15 bp, Artificial Sequence
  dgRNA
  Nutf2
ctgcgcctctgcgaa

SEQ ID NO: 15834 - DNA, 15 bp, Artificial Sequence
  dgRNA
  Dynlt3
cacttaaaacctagc

SEQ ID NO: 15835 - DNA, 15 bp, Artificial Sequence
  dgRNA
  Dynlt3
acttaaaacctagca

SEQ ID NO: 15836 - DNA, 15 bp, Artificial Sequence
  dgRNA
  Dynlt3
cttaaaacctagcag

SEQ ID NO: 15837 - DNA, 15 bp, Artificial Sequence
  dgRNA
  Dynlt3
ccttagccccgctaa

SEQ ID NO: 15838 - DNA, 15 bp, Artificial Sequence
  dgRNA
  Mrpl15
catagcctaccgacg

SEQ ID NO: 15839 - DNA, 15 bp, Artificial Sequence
  dgRNA
  Mrpl15
ctaccgacgcggatg

SEQ ID NO: 15840 - DNA, 15 bp, Artificial Sequence
  dgRNA
  Mrpl15
gctctgcagcacgac

SEQ ID NO: 15841 - DNA, 15 bp, Artificial Sequence
  dgRNA
  Mrpl15
ctctgcagcacgaca

SEQ ID NO: 15842 - DNA, 15 bp, Artificial Sequence
  dgRNA
  Cspg4
ccttcaatcctaacc

SEQ ID NO: 15843 - DNA, 15 bp, Artificial Sequence
  dgRNA
  Cspg4
cccctttaagaaagt

SEQ ID NO: 15844 - DNA, 15 bp, Artificial Sequence
  dgRNA
  Cspg4
cccgaaatctaagcg

SEQ ID NO: 15845 - DNA, 15 bp, Artificial Sequence
  dgRNA
  Cspg4
ccgaaatctaagcgc

SEQ ID NO: 15846 - DNA, 15 bp, Artificial Sequence
  dgRNA
  Txndc8
gataagagagccgat

SEQ ID NO: 15847 - DNA, 15 bp, Artificial Sequence
  dgRNA
  Txndc8
ccgacccccgttttc

SEQ ID NO: 15848 - DNA, 15 bp, Artificial Sequence
  dgRNA
  Txndc8
cgacccccgttttca

SEQ ID NO: 15849 - DNA, 15 bp, Artificial Sequence
  dgRNA
  Txndc8
cccgttttcagggtc

SEQ ID NO: 15850 - DNA, 15 bp, Artificial Sequence
  dgRNA
  Fam173b
tgttcgaaacttaga

SEQ ID NO: 15851 - DNA, 15 bp, Artificial Sequence
  dgRNA
  Fam173b
gtagtcactgattca

SEQ ID NO: 15852 - DNA, 15 bp, Artificial Sequence
  dgRNA
  Fam173b
tccagagttgcagcg

SEQ ID NO: 15853 - DNA, 15 bp, Artificial Sequence
  dgRNA
  Fam173b
tctttgattgccgcc

SEQ ID NO: 15854 - DNA, 15 bp, Artificial Sequence
  dgRNA
  Elovl7
accctgggttgctcg

SEQ ID NO: 15855 - DNA, 15 bp, Artificial Sequence
  dgRNA
  Elovl7
gggttgctcggggcc

SEQ ID NO: 15856 - DNA, 15 bp, Artificial Sequence
  dgRNA
  Elovl7
gccaggctctacccg

SEQ ID NO: 15857 - DNA, 15 bp, Artificial Sequence
  dgRNA
  Elovl7
gctctacccgcggcg

SEQ ID NO: 15858 - DNA, 15 bp, Artificial Sequence
  dgRNA
  Skint5
gcttgtagaatcatt

SEQ ID NO: 15859 - DNA, 15 bp, Artificial Sequence
  dgRNA
  Skint5
tttggccagatattc

SEQ ID NO: 15860 - DNA, 15 bp, Artificial Sequence
  dgRNA
  Skint5
ttggccagatattca

SEQ ID NO: 15861 - DNA, 15 bp, Artificial Sequence
  dgRNA
  Skint5
attcagggtaggtga

SEQ ID NO: 15862 - DNA, 15 bp, Artificial Sequence
  dgRNA
  Snx12
gagatgcaggttccg

SEQ ID NO: 15863 - DNA, 15 bp, Artificial Sequence
  dgRNA
  Snx12
gctaccagtaccacc

SEQ ID NO: 15864 - DNA, 15 bp, Artificial Sequence
  dgRNA
  Snx12
cagccctagtctgca

SEQ ID NO: 15865 - DNA, 15 bp, Artificial Sequence
  dgRNA
  Snx12
gaagggcccgaggct

SEQ ID NO: 15866 - DNA, 15 bp, Artificial Sequence
  dgRNA
  Mbd2
ggtaaccacatacaa

SEQ ID NO: 15867 - DNA, 15 bp, Artificial Sequence
  dgRNA
  Mbd2
tccttacaacgtagc

SEQ ID NO: 15868 - DNA, 15 bp, Artificial Sequence
  dgRNA
  Mbd2
cggccacgcttgaca

SEQ ID NO: 15869 - DNA, 15 bp, Artificial Sequence
  dgRNA
  Mbd2
ggccacgcttgacac

SEQ ID NO: 15870 - DNA, 15 bp, Artificial Sequence
  dgRNA
  Armc4
agcagcagcgactag

SEQ ID NO: 15871 - DNA, 15 bp, Artificial Sequence
  dgRNA
  Armc4
gcagcgactagaggc

SEQ ID NO: 15872 - DNA, 15 bp, Artificial Sequence
  dgRNA
  Armc4
ctggggcttccagcg

SEQ ID NO: 15873 - DNA, 15 bp, Artificial Sequence
  dgRNA
  Armc4
gggcttccagcgcgg

SEQ ID NO: 15874 - DNA, 15 bp, Artificial Sequence
  dgRNA
  Usp46
accgagcgggaccct

SEQ ID NO: 15875 - DNA, 15 bp, Artificial Sequence
  dgRNA
  Usp46
ccgagcgggacccta

SEQ ID NO: 15876 - DNA, 15 bp, Artificial Sequence
  dgRNA
  Usp46
aagaacggcttccag

SEQ ID NO: 15877 - DNA, 15 bp, Artificial Sequence
  dgRNA
  Usp46
agaacggcttccagt

SEQ ID NO: 15878 - DNA, 15 bp, Artificial Sequence
  dgRNA
  Defb30
agatcttgcatttgc

SEQ ID NO: 15879 - DNA, 15 bp, Artificial Sequence
  dgRNA
  Defb30
gctagtgaaccttgg

SEQ ID NO: 15880 - DNA, 15 bp, Artificial Sequence
  dgRNA
  Defb30
ggctagtgaaccttg

SEQ ID NO: 15881 - DNA, 15 bp, Artificial Sequence
  dgRNA
  Defb30
atataaggatttgcg

SEQ ID NO: 15882 - DNA, 15 bp, Artificial Sequence
  dgRNA
  Ccdc126
gtcgccctgagcccc

SEQ ID NO: 15883 - DNA, 15 bp, Artificial Sequence
  dgRNA
  Ccdc126
tcgccctgagcccct

SEQ ID NO: 15884 - DNA, 15 bp, Artificial Sequence
  dgRNA
  Ccdc126
tgtctctccgcaagg

SEQ ID NO: 15885 - DNA, 15 bp, Artificial Sequence
  dgRNA
  Ccdc126
gtctctccgcaaggc

SEQ ID NO: 15886 - DNA, 15 bp, Artificial Sequence
  dgRNA
  Cmtr2
tcagagcctcgcagc

SEQ ID NO: 15887 - DNA, 15 bp, Artificial Sequence
  dgRNA
  Cmtr2
gagcctcgcagccgg

SEQ ID NO: 15888 - DNA, 15 bp, Artificial Sequence
  dgRNA
  Cmtr2
agcctcgcagccggt

SEQ ID NO: 15889 - DNA, 15 bp, Artificial Sequence
  dgRNA
  Cmtr2
gcctcgcagccggtg

SEQ ID NO: 15890 - DNA, 15 bp, Artificial Sequence
  dgRNA
  Pms1
agccttcgagcttac

SEQ ID NO: 15891 - DNA, 15 bp, Artificial Sequence
  dgRNA
  Pms1
ccggccgccagctcc

SEQ ID NO: 15892 - DNA, 15 bp, Artificial Sequence
  dgRNA
  Pms1
acaggacaattcccg

SEQ ID NO: 15893 - DNA, 15 bp, Artificial Sequence
  dgRNA
  Pms1
cgcggcagccacagt

SEQ ID NO: 15894 - DNA, 15 bp, Artificial Sequence
  dgRNA
  Mpzl2
gcttgtgaggccatc

SEQ ID NO: 15895 - DNA, 15 bp, Artificial Sequence
  dgRNA
  Mpzl2
tgtgaggccatccgg

SEQ ID NO: 15896 - DNA, 15 bp, Artificial Sequence
  dgRNA
  Mpzl2
ggccatccggaggcc

SEQ ID NO: 15897 - DNA, 15 bp, Artificial Sequence
  dgRNA
  Mpzl2
gccatccggaggcca

SEQ ID NO: 15898 - DNA, 15 bp, Artificial Sequence
  dgRNA
  Ccdc17
ctgtactcgctgccc

SEQ ID NO: 15899 - DNA, 15 bp, Artificial Sequence
  dgRNA
  Ccdc17
tgtactcgctgccca

SEQ ID NO: 15900 - DNA, 15 bp, Artificial Sequence
  dgRNA
  Ccdc17
gcgatttagcagact

SEQ ID NO: 15901 - DNA, 15 bp, Artificial Sequence
  dgRNA
  Ccdc17
agtacaggcttaggc

SEQ ID NO: 15902 - DNA, 15 bp, Artificial Sequence
  dgRNA
  Msmb
aagaacacccacgag

SEQ ID NO: 15903 - DNA, 15 bp, Artificial Sequence
  dgRNA
  Msmb
cctgtataaatagga

SEQ ID NO: 15904 - DNA, 15 bp, Artificial Sequence
  dgRNA
  Msmb
ggttttctaggcact

SEQ ID NO: 15905 - DNA, 15 bp, Artificial Sequence
  dgRNA
  Msmb
ctgtgcttatcacta

SEQ ID NO: 15906 - DNA, 15 bp, Artificial Sequence
  dgRNA
  Rnf6
gaggaggacgtgcta

SEQ ID NO: 15907 - DNA, 15 bp, Artificial Sequence
  dgRNA
  Rnf6
aggaggacgtgctag

SEQ ID NO: 15908 - DNA, 15 bp, Artificial Sequence
  dgRNA
  Rnf6
ggaggacgtgctagg

SEQ ID NO: 15909 - DNA, 15 bp, Artificial Sequence
  dgRNA
  Rnf6
ggacgtgctaggggg

SEQ ID NO: 15910 - DNA, 15 bp, Artificial Sequence
  dgRNA
  Cgref1
tgcgtatgacaggct

SEQ ID NO: 15911 - DNA, 15 bp, Artificial Sequence
  dgRNA
  Cgref1
gtgcgtatgacaggc

SEQ ID NO: 15912 - DNA, 15 bp, Artificial Sequence
  dgRNA
  Cgref1
gtatgtgcgtatgac

SEQ ID NO: 15913 - DNA, 15 bp, Artificial Sequence
  dgRNA
  Rwdd3
gccgacctggctgtg

SEQ ID NO: 15914 - DNA, 15 bp, Artificial Sequence
  dgRNA
  Rwdd3
ccccccagtgaccgt

SEQ ID NO: 15915 - DNA, 15 bp, Artificial Sequence
  dgRNA
  Rwdd3
cccccagtgaccgta

SEQ ID NO: 15916 - DNA, 15 bp, Artificial Sequence
  dgRNA
  Rwdd3
ccccagtgaccgtag

SEQ ID NO: 15917 - DNA, 15 bp, Artificial Sequence
  dgRNA
  Gsdmc
taaccagtgcctgac

SEQ ID NO: 15918 - DNA, 15 bp, Artificial Sequence
  dgRNA
  Gsdmc
aggtgtacccctgga

SEQ ID NO: 15919 - DNA, 15 bp, Artificial Sequence
  dgRNA
  Gsdmc
tggcaggtgtacccc

SEQ ID NO: 15920 - DNA, 15 bp, Artificial Sequence
  dgRNA
  Slc7a9
aagtagctgatctag

SEQ ID NO: 15921 - DNA, 15 bp, Artificial Sequence
  dgRNA
  Slc7a9
ctggcggtgtctatc

SEQ ID NO: 15922 - DNA, 15 bp, Artificial Sequence
  dgRNA
  Slc7a9
tggcggtgtctatct

SEQ ID NO: 15923 - DNA, 15 bp, Artificial Sequence
  dgRNA
  Slc7a9
gctttgttgcctaga

SEQ ID NO: 15924 - DNA, 15 bp, Artificial Sequence
  dgRNA
  Pcdha4
aacgggaaacctatt

SEQ ID NO: 15925 - DNA, 15 bp, Artificial Sequence
  dgRNA
  Pcdha4
aatagatcctacaga

SEQ ID NO: 15926 - DNA, 15 bp, Artificial Sequence
  dgRNA
  Pcdha4
gctttccgagaagag

SEQ ID NO: 15927 - DNA, 15 bp, Artificial Sequence
  dgRNA
  Kat6b
tccgggctgcgcccc

SEQ ID NO: 15928 - DNA, 15 bp, Artificial Sequence
  dgRNA
  Kat6b
ggctgcgcccccggc

SEQ ID NO: 15929 - DNA, 15 bp, Artificial Sequence
  dgRNA
  Kat6b
cccggccgggccagg

SEQ ID NO: 15930 - DNA, 15 bp, Artificial Sequence
  dgRNA
  Kat6b
ggccaggcgggctag

SEQ ID NO: 15931 - DNA, 15 bp, Artificial Sequence
  dgRNA
  Adcy9
gggcgctgctgcggc

SEQ ID NO: 15932 - DNA, 15 bp, Artificial Sequence
  dgRNA
  Adcy9
tgcgaaagctgctcc

SEQ ID NO: 15933 - DNA, 15 bp, Artificial Sequence
  dgRNA
  Adcy9
tgccccgagcgctca

SEQ ID NO: 15934 - DNA, 15 bp, Artificial Sequence
  dgRNA
  Adcy9
cagttggagttgcac

SEQ ID NO: 15935 - DNA, 15 bp, Artificial Sequence
  dgRNA
  Zfp672
gcgtggacacccgaa

SEQ ID NO: 15936 - DNA, 15 bp, Artificial Sequence
  dgRNA
  Zfp672
cccgaacggagagac

SEQ ID NO: 15937 - DNA, 15 bp, Artificial Sequence
  dgRNA
  Zfp672
gccctgtgacactgt

SEQ ID NO: 15938 - DNA, 15 bp, Artificial Sequence
  dgRNA
  Zfp672
actccgccctctgcc

SEQ ID NO: 15939 - DNA, 15 bp, Artificial Sequence
  dgRNA
  Msh3
ccacttgcgcagctt

SEQ ID NO: 15940 - DNA, 15 bp, Artificial Sequence
  dgRNA
  Msh3
gctccgcccctacca

SEQ ID NO: 15941 - DNA, 15 bp, Artificial Sequence
  dgRNA
  Msh3
aaggctccgccccca

SEQ ID NO: 15942 - DNA, 15 bp, Artificial Sequence
  dgRNA
  Msh3
cctaagctgcgcaag

SEQ ID NO: 15943 - DNA, 15 bp, Artificial Sequence
  dgRNA
  Pnmt
gggcaaagagtcttt

SEQ ID NO: 15944 - DNA, 15 bp, Artificial Sequence
  dgRNA
  Pnmt
gagctggggtaccgc

SEQ ID NO: 15945 - DNA, 15 bp, Artificial Sequence
  dgRNA
  Pnmt
gtaccgctggaactg

SEQ ID NO: 15946 - DNA, 15 bp, Artificial Sequence
  dgRNA
  Pnmt
agccctggagcgatc

SEQ ID NO: 15947 - DNA, 15 bp, Artificial Sequence
  dgRNA
  Arfgef1
gaggcgccgccacct

SEQ ID NO: 15948 - DNA, 15 bp, Artificial Sequence
  dgRNA
  Arfgef1
ctaggccctcggccc

SEQ ID NO: 15949 - DNA, 15 bp, Artificial Sequence
  dgRNA
  Arfgef1
taggccctcggcccc

SEQ ID NO: 15950 - DNA, 15 bp, Artificial Sequence
  dgRNA
  Arfgef1
tcggccccgggaaga

SEQ ID NO: 15951 - DNA, 15 bp, Artificial Sequence
  dgRNA
  Psma3
gattattagctactt

SEQ ID NO: 15952 - DNA, 15 bp, Artificial Sequence
  dgRNA
  Psma3
ctacttaggactatt

SEQ ID NO: 15953 - DNA, 15 bp, Artificial Sequence
  dgRNA
  Psma3
ggactattaggaact

SEQ ID NO: 15954 - DNA, 15 bp, Artificial Sequence
  dgRNA
  Psma3
agtagcaacttctcc

SEQ ID NO: 15955 - DNA, 15 bp, Artificial Sequence
  dgRNA
  Cabp1
tgttgatgatcctaa

SEQ ID NO: 15956 - DNA, 15 bp, Artificial Sequence
  dgRNA
  Cabp1
gtgatctactctcca

SEQ ID NO: 15957 - DNA, 15 bp, Artificial Sequence
  dgRNA
  Cabp1
cgctgggaagccttt

SEQ ID NO: 15958 - DNA, 15 bp, Artificial Sequence
  dgRNA
  Cabp1
gagggcactggcgct

SEQ ID NO: 15959 - DNA, 15 bp, Artificial Sequence
  dgRNA
  Tnfrsf23
tgttaataacgtcac

SEQ ID NO: 15960 - DNA, 15 bp, Artificial Sequence
  dgRNA
  Tnfrsf23
cccgcccacgagatt

SEQ ID NO: 15961 - DNA, 15 bp, Artificial Sequence
  dgRNA
  Tnfrsf23
caatccgctgacaag

SEQ ID NO: 15962 - DNA, 15 bp, Artificial Sequence
  dgRNA
  Tnfrsf23
cgctgacaagaggcg

SEQ ID NO: 15963 - DNA, 15 bp, Artificial Sequence
  dgRNA
  Adat1
agatgcgagctaagt

SEQ ID NO: 15964 - DNA, 15 bp, Artificial Sequence
  dgRNA
  Adat1
agtcggtctttgctg

SEQ ID NO: 15965 - DNA, 15 bp, Artificial Sequence
  dgRNA
  Adat1
cggtctttgctgcgg

SEQ ID NO: 15966 - DNA, 15 bp, Artificial Sequence
  dgRNA
  Adat1
tctttgctgcggagg

SEQ ID NO: 15967 - DNA, 15 bp, Artificial Sequence
  dgRNA
  Hspa9
accgtgatgagagaa

SEQ ID NO: 15968 - DNA, 15 bp, Artificial Sequence
  dgRNA
  Hspa9
ccgtgatgagagaac

SEQ ID NO: 15969 - DNA, 15 bp, Artificial Sequence
  dgRNA
  Hspa9
acgattaatgctgag

SEQ ID NO: 15970 - DNA, 15 bp, Artificial Sequence
  dgRNA
  Hspa9
tgctgagaggcgtgc

SEQ ID NO: 15971 - DNA, 15 bp, Artificial Sequence
  dgRNA
  Dscam
agagctacacacgat

SEQ ID NO: 15972 - DNA, 15 bp, Artificial Sequence
  dgRNA
  Dscam
acacgatgggctgtg

SEQ ID NO: 15973 - DNA, 15 bp, Artificial Sequence
  dgRNA
  Dscam
cacgatgggctgtgt

SEQ ID NO: 15974 - DNA, 15 bp, Artificial Sequence
  dgRNA
  Dscam
acgatgggctgtgtg

SEQ ID NO: 15975 - DNA, 15 bp, Artificial Sequence
  dgRNA
  Sdcbp2
gccccacccactcgt

SEQ ID NO: 15976 - DNA, 15 bp, Artificial Sequence
  dgRNA
  Sdcbp2
tttaccgagccacac

SEQ ID NO: 15977 - DNA, 15 bp, Artificial Sequence
  dgRNA
  Sdcbp2
gcccatcctagtcca

SEQ ID NO: 15978 - DNA, 15 bp, Artificial Sequence
  dgRNA
  Sdcbp2
aagtcagcacgactg

SEQ ID NO: 15979 - DNA, 15 bp, Artificial Sequence
  dgRNA
  Cblc
tccctcagactctac

SEQ ID NO: 15980 - DNA, 15 bp, Artificial Sequence
  dgRNA
  Cblc
cctacagtcccctcc

SEQ ID NO: 15981 - DNA, 15 bp, Artificial Sequence
  dgRNA
  Cblc
ggtcccgcccctacc

SEQ ID NO: 15982 - DNA, 15 bp, Artificial Sequence
  dgRNA
  Cblc
gcctgtagagtctga

SEQ ID NO: 15983 - DNA, 15 bp, Artificial Sequence
  dgRNA
  Clp1
tcccacacaaagtga

SEQ ID NO: 15984 - DNA, 15 bp, Artificial Sequence
  dgRNA
  Clp1
tcgccctcgggaggg

SEQ ID NO: 15985 - DNA, 15 bp, Artificial Sequence
  dgRNA
  Clp1
ggttcgccctcggga

SEQ ID NO: 15986 - DNA, 15 bp, Artificial Sequence
  dgRNA
  Clp1
tggttcgccctcggg

SEQ ID NO: 15987 - DNA, 15 bp, Artificial Sequence
  dgRNA
  Smad3
cgtgaaacgtagact

SEQ ID NO: 15988 - DNA, 15 bp, Artificial Sequence
  dgRNA
  Smad3
gtgaaacgtagactt

SEQ ID NO: 15989 - DNA, 15 bp, Artificial Sequence
  dgRNA
  Smad3
acgtagacttgggag

SEQ ID NO: 15990 - DNA, 15 bp, Artificial Sequence
  dgRNA
  Smad3
cgtagacttgggagc

SEQ ID NO: 15991 - DNA, 15 bp, Artificial Sequence
  dgRNA
  Itpkc
aacttgttactgggg

SEQ ID NO: 15992 - DNA, 15 bp, Artificial Sequence
  dgRNA
  Itpkc
cggagtaagtgatgt

SEQ ID NO: 15993 - DNA, 15 bp, Artificial Sequence
  dgRNA
  Itpkc
ggagtaagtgatgta

SEQ ID NO: 15994 - DNA, 15 bp, Artificial Sequence
  dgRNA
  Itpkc
tgtagggaaagatcg

SEQ ID NO: 15995 - DNA, 15 bp, Artificial Sequence
  dgRNA
  Gm9733
ctcttaaacctgtct

SEQ ID NO: 15996 - DNA, 15 bp, Artificial Sequence
  dgRNA
  Fpgs
ggaggaccccctccc

SEQ ID NO: 15997 - DNA, 15 bp, Artificial Sequence
  dgRNA
  Fpgs
cgccccctagaagca

SEQ ID NO: 15998 - DNA, 15 bp, Artificial Sequence
  dgRNA
  Fpgs
agagcagcgcacctc

SEQ ID NO: 15999 - DNA, 15 bp, Artificial Sequence
  dgRNA
  Fpgs
aagatggccgtgata

SEQ ID NO: 16000 - DNA, 15 bp, Artificial Sequence
  dgRNA
  Ric8b
cctaggggagtaggc

SEQ ID NO: 16001 - DNA, 15 bp, Artificial Sequence
  dgRNA
  Ric8b
gccccgggccttgtc

SEQ ID NO: 16002 - DNA, 15 bp, Artificial Sequence
  dgRNA
  Ric8b
ccccgggccttgtca

SEQ ID NO: 16003 - DNA, 15 bp, Artificial Sequence
  dgRNA
  Ric8b
cccgggccttgtcag

SEQ ID NO: 16004 - DNA, 15 bp, Artificial Sequence
  dgRNA
  Cyb5r2
gctgctgacatgcgc

SEQ ID NO: 16005 - DNA, 15 bp, Artificial Sequence
  dgRNA
  Cyb5r2
gagggatccctgcat

SEQ ID NO: 16006 - DNA, 15 bp, Artificial Sequence
  dgRNA
  Cyb5r2
cctgcatagggatct

SEQ ID NO: 16007 - DNA, 15 bp, Artificial Sequence
  dgRNA
  Cyb5r2
tcgaatccgtcgcta

SEQ ID NO: 16008 - DNA, 15 bp, Artificial Sequence
  dgRNA
  D8Ertd738e
tgcgccgctctgtgt

SEQ ID NO: 16009 - DNA, 15 bp, Artificial Sequence
  dgRNA
  D8Ertd738e
gcgccgctctgtgtc

SEQ ID NO: 16010 - DNA, 15 bp, Artificial Sequence
  dgRNA
  D8Ertd738e
taccattttcagggg

SEQ ID NO: 16011 - DNA, 15 bp, Artificial Sequence
  dgRNA
  D8Ertd738e
gtctaaaaagttgga

SEQ ID NO: 16012 - DNA, 15 bp, Artificial Sequence
  dgRNA
  Sun1
gggccgcacctaggg

SEQ ID NO: 16013 - DNA, 15 bp, Artificial Sequence
  dgRNA
  Hmgcll1
cagtgccaaccctac

SEQ ID NO: 16014 - DNA, 15 bp, Artificial Sequence
  dgRNA
  Hmgcll1
aaccctacaggcttg

SEQ ID NO: 16015 - DNA, 15 bp, Artificial Sequence
  dgRNA
  Hmgcll1
caccatattttacgg

SEQ ID NO: 16016 - DNA, 15 bp, Artificial Sequence
  dgRNA
  Hmgcll1
accatattttacgga

SEQ ID NO: 16017 - DNA, 15 bp, Artificial Sequence
  dgRNA
  Cemip
ctgcggctcccggag

SEQ ID NO: 16018 - DNA, 15 bp, Artificial Sequence
  dgRNA
  Cemip
ccgccagagcccgcc

SEQ ID NO: 16019 - DNA, 15 bp, Artificial Sequence
  dgRNA
  Cemip
cgccagagcccgccc

SEQ ID NO: 16020 - DNA, 15 bp, Artificial Sequence
  dgRNA
  Cemip
cgggtccagccccgc

SEQ ID NO: 16021 - DNA, 15 bp, Artificial Sequence
  dgRNA
  Vmn1r22
acgcaagaatttttt

SEQ ID NO: 16022 - DNA, 15 bp, Artificial Sequence
  dgRNA
  Vmn1r22
cgcaagaatttttta

SEQ ID NO: 16023 - DNA, 15 bp, Artificial Sequence
  dgRNA
  Vmn1r22
tatagtaatactgtg

SEQ ID NO: 16024 - DNA, 15 bp, Artificial Sequence
  dgRNA
  Paip2b
cgagggcggagcgaa

SEQ ID NO: 16025 - DNA, 15 bp, Artificial Sequence
  dgRNA
  Paip2b
agaccaatcaaaacc

SEQ ID NO: 16026 - DNA, 15 bp, Artificial Sequence
  dgRNA
  Paip2b
gtccaatagatggac

SEQ ID NO: 16027 - DNA, 15 bp, Artificial Sequence
  dgRNA
  Paip2b
tccaatagatggacg

SEQ ID NO: 16028 - DNA, 15 bp, Artificial Sequence
  dgRNA
  Cpne6
tcctccgtgtggatg

SEQ ID NO: 16029 - DNA, 15 bp, Artificial Sequence
  dgRNA
  Cpne6
tcactgtgtctgcgg

SEQ ID NO: 16030 - DNA, 15 bp, Artificial Sequence
  dgRNA
  Cpne6
gcacccacgactcac

SEQ ID NO: 16031 - DNA, 15 bp, Artificial Sequence
  dgRNA
  Cpne6
gaaggatgcgacgca

SEQ ID NO: 16032 - DNA, 15 bp, Artificial Sequence
  dgRNA
  St6galnac4
acctcgcccccagcc

SEQ ID NO: 16033 - DNA, 15 bp, Artificial Sequence
  dgRNA
  St6galnac4
tcgcccccagcccgg

SEQ ID NO: 16034 - DNA, 15 bp, Artificial Sequence
  dgRNA
  St6galnac4
ccacgcgccgctagc

SEQ ID NO: 16035 - DNA, 15 bp, Artificial Sequence
  dgRNA
  St6galnac4
tagccggcgctgcgc

SEQ ID NO: 16036 - DNA, 15 bp, Artificial Sequence
  dgRNA
  Skp2
tccttcaatcccgcc

SEQ ID NO: 16037 - DNA, 15 bp, Artificial Sequence
  dgRNA
  Skp2
ccgcccggcgccgca

SEQ ID NO: 16038 - DNA, 15 bp, Artificial Sequence
  dgRNA
  Skp2
cgccgcagggagttg

SEQ ID NO: 16039 - DNA, 15 bp, Artificial Sequence
  dgRNA
  Skp2
gccgcagggagttgt

SEQ ID NO: 16040 - DNA, 15 bp, Artificial Sequence
  dgRNA
  Snx7
cagaggcggccggct

SEQ ID NO: 16041 - DNA, 15 bp, Artificial Sequence
  dgRNA
  Snx7
ctgggcgcgcactgc

SEQ ID NO: 16042 - DNA, 15 bp, Artificial Sequence
  dgRNA
  Snx7
tgggcgcgcactgcc

SEQ ID NO: 16043 - DNA, 15 bp, Artificial Sequence
  dgRNA
  Snx7
cgcgcactgccggga

SEQ ID NO: 16044 - DNA, 15 bp, Artificial Sequence
  dgRNA
  Pih1d2
cagccccggcgctct

SEQ ID NO: 16045 - DNA, 15 bp, Artificial Sequence
  dgRNA
  Pih1d2
ccccggcgctctcgg

SEQ ID NO: 16046 - DNA, 15 bp, Artificial Sequence
  dgRNA
  Pih1d2
cgccgcagcctcgcg

SEQ ID NO: 16047 - DNA, 15 bp, Artificial Sequence
  dgRNA
  Pih1d2
cgcagcctcgcgtgg

SEQ ID NO: 16048 - DNA, 15 bp, Artificial Sequence
  dgRNA
  Stk40
attggcgatcttatc

SEQ ID NO: 16049 - DNA, 15 bp, Artificial Sequence
  dgRNA
  Stk40
ttggcgatcttatct

SEQ ID NO: 16050 - DNA, 15 bp, Artificial Sequence
  dgRNA
  Stk40
cgcccatcctgaaga

SEQ ID NO: 16051 - DNA, 15 bp, Artificial Sequence
  dgRNA
  Stk40
ccccaaactcaggcg

SEQ ID NO: 16052 - DNA, 15 bp, Artificial Sequence
  dgRNA
  Lnx1
cgtaccagctgcttc

SEQ ID NO: 16053 - DNA, 15 bp, Artificial Sequence
  dgRNA
  Lnx1
cagtccgaatcctgc

SEQ ID NO: 16054 - DNA, 15 bp, Artificial Sequence
  dgRNA
  Lnx1
tccgaatcctgcagg

SEQ ID NO: 16055 - DNA, 15 bp, Artificial Sequence
  dgRNA
  Lnx1
ccgaatcctgcagga

SEQ ID NO: 16056 - DNA, 15 bp, Artificial Sequence
  dgRNA
  Pias4
gagaaatgaggcggc

SEQ ID NO: 16057 - DNA, 15 bp, Artificial Sequence
  dgRNA
  Pias4
cttgaaaaataaccg

SEQ ID NO: 16058 - DNA, 15 bp, Artificial Sequence
  dgRNA
  Pias4
ttgaaaaataaccgt

SEQ ID NO: 16059 - DNA, 15 bp, Artificial Sequence
  dgRNA
  Pias4
tgaaaaataaccgtg

SEQ ID NO: 16060 - DNA, 15 bp, Artificial Sequence
  dgRNA
  Rps15a
atgccaaaaccctag

SEQ ID NO: 16061 - DNA, 15 bp, Artificial Sequence
  dgRNA
  Rps15a
gccccgccctcgcat

SEQ ID NO: 16062 - DNA, 15 bp, Artificial Sequence
  dgRNA
  Rps15a
cattaacgccactgc

SEQ ID NO: 16063 - DNA, 15 bp, Artificial Sequence
  dgRNA
  Rps15a
gcattaacgccactg

SEQ ID NO: 16064 - DNA, 15 bp, Artificial Sequence
  dgRNA
  Rbm12b1
gctttatattaccta

SEQ ID NO: 16065 - DNA, 15 bp, Artificial Sequence
  dgRNA
  Rbm12b1
agagcgcccctgttg

SEQ ID NO: 16066 - DNA, 15 bp, Artificial Sequence
  dgRNA
  Rbm12b1
gagcgcccctgttgt

SEQ ID NO: 16067 - DNA, 15 bp, Artificial Sequence
  dgRNA
  Rbm12b1
tcggtttgtctggac

SEQ ID NO: 16068 - DNA, 15 bp, Artificial Sequence
  dgRNA
  Dab2ip
ttcttcggacgggac

SEQ ID NO: 16069 - DNA, 15 bp, Artificial Sequence
  dgRNA
  Dab2ip
tcttcggacgggaca

SEQ ID NO: 16070 - DNA, 15 bp, Artificial Sequence
  dgRNA
  Dab2ip
cttcggacgggacag

SEQ ID NO: 16071 - DNA, 15 bp, Artificial Sequence
  dgRNA
  Dab2ip
tcgggccgcgtcgcc

SEQ ID NO: 16072 - DNA, 15 bp, Artificial Sequence
  dgRNA
  Zfp296
ttttttgcaccctcc

SEQ ID NO: 16073 - DNA, 15 bp, Artificial Sequence
  dgRNA
  Zfp296
tttttgcaccctccc

SEQ ID NO: 16074 - DNA, 15 bp, Artificial Sequence
  dgRNA
  Zfp296
tcccgggtgaaatca

SEQ ID NO: 16075 - DNA, 15 bp, Artificial Sequence
  dgRNA
  Zfp296
gcacaatttgcatac

SEQ ID NO: 16076 - DNA, 15 bp, Artificial Sequence
  dgRNA
  Pah
gagaatccatactcc

SEQ ID NO: 16077 - DNA, 15 bp, Artificial Sequence
  dgRNA
  Pah
gcctgtctgagcgtc

SEQ ID NO: 16078 - DNA, 15 bp, Artificial Sequence
  dgRNA
  Pah
tgagcgtcaggatgt

SEQ ID NO: 16079 - DNA, 15 bp, Artificial Sequence
  dgRNA
  Pah
aggatgtaggtagtc

SEQ ID NO: 16080 - DNA, 15 bp, Artificial Sequence
  dgRNA
  Syk
caggttgtgtagctt

SEQ ID NO: 16081 - DNA, 15 bp, Artificial Sequence
  dgRNA
  Syk
tcagcgtgacaatcc

SEQ ID NO: 16082 - DNA, 15 bp, Artificial Sequence
  dgRNA
  Syk
tggcgattcttgacc

SEQ ID NO: 16083 - DNA, 15 bp, Artificial Sequence
  dgRNA
  Faiml
cccagcaacggagtc

SEQ ID NO: 16084 - DNA, 15 bp, Artificial Sequence
  dgRNA
  Faiml
ttgtgcgttgctcac

SEQ ID NO: 16085 - DNA, 15 bp, Artificial Sequence
  dgRNA
  Faiml
tgtgcgttgctcaca

SEQ ID NO: 16086 - DNA, 15 bp, Artificial Sequence
  dgRNA
  Faiml
gcgttgctcacaggg

SEQ ID NO: 16087 - DNA, 15 bp, Artificial Sequence
  dgRNA
  Fam122c
tatcaatcttttaag

SEQ ID NO: 16088 - DNA, 15 bp, Artificial Sequence
  dgRNA
  Fam122c
ggaatgggctatttg

SEQ ID NO: 16089 - DNA, 15 bp, Artificial Sequence
  dgRNA
  Fam122c
gttggcttactcttg

SEQ ID NO: 16090 - DNA, 15 bp, Artificial Sequence
  dgRNA
  Fam122c
actttaaggttgcta

SEQ ID NO: 16091 - DNA, 15 bp, Artificial Sequence
  dgRNA
  Nedd8
ccgctaacaccagtt

SEQ ID NO: 16092 - DNA, 15 bp, Artificial Sequence
  dgRNA
  Nedd8
ctaacaccagttcgg

SEQ ID NO: 16093 - DNA, 15 bp, Artificial Sequence
  dgRNA
  Nedd8
ttcggtggccacgcg

SEQ ID NO: 16094 - DNA, 15 bp, Artificial Sequence
  dgRNA
  Nedd8
tcggtggccacgcgc

SEQ ID NO: 16095 - DNA, 15 bp, Artificial Sequence
  dgRNA
  Zc3h14
accaggtaaccccgt

SEQ ID NO: 16096 - DNA, 15 bp, Artificial Sequence
  dgRNA
  Zc3h14
tggtcgccagagcac

SEQ ID NO: 16097 - DNA, 15 bp, Artificial Sequence
  dgRNA
  Zc3h14
cagacgcatgcgcgt

SEQ ID NO: 16098 - DNA, 15 bp, Artificial Sequence
  dgRNA
  Zc3h14
gctcccacttgcacg

SEQ ID NO: 16099 - DNA, 15 bp, Artificial Sequence
  dgRNA
  Mfge8
actggcagcggcatc

SEQ ID NO: 16100 - DNA, 15 bp, Artificial Sequence
  dgRNA
  Mfge8
ctggcagcggcatca

SEQ ID NO: 16101 - DNA, 15 bp, Artificial Sequence
  dgRNA
  Mfge8
agcggcatcagggcg

SEQ ID NO: 16102 - DNA, 15 bp, Artificial Sequence
  dgRNA
  Mfge8
cagggcgtggctcgc

SEQ ID NO: 16103 - DNA, 15 bp, Artificial Sequence
  dgRNA
  Wdr45
ttccggaacttccct

SEQ ID NO: 16104 - DNA, 15 bp, Artificial Sequence
  dgRNA
  Wdr45
cggaacttccctcgg

SEQ ID NO: 16105 - DNA, 15 bp, Artificial Sequence
  dgRNA
  Wdr45
actctactactgctc

SEQ ID NO: 16106 - DNA, 15 bp, Artificial Sequence
  dgRNA
  Wdr45
cacaggtccgccaag

SEQ ID NO: 16107 - DNA, 15 bp, Artificial Sequence
  dgRNA
  Gna14
ccctcatccggtgcc

SEQ ID NO: 16108 - DNA, 15 bp, Artificial Sequence
  dgRNA
  Gna14
tcatccggtgccagg

SEQ ID NO: 16109 - DNA, 15 bp, Artificial Sequence
  dgRNA
  Gna14
ccggtgccaggaggt

SEQ ID NO: 16110 - DNA, 15 bp, Artificial Sequence
  dgRNA
  Gna14
ggaggtaggaccggc

SEQ ID NO: 16111 - DNA, 15 bp, Artificial Sequence
  dgRNA
  Mef2a
catgacaaacccttc

SEQ ID NO: 16112 - DNA, 15 bp, Artificial Sequence
  dgRNA
  Mef2a
aggcgaggcccgcgg

SEQ ID NO: 16113 - DNA, 15 bp, Artificial Sequence
  dgRNA
  Mef2a
ggcgaggcccgcgga

SEQ ID NO: 16114 - DNA, 15 bp, Artificial Sequence
  dgRNA
  Mef2a
gcgaagaacgagttc

SEQ ID NO: 16115 - DNA, 15 bp, Artificial Sequence
  dgRNA
  Olfr1336
tcgtgatcagagttt

SEQ ID NO: 16116 - DNA, 15 bp, Artificial Sequence
  dgRNA
  Vkorc1l1
ccgcctcactcctct

SEQ ID NO: 16117 - DNA, 15 bp, Artificial Sequence
  dgRNA
  Vkorc1l1
gcctcactcctctcg

SEQ ID NO: 16118 - DNA, 15 bp, Artificial Sequence
  dgRNA
  Vkorc1l1
tcactcctctcgggg

SEQ ID NO: 16119 - DNA, 15 bp, Artificial Sequence
  dgRNA
  Vkorc1l1
tcctctcggggcggt

SEQ ID NO: 16120 - DNA, 15 bp, Artificial Sequence
  dgRNA
  Vps13b
cctaacccagagcgg

SEQ ID NO: 16121 - DNA, 15 bp, Artificial Sequence
  dgRNA
  Vps13b
agagcggtggcagcg

SEQ ID NO: 16122 - DNA, 15 bp, Artificial Sequence
  dgRNA
  Vps13b
agccggagtcgtccc

SEQ ID NO: 16123 - DNA, 15 bp, Artificial Sequence
  dgRNA
  Vps13b
ggagtcgtcccaggc

SEQ ID NO: 16124 - DNA, 15 bp, Artificial Sequence
  dgRNA
  Hils1
tgggcattccctatg

SEQ ID NO: 16125 - DNA, 15 bp, Artificial Sequence
  dgRNA
  Hils1
tactatgacccccac

SEQ ID NO: 16126 - DNA, 15 bp, Artificial Sequence
  dgRNA
  Hils1
acaatggcccccttg

SEQ ID NO: 16127 - DNA, 15 bp, Artificial Sequence
  dgRNA
  Hils1
ggttgagtccacata

SEQ ID NO: 16128 - DNA, 15 bp, Artificial Sequence
  dgRNA
  1700011A15Rik
gtcaactgggtccta

SEQ ID NO: 16129 - DNA, 15 bp, Artificial Sequence
  dgRNA
  1700011A15Rik
aattgtaaccaagtg

SEQ ID NO: 16130 - DNA, 15 bp, Artificial Sequence
  dgRNA
  1700011A15Rik
atctccgtgtaattc

SEQ ID NO: 16131 - DNA, 15 bp, Artificial Sequence
  dgRNA
  1700011A15Rik
ttgcagggttccaat

SEQ ID NO: 16132 - DNA, 15 bp, Artificial Sequence
  dgRNA
  Pax5
cggcgggggagcgga

SEQ ID NO: 16133 - DNA, 15 bp, Artificial Sequence
  dgRNA
  Pax5
attccgacttgtgag

SEQ ID NO: 16134 - DNA, 15 bp, Artificial Sequence
  dgRNA
  Pax5
ttccgacttgtgagc

SEQ ID NO: 16135 - DNA, 15 bp, Artificial Sequence
  dgRNA
  Pax5
tcccccgccgagctg

SEQ ID NO: 16136 - DNA, 15 bp, Artificial Sequence
  dgRNA
  Popdc3
tatcccacacctctc

SEQ ID NO: 16137 - DNA, 15 bp, Artificial Sequence
  dgRNA
  Popdc3
agttgcttcccgtgc

SEQ ID NO: 16138 - DNA, 15 bp, Artificial Sequence
  dgRNA
  Popdc3
caccaagggtagccc

SEQ ID NO: 16139 - DNA, 15 bp, Artificial Sequence
  dgRNA
  Popdc3
accaagggtagccca

SEQ ID NO: 16140 - DNA, 15 bp, Artificial Sequence
  dgRNA
  Tbc1d13
accgcagttaatgac

SEQ ID NO: 16141 - DNA, 15 bp, Artificial Sequence
  dgRNA
  Tbc1d13
ccgcagttaatgaca

SEQ ID NO: 16142 - DNA, 15 bp, Artificial Sequence
  dgRNA
  Tbc1d13
agactcatagccagc

SEQ ID NO: 16143 - DNA, 15 bp, Artificial Sequence
  dgRNA
  Tbc1d13
ctgacgctcaactga

SEQ ID NO: 16144 - DNA, 15 bp, Artificial Sequence
  dgRNA
  Abhd12
cgcccttctccaaga

SEQ ID NO: 16145 - DNA, 15 bp, Artificial Sequence
  dgRNA
  Abhd12
gcgctgcttgtgaag

SEQ ID NO: 16146 - DNA, 15 bp, Artificial Sequence
  dgRNA
  Abhd12
gtgaagcggagctgc

SEQ ID NO: 16147 - DNA, 15 bp, Artificial Sequence
  dgRNA
  Abhd12
tgaagcggagctgcc

SEQ ID NO: 16148 - DNA, 15 bp, Artificial Sequence
  dgRNA
  Repin1
tgaagctcgggccgg

SEQ ID NO: 16149 - DNA, 15 bp, Artificial Sequence
  dgRNA
  Repin1
ggccggtggccaaac

SEQ ID NO: 16150 - DNA, 15 bp, Artificial Sequence
  dgRNA
  Repin1
tggccaaaccggagc

SEQ ID NO: 16151 - DNA, 15 bp, Artificial Sequence
  dgRNA
  Repin1
ccaaaccggagctgg

SEQ ID NO: 16152 - DNA, 15 bp, Artificial Sequence
  dgRNA
  Bora
gcgttgatttgaatt

SEQ ID NO: 16153 - DNA, 15 bp, Artificial Sequence
  dgRNA
  Bora
cctcgttcccttgcg

SEQ ID NO: 16154 - DNA, 15 bp, Artificial Sequence
  dgRNA
  Bora
gcggaacgtagagcg

SEQ ID NO: 16155 - DNA, 15 bp, Artificial Sequence
  dgRNA
  Bora
gcgttcgaattcacc

SEQ ID NO: 16156 - DNA, 15 bp, Artificial Sequence
  dgRNA
  Flywch2
ccccttcccgggtaa

SEQ ID NO: 16157 - DNA, 15 bp, Artificial Sequence
  dgRNA
  Flywch2
aacttgtcgctgcga

SEQ ID NO: 16158 - DNA, 15 bp, Artificial Sequence
  dgRNA
  Flywch2
tgcgaaggtaatatc

SEQ ID NO: 16159 - DNA, 15 bp, Artificial Sequence
  dgRNA
  Flywch2
taatatccggataga

SEQ ID NO: 16160 - DNA, 15 bp, Artificial Sequence
  dgRNA
  Rcc1
cactcatcccacttt

SEQ ID NO: 16161 - DNA, 15 bp, Artificial Sequence
  dgRNA
  Rcc1
cgctcgcacttcccg

SEQ ID NO: 16162 - DNA, 15 bp, Artificial Sequence
  dgRNA
  Rcc1
tcgcacttcccgcgg

SEQ ID NO: 16163 - DNA, 15 bp, Artificial Sequence
  dgRNA
  Rcc1
cccgcggtggccgcc

SEQ ID NO: 16164 - DNA, 15 bp, Artificial Sequence
  dgRNA
  Txk
acacacccacagcgt

SEQ ID NO: 16165 - DNA, 15 bp, Artificial Sequence
  dgRNA
  Txk
cacagcgtaggtata

SEQ ID NO: 16166 - DNA, 15 bp, Artificial Sequence
  dgRNA
  Txk
ctaacacttcagatc

SEQ ID NO: 16167 - DNA, 15 bp, Artificial Sequence
  dgRNA
  Txk
tcttatgtaggccac

SEQ ID NO: 16168 - DNA, 15 bp, Artificial Sequence
  dgRNA
  Hivep1
tgggtccccgcggcg

SEQ ID NO: 16169 - DNA, 15 bp, Artificial Sequence
  dgRNA
  Hivep1
ccgcggcggggcctg

SEQ ID NO: 16170 - DNA, 15 bp, Artificial Sequence
  dgRNA
  Hivep1
gcggcagggggcccc

SEQ ID NO: 16171 - DNA, 15 bp, Artificial Sequence
  dgRNA
  Hivep1
cagggggccccgggc

SEQ ID NO: 16172 - DNA, 15 bp, Artificial Sequence
  dgRNA
  Spata5
ggttcataacgtcaa

SEQ ID NO: 16173 - DNA, 15 bp, Artificial Sequence
  dgRNA
  Spata5
tcataacgtcaacgg

SEQ ID NO: 16174 - DNA, 15 bp, Artificial Sequence
  dgRNA
  Spata5
tccgcctccgcctcg

SEQ ID NO: 16175 - DNA, 15 bp, Artificial Sequence
  dgRNA
  Spata5
ccgcctccgcctcgt

SEQ ID NO: 16176 - DNA, 15 bp, Artificial Sequence
  dgRNA
  Tmem234
gtggggacagaaccg

SEQ ID NO: 16177 - DNA, 15 bp, Artificial Sequence
  dgRNA
  Tmem234
ccggggtgtcagtgc

SEQ ID NO: 16178 - DNA, 15 bp, Artificial Sequence
  dgRNA
  Tmem234
cggggtgtcagtgcc

SEQ ID NO: 16179 - DNA, 15 bp, Artificial Sequence
  dgRNA
  Tmem234
gtcccatgcctactg

SEQ ID NO: 16180 - DNA, 15 bp, Artificial Sequence
  dgRNA
  Btbd1
gcgggaggcggcctg

SEQ ID NO: 16181 - DNA, 15 bp, Artificial Sequence
  dgRNA
  Btbd1
cctgaggaatcagcg

SEQ ID NO: 16182 - DNA, 15 bp, Artificial Sequence
  dgRNA
  Btbd1
ccctcaaccctctcg

SEQ ID NO: 16183 - DNA, 15 bp, Artificial Sequence
  dgRNA
  Btbd1
cccgcctcagcaacg

SEQ ID NO: 16184 - DNA, 15 bp, Artificial Sequence
  dgRNA
  Polr3c
gtttcgcctccgccg

SEQ ID NO: 16185 - DNA, 15 bp, Artificial Sequence
  dgRNA
  Polr3c
ccgaggatgtccgaa

SEQ ID NO: 16186 - DNA, 15 bp, Artificial Sequence
  dgRNA
  Polr3c
cgaggatgtccgaaa

SEQ ID NO: 16187 - DNA, 15 bp, Artificial Sequence
  dgRNA
  Polr3c
gtccgaaagggcggc

SEQ ID NO: 16188 - DNA, 15 bp, Artificial Sequence
  dgRNA
  Homer1
tcttccacgacactc

SEQ ID NO: 16189 - DNA, 15 bp, Artificial Sequence
  dgRNA
  Homer1
aaaaaatgagttcgc

SEQ ID NO: 16190 - DNA, 15 bp, Artificial Sequence
  dgRNA
  Homer1
tttgaaaaggttgcg

SEQ ID NO: 16191 - DNA, 15 bp, Artificial Sequence
  dgRNA
  Tceb1
gcactgctgcctcgc

SEQ ID NO: 16192 - DNA, 15 bp, Artificial Sequence
  dgRNA
  Tceb1
cggctcagcttttct

SEQ ID NO: 16193 - DNA, 15 bp, Artificial Sequence
  dgRNA
  Tceb1
tttctcggcagaaat

SEQ ID NO: 16194 - DNA, 15 bp, Artificial Sequence
  dgRNA
  Tceb1
gaaattggatccgga

SEQ ID NO: 16195 - DNA, 15 bp, Artificial Sequence
  dgRNA
  Rnf40
cggggtcagtaacta

SEQ ID NO: 16196 - DNA, 15 bp, Artificial Sequence
  dgRNA
  Rnf40
ggggtcagtaactat

SEQ ID NO: 16197 - DNA, 15 bp, Artificial Sequence
  dgRNA
  Rnf40
atgggaaccgcctgc

SEQ ID NO: 16198 - DNA, 15 bp, Artificial Sequence
  dgRNA
  Rnf40
aaatacagtccgtcg

SEQ ID NO: 16199 - DNA, 15 bp, Artificial Sequence
  dgRNA
  Zfp281
cacgtcccctcgctg

SEQ ID NO: 16200 - DNA, 15 bp, Artificial Sequence
  dgRNA
  Zfp281
gcccgcttgattgac

SEQ ID NO: 16201 - DNA, 15 bp, Artificial Sequence
  dgRNA
  Zfp281
gccaggcggaaactg

SEQ ID NO: 16202 - DNA, 15 bp, Artificial Sequence
  dgRNA
  Zfp281
tgaggcgcaggcgca

SEQ ID NO: 16203 - DNA, 15 bp, Artificial Sequence
  dgRNA
  Ctdsp2
aagcggggagtggcc

SEQ ID NO: 16204 - DNA, 15 bp, Artificial Sequence
  dgRNA
  Ctdsp2
agcggggagtggccc

SEQ ID NO: 16205 - DNA, 15 bp, Artificial Sequence
  dgRNA
  Ctdsp2
gcggggagtggcccg

SEQ ID NO: 16206 - DNA, 15 bp, Artificial Sequence
  dgRNA
  Ctdsp2
cggggagtggcccgg

SEQ ID NO: 16207 - DNA, 15 bp, Artificial Sequence
  dgRNA
  Neurl1b
agccccgcccaagca

SEQ ID NO: 16208 - DNA, 15 bp, Artificial Sequence
  dgRNA
  Neurl1b
ccgcccaagcacggt

SEQ ID NO: 16209 - DNA, 15 bp, Artificial Sequence
  dgRNA
  Neurl1b
cccaagcacggttgg

SEQ ID NO: 16210 - DNA, 15 bp, Artificial Sequence
  dgRNA
  Neurl1b
aagcacggttggtgg

SEQ ID NO: 16211 - DNA, 15 bp, Artificial Sequence
  dgRNA
  Cd40
cgccctcttcctggg

SEQ ID NO: 16212 - DNA, 15 bp, Artificial Sequence
  dgRNA
  Cd40
cgcccaggaagaggg

SEQ ID NO: 16213 - DNA, 15 bp, Artificial Sequence
  dgRNA
  Cd40
tcccgcccaggaaga

SEQ ID NO: 16214 - DNA, 15 bp, Artificial Sequence
  dgRNA
  Cd40
gtcccgcccaggaag

SEQ ID NO: 16215 - DNA, 15 bp, Artificial Sequence
  dgRNA
  Trim54
ttacatgagctaaat

SEQ ID NO: 16216 - DNA, 15 bp, Artificial Sequence
  dgRNA
  Trim54
tacatgagctaaatt

SEQ ID NO: 16217 - DNA, 15 bp, Artificial Sequence
  dgRNA
  Trim54
agctaaattgggaac

SEQ ID NO: 16218 - DNA, 15 bp, Artificial Sequence
  dgRNA
  Trim54
ttaatctctctaggg

SEQ ID NO: 16219 - DNA, 15 bp, Artificial Sequence
  dgRNA
  Cst10
gcagtaagatccatg

SEQ ID NO: 16220 - DNA, 15 bp, Artificial Sequence
  dgRNA
  Cst10
taagtgctaatggaa

SEQ ID NO: 16221 - DNA, 15 bp, Artificial Sequence
  dgRNA
  Cst10
cagtatggaacaagg

SEQ ID NO: 16222 - DNA, 15 bp, Artificial Sequence
  dgRNA
  Cst10
acaaggaggatctag

SEQ ID NO: 16223 - DNA, 15 bp, Artificial Sequence
  dgRNA
  Ccdc78
actccttgatccagc

SEQ ID NO: 16224 - DNA, 15 bp, Artificial Sequence
  dgRNA
  Ccdc78
cttgcccttccgtgt

SEQ ID NO: 16225 - DNA, 15 bp, Artificial Sequence
  dgRNA
  Ccdc78
cccttccgtgtaggc

SEQ ID NO: 16226 - DNA, 15 bp, Artificial Sequence
  dgRNA
  Ccdc78
ccgtgtaggcaggag

SEQ ID NO: 16227 - DNA, 15 bp, Artificial Sequence
  dgRNA
  Oxr1
gtcgcctccagctcg

SEQ ID NO: 16228 - DNA, 15 bp, Artificial Sequence
  dgRNA
  Oxr1
cgtcgctctgcagct

SEQ ID NO: 16229 - DNA, 15 bp, Artificial Sequence
  dgRNA
  Oxr1
ctcccccgccgcgga

SEQ ID NO: 16230 - DNA, 15 bp, Artificial Sequence
  dgRNA
  Oxr1
gccgcggatggctct

SEQ ID NO: 16231 - DNA, 15 bp, Artificial Sequence
  dgRNA
  Rab23
acctgaccctgtgta

SEQ ID NO: 16232 - DNA, 15 bp, Artificial Sequence
  dgRNA
  Rab23
aggcacaccttcagt

SEQ ID NO: 16233 - DNA, 15 bp, Artificial Sequence
  dgRNA
  Rab23
gagcatgcgcagacc

SEQ ID NO: 16234 - DNA, 15 bp, Artificial Sequence
  dgRNA
  Rab23
catgcgcagaccagg

SEQ ID NO: 16235 - DNA, 15 bp, Artificial Sequence
  dgRNA
  Gm13124
atagctgcctgtagt

SEQ ID NO: 16236 - DNA, 15 bp, Artificial Sequence
  dgRNA
  Gm13124
gtgttataaggcacc

SEQ ID NO: 16237 - DNA, 15 bp, Artificial Sequence
  dgRNA
  Gm13124
ctataagctctttcc

SEQ ID NO: 16238 - DNA, 15 bp, Artificial Sequence
  dgRNA
  Gm13124
gagataggtcttctt

SEQ ID NO: 16239 - DNA, 15 bp, Artificial Sequence
  dgRNA
  Bak1
gcagatagggcggcc

SEQ ID NO: 16240 - DNA, 15 bp, Artificial Sequence
  dgRNA
  Bak1
cagatagggcggccg

SEQ ID NO: 16241 - DNA, 15 bp, Artificial Sequence
  dgRNA
  Bak1
agatagggcggccgg

SEQ ID NO: 16242 - DNA, 15 bp, Artificial Sequence
  dgRNA
  Bak1
gatagggcggccggg

SEQ ID NO: 16243 - DNA, 15 bp, Artificial Sequence
  dgRNA
  Aifm2
gggcacgccccgaca

SEQ ID NO: 16244 - DNA, 15 bp, Artificial Sequence
  dgRNA
  Aifm2
ggcacgccccgacac

SEQ ID NO: 16245 - DNA, 15 bp, Artificial Sequence
  dgRNA
  Aifm2
gcacgccccgacacg

SEQ ID NO: 16246 - DNA, 15 bp, Artificial Sequence
  dgRNA
  Aifm2
tgaggccccgtgtcg

SEQ ID NO: 16247 - DNA, 15 bp, Artificial Sequence
  dgRNA
  Ccdc64b
acctggcaccgcctc

SEQ ID NO: 16248 - DNA, 15 bp, Artificial Sequence
  dgRNA
  Ccdc64b
caccgcctccggaag

SEQ ID NO: 16249 - DNA, 15 bp, Artificial Sequence
  dgRNA
  Ccdc64b
tatgtgcagatctac

SEQ ID NO: 16250 - DNA, 15 bp, Artificial Sequence
  dgRNA
  Ccdc64b
acgccccctggtggt

SEQ ID NO: 16251 - DNA, 15 bp, Artificial Sequence
  dgRNA
  Cpeb2
acgaggccgctctcg

SEQ ID NO: 16252 - DNA, 15 bp, Artificial Sequence
  dgRNA
  Cpeb2
cgaggccgctctcgg

SEQ ID NO: 16253 - DNA, 15 bp, Artificial Sequence
  dgRNA
  Cpeb2
ggccgctctcggggg

SEQ ID NO: 16254 - DNA, 15 bp, Artificial Sequence
  dgRNA
  Cpeb2
cgctctcgggggcgg

SEQ ID NO: 16255 - DNA, 15 bp, Artificial Sequence
  dgRNA
  Alkbh6
cagtcgccctcgctg

SEQ ID NO: 16256 - DNA, 15 bp, Artificial Sequence
  dgRNA
  Alkbh6
agtcgccctcgctgt

SEQ ID NO: 16257 - DNA, 15 bp, Artificial Sequence
  dgRNA
  Alkbh6
tcaactgagtccaca

SEQ ID NO: 16258 - DNA, 15 bp, Artificial Sequence
  dgRNA
  Alkbh6
tccacaaggacacgc

SEQ ID NO: 16259 - DNA, 15 bp, Artificial Sequence
  dgRNA
  Gm14744
gatgtttccaccacc

SEQ ID NO: 16260 - DNA, 15 bp, Artificial Sequence
  dgRNA
  Ccdc106
ttacacgacttcttt

SEQ ID NO: 16261 - DNA, 15 bp, Artificial Sequence
  dgRNA
  Ccdc106
acacgacttcttttg

SEQ ID NO: 16262 - DNA, 15 bp, Artificial Sequence
  dgRNA
  Ccdc106
tcttttggggcggaa

SEQ ID NO: 16263 - DNA, 15 bp, Artificial Sequence
  dgRNA
  Ccdc106
gggggagtgtcttaa

SEQ ID NO: 16264 - DNA, 15 bp, Artificial Sequence
  dgRNA
  Egfl7
cacaggaagtccggc

SEQ ID NO: 16265 - DNA, 15 bp, Artificial Sequence
  dgRNA
  Egfl7
ggaagtccggcggga

SEQ ID NO: 16266 - DNA, 15 bp, Artificial Sequence
  dgRNA
  Egfl7
gaagtccggcgggaa

SEQ ID NO: 16267 - DNA, 15 bp, Artificial Sequence
  dgRNA
  Egfl7
agtcctgatttaccc

SEQ ID NO: 16268 - DNA, 15 bp, Artificial Sequence
  dgRNA
  2-Mar
gagccagaacgcagc

SEQ ID NO: 16269 - DNA, 15 bp, Artificial Sequence
  dgRNA
  2-Mar
gaagctgcggcgccg

SEQ ID NO: 16270 - DNA, 15 bp, Artificial Sequence
  dgRNA
  2-Mar
aagctgcggcgccgc

SEQ ID NO: 16271 - DNA, 15 bp, Artificial Sequence
  dgRNA
  2-Mar
gggcctggaccgccc

SEQ ID NO: 16272 - DNA, 15 bp, Artificial Sequence
  dgRNA
  Cwc22
tcccgtcatgcactg

SEQ ID NO: 16273 - DNA, 15 bp, Artificial Sequence
  dgRNA
  Cwc22
agagctaggttttcg

SEQ ID NO: 16274 - DNA, 15 bp, Artificial Sequence
  dgRNA
  Cwc22
gttcgttcggatagg

SEQ ID NO: 16275 - DNA, 15 bp, Artificial Sequence
  dgRNA
  Cwc22
gtagttcgttcggat

SEQ ID NO: 16276 - DNA, 15 bp, Artificial Sequence
  dgRNA
  Sin3b
tttaggccttccagg

SEQ ID NO: 16277 - DNA, 15 bp, Artificial Sequence
  dgRNA
  Sin3b
ccgccccgtccagca

SEQ ID NO: 16278 - DNA, 15 bp, Artificial Sequence
  dgRNA
  Sin3b
agcaaggcccttatg

SEQ ID NO: 16279 - DNA, 15 bp, Artificial Sequence
  dgRNA
  Sin3b
accccctaggaggcg

SEQ ID NO: 16280 - DNA, 15 bp, Artificial Sequence
  dgRNA
  Cant1
cgcgcggccagagtg

SEQ ID NO: 16281 - DNA, 15 bp, Artificial Sequence
  dgRNA
  Phlda3
agcggtgttttaaga

SEQ ID NO: 16282 - DNA, 15 bp, Artificial Sequence
  dgRNA
  Phlda3
gcggtgttttaagaa

SEQ ID NO: 16283 - DNA, 15 bp, Artificial Sequence
  dgRNA
  Phlda3
cggtgttttaagaag

SEQ ID NO: 16284 - DNA, 15 bp, Artificial Sequence
  dgRNA
  Phlda3
gaaggggcagcccgc

SEQ ID NO: 16285 - DNA, 15 bp, Artificial Sequence
  dgRNA
  Pabpc2
gaggtgaaacatctg

SEQ ID NO: 16286 - DNA, 15 bp, Artificial Sequence
  dgRNA
  Pabpc2
ggaccctgctaggag

SEQ ID NO: 16287 - DNA, 15 bp, Artificial Sequence
  dgRNA
  Pabpc2
gtctgcttgaaggtc

SEQ ID NO: 16288 - DNA, 15 bp, Artificial Sequence
  dgRNA
  Pabpc2
gctgccttgggagcg

SEQ ID NO: 16289 - DNA, 15 bp, Artificial Sequence
  dgRNA
  Myl1
cttctttacagatag

SEQ ID NO: 16290 - DNA, 15 bp, Artificial Sequence
  dgRNA
  Myl1
cggtcaaaaaacttg

SEQ ID NO: 16291 - DNA, 15 bp, Artificial Sequence
  dgRNA
  Myl1
gacgtacctttttct

SEQ ID NO: 16292 - DNA, 15 bp, Artificial Sequence
  dgRNA
  Cdipt
cctatgatgggcctc

SEQ ID NO: 16293 - DNA, 15 bp, Artificial Sequence
  dgRNA
  Cdipt
ctatgatgggcctca

SEQ ID NO: 16294 - DNA, 15 bp, Artificial Sequence
  dgRNA
  Cdipt
gggcctcaggggatt

SEQ ID NO: 16295 - DNA, 15 bp, Artificial Sequence
  dgRNA
  Cdipt
ccgggaaagaaggtt

SEQ ID NO: 16296 - DNA, 15 bp, Artificial Sequence
  dgRNA
  Adamtsl3
tagggcagaggacgc

SEQ ID NO: 16297 - DNA, 15 bp, Artificial Sequence
  dgRNA
  Adamtsl3
acggtaccctagacg

SEQ ID NO: 16298 - DNA, 15 bp, Artificial Sequence
  dgRNA
  Adamtsl3
cgcggcgcgcacttg

SEQ ID NO: 16299 - DNA, 15 bp, Artificial Sequence
  dgRNA
  Adamtsl3
gcggcgcgcacttgc

SEQ ID NO: 16300 - DNA, 15 bp, Artificial Sequence
  dgRNA
  Sh2d1b1
taggctgaagtatcg

SEQ ID NO: 16301 - DNA, 15 bp, Artificial Sequence
  dgRNA
  Sh2d1b1
atgactcacacaagt

SEQ ID NO: 16302 - DNA, 15 bp, Artificial Sequence
  dgRNA
  Sh2d1b1
tatgactcacacaag

SEQ ID NO: 16303 - DNA, 15 bp, Artificial Sequence
  dgRNA
  Sh2d1b1
cttcagcctaggggt

SEQ ID NO: 16304 - DNA, 15 bp, Artificial Sequence
  dgRNA
  Ttll10
tggcgttgtgaactc

SEQ ID NO: 16305 - DNA, 15 bp, Artificial Sequence
  dgRNA
  Ttll10
ctagtaacagttgcc

SEQ ID NO: 16306 - DNA, 15 bp, Artificial Sequence
  dgRNA
  Ttll10
acgccatctgaatct

SEQ ID NO: 16307 - DNA, 15 bp, Artificial Sequence
  dgRNA
  Ttll10
aacgccatctgaatc

SEQ ID NO: 16308 - DNA, 15 bp, Artificial Sequence
  dgRNA
  Tmem65
ggctatgcgcctgcg

SEQ ID NO: 16309 - DNA, 15 bp, Artificial Sequence
  dgRNA
  Tmem65
cccgccctcctatcc

SEQ ID NO: 16310 - DNA, 15 bp, Artificial Sequence
  dgRNA
  Tmem65
ccgggctccgccgct

SEQ ID NO: 16311 - DNA, 15 bp, Artificial Sequence
  dgRNA
  Tmem65
cgggctccgccgcta

SEQ ID NO: 16312 - DNA, 15 bp, Artificial Sequence
  dgRNA
  Fam89a
ggggcgggtcccgag

SEQ ID NO: 16313 - DNA, 15 bp, Artificial Sequence
  dgRNA
  Fam89a
gggcgggtcccgaga

SEQ ID NO: 16314 - DNA, 15 bp, Artificial Sequence
  dgRNA
  Fam89a
ggcgggtcccgagag

SEQ ID NO: 16315 - DNA, 15 bp, Artificial Sequence
  dgRNA
  Fam89a
aggggcggagaccaa

SEQ ID NO: 16316 - DNA, 15 bp, Artificial Sequence
  dgRNA
  Setd3
aaccaatcgagtctt

SEQ ID NO: 16317 - DNA, 15 bp, Artificial Sequence
  dgRNA
  Setd3
tcgagtcttcggata

SEQ ID NO: 16318 - DNA, 15 bp, Artificial Sequence
  dgRNA
  Setd3
gatacggctccgccc

SEQ ID NO: 16319 - DNA, 15 bp, Artificial Sequence
  dgRNA
  Setd3
cgggcggatgggcgg

SEQ ID NO: 16320 - DNA, 15 bp, Artificial Sequence
  dgRNA
  Chid1
tcttcatccaactga

SEQ ID NO: 16321 - DNA, 15 bp, Artificial Sequence
  dgRNA
  Chid1
tcgccggtcgctacg

SEQ ID NO: 16322 - DNA, 15 bp, Artificial Sequence
  dgRNA
  Chid1
agcgtgccgtgcgca

SEQ ID NO: 16323 - DNA, 15 bp, Artificial Sequence
  dgRNA
  Chid1
gtgcgcaaggcatct

SEQ ID NO: 16324 - DNA, 15 bp, Artificial Sequence
  dgRNA
  Ing4
tagatgaccgtgaat

SEQ ID NO: 16325 - DNA, 15 bp, Artificial Sequence
  dgRNA
  Ing4
aagttcagtttccgg

SEQ ID NO: 16326 - DNA, 15 bp, Artificial Sequence
  dgRNA
  Ing4
cggcggatgtatccg

SEQ ID NO: 16327 - DNA, 15 bp, Artificial Sequence
  dgRNA
  Ing4
gcagatagtttagta

SEQ ID NO: 16328 - DNA, 15 bp, Artificial Sequence
  dgRNA
  Nr3c2
aatgagaagcgcgcc

SEQ ID NO: 16329 - DNA, 15 bp, Artificial Sequence
  dgRNA
  Nr3c2
ttcccccttggccaa

SEQ ID NO: 16330 - DNA, 15 bp, Artificial Sequence
  dgRNA
  Nr3c2
aatggctccagcggg

SEQ ID NO: 16331 - DNA, 15 bp, Artificial Sequence
  dgRNA
  Nr3c2
atggctccagcgggc

SEQ ID NO: 16332 - DNA, 15 bp, Artificial Sequence
  dgRNA
  H2-DMa
ccgaattattttttc

SEQ ID NO: 16333 - DNA, 15 bp, Artificial Sequence
  dgRNA
  H2-DMa
gaagtctcgtggcct

SEQ ID NO: 16334 - DNA, 15 bp, Artificial Sequence
  dgRNA
  H2-DMa
taattcggagggcag

SEQ ID NO: 16335 - DNA, 15 bp, Artificial Sequence
  dgRNA
  H2-DMa
ataattcggagggca

SEQ ID NO: 16336 - DNA, 15 bp, Artificial Sequence
  dgRNA
  Evl
ccccgtcttgccccc

SEQ ID NO: 16337 - DNA, 15 bp, Artificial Sequence
  dgRNA
  Evl
gccccgccctcttag

SEQ ID NO: 16338 - DNA, 15 bp, Artificial Sequence
  dgRNA
  Evl
gccctcttagaggcg

SEQ ID NO: 16339 - DNA, 15 bp, Artificial Sequence
  dgRNA
  Evl
tagaggcgcggacca

SEQ ID NO: 16340 - DNA, 15 bp, Artificial Sequence
  dgRNA
  Hectd1
gtagccgaccgccga

SEQ ID NO: 16341 - DNA, 15 bp, Artificial Sequence
  dgRNA
  Hectd1
accgccgaaggagcc

SEQ ID NO: 16342 - DNA, 15 bp, Artificial Sequence
  dgRNA
  Hectd1
cgtcgccccgtgccg

SEQ ID NO: 16343 - DNA, 15 bp, Artificial Sequence
  dgRNA
  Hectd1
gtcgccccgtgccgc

SEQ ID NO: 16344 - DNA, 15 bp, Artificial Sequence
  dgRNA
  Pcdh15
agcacgttgatcagc

SEQ ID NO: 16345 - DNA, 15 bp, Artificial Sequence
  dgRNA
  Pcdh15
ctagcaggcatccgc

SEQ ID NO: 16346 - DNA, 15 bp, Artificial Sequence
  dgRNA
  P2rx1
ttccggaggcccagc

SEQ ID NO: 16347 - DNA, 15 bp, Artificial Sequence
  dgRNA
  P2rx1
ccaggcggagccttg

SEQ ID NO: 16348 - DNA, 15 bp, Artificial Sequence
  dgRNA
  P2rx1
caggcggagccttga

SEQ ID NO: 16349 - DNA, 15 bp, Artificial Sequence
  dgRNA
  P2rx1
gccttgaggggtagt

SEQ ID NO: 16350 - DNA, 15 bp, Artificial Sequence
  dgRNA
  Sox6
ggggtctttagttga

SEQ ID NO: 16351 - DNA, 15 bp, Artificial Sequence
  dgRNA
  Sox6
tgtgctacacgagac

SEQ ID NO: 16352 - DNA, 15 bp, Artificial Sequence
  dgRNA
  Sox6
taacaaaggccggct

SEQ ID NO: 16353 - DNA, 15 bp, Artificial Sequence
  dgRNA
  Sox6
atgactaacaaaggc

SEQ ID NO: 16354 - DNA, 15 bp, Artificial Sequence
  dgRNA
  Gjb1
tgatgtgcggagtgt

SEQ ID NO: 16355 - DNA, 15 bp, Artificial Sequence
  dgRNA
  Gjb1
taagtatttagcctt

SEQ ID NO: 16356 - DNA, 15 bp, Artificial Sequence
  dgRNA
  Gjb1
ataagtatttagcct

SEQ ID NO: 16357 - DNA, 15 bp, Artificial Sequence
  dgRNA
  Gjb1
aagagtttattggtc

SEQ ID NO: 16358 - DNA, 15 bp, Artificial Sequence
  dgRNA
  Kcnj16
gctgatgtagattcc

SEQ ID NO: 16359 - DNA, 15 bp, Artificial Sequence
  dgRNA
  Kcnj16
atgtagattccaggg

SEQ ID NO: 16360 - DNA, 15 bp, Artificial Sequence
  dgRNA
  Kcnj16
gcaaaccggtgtcaa

SEQ ID NO: 16361 - DNA, 15 bp, Artificial Sequence
  dgRNA
  Kcnj16
tgtcaatggttaacc

SEQ ID NO: 16362 - DNA, 15 bp, Artificial Sequence
  dgRNA
  Slc31a2
taaacccccacattc

SEQ ID NO: 16363 - DNA, 15 bp, Artificial Sequence
  dgRNA
  Rpe
ggacttcctcgccgc

SEQ ID NO: 16364 - DNA, 15 bp, Artificial Sequence
  dgRNA
  Rpe
gacttcctcgccgca

SEQ ID NO: 16365 - DNA, 15 bp, Artificial Sequence
  dgRNA
  Rpe
gcttccggcagagtc

SEQ ID NO: 16366 - DNA, 15 bp, Artificial Sequence
  dgRNA
  Rpe
ccggaagagagtgcg

SEQ ID NO: 16367 - DNA, 15 bp, Artificial Sequence
  dgRNA
  Gcgr
caggagatatactcg

SEQ ID NO: 16368 - DNA, 15 bp, Artificial Sequence
  dgRNA
  Gcgr
cggggttacaccgag

SEQ ID NO: 16369 - DNA, 15 bp, Artificial Sequence
  dgRNA
  Gcgr
ggggttacaccgaga

SEQ ID NO: 16370 - DNA, 15 bp, Artificial Sequence
  dgRNA
  Gcgr
aggtccgctgcacta

SEQ ID NO: 16371 - DNA, 15 bp, Artificial Sequence
  dgRNA
  Sgms1
gcttatcccagcaag

SEQ ID NO: 16372 - DNA, 15 bp, Artificial Sequence
  dgRNA
  Sgms1
caagataataccgtg

SEQ ID NO: 16373 - DNA, 15 bp, Artificial Sequence
  dgRNA
  Sgms1
aatgcttatccttcc

SEQ ID NO: 16374 - DNA, 15 bp, Artificial Sequence
  dgRNA
  Sgms1
cacacggtattatct

SEQ ID NO: 16375 - DNA, 15 bp, Artificial Sequence
  dgRNA
  Oard1
accgcctcccgccaa

SEQ ID NO: 16376 - DNA, 15 bp, Artificial Sequence
  dgRNA
  Oard1
gccaaaggcctacgc

SEQ ID NO: 16377 - DNA, 15 bp, Artificial Sequence
  dgRNA
  Oard1
aattatataccacgc

SEQ ID NO: 16378 - DNA, 15 bp, Artificial Sequence
  dgRNA
  Oard1
tttctaagcgtccac

SEQ ID NO: 16379 - DNA, 15 bp, Artificial Sequence
  dgRNA
  Lce3b
aacaatccttgttcc

SEQ ID NO: 16380 - DNA, 15 bp, Artificial Sequence
  dgRNA
  Lce3b
ggttcaatcttcagt

SEQ ID NO: 16381 - DNA, 15 bp, Artificial Sequence
  dgRNA
  Lce3b
aggtaacacctcctc

SEQ ID NO: 16382 - DNA, 15 bp, Artificial Sequence
  dgRNA
  Lce3b
tttcacaaccagagg

SEQ ID NO: 16383 - DNA, 15 bp, Artificial Sequence
  dgRNA
  Setd7
gcgacctggaccgcg

SEQ ID NO: 16384 - DNA, 15 bp, Artificial Sequence
  dgRNA
  Setd7
gtgaaccaagccaaa

SEQ ID NO: 16385 - DNA, 15 bp, Artificial Sequence
  dgRNA
  Setd7
aaggtaaacgccgcc

SEQ ID NO: 16386 - DNA, 15 bp, Artificial Sequence
  dgRNA
  Setd7
gaggcggcgcagctc

SEQ ID NO: 16387 - DNA, 15 bp, Artificial Sequence
  dgRNA
  Garem
aagcctgcgtaccag

SEQ ID NO: 16388 - DNA, 15 bp, Artificial Sequence
  dgRNA
  Garem
tgcgtaccagcggag

SEQ ID NO: 16389 - DNA, 15 bp, Artificial Sequence
  dgRNA
  Garem
gtggagctagcgtcg

SEQ ID NO: 16390 - DNA, 15 bp, Artificial Sequence
  dgRNA
  Garem
tggagctagcgtcgt

SEQ ID NO: 16391 - DNA, 15 bp, Artificial Sequence
  dgRNA
  Ncaph
tccgcgcccagcgct

SEQ ID NO: 16392 - DNA, 15 bp, Artificial Sequence
  dgRNA
  Ncaph
ccaaacgtcttcagc

SEQ ID NO: 16393 - DNA, 15 bp, Artificial Sequence
  dgRNA
  Ncaph
ctgtccaagtttccg

SEQ ID NO: 16394 - DNA, 15 bp, Artificial Sequence
  dgRNA
  Ncaph
atcagccagccgcct

SEQ ID NO: 16395 - DNA, 15 bp, Artificial Sequence
  dgRNA
  Ago3
gggattgtcgccgtc

SEQ ID NO: 16396 - DNA, 15 bp, Artificial Sequence
  dgRNA
  Ago3
cgccgtcaggcacag

SEQ ID NO: 16397 - DNA, 15 bp, Artificial Sequence
  dgRNA
  Ago3
gccgtcaggcacagc

SEQ ID NO: 16398 - DNA, 15 bp, Artificial Sequence
  dgRNA
  Ago3
aggcacagcgggtgc

SEQ ID NO: 16399 - DNA, 15 bp, Artificial Sequence
  dgRNA
  Lrrc74b
ggaaagagcgtgcca

SEQ ID NO: 16400 - DNA, 15 bp, Artificial Sequence
  dgRNA
  Lrrc74b
caagacccggttccc

SEQ ID NO: 16401 - DNA, 15 bp, Artificial Sequence
  dgRNA
  Lrrc74b
cggttcccaggacga

SEQ ID NO: 16402 - DNA, 15 bp, Artificial Sequence
  dgRNA
  Lrrc74b
ttcccaggacgacgg

SEQ ID NO: 16403 - DNA, 15 bp, Artificial Sequence
  dgRNA
  Tgm2
agaggtgcgtgttct

SEQ ID NO: 16404 - DNA, 15 bp, Artificial Sequence
  dgRNA
  Tgm2
cgtgttcttggccac

SEQ ID NO: 16405 - DNA, 15 bp, Artificial Sequence
  dgRNA
  Tgm2
ctgtgtctagggtat

SEQ ID NO: 16406 - DNA, 15 bp, Artificial Sequence
  dgRNA
  Tgm2
ttggtcacacgctcc

SEQ ID NO: 16407 - DNA, 15 bp, Artificial Sequence
  dgRNA
  Tmf1
ggcggctggtaacta

SEQ ID NO: 16408 - DNA, 15 bp, Artificial Sequence
  dgRNA
  Tmf1
gcggctggtaactaa

SEQ ID NO: 16409 - DNA, 15 bp, Artificial Sequence
  dgRNA
  Tmf1
ctccgctcccggatg

SEQ ID NO: 16410 - DNA, 15 bp, Artificial Sequence
  dgRNA
  Tmf1
ctccgtccttccgtc

SEQ ID NO: 16411 - DNA, 15 bp, Artificial Sequence
  dgRNA
  Etfdh
cgtttgtctctgccc

SEQ ID NO: 16412 - DNA, 15 bp, Artificial Sequence
  dgRNA
  Etfdh
atcagatatcaagcc

SEQ ID NO: 16413 - DNA, 15 bp, Artificial Sequence
  dgRNA
  Etfdh
aagccaggcgtcacc

SEQ ID NO: 16414 - DNA, 15 bp, Artificial Sequence
  dgRNA
  Etfdh
cctcgctatgcttct

SEQ ID NO: 16415 - DNA, 15 bp, Artificial Sequence
  dgRNA
  Prox1
cccccttgaatccga

SEQ ID NO: 16416 - DNA, 15 bp, Artificial Sequence
  dgRNA
  Prox1
aaggcgcctcgcgat

SEQ ID NO: 16417 - DNA, 15 bp, Artificial Sequence
  dgRNA
  Prox1
aggcgcctcgcgatt

SEQ ID NO: 16418 - DNA, 15 bp, Artificial Sequence
  dgRNA
  Prox1
ctcgcgattgggtgc

SEQ ID NO: 16419 - DNA, 15 bp, Artificial Sequence
  dgRNA
  Pdlim2
agggtctcagtctag

SEQ ID NO: 16420 - DNA, 15 bp, Artificial Sequence
  dgRNA
  Pdlim2
gtctcagtctagagg

SEQ ID NO: 16421 - DNA, 15 bp, Artificial Sequence
  dgRNA
  Pdlim2
ctagaggcggttttc

SEQ ID NO: 16422 - DNA, 15 bp, Artificial Sequence
  dgRNA
  Pdlim2
gaggcggttttcagg

SEQ ID NO: 16423 - DNA, 15 bp, Artificial Sequence
  dgRNA
  Umodl1
taggctctgacatgc

SEQ ID NO: 16424 - DNA, 15 bp, Artificial Sequence
  dgRNA
  Umodl1
catgcaggcgccccc

SEQ ID NO: 16425 - DNA, 15 bp, Artificial Sequence
  dgRNA
  Umodl1
atgcaggcgccccca

SEQ ID NO: 16426 - DNA, 15 bp, Artificial Sequence
  dgRNA
  Umodl1
cacagccatgccggt

SEQ ID NO: 16427 - DNA, 15 bp, Artificial Sequence
  dgRNA
  Pdpk1
acatgaggattagtt

SEQ ID NO: 16428 - DNA, 15 bp, Artificial Sequence
  dgRNA
  Pdpk1
aactaatcctcatgt

SEQ ID NO: 16429 - DNA, 15 bp, Artificial Sequence
  dgRNA
  Pdpk1
gggaaccatcttaga

SEQ ID NO: 16430 - DNA, 15 bp, Artificial Sequence
  dgRNA
  Pdpk1
atgaagtagcttgag

SEQ ID NO: 16431 - DNA, 15 bp, Artificial Sequence
  dgRNA
  Hnf1b
ccagcgtgagtagaa

SEQ ID NO: 16432 - DNA, 15 bp, Artificial Sequence
  dgRNA
  Hnf1b
cagcgtgagtagaat

SEQ ID NO: 16433 - DNA, 15 bp, Artificial Sequence
  dgRNA
  Hnf1b
gagtagaatgggctc

SEQ ID NO: 16434 - DNA, 15 bp, Artificial Sequence
  dgRNA
  Hnf1b
ggcaagtcccaatcc

SEQ ID NO: 16435 - DNA, 15 bp, Artificial Sequence
  dgRNA
  Slc28a3
ctacagagaaaacgg

SEQ ID NO: 16436 - DNA, 15 bp, Artificial Sequence
  dgRNA
  Slc28a3
tacagagaaaacggc

SEQ ID NO: 16437 - DNA, 15 bp, Artificial Sequence
  dgRNA
  Slc28a3
ggcgtgctcaaaaag

SEQ ID NO: 16438 - DNA, 15 bp, Artificial Sequence
  dgRNA
  Slc28a3
gcgggcagaagggcg

SEQ ID NO: 16439 - DNA, 15 bp, Artificial Sequence
  dgRNA
  Pth1r
cgtcaactgaggcag

SEQ ID NO: 16440 - DNA, 15 bp, Artificial Sequence
  dgRNA
  Pth1r
aaggcaaacccttgg

SEQ ID NO: 16441 - DNA, 15 bp, Artificial Sequence
  dgRNA
  Pth1r
aacccttgggggtta

SEQ ID NO: 16442 - DNA, 15 bp, Artificial Sequence
  dgRNA
  Pth1r
acccttgggggttaa

SEQ ID NO: 16443 - DNA, 15 bp, Artificial Sequence
  dgRNA
  Tbc1d8
aattcgagactcgtc

SEQ ID NO: 16444 - DNA, 15 bp, Artificial Sequence
  dgRNA
  Tbc1d8
attcgagactcgtcc

SEQ ID NO: 16445 - DNA, 15 bp, Artificial Sequence
  dgRNA
  Tbc1d8
ctcgtccgggactag

SEQ ID NO: 16446 - DNA, 15 bp, Artificial Sequence
  dgRNA
  Tbc1d8
tcgtccgggactaga

SEQ ID NO: 16447 - DNA, 15 bp, Artificial Sequence
  dgRNA
  Cav1
gctgccagaaccttg

SEQ ID NO: 16448 - DNA, 15 bp, Artificial Sequence
  dgRNA
  Cav1
ggatgtgcctagacc

SEQ ID NO: 16449 - DNA, 15 bp, Artificial Sequence
  dgRNA
  Cav1
tggcgaacagccaag

SEQ ID NO: 16450 - DNA, 15 bp, Artificial Sequence
  dgRNA
  Cav1
gatattttagactcg

SEQ ID NO: 16451 - DNA, 15 bp, Artificial Sequence
  dgRNA
  Ugt3a1
caacactagttaagg

SEQ ID NO: 16452 - DNA, 15 bp, Artificial Sequence
  dgRNA
  Ugt3a1
aacactagttaagga

SEQ ID NO: 16453 - DNA, 15 bp, Artificial Sequence
  dgRNA
  Ugt3a1
gggcaaaagggcatt

SEQ ID NO: 16454 - DNA, 15 bp, Artificial Sequence
  dgRNA
  Ugt3a1
atgcccttttgccct

SEQ ID NO: 16455 - DNA, 15 bp, Artificial Sequence
  dgRNA
  Prmt5
caataacgatacttc

SEQ ID NO: 16456 - DNA, 15 bp, Artificial Sequence
  dgRNA
  Prmt5
tcaggtttttctgcg

SEQ ID NO: 16457 - DNA, 15 bp, Artificial Sequence
  dgRNA
  Prmt5
caggtttttctgcgg

SEQ ID NO: 16458 - DNA, 15 bp, Artificial Sequence
  dgRNA
  Prmt5
ttctgcgggggctcc

SEQ ID NO: 16459 - DNA, 15 bp, Artificial Sequence
  dgRNA
  Mlf1
caggagcctcgcgga

SEQ ID NO: 16460 - DNA, 15 bp, Artificial Sequence
  dgRNA
  Mlf1
aggagcctcgcggat

SEQ ID NO: 16461 - DNA, 15 bp, Artificial Sequence
  dgRNA
  Mlf1
ggagcctcgcggatg

SEQ ID NO: 16462 - DNA, 15 bp, Artificial Sequence
  dgRNA
  Mlf1
cttagtgacgtcata

SEQ ID NO: 16463 - DNA, 15 bp, Artificial Sequence
  dgRNA
  Slc16a6
cgctcacacccaaac

SEQ ID NO: 16464 - DNA, 15 bp, Artificial Sequence
  dgRNA
  Slc16a6
ggaacctgttcagtc

SEQ ID NO: 16465 - DNA, 15 bp, Artificial Sequence
  dgRNA
  Slc16a6
gttcagtccgggacc

SEQ ID NO: 16466 - DNA, 15 bp, Artificial Sequence
  dgRNA
  Slc16a6
ttcagtccgggacca

SEQ ID NO: 16467 - DNA, 15 bp, Artificial Sequence
  dgRNA
  Mroh2b
gcaactgcccctgac

SEQ ID NO: 16468 - DNA, 15 bp, Artificial Sequence
  dgRNA
  Mroh2b
ccctgacaggcattc

SEQ ID NO: 16469 - DNA, 15 bp, Artificial Sequence
  dgRNA
  Mroh2b
cggaatgcctgtcag

SEQ ID NO: 16470 - DNA, 15 bp, Artificial Sequence
  dgRNA
  Mroh2b
ccggaatgcctgtca

SEQ ID NO: 16471 - DNA, 15 bp, Artificial Sequence
  dgRNA
  Olfr448
aattaaatccattac

SEQ ID NO: 16472 - DNA, 15 bp, Artificial Sequence
  dgRNA
  Olfr448
tcgtgacaggccctg

SEQ ID NO: 16473 - DNA, 15 bp, Artificial Sequence
  dgRNA
  Sh3bgr
ctaggcacctctcca

SEQ ID NO: 16474 - DNA, 15 bp, Artificial Sequence
  dgRNA
  Sh3bgr
taggcacctctccat

SEQ ID NO: 16475 - DNA, 15 bp, Artificial Sequence
  dgRNA
  Sh3bgr
cccgagctctcagcc

SEQ ID NO: 16476 - DNA, 15 bp, Artificial Sequence
  dgRNA
  Sh3bgr
cctttaaagtgataa

SEQ ID NO: 16477 - DNA, 15 bp, Artificial Sequence
  dgRNA
  Opn1sw
ccagccttgttatcc

SEQ ID NO: 16478 - DNA, 15 bp, Artificial Sequence
  dgRNA
  Opn1sw
aagagatctctaatc

SEQ ID NO: 16479 - DNA, 15 bp, Artificial Sequence
  dgRNA
  Opn1sw
agagatctctaatct

SEQ ID NO: 16480 - DNA, 15 bp, Artificial Sequence
  dgRNA
  Opn1sw
ctgacctatattctt

SEQ ID NO: 16481 - DNA, 15 bp, Artificial Sequence
  dgRNA
  Fgb
tgactcaatgattcg

SEQ ID NO: 16482 - DNA, 15 bp, Artificial Sequence
  dgRNA
  Fgb
attaggccagcagtg

SEQ ID NO: 16483 - DNA, 15 bp, Artificial Sequence
  dgRNA
  Fgb
gtaaataaggcttgc

SEQ ID NO: 16484 - DNA, 15 bp, Artificial Sequence
  dgRNA
  Fgb
cctaatgtggacaca

SEQ ID NO: 16485 - DNA, 15 bp, Artificial Sequence
  dgRNA
  Tfap2b
cgtcatttacaatag

SEQ ID NO: 16486 - DNA, 15 bp, Artificial Sequence
  dgRNA
  Tfap2b
tcaattaactgagcg

SEQ ID NO: 16487 - DNA, 15 bp, Artificial Sequence
  dgRNA
  Tfap2b
ttcaattaactgagc

SEQ ID NO: 16488 - DNA, 15 bp, Artificial Sequence
  dgRNA
  Tfap2b
cttcaattaactgag

SEQ ID NO: 16489 - DNA, 15 bp, Artificial Sequence
  dgRNA
  Lrrc25
ggaagctgcgggcca

SEQ ID NO: 16490 - DNA, 15 bp, Artificial Sequence
  dgRNA
  Lrrc25
tactcgggggacatc

SEQ ID NO: 16491 - DNA, 15 bp, Artificial Sequence
  dgRNA
  Lrrc25
tgggcaggtactcgg

SEQ ID NO: 16492 - DNA, 15 bp, Artificial Sequence
  dgRNA
  Lrrc25
ctgggcaggtactcg

SEQ ID NO: 16493 - DNA, 15 bp, Artificial Sequence
  dgRNA
  Acta2
tgtttgggaagcgag

SEQ ID NO: 16494 - DNA, 15 bp, Artificial Sequence
  dgRNA
  Acta2
gtttgggaagcgagt

SEQ ID NO: 16495 - DNA, 15 bp, Artificial Sequence
  dgRNA
  Acta2
tgctcccgaaacagg

SEQ ID NO: 16496 - DNA, 15 bp, Artificial Sequence
  dgRNA
  Acta2
ttctgctcccgaaac

SEQ ID NO: 16497 - DNA, 15 bp, Artificial Sequence
  dgRNA
  Calr4
actcgggttggtccc

SEQ ID NO: 16498 - DNA, 15 bp, Artificial Sequence
  dgRNA
  Calr4
tgggcaccgagtgtt

SEQ ID NO: 16499 - DNA, 15 bp, Artificial Sequence
  dgRNA
  Calr4
gggcaccgagtgttt

SEQ ID NO: 16500 - DNA, 15 bp, Artificial Sequence
  dgRNA
  Calr4
caccgagtgtttggg

SEQ ID NO: 16501 - DNA, 15 bp, Artificial Sequence
  dgRNA
  Slc12a4
agtacttcgttcccg

SEQ ID NO: 16502 - DNA, 15 bp, Artificial Sequence
  dgRNA
  Slc12a4
tctcatcccccctcg

SEQ ID NO: 16503 - DNA, 15 bp, Artificial Sequence
  dgRNA
  Slc12a4
catcccccctcgggg

SEQ ID NO: 16504 - DNA, 15 bp, Artificial Sequence
  dgRNA
  Slc12a4
ccccgaggggcggcc

SEQ ID NO: 16505 - DNA, 15 bp, Artificial Sequence
  dgRNA
  Pphln1
aaaccccgacggccc

SEQ ID NO: 16506 - DNA, 15 bp, Artificial Sequence
  dgRNA
  Pphln1
aaccccgacggcccc

SEQ ID NO: 16507 - DNA, 15 bp, Artificial Sequence
  dgRNA
  Pphln1
ccgacggccccgggc

SEQ ID NO: 16508 - DNA, 15 bp, Artificial Sequence
  dgRNA
  Pphln1
acggccccgggccgg

SEQ ID NO: 16509 - DNA, 15 bp, Artificial Sequence
  dgRNA
  Nrbp1
tccggcagaattact

SEQ ID NO: 16510 - DNA, 15 bp, Artificial Sequence
  dgRNA
  Nrbp1
ccggcagaattactt

SEQ ID NO: 16511 - DNA, 15 bp, Artificial Sequence
  dgRNA
  Nrbp1
cggcagaattacttg

SEQ ID NO: 16512 - DNA, 15 bp, Artificial Sequence
  dgRNA
  Nrbp1
tgggggcacctcgac

SEQ ID NO: 16513 - DNA, 15 bp, Artificial Sequence
  dgRNA
  Gramd1c
tagttaattttcacg

SEQ ID NO: 16514 - DNA, 15 bp, Artificial Sequence
  dgRNA
  Gramd1c
agttaattttcacgt

SEQ ID NO: 16515 - DNA, 15 bp, Artificial Sequence
  dgRNA
  Gramd1c
gttaattttcacgtg

SEQ ID NO: 16516 - DNA, 15 bp, Artificial Sequence
  dgRNA
  Gramd1c
gcgacagggtgcaaa

SEQ ID NO: 16517 - DNA, 15 bp, Artificial Sequence
  dgRNA
  Gm9573
gcgctgggttgaaac

SEQ ID NO: 16518 - DNA, 15 bp, Artificial Sequence
  dgRNA
  Gm9573
tgatcacactgcgct

SEQ ID NO: 16519 - DNA, 15 bp, Artificial Sequence
  dgRNA
  Gm9573
atgatcacactgcgc

SEQ ID NO: 16520 - DNA, 15 bp, Artificial Sequence
  dgRNA
  Gm9573
aaggggatggtactt

SEQ ID NO: 16521 - DNA, 15 bp, Artificial Sequence
  dgRNA
  Vwa7
caggatgcgtctgcc

SEQ ID NO: 16522 - DNA, 15 bp, Artificial Sequence
  dgRNA
  Vwa7
actgcgctgtgcctg

SEQ ID NO: 16523 - DNA, 15 bp, Artificial Sequence
  dgRNA
  Vwa7
gcgctgtgcctgcgg

SEQ ID NO: 16524 - DNA, 15 bp, Artificial Sequence
  dgRNA
  Vwa7
tgcggaggcctgccc

SEQ ID NO: 16525 - DNA, 15 bp, Artificial Sequence
  dgRNA
  Ppp3ca
ccgccttagcgatga

SEQ ID NO: 16526 - DNA, 15 bp, Artificial Sequence
  dgRNA
  Ppp3ca
gccaatgagcttgcg

SEQ ID NO: 16527 - DNA, 15 bp, Artificial Sequence
  dgRNA
  Ppp3ca
ttgcgaggtgcaacg

SEQ ID NO: 16528 - DNA, 15 bp, Artificial Sequence
  dgRNA
  Ppp3ca
tgcgaggtgcaacgt

SEQ ID NO: 16529 - DNA, 15 bp, Artificial Sequence
  dgRNA
  Zfp207
cttcaatttgcatac

SEQ ID NO: 16530 - DNA, 15 bp, Artificial Sequence
  dgRNA
  Zfp207
ggatagccgacgtac

SEQ ID NO: 16531 - DNA, 15 bp, Artificial Sequence
  dgRNA
  Zfp207
tgacccaagctctaa

SEQ ID NO: 16532 - DNA, 15 bp, Artificial Sequence
  dgRNA
  Zfp207
cccgctcagccactc

SEQ ID NO: 16533 - DNA, 15 bp, Artificial Sequence
  dgRNA
  Olfr750
cgctttcctaagacg

SEQ ID NO: 16534 - DNA, 15 bp, Artificial Sequence
  dgRNA
  Olfr750
acgtggctacccttt

SEQ ID NO: 16535 - DNA, 15 bp, Artificial Sequence
  dgRNA
  Olfr750
cgtggctacccttta

SEQ ID NO: 16536 - DNA, 15 bp, Artificial Sequence
  dgRNA
  Olfr750
gtggctaccctttag

SEQ ID NO: 16537 - DNA, 15 bp, Artificial Sequence
  dgRNA
  Upp1
caacttttccgggtt

SEQ ID NO: 16538 - DNA, 15 bp, Artificial Sequence
  dgRNA
  Upp1
aacttttccgggttc

SEQ ID NO: 16539 - DNA, 15 bp, Artificial Sequence
  dgRNA
  Upp1
tccgggttcgggttg

SEQ ID NO: 16540 - DNA, 15 bp, Artificial Sequence
  dgRNA
  Upp1
ccgggttcgggttga

SEQ ID NO: 16541 - DNA, 15 bp, Artificial Sequence
  dgRNA
  Olfr33
tgaacatatctagag

SEQ ID NO: 16542 - DNA, 15 bp, Artificial Sequence
  dgRNA
  Olfr33
aagccaatcattccc

SEQ ID NO: 16543 - DNA, 15 bp, Artificial Sequence
  dgRNA
  Btbd6
actcgcccttaaacc

SEQ ID NO: 16544 - DNA, 15 bp, Artificial Sequence
  dgRNA
  Btbd6
ctcgcccttaaacct

SEQ ID NO: 16545 - DNA, 15 bp, Artificial Sequence
  dgRNA
  Btbd6
acctgggcacccggg

SEQ ID NO: 16546 - DNA, 15 bp, Artificial Sequence
  dgRNA
  Btbd6
agtgacgagagacgc

SEQ ID NO: 16547 - DNA, 15 bp, Artificial Sequence
  dgRNA
  Fbxo7
gcgcgcctcgcctcc

SEQ ID NO: 16548 - DNA, 15 bp, Artificial Sequence
  dgRNA
  Fbxo7
cgcctcgcctccagg

SEQ ID NO: 16549 - DNA, 15 bp, Artificial Sequence
  dgRNA
  Fbxo7
cgccgagccagcgat

SEQ ID NO: 16550 - DNA, 15 bp, Artificial Sequence
  dgRNA
  Fbxo7
gccgagccagcgata

SEQ ID NO: 16551 - DNA, 15 bp, Artificial Sequence
  dgRNA
  Zfp956
ccctagtggttggcg

SEQ ID NO: 16552 - DNA, 15 bp, Artificial Sequence
  dgRNA
  Zfp956
ggctctacagctcaa

SEQ ID NO: 16553 - DNA, 15 bp, Artificial Sequence
  dgRNA
  Zfp956
gtgctcacacctgcg

SEQ ID NO: 16554 - DNA, 15 bp, Artificial Sequence
  dgRNA
  Zfp956
ctagccaatagagtc

SEQ ID NO: 16555 - DNA, 15 bp, Artificial Sequence
  dgRNA
  Bmp15
aagaggtctacaagt

SEQ ID NO: 16556 - DNA, 15 bp, Artificial Sequence
  dgRNA
  Bmp15
ggtctacaagttgga

SEQ ID NO: 16557 - DNA, 15 bp, Artificial Sequence
  dgRNA
  Bmp15
gtctacaagttggat

SEQ ID NO: 16558 - DNA, 15 bp, Artificial Sequence
  dgRNA
  Bmp15
tttaaggcctgattg

SEQ ID NO: 16559 - DNA, 15 bp, Artificial Sequence
  dgRNA
  Gimap8
tagctgaagcttact

SEQ ID NO: 16560 - DNA, 15 bp, Artificial Sequence
  dgRNA
  Gimap8
ccggtgtgaacacaa

SEQ ID NO: 16561 - DNA, 15 bp, Artificial Sequence
  dgRNA
  Gripap1
ccaattactggtcag

SEQ ID NO: 16562 - DNA, 15 bp, Artificial Sequence
  dgRNA
  Gripap1
gaccttagcactgac

SEQ ID NO: 16563 - DNA, 15 bp, Artificial Sequence
  dgRNA
  Gripap1
gtaaattgtctgtta

SEQ ID NO: 16564 - DNA, 15 bp, Artificial Sequence
  dgRNA
  Gripap1
tgaccagtaattgga

SEQ ID NO: 16565 - DNA, 15 bp, Artificial Sequence
  dgRNA
  Sprr2i
caagctagtcatgcg

SEQ ID NO: 16566 - DNA, 15 bp, Artificial Sequence
  dgRNA
  Sprr2i
cgtggatttgcattt

SEQ ID NO: 16567 - DNA, 15 bp, Artificial Sequence
  dgRNA
  Sprr2i
gtgcttccattaggc

SEQ ID NO: 16568 - DNA, 15 bp, Artificial Sequence
  dgRNA
  Sprr2i
atgactagcttgact

SEQ ID NO: 16569 - DNA, 15 bp, Artificial Sequence
  dgRNA
  Slfn5
gttaactgaggttac

SEQ ID NO: 16570 - DNA, 15 bp, Artificial Sequence
  dgRNA
  Slfn5
tcttacggccactca

SEQ ID NO: 16571 - DNA, 15 bp, Artificial Sequence
  dgRNA
  Slfn5
ttcttacggccactc

SEQ ID NO: 16572 - DNA, 15 bp, Artificial Sequence
  dgRNA
  Slfn5
cgttaatagttctta

SEQ ID NO: 16573 - DNA, 15 bp, Artificial Sequence
  dgRNA
  Olfr298
ttttgcatacctgac

SEQ ID NO: 16574 - DNA, 15 bp, Artificial Sequence
  dgRNA
  Olfr298
atacctgacaggcta

SEQ ID NO: 16575 - DNA, 15 bp, Artificial Sequence
  dgRNA
  Ppp1r12b
tgctagattccccct

SEQ ID NO: 16576 - DNA, 15 bp, Artificial Sequence
  dgRNA
  Ppp1r12b
tagattccccctcgg

SEQ ID NO: 16577 - DNA, 15 bp, Artificial Sequence
  dgRNA
  Ppp1r12b
attccccctcggagg

SEQ ID NO: 16578 - DNA, 15 bp, Artificial Sequence
  dgRNA
  Ppp1r12b
ttccccctcggagga

SEQ ID NO: 16579 - DNA, 15 bp, Artificial Sequence
  dgRNA
  Trmt112
aagcacgtcgatgca

SEQ ID NO: 16580 - DNA, 15 bp, Artificial Sequence
  dgRNA
  Trmt112
cagcccacccgcaga

SEQ ID NO: 16581 - DNA, 15 bp, Artificial Sequence
  dgRNA
  Trmt112
tcgcagccacagcgc

SEQ ID NO: 16582 - DNA, 15 bp, Artificial Sequence
  dgRNA
  Trmt112
acagcgccggcttag

SEQ ID NO: 16583 - DNA, 15 bp, Artificial Sequence
  dgRNA
  1700037C18Rik
tacctcactgatata

SEQ ID NO: 16584 - DNA, 15 bp, Artificial Sequence
  dgRNA
  1700037C18Rik
aagataccctaccct

SEQ ID NO: 16585 - DNA, 15 bp, Artificial Sequence
  dgRNA
  1700037C18Rik
ttcgagacctgtacc

SEQ ID NO: 16586 - DNA, 15 bp, Artificial Sequence
  dgRNA
  1700037C18Rik
agacctgtacccgga

SEQ ID NO: 16587 - DNA, 15 bp, Artificial Sequence
  dgRNA
  Mageb16
aaggaacctctggta

SEQ ID NO: 16588 - DNA, 15 bp, Artificial Sequence
  dgRNA
  Mageb16
tctggtagggaaccc

SEQ ID NO: 16589 - DNA, 15 bp, Artificial Sequence
  dgRNA
  Mageb16
tctgcggctgcgaac

SEQ ID NO: 16590 - DNA, 15 bp, Artificial Sequence
  dgRNA
  Il3
atacatataaggtga

SEQ ID NO: 16591 - DNA, 15 bp, Artificial Sequence
  dgRNA
  Il3
caagattatcgacat

SEQ ID NO: 16592 - DNA, 15 bp, Artificial Sequence
  dgRNA
  Il3
tcaagattatcgaca

SEQ ID NO: 16593 - DNA, 15 bp, Artificial Sequence
  dgRNA
  Il3
cagctttatctgaca

SEQ ID NO: 16594 - DNA, 15 bp, Artificial Sequence
  dgRNA
  2810417H13Rik
ctagcaccgcctacc

SEQ ID NO: 16595 - DNA, 15 bp, Artificial Sequence
  dgRNA
  2810417H13Rik
tagcaccgcctacca

SEQ ID NO: 16596 - DNA, 15 bp, Artificial Sequence
  dgRNA
  2810417H13Rik
caccgcctaccaggg

SEQ ID NO: 16597 - DNA, 15 bp, Artificial Sequence
  dgRNA
  2810417H13Rik
acaaatcacgaccac

SEQ ID NO: 16598 - DNA, 15 bp, Artificial Sequence
  dgRNA
  Emx1
tgtggcggaggctaa

SEQ ID NO: 16599 - DNA, 15 bp, Artificial Sequence
  dgRNA
  Emx1
accaatgctccagtc

SEQ ID NO: 16600 - DNA, 15 bp, Artificial Sequence
  dgRNA
  Emx1
gcttttgcctccgac

SEQ ID NO: 16601 - DNA, 15 bp, Artificial Sequence
  dgRNA
  Emx1
cttttgcctccgact

SEQ ID NO: 16602 - DNA, 15 bp, Artificial Sequence
  dgRNA
  Klra2
ttcaactatcaatta

SEQ ID NO: 16603 - DNA, 15 bp, Artificial Sequence
  dgRNA
  Klra2
gcttagatcaagagg

SEQ ID NO: 16604 - DNA, 15 bp, Artificial Sequence
  dgRNA
  Klra2
cttagatcaagagga

SEQ ID NO: 16605 - DNA, 15 bp, Artificial Sequence
  dgRNA
  Klra2
ccgaatgttatgagc

SEQ ID NO: 16606 - DNA, 15 bp, Artificial Sequence
  dgRNA
  Hnrnpm
acccaactgtatctg

SEQ ID NO: 16607 - DNA, 15 bp, Artificial Sequence
  dgRNA
  Hnrnpm
tgtatctgcggacat

SEQ ID NO: 16608 - DNA, 15 bp, Artificial Sequence
  dgRNA
  Hnrnpm
gtatctgcggacatc

SEQ ID NO: 16609 - DNA, 15 bp, Artificial Sequence
  dgRNA
  Hnrnpm
ggacatcgggaagtg

SEQ ID NO: 16610 - DNA, 15 bp, Artificial Sequence
  dgRNA
  Nhsl1
gcgctcatgcaaatg

SEQ ID NO: 16611 - DNA, 15 bp, Artificial Sequence
  dgRNA
  Nhsl1
aatgaggaccgtgat

SEQ ID NO: 16612 - DNA, 15 bp, Artificial Sequence
  dgRNA
  Nhsl1
ttccgccgttgtcgc

SEQ ID NO: 16613 - DNA, 15 bp, Artificial Sequence
  dgRNA
  Nhsl1
agattaggtttcagt

SEQ ID NO: 16614 - DNA, 15 bp, Artificial Sequence
  dgRNA
  Mpp7
acgacctttttcctt

SEQ ID NO: 16615 - DNA, 15 bp, Artificial Sequence
  dgRNA
  Mpp7
ttgctcttggcccat

SEQ ID NO: 16616 - DNA, 15 bp, Artificial Sequence
  dgRNA
  Mpp7
ccagagtctccgccc

SEQ ID NO: 16617 - DNA, 15 bp, Artificial Sequence
  dgRNA
  Mpp7
cagagtctccgcccc

SEQ ID NO: 16618 - DNA, 15 bp, Artificial Sequence
  dgRNA
  Wbp2nl
cgcccactgccttgc

SEQ ID NO: 16619 - DNA, 15 bp, Artificial Sequence
  dgRNA
  Wbp2nl
ttgaagagctggcgg

SEQ ID NO: 16620 - DNA, 15 bp, Artificial Sequence
  dgRNA
  Wbp2nl
cccctagaacgggga

SEQ ID NO: 16621 - DNA, 15 bp, Artificial Sequence
  dgRNA
  Wbp2nl
acccctagaacgggg

SEQ ID NO: 16622 - DNA, 15 bp, Artificial Sequence
  dgRNA
  Gas1
aagggcgccggagag

SEQ ID NO: 16623 - DNA, 15 bp, Artificial Sequence
  dgRNA
  Gas1
gaaagcgggcaagcc

SEQ ID NO: 16624 - DNA, 15 bp, Artificial Sequence
  dgRNA
  Gas1
caagcctggagcgcg

SEQ ID NO: 16625 - DNA, 15 bp, Artificial Sequence
  dgRNA
  Gas1
aagcctggagcgcgc

SEQ ID NO: 16626 - DNA, 15 bp, Artificial Sequence
  dgRNA
  Acer3
tccggattcccaccc

SEQ ID NO: 16627 - DNA, 15 bp, Artificial Sequence
  dgRNA
  Acer3
ccggattcccaccca

SEQ ID NO: 16628 - DNA, 15 bp, Artificial Sequence
  dgRNA
  Acer3
cagccccgcacgatc

SEQ ID NO: 16629 - DNA, 15 bp, Artificial Sequence
  dgRNA
  Acer3
cccgcacgatcagga

SEQ ID NO: 16630 - DNA, 15 bp, Artificial Sequence
  dgRNA
  Deb1
cgcgcgtccaatcac

SEQ ID NO: 16631 - DNA, 15 bp, Artificial Sequence
  dgRNA
  Deb1
cccccgcctccacgc

SEQ ID NO: 16632 - DNA, 15 bp, Artificial Sequence
  dgRNA
  Deb1
ccccgcctccacgcg

SEQ ID NO: 16633 - DNA, 15 bp, Artificial Sequence
  dgRNA
  Deb1
cgcctccacgcgggg

SEQ ID NO: 16634 - DNA, 15 bp, Artificial Sequence
  dgRNA
  Osbpl3
ccgacttcatcagca

SEQ ID NO: 16635 - DNA, 15 bp, Artificial Sequence
  dgRNA
  Osbpl3
gacttcatcagcacg

SEQ ID NO: 16636 - DNA, 15 bp, Artificial Sequence
  dgRNA
  Osbpl3
ttcatcagcacgggg

SEQ ID NO: 16637 - DNA, 15 bp, Artificial Sequence
  dgRNA
  Osbpl3
gtgctgatgaagtcg

SEQ ID NO: 16638 - DNA, 15 bp, Artificial Sequence
  dgRNA
  Mtg2
acagtaatgcccgcg

SEQ ID NO: 16639 - DNA, 15 bp, Artificial Sequence
  dgRNA
  Mtg2
cagtaatgcccgcgt

SEQ ID NO: 16640 - DNA, 15 bp, Artificial Sequence
  dgRNA
  Mtg2
gtgggatttaatatc

SEQ ID NO: 16641 - DNA, 15 bp, Artificial Sequence
  dgRNA
  Mtg2
tattaaatcccacgc

SEQ ID NO: 16642 - DNA, 15 bp, Artificial Sequence
  dgRNA
  H2-Eb1
ccttacccaatccag

SEQ ID NO: 16643 - DNA, 15 bp, Artificial Sequence
  dgRNA
  H2-Eb1
atggatactcagtct

SEQ ID NO: 16644 - DNA, 15 bp, Artificial Sequence
  dgRNA
  H2-Eb1
catggatactcagtc

SEQ ID NO: 16645 - DNA, 15 bp, Artificial Sequence
  dgRNA
  H2-Eb1
gctttgccactggat

SEQ ID NO: 16646 - DNA, 15 bp, Artificial Sequence
  dgRNA
  Fbxo5
gtcggagctgtcccc

SEQ ID NO: 16647 - DNA, 15 bp, Artificial Sequence
  dgRNA
  Fbxo5
ggagaagccggttcg

SEQ ID NO: 16648 - DNA, 15 bp, Artificial Sequence
  dgRNA
  Fbxo5
gagaagccggttcgc

SEQ ID NO: 16649 - DNA, 15 bp, Artificial Sequence
  dgRNA
  Fbxo5
cggttcgcgggataa

SEQ ID NO: 16650 - DNA, 15 bp, Artificial Sequence
  dgRNA
  Prss45
atcttagagcactag

SEQ ID NO: 16651 - DNA, 15 bp, Artificial Sequence
  dgRNA
  Prss45
gtgctgtcatagatc

SEQ ID NO: 16652 - DNA, 15 bp, Artificial Sequence
  dgRNA
  Prss45
tattaaggacgagag

SEQ ID NO: 16653 - DNA, 15 bp, Artificial Sequence
  dgRNA
  Prss45
attaaggacgagagt

SEQ ID NO: 16654 - DNA, 15 bp, Artificial Sequence
  dgRNA
  Sorcs3
tttaaaagaggtcgg

SEQ ID NO: 16655 - DNA, 15 bp, Artificial Sequence
  dgRNA
  Sorcs3
gtcggtggaaaagat

SEQ ID NO: 16656 - DNA, 15 bp, Artificial Sequence
  dgRNA
  Sorcs3
tcggtggaaaagatt

SEQ ID NO: 16657 - DNA, 15 bp, Artificial Sequence
  dgRNA
  Sorcs3
gagcaagcgatccag

SEQ ID NO: 16658 - DNA, 15 bp, Artificial Sequence
  dgRNA
  Prr19
gagaggggcggactc

SEQ ID NO: 16659 - DNA, 15 bp, Artificial Sequence
  dgRNA
  Prr19
gggcggactctggac

SEQ ID NO: 16660 - DNA, 15 bp, Artificial Sequence
  dgRNA
  Prr19
ggcggactctggaca

SEQ ID NO: 16661 - DNA, 15 bp, Artificial Sequence
  dgRNA
  Prr19
cataactgtcaatct

SEQ ID NO: 16662 - DNA, 15 bp, Artificial Sequence
  dgRNA
  Dcdc2b
atgctcccatgcaag

SEQ ID NO: 16663 - DNA, 15 bp, Artificial Sequence
  dgRNA
  Dcdc2b
gcaggactctacctt

SEQ ID NO: 16664 - DNA, 15 bp, Artificial Sequence
  dgRNA
  Dcdc2b
gtgagccccttgcat

SEQ ID NO: 16665 - DNA, 15 bp, Artificial Sequence
  dgRNA
  Dclk1
gcggtggcaacgcgt

SEQ ID NO: 16666 - DNA, 15 bp, Artificial Sequence
  dgRNA
  Dclk1
caacgcgttggcaag

SEQ ID NO: 16667 - DNA, 15 bp, Artificial Sequence
  dgRNA
  Dclk1
acctcccactgccgc

SEQ ID NO: 16668 - DNA, 15 bp, Artificial Sequence
  dgRNA
  Dclk1
cctcccactgccgct

SEQ ID NO: 16669 - DNA, 15 bp, Artificial Sequence
  dgRNA
  Adcy3
tatctgccaccaatt

SEQ ID NO: 16670 - DNA, 15 bp, Artificial Sequence
  dgRNA
  Adcy3
ccacgcagtcgtcgc

SEQ ID NO: 16671 - DNA, 15 bp, Artificial Sequence
  dgRNA
  Adcy3
cacgcagtcgtcgcc

SEQ ID NO: 16672 - DNA, 15 bp, Artificial Sequence
  dgRNA
  Adcy3
gtcgtcgccgggcgc

SEQ ID NO: 16673 - DNA, 15 bp, Artificial Sequence
  dgRNA
  Vill
aagaagtaatctacc

SEQ ID NO: 16674 - DNA, 15 bp, Artificial Sequence
  dgRNA
  Vill
taatctaccaggcca

SEQ ID NO: 16675 - DNA, 15 bp, Artificial Sequence
  dgRNA
  Vill
aatctaccaggccac

SEQ ID NO: 16676 - DNA, 15 bp, Artificial Sequence
  dgRNA
  Vill
taccaggccacggga

SEQ ID NO: 16677 - DNA, 15 bp, Artificial Sequence
  dgRNA
  Sptbn2
gagtatagaacccaa

SEQ ID NO: 16678 - DNA, 15 bp, Artificial Sequence
  dgRNA
  Sptbn2
gttagctctccaatc

SEQ ID NO: 16679 - DNA, 15 bp, Artificial Sequence
  dgRNA
  Sptbn2
ttgtagcaagccttt

SEQ ID NO: 16680 - DNA, 15 bp, Artificial Sequence
  dgRNA
  Sptbn2
actgttcctccagat

SEQ ID NO: 16681 - DNA, 15 bp, Artificial Sequence
  dgRNA
  Ubl4a
aaacgtcacatccgt

SEQ ID NO: 16682 - DNA, 15 bp, Artificial Sequence
  dgRNA
  Ubl4a
aacgtcacatccgtt

SEQ ID NO: 16683 - DNA, 15 bp, Artificial Sequence
  dgRNA
  Ubl4a
tgacacaagcccgcc

SEQ ID NO: 16684 - DNA, 15 bp, Artificial Sequence
  dgRNA
  Ubl4a
gacacaagcccgcca

SEQ ID NO: 16685 - DNA, 15 bp, Artificial Sequence
  dgRNA
  Keap1
cccacgcgtgccgcc

SEQ ID NO: 16686 - DNA, 15 bp, Artificial Sequence
  dgRNA
  Keap1
ccacgcgtgccgccc

SEQ ID NO: 16687 - DNA, 15 bp, Artificial Sequence
  dgRNA
  Keap1
ctcttcccggaagcg

SEQ ID NO: 16688 - DNA, 15 bp, Artificial Sequence
  dgRNA
  Keap1
aagcgcggcgcgtgg

SEQ ID NO: 16689 - DNA, 15 bp, Artificial Sequence
  dgRNA
  Cadm4
tctccccgcattgtc

SEQ ID NO: 16690 - DNA, 15 bp, Artificial Sequence
  dgRNA
  Cadm4
ctccccgcattgtct

SEQ ID NO: 16691 - DNA, 15 bp, Artificial Sequence
  dgRNA
  Cadm4
ccctctgtccccgtc

SEQ ID NO: 16692 - DNA, 15 bp, Artificial Sequence
  dgRNA
  Cadm4
acgccacgcccacca

SEQ ID NO: 16693 - DNA, 15 bp, Artificial Sequence
  dgRNA
  Nup88
cttggcttcaacccg

SEQ ID NO: 16694 - DNA, 15 bp, Artificial Sequence
  dgRNA
  Nup88
gcgattctttcttat

SEQ ID NO: 16695 - DNA, 15 bp, Artificial Sequence
  dgRNA
  Nup88
cgattctttcttatt

SEQ ID NO: 16696 - DNA, 15 bp, Artificial Sequence
  dgRNA
  Nup88
gtgctggccgcggat

SEQ ID NO: 16697 - DNA, 15 bp, Artificial Sequence
  dgRNA
  Ccdc159
ggagcacacgagctc

SEQ ID NO: 16698 - DNA, 15 bp, Artificial Sequence
  dgRNA
  Ccdc159
cacgagctcaggcgt

SEQ ID NO: 16699 - DNA, 15 bp, Artificial Sequence
  dgRNA
  Ccdc159
acgagctcaggcgta

SEQ ID NO: 16700 - DNA, 15 bp, Artificial Sequence
  dgRNA
  Ccdc159
agggaccaagaaccg

SEQ ID NO: 16701 - DNA, 15 bp, Artificial Sequence
  dgRNA
  Snx24
tcggagcccgcaggc

SEQ ID NO: 16702 - DNA, 15 bp, Artificial Sequence
  dgRNA
  Snx24
cggagcccgcaggca

SEQ ID NO: 16703 - DNA, 15 bp, Artificial Sequence
  dgRNA
  Snx24
agggctagggcgacc

SEQ ID NO: 16704 - DNA, 15 bp, Artificial Sequence
  dgRNA
  Snx24
gggctagggcgaccc

SEQ ID NO: 16705 - DNA, 15 bp, Artificial Sequence
  dgRNA
  Tmem151a
gggtgccgcagagca

SEQ ID NO: 16706 - DNA, 15 bp, Artificial Sequence
  dgRNA
  Tmem151a
gcaaggactcgccca

SEQ ID NO: 16707 - DNA, 15 bp, Artificial Sequence
  dgRNA
  Tmem151a
tcgcaagcgcgagcg

SEQ ID NO: 16708 - DNA, 15 bp, Artificial Sequence
  dgRNA
  Tmem151a
gcggctagagaaacc

SEQ ID NO: 16709 - DNA, 15 bp, Artificial Sequence
  dgRNA
  Ephx1
gaaggctgtagcacc

SEQ ID NO: 16710 - DNA, 15 bp, Artificial Sequence
  dgRNA
  Ephx1
caaccagccaactcg

SEQ ID NO: 16711 - DNA, 15 bp, Artificial Sequence
  dgRNA
  Ephx1
aaccagccaactcgg

SEQ ID NO: 16712 - DNA, 15 bp, Artificial Sequence
  dgRNA
  Ephx1
agccaactcgggggt

SEQ ID NO: 16713 - DNA, 15 bp, Artificial Sequence
  dgRNA
  Speer2
caagtgacggttctt

SEQ ID NO: 16714 - DNA, 15 bp, Artificial Sequence
  dgRNA
  Speer2
aagtgacggttcttt

SEQ ID NO: 16715 - DNA, 15 bp, Artificial Sequence
  dgRNA
  Speer2
gctcacggaactcct

SEQ ID NO: 16716 - DNA, 15 bp, Artificial Sequence
  dgRNA
  Speer2
ctcacggaactcctt

SEQ ID NO: 16717 - DNA, 15 bp, Artificial Sequence
  dgRNA
  Actb
ctgcactgtgcggcg

SEQ ID NO: 16718 - DNA, 15 bp, Artificial Sequence
  dgRNA
  Actb
actgtgcggcgaggc

SEQ ID NO: 16719 - DNA, 15 bp, Artificial Sequence
  dgRNA
  Actb
ggtgagtgagcgacg

SEQ ID NO: 16720 - DNA, 15 bp, Artificial Sequence
  dgRNA
  Actb
cttttatggctcgag

SEQ ID NO: 16721 - DNA, 15 bp, Artificial Sequence
  dgRNA
  Slc35f2
atttgcagtatgcct

SEQ ID NO: 16722 - DNA, 15 bp, Artificial Sequence
  dgRNA
  Slc35f2
tagccgggtctatcc

SEQ ID NO: 16723 - DNA, 15 bp, Artificial Sequence
  dgRNA
  Slc35f2
tgggtggagttgatt

SEQ ID NO: 16724 - DNA, 15 bp, Artificial Sequence
  dgRNA
  Eef2k
atctccgggtgcttt

SEQ ID NO: 16725 - DNA, 15 bp, Artificial Sequence
  dgRNA
  Eef2k
taaacctcccctctg

SEQ ID NO: 16726 - DNA, 15 bp, Artificial Sequence
  dgRNA
  Eef2k
atcgggagacacaag

SEQ ID NO: 16727 - DNA, 15 bp, Artificial Sequence
  dgRNA
  Eef2k
aagcacccggagatc

SEQ ID NO: 16728 - DNA, 15 bp, Artificial Sequence
  dgRNA
  Syndig1
tggaacggcacatcc

SEQ ID NO: 16729 - DNA, 15 bp, Artificial Sequence
  dgRNA
  Syndig1
ggaacggcacatccc

SEQ ID NO: 16730 - DNA, 15 bp, Artificial Sequence
  dgRNA
  Syndig1
ctcctaggggccaag

SEQ ID NO: 16731 - DNA, 15 bp, Artificial Sequence
  dgRNA
  Syndig1
aagaggaccgggttc

SEQ ID NO: 16732 - DNA, 15 bp, Artificial Sequence
  dgRNA
  Ect2
cctcaagcccacatc

SEQ ID NO: 16733 - DNA, 15 bp, Artificial Sequence
  dgRNA
  Ect2
tcacaaccaatcagc

SEQ ID NO: 16734 - DNA, 15 bp, Artificial Sequence
  dgRNA
  Ect2
gccggcgcctcccga

SEQ ID NO: 16735 - DNA, 15 bp, Artificial Sequence
  dgRNA
  Ect2
cccgaaggcagacgt

SEQ ID NO: 16736 - DNA, 15 bp, Artificial Sequence
  dgRNA
  Crtap
agttccacgcaccgc

SEQ ID NO: 16737 - DNA, 15 bp, Artificial Sequence
  dgRNA
  Crtap
ccacgcaccgcaggc

SEQ ID NO: 16738 - DNA, 15 bp, Artificial Sequence
  dgRNA
  Crtap
caggcacgcccatct

SEQ ID NO: 16739 - DNA, 15 bp, Artificial Sequence
  dgRNA
  Crtap
cccatctcggtcccc

SEQ ID NO: 16740 - DNA, 15 bp, Artificial Sequence
  dgRNA
  Nudt19
aagcattgctagtct

SEQ ID NO: 16741 - DNA, 15 bp, Artificial Sequence
  dgRNA
  Homer1
accagcagttttaac

SEQ ID NO: 16742 - DNA, 15 bp, Artificial Sequence
  dgRNA
  Homer1
ggtcaactgaagtct

SEQ ID NO: 16743 - DNA, 15 bp, Artificial Sequence
  dgRNA
  Homer1
tgtaaaaagtgtacc

SEQ ID NO: 16744 - DNA, 15 bp, Artificial Sequence
  dgRNA
  Homer1
cgagacgtgcctgtt

SEQ ID NO: 16745 - DNA, 15 bp, Artificial Sequence
  dgRNA
  Sgce
tggaaacgcgtgtat

SEQ ID NO: 16746 - DNA, 15 bp, Artificial Sequence
  dgRNA
  Sgce
ggaaacgcgtgtatc

SEQ ID NO: 16747 - DNA, 15 bp, Artificial Sequence
  dgRNA
  Sgce
cgtgtatcgggagtc

SEQ ID NO: 16748 - DNA, 15 bp, Artificial Sequence
  dgRNA
  Sgce
gtgcttcgcgagcag

SEQ ID NO: 16749 - DNA, 15 bp, Artificial Sequence
  dgRNA
  Ccdc69
ggcctcaggtacttc

SEQ ID NO: 16750 - DNA, 15 bp, Artificial Sequence
  dgRNA
  Ccdc69
caggtacttctggcg

SEQ ID NO: 16751 - DNA, 15 bp, Artificial Sequence
  dgRNA
  Ccdc69
ggcgtggagcgccgc

SEQ ID NO: 16752 - DNA, 15 bp, Artificial Sequence
  dgRNA
  Ccdc69
cggccccggctcggc

SEQ ID NO: 16753 - DNA, 15 bp, Artificial Sequence
  dgRNA
  Ptges
gagccaaggatggcg

SEQ ID NO: 16754 - DNA, 15 bp, Artificial Sequence
  dgRNA
  Ptges
ccccacccggacact

SEQ ID NO: 16755 - DNA, 15 bp, Artificial Sequence
  dgRNA
  Ptges
cttcttgacttgagc

SEQ ID NO: 16756 - DNA, 15 bp, Artificial Sequence
  dgRNA
  Ptges
ctgctgcgggtgatc

SEQ ID NO: 16757 - DNA, 15 bp, Artificial Sequence
  dgRNA
  Ccdc153
ttttacaccttggat

SEQ ID NO: 16758 - DNA, 15 bp, Artificial Sequence
  dgRNA
  Ccdc153
tagactcaatctact

SEQ ID NO: 16759 - DNA, 15 bp, Artificial Sequence
  dgRNA
  Ccdc153
agactcaatctactt

SEQ ID NO: 16760 - DNA, 15 bp, Artificial Sequence
  dgRNA
  Ccdc153
cgttgtccaggcaac

SEQ ID NO: 16761 - DNA, 15 bp, Artificial Sequence
  dgRNA
  Clec12b
acgttctaattccta

SEQ ID NO: 16762 - DNA, 15 bp, Artificial Sequence
  dgRNA
  Clec12b
aggaatggcctgaac

SEQ ID NO: 16763 - DNA, 15 bp, Artificial Sequence
  dgRNA
  Clec12b
ggaatggcctgaact

SEQ ID NO: 16764 - DNA, 15 bp, Artificial Sequence
  dgRNA
  Clec12b
tgttgcaatctcttc

SEQ ID NO: 16765 - DNA, 15 bp, Artificial Sequence
  dgRNA
  Tmem178b
tagaggctatcacca

SEQ ID NO: 16766 - DNA, 15 bp, Artificial Sequence
  dgRNA
  Tmem178b
agaggctatcaccaa

SEQ ID NO: 16767 - DNA, 15 bp, Artificial Sequence
  dgRNA
  Tmem178b
gctgcattgagtccc

SEQ ID NO: 16768 - DNA, 15 bp, Artificial Sequence
  dgRNA
  Tmem178b
ctgcattgagtcccg

SEQ ID NO: 16769 - DNA, 15 bp, Artificial Sequence
  dgRNA
  Akr1c21
ctaacttaagctaac

SEQ ID NO: 16770 - DNA, 15 bp, Artificial Sequence
  dgRNA
  Akr1c21
gattatataatagcc

SEQ ID NO: 16771 - DNA, 15 bp, Artificial Sequence
  dgRNA
  Akr1c21
atctgtgtcacgtgt

SEQ ID NO: 16772 - DNA, 15 bp, Artificial Sequence
  dgRNA
  Bmpr2
cacggcgtccacgtg

SEQ ID NO: 16773 - DNA, 15 bp, Artificial Sequence
  dgRNA
  Bmpr2
gcgttcgcctgtgtg

SEQ ID NO: 16774 - DNA, 15 bp, Artificial Sequence
  dgRNA
  Bmpr2
cgcctgtgtgaggaa

SEQ ID NO: 16775 - DNA, 15 bp, Artificial Sequence
  dgRNA
  Bmpr2
ctgcactgggcgccc

SEQ ID NO: 16776 - DNA, 15 bp, Artificial Sequence
  dgRNA
  Skap1
atctaggcaattttt

SEQ ID NO: 16777 - DNA, 15 bp, Artificial Sequence
  dgRNA
  Skap1
ggcaattttttggtg

SEQ ID NO: 16778 - DNA, 15 bp, Artificial Sequence
  dgRNA
  Skap1
gcaattttttggtga

SEQ ID NO: 16779 - DNA, 15 bp, Artificial Sequence
  dgRNA
  Skap1
tgcgtgccacctcag

SEQ ID NO: 16780 - DNA, 15 bp, Artificial Sequence
  dgRNA
  Tiam1
tcctgatatgttgcc

SEQ ID NO: 16781 - DNA, 15 bp, Artificial Sequence
  dgRNA
  Tiam1
ctgatatgttgcctg

SEQ ID NO: 16782 - DNA, 15 bp, Artificial Sequence
  dgRNA
  Tiam1
attctgatagcgcac

SEQ ID NO: 16783 - DNA, 15 bp, Artificial Sequence
  dgRNA
  Tiam1
tagcatgccaagcct

SEQ ID NO: 16784 - DNA, 15 bp, Artificial Sequence
  dgRNA
  Ndufa9
acttccgttcccagt

SEQ ID NO: 16785 - DNA, 15 bp, Artificial Sequence
  dgRNA
  Ndufa9
ggcgtttgcgcagag

SEQ ID NO: 16786 - DNA, 15 bp, Artificial Sequence
  dgRNA
  Ndufa9
cgttgttgccgtagt

SEQ ID NO: 16787 - DNA, 15 bp, Artificial Sequence
  dgRNA
  Ndufa9
tgttgccgtagttgg

SEQ ID NO: 16788 - DNA, 15 bp, Artificial Sequence
  dgRNA
  Abhd4
ttaatgctcctgcgc

SEQ ID NO: 16789 - DNA, 15 bp, Artificial Sequence
  dgRNA
  Abhd4
taatgctcctgcgca

SEQ ID NO: 16790 - DNA, 15 bp, Artificial Sequence
  dgRNA
  Abhd4
gcctatctccccctc

SEQ ID NO: 16791 - DNA, 15 bp, Artificial Sequence
  dgRNA
  Abhd4
cgccctctgttgctc

SEQ ID NO: 16792 - DNA, 15 bp, Artificial Sequence
  dgRNA
  Zfp213
ccatctccgacattc

SEQ ID NO: 16793 - DNA, 15 bp, Artificial Sequence
  dgRNA
  Zfp213
cgcgcatgcgccagc

SEQ ID NO: 16794 - DNA, 15 bp, Artificial Sequence
  dgRNA
  Zfp213
agtcggatgcttggg

SEQ ID NO: 16795 - DNA, 15 bp, Artificial Sequence
  dgRNA
  Zfp213
ctaagtcggatgctt

SEQ ID NO: 16796 - DNA, 15 bp, Artificial Sequence
  dgRNA
  Dph3
cgtaaccgccatgag

SEQ ID NO: 16797 - DNA, 15 bp, Artificial Sequence
  dgRNA
  Dph3
gtaaccgccatgaga

SEQ ID NO: 16798 - DNA, 15 bp, Artificial Sequence
  dgRNA
  Dph3
agcccttcacactat

SEQ ID NO: 16799 - DNA, 15 bp, Artificial Sequence
  dgRNA
  Dph3
cacactattggtcgc

SEQ ID NO: 16800 - DNA, 15 bp, Artificial Sequence
  dgRNA
  Sertm1
cctcgtcctccaacc

SEQ ID NO: 16801 - DNA, 15 bp, Artificial Sequence
  dgRNA
  Sertm1
ctcgtcctccaacca

SEQ ID NO: 16802 - DNA, 15 bp, Artificial Sequence
  dgRNA
  Sertm1
tagctccagagcgcc

SEQ ID NO: 16803 - DNA, 15 bp, Artificial Sequence
  dgRNA
  Sertm1
ctgccattggtcgca

SEQ ID NO: 16804 - DNA, 15 bp, Artificial Sequence
  dgRNA
  Zfp512
gtgcaaacgctagtt

SEQ ID NO: 16805 - DNA, 15 bp, Artificial Sequence
  dgRNA
  Zfp512
tgcaaacgctagttc

SEQ ID NO: 16806 - DNA, 15 bp, Artificial Sequence
  dgRNA
  Zfp512
aaacgctagttcggg

SEQ ID NO: 16807 - DNA, 15 bp, Artificial Sequence
  dgRNA
  Zfp512
accttcacgccccaa

SEQ ID NO: 16808 - DNA, 15 bp, Artificial Sequence
  dgRNA
  Cenpa
agccgtcctgcccag

SEQ ID NO: 16809 - DNA, 15 bp, Artificial Sequence
  dgRNA
  Cenpa
gccgtcctgcccaga

SEQ ID NO: 16810 - DNA, 15 bp, Artificial Sequence
  dgRNA
  Cenpa
tatcaaacgttgagg

SEQ ID NO: 16811 - DNA, 15 bp, Artificial Sequence
  dgRNA
  Cenpa
ttctatcaaacgttg

SEQ ID NO: 16812 - DNA, 15 bp, Artificial Sequence
  dgRNA
  Gpr132
gccatcatccgagca

SEQ ID NO: 16813 - DNA, 15 bp, Artificial Sequence
  dgRNA
  Gpr132
cgagcaaggtcagac

SEQ ID NO: 16814 - DNA, 15 bp, Artificial Sequence
  dgRNA
  Gpr132
cgctagcctgcgttg

SEQ ID NO: 16815 - DNA, 15 bp, Artificial Sequence
  dgRNA
  Gpr132
gcctgcgttgtggtt

SEQ ID NO: 16816 - DNA, 15 bp, Artificial Sequence
  dgRNA
  Gata2
actcatgttgtccag

SEQ ID NO: 16817 - DNA, 15 bp, Artificial Sequence
  dgRNA
  Gata2
gctatccctgataga

SEQ ID NO: 16818 - DNA, 15 bp, Artificial Sequence
  dgRNA
  Gata2
ggagtcagttggatt

SEQ ID NO: 16819 - DNA, 15 bp, Artificial Sequence
  dgRNA
  Gata2
gagtcagttggattt

SEQ ID NO: 16820 - DNA, 15 bp, Artificial Sequence
  dgRNA
  Olfr3
ggtacacctactgct

SEQ ID NO: 16821 - DNA, 15 bp, Artificial Sequence
  dgRNA
  Crh
tcgttgacgtcacca

SEQ ID NO: 16822 - DNA, 15 bp, Artificial Sequence
  dgRNA
  Crh
ttgacgtcaccaagg

SEQ ID NO: 16823 - DNA, 15 bp, Artificial Sequence
  dgRNA
  Crh
ccctattatttatgc

SEQ ID NO: 16824 - DNA, 15 bp, Artificial Sequence
  dgRNA
  Crh
agcccgaaaatggaa

SEQ ID NO: 16825 - DNA, 15 bp, Artificial Sequence
  dgRNA
  Arvcf
aagactgacaatacc

SEQ ID NO: 16826 - DNA, 15 bp, Artificial Sequence
  dgRNA
  Arvcf
gcacatccatccaat

SEQ ID NO: 16827 - DNA, 15 bp, Artificial Sequence
  dgRNA
  Arvcf
tccatccaatcggtg

SEQ ID NO: 16828 - DNA, 15 bp, Artificial Sequence
  dgRNA
  Arvcf
ccatccaatcggtgc

SEQ ID NO: 16829 - DNA, 15 bp, Artificial Sequence
  dgRNA
  Tex35
aaactaacctggtaa

SEQ ID NO: 16830 - DNA, 15 bp, Artificial Sequence
  dgRNA
  Tex35
acggtggggcctctg

SEQ ID NO: 16831 - DNA, 15 bp, Artificial Sequence
  dgRNA
  Tex35
cggtggggcctctgt

SEQ ID NO: 16832 - DNA, 15 bp, Artificial Sequence
  dgRNA
  Tex35
ccgcctccattcagc

SEQ ID NO: 16833 - DNA, 15 bp, Artificial Sequence
  dgRNA
  Lemd1
tcgagttgttcacca

SEQ ID NO: 16834 - DNA, 15 bp, Artificial Sequence
  dgRNA
  Lemd1
ggctaccagtgccac

SEQ ID NO: 16835 - DNA, 15 bp, Artificial Sequence
  dgRNA
  Lemd1
ctagccctgctagtc

SEQ ID NO: 16836 - DNA, 15 bp, Artificial Sequence
  dgRNA
  Lemd1
gccctgctagtccgg

SEQ ID NO: 16837 - DNA, 15 bp, Artificial Sequence
  dgRNA
  Lhcgr
ggacaggcggtgaga

SEQ ID NO: 16838 - DNA, 15 bp, Artificial Sequence
  dgRNA
  Lhcgr
gacaggcggtgagag

SEQ ID NO: 16839 - DNA, 15 bp, Artificial Sequence
  dgRNA
  Lhcgr
gcagagggtacgggc

SEQ ID NO: 16840 - DNA, 15 bp, Artificial Sequence
  dgRNA
  Lhcgr
tacgggcgggccccc

SEQ ID NO: 16841 - DNA, 15 bp, Artificial Sequence
  dgRNA
  Stab2
atccgccacagcgat

SEQ ID NO: 16842 - DNA, 15 bp, Artificial Sequence
  dgRNA
  Stab2
cgccacagcgatagg

SEQ ID NO: 16843 - DNA, 15 bp, Artificial Sequence
  dgRNA
  Stab2
ccacagcgataggag

SEQ ID NO: 16844 - DNA, 15 bp, Artificial Sequence
  dgRNA
  Stab2
cctagttgttccgct

SEQ ID NO: 16845 - DNA, 15 bp, Artificial Sequence
  dgRNA
  Spi1
acgttgctaaccgcg

SEQ ID NO: 16846 - DNA, 15 bp, Artificial Sequence
  dgRNA
  Spi1
cgttgctaaccgcga

SEQ ID NO: 16847 - DNA, 15 bp, Artificial Sequence
  dgRNA
  Spi1
agcagacgagctgac

SEQ ID NO: 16848 - DNA, 15 bp, Artificial Sequence
  dgRNA
  Spi1
gtgtagacggatggg

SEQ ID NO: 16849 - DNA, 15 bp, Artificial Sequence
  dgRNA
  BC061237
gggcaattcaaaaac

SEQ ID NO: 16850 - DNA, 15 bp, Artificial Sequence
  dgRNA
  Blvrb
cttcagcccctcgtg

SEQ ID NO: 16851 - DNA, 15 bp, Artificial Sequence
  dgRNA
  Blvrb
aactaacctttgaac

SEQ ID NO: 16852 - DNA, 15 bp, Artificial Sequence
  dgRNA
  Blvrb
aaagggccccacgag

SEQ ID NO: 16853 - DNA, 15 bp, Artificial Sequence
  dgRNA
  Blvrb
aaaagggccccacga

SEQ ID NO: 16854 - DNA, 15 bp, Artificial Sequence
  dgRNA
  Mc3r
ctcctacacgagcgc

SEQ ID NO: 16855 - DNA, 15 bp, Artificial Sequence
  dgRNA
  Mc3r
cgcaggtgagcagtc

SEQ ID NO: 16856 - DNA, 15 bp, Artificial Sequence
  dgRNA
  Mc3r
agcagtccggactgc

SEQ ID NO: 16857 - DNA, 15 bp, Artificial Sequence
  dgRNA
  Mc3r
gcagtccggactgca

SEQ ID NO: 16858 - DNA, 15 bp, Artificial Sequence
  dgRNA
  Mefv
aatcaggacataggc

SEQ ID NO: 16859 - DNA, 15 bp, Artificial Sequence
  dgRNA
  Mefv
gattaaacaacaggc

SEQ ID NO: 16860 - DNA, 15 bp, Artificial Sequence
  dgRNA
  Mefv
tcctgattaaacaac

SEQ ID NO: 16861 - DNA, 15 bp, Artificial Sequence
  dgRNA
  Mefv
atgagggcgtgtcca

SEQ ID NO: 16862 - DNA, 15 bp, Artificial Sequence
  dgRNA
  Gm1527
caattgttgaaccat

SEQ ID NO: 16863 - DNA, 15 bp, Artificial Sequence
  dgRNA
  Gm1527
tgctataactgacaa

SEQ ID NO: 16864 - DNA, 15 bp, Artificial Sequence
  dgRNA
  Gm1527
atgctataactgaca

SEQ ID NO: 16865 - DNA, 15 bp, Artificial Sequence
  dgRNA
  Hdlbp
tagtcccctcctccg

SEQ ID NO: 16866 - DNA, 15 bp, Artificial Sequence
  dgRNA
  Hdlbp
tgcagagcgcaagcg

SEQ ID NO: 16867 - DNA, 15 bp, Artificial Sequence
  dgRNA
  Hdlbp
cgtccgcctctgcgc

SEQ ID NO: 16868 - DNA, 15 bp, Artificial Sequence
  dgRNA
  Hdlbp
gtgcccctcccacgg

SEQ ID NO: 16869 - DNA, 15 bp, Artificial Sequence
  dgRNA
  Pex2
gaagcccgcagattc

SEQ ID NO: 16870 - DNA, 15 bp, Artificial Sequence
  dgRNA
  Pex2
gggcttccggagcga

SEQ ID NO: 16871 - DNA, 15 bp, Artificial Sequence
  dgRNA
  Pex2
gaatctgcgggcttc

SEQ ID NO: 16872 - DNA, 15 bp, Artificial Sequence
  dgRNA
  Pex2
acttccggaatctgc

SEQ ID NO: 16873 - DNA, 15 bp, Artificial Sequence
  dgRNA
  Mgst2
taacaacctttgcac

SEQ ID NO: 16874 - DNA, 15 bp, Artificial Sequence
  dgRNA
  Mgst2
ttgagtcaacaggat

SEQ ID NO: 16875 - DNA, 15 bp, Artificial Sequence
  dgRNA
  Mgst2
cagagttgagtcaac

SEQ ID NO: 16876 - DNA, 15 bp, Artificial Sequence
  dgRNA
  Fcer2a
actgactggcacccg

SEQ ID NO: 16877 - DNA, 15 bp, Artificial Sequence
  dgRNA
  Fcer2a
ccgtggcacacagcc

SEQ ID NO: 16878 - DNA, 15 bp, Artificial Sequence
  dgRNA
  Fcer2a
tccagctggacagtt

SEQ ID NO: 16879 - DNA, 15 bp, Artificial Sequence
  dgRNA
  Fcer2a
atttgaacgggaact

SEQ ID NO: 16880 - DNA, 15 bp, Artificial Sequence
  dgRNA
  Umod
tgtcttgctgccaaa

SEQ ID NO: 16881 - DNA, 15 bp, Artificial Sequence
  dgRNA
  Umod
ctcatggcttggaaa

SEQ ID NO: 16882 - DNA, 15 bp, Artificial Sequence
  dgRNA
  Umod
cagttagacattaac

SEQ ID NO: 16883 - DNA, 15 bp, Artificial Sequence
  dgRNA
  Syce1l
cctcttatagagact

SEQ ID NO: 16884 - DNA, 15 bp, Artificial Sequence
  dgRNA
  Syce1l
cgagtctctataaga

SEQ ID NO: 16885 - DNA, 15 bp, Artificial Sequence
  dgRNA
  Syce1l
ccgagtctctataag

SEQ ID NO: 16886 - DNA, 15 bp, Artificial Sequence
  dgRNA
  Syce1l
atgcgcgcaaccaca

SEQ ID NO: 16887 - DNA, 15 bp, Artificial Sequence
  dgRNA
  Sva
tctgatcatcttagc

SEQ ID NO: 16888 - DNA, 15 bp, Artificial Sequence
  dgRNA
  Dpy19l2
ccaacgcccagaccc

SEQ ID NO: 16889 - DNA, 15 bp, Artificial Sequence
  dgRNA
  Dpy19l2
caacgcccagaccct

SEQ ID NO: 16890 - DNA, 15 bp, Artificial Sequence
  dgRNA
  Dpy19l2
aacgcccagaccctg

SEQ ID NO: 16891 - DNA, 15 bp, Artificial Sequence
  dgRNA
  Dpy19l2
ttgcaagtcctgctc

SEQ ID NO: 16892 - DNA, 15 bp, Artificial Sequence
  dgRNA
  Ecel1
cctgccaatgatgtc

SEQ ID NO: 16893 - DNA, 15 bp, Artificial Sequence
  dgRNA
  Ecel1
aacctaaggttgagg

SEQ ID NO: 16894 - DNA, 15 bp, Artificial Sequence
  dgRNA
  Ecel1
ggtgctgatggcgcc

SEQ ID NO: 16895 - DNA, 15 bp, Artificial Sequence
  dgRNA
  Ecel1
cgcctggcagagtgc

SEQ ID NO: 16896 - DNA, 15 bp, Artificial Sequence
  dgRNA
  Serinc5
ctgtgctgcccggaa

SEQ ID NO: 16897 - DNA, 15 bp, Artificial Sequence
  dgRNA
  Serinc5
tgtgctgcccggaaa

SEQ ID NO: 16898 - DNA, 15 bp, Artificial Sequence
  dgRNA
  Serinc5
gtgctgcccggaaag

SEQ ID NO: 16899 - DNA, 15 bp, Artificial Sequence
  dgRNA
  Serinc5
tgcccggaaaggggc

SEQ ID NO: 16900 - DNA, 15 bp, Artificial Sequence
  dgRNA
  Rcor3
ggggcgggccggtgt

SEQ ID NO: 16901 - DNA, 15 bp, Artificial Sequence
  dgRNA
  Rcor3
ggggcgactgcgcta

SEQ ID NO: 16902 - DNA, 15 bp, Artificial Sequence
  dgRNA
  Rcor3
cacaccggcccgccc

SEQ ID NO: 16903 - DNA, 15 bp, Artificial Sequence
  dgRNA
  Rcor3
gcagtcgccccacac

SEQ ID NO: 16904 - DNA, 15 bp, Artificial Sequence
  dgRNA
  Comtd1
attcccgagtctctt

SEQ ID NO: 16905 - DNA, 15 bp, Artificial Sequence
  dgRNA
  Comtd1
tccgcatgcagccac

SEQ ID NO: 16906 - DNA, 15 bp, Artificial Sequence
  dgRNA
  Comtd1
ccgcatgcagccacc

SEQ ID NO: 16907 - DNA, 15 bp, Artificial Sequence
  dgRNA
  Comtd1
catgcagccaccggg

SEQ ID NO: 16908 - DNA, 15 bp, Artificial Sequence
  dgRNA
  Cpeb4
tgaaataagcccaat

SEQ ID NO: 16909 - DNA, 15 bp, Artificial Sequence
  dgRNA
  Cpeb4
aaatcagagatacgt

SEQ ID NO: 16910 - DNA, 15 bp, Artificial Sequence
  dgRNA
  Cpeb4
aatcagagatacgta

SEQ ID NO: 16911 - DNA, 15 bp, Artificial Sequence
  dgRNA
  Cpeb4
ggcttatttcaagga

SEQ ID NO: 16912 - DNA, 15 bp, Artificial Sequence
  dgRNA
  Rabggtb
ttgacatcaatgtcc

SEQ ID NO: 16913 - DNA, 15 bp, Artificial Sequence
  dgRNA
  Rabggtb
gcaaactgagcgaca

SEQ ID NO: 16914 - DNA, 15 bp, Artificial Sequence
  dgRNA
  Rabggtb
caaactgagcgacat

SEQ ID NO: 16915 - DNA, 15 bp, Artificial Sequence
  dgRNA
  Rabggtb
aaactgagcgacatg

SEQ ID NO: 16916 - DNA, 15 bp, Artificial Sequence
  dgRNA
  Itgal
ctactcccttctatc

SEQ ID NO: 16917 - DNA, 15 bp, Artificial Sequence
  dgRNA
  Itgal
ttgaagaatcttccg

SEQ ID NO: 16918 - DNA, 15 bp, Artificial Sequence
  dgRNA
  Itgal
gaatcttccggggcc

SEQ ID NO: 16919 - DNA, 15 bp, Artificial Sequence
  dgRNA
  Itgal
ctggtgtgagagcgg

SEQ ID NO: 16920 - DNA, 15 bp, Artificial Sequence
  dgRNA
  Bptf
cggctgcaggcgatc

SEQ ID NO: 16921 - DNA, 15 bp, Artificial Sequence
  dgRNA
  Bptf
gcaggcgatccggag

SEQ ID NO: 16922 - DNA, 15 bp, Artificial Sequence
  dgRNA
  Bptf
caggcgatccggagc

SEQ ID NO: 16923 - DNA, 15 bp, Artificial Sequence
  dgRNA
  Bptf
aggcgatccggagcg

SEQ ID NO: 16924 - DNA, 15 bp, Artificial Sequence
  dgRNA
  Lce1c
aattgcagcacgcct

SEQ ID NO: 16925 - DNA, 15 bp, Artificial Sequence
  dgRNA
  Lce1c
gccttggtctcgaga

SEQ ID NO: 16926 - DNA, 15 bp, Artificial Sequence
  dgRNA
  Lce1c
tatcacaaaaccatg

SEQ ID NO: 16927 - DNA, 15 bp, Artificial Sequence
  dgRNA
  Lce1c
tagccactgtatcac

SEQ ID NO: 16928 - DNA, 15 bp, Artificial Sequence
  dgRNA
  Txndc9
acccggctcgtttcc

SEQ ID NO: 16929 - DNA, 15 bp, Artificial Sequence
  dgRNA
  Txndc9
gtttcccggtagagc

SEQ ID NO: 16930 - DNA, 15 bp, Artificial Sequence
  dgRNA
  Txndc9
tttcccggtagagcc

SEQ ID NO: 16931 - DNA, 15 bp, Artificial Sequence
  dgRNA
  Txndc9
tagcgcccatccctc

SEQ ID NO: 16932 - DNA, 15 bp, Artificial Sequence
  dgRNA
  Procr
gttagattccaatcc

SEQ ID NO: 16933 - DNA, 15 bp, Artificial Sequence
  dgRNA
  Procr
tggatctgccgtcat

SEQ ID NO: 16934 - DNA, 15 bp, Artificial Sequence
  dgRNA
  Procr
ggatctgccgtcatc

SEQ ID NO: 16935 - DNA, 15 bp, Artificial Sequence
  dgRNA
  Procr
gggacgtacaaactt

SEQ ID NO: 16936 - DNA, 15 bp, Artificial Sequence
  dgRNA
  Nsun3
actccacccttcgct

SEQ ID NO: 16937 - DNA, 15 bp, Artificial Sequence
  dgRNA
  Nsun3
ctccacccttcgctc

SEQ ID NO: 16938 - DNA, 15 bp, Artificial Sequence
  dgRNA
  Nsun3
tccacccttcgctcg

SEQ ID NO: 16939 - DNA, 15 bp, Artificial Sequence
  dgRNA
  Nsun3
acaatctcgcgagac

SEQ ID NO: 16940 - DNA, 15 bp, Artificial Sequence
  dgRNA
  Pdzk1ip1
ctgtttcacgtgagg

SEQ ID NO: 16941 - DNA, 15 bp, Artificial Sequence
  dgRNA
  Pdzk1ip1
tgtttcacgtgaggt

SEQ ID NO: 16942 - DNA, 15 bp, Artificial Sequence
  dgRNA
  Pdzk1ip1
gtttcacgtgaggtg

SEQ ID NO: 16943 - DNA, 15 bp, Artificial Sequence
  dgRNA
  Pdzk1ip1
gctctagctggctca

SEQ ID NO: 16944 - DNA, 15 bp, Artificial Sequence
  dgRNA
  Rhox3c
agggtgatcacctaa

SEQ ID NO: 16945 - DNA, 15 bp, Artificial Sequence
  dgRNA
  Rhox3c
taggtgatcaccctg

SEQ ID NO: 16946 - DNA, 15 bp, Artificial Sequence
  dgRNA
  Olfr1412
tcaggcttctgcacg

SEQ ID NO: 16947 - DNA, 15 bp, Artificial Sequence
  dgRNA
  Olfr1412
aactaagtacctcag

SEQ ID NO: 16948 - DNA, 15 bp, Artificial Sequence
  dgRNA
  Olfr1412
actggtccacctgga

SEQ ID NO: 16949 - DNA, 15 bp, Artificial Sequence
  dgRNA
  Olfr1412
cattgagtgactctc

SEQ ID NO: 16950 - DNA, 15 bp, Artificial Sequence
  dgRNA
  Wwp1
agcggagtggcccct

SEQ ID NO: 16951 - DNA, 15 bp, Artificial Sequence
  dgRNA
  Wwp1
ggagtggcccctagg

SEQ ID NO: 16952 - DNA, 15 bp, Artificial Sequence
  dgRNA
  Wwp1
gagtggcccctaggc

SEQ ID NO: 16953 - DNA, 15 bp, Artificial Sequence
  dgRNA
  Wwp1
ggcccctaggcgggc

SEQ ID NO: 16954 - DNA, 15 bp, Artificial Sequence
  dgRNA
  Dnajc25
gctactaagactacc

SEQ ID NO: 16955 - DNA, 15 bp, Artificial Sequence
  dgRNA
  Dnajc25
cacagaagccgcccg

SEQ ID NO: 16956 - DNA, 15 bp, Artificial Sequence
  dgRNA
  Dnajc25
agccgcccgaggcta

SEQ ID NO: 16957 - DNA, 15 bp, Artificial Sequence
  dgRNA
  Dnajc25
tctcctagcaacgcg

SEQ ID NO: 16958 - DNA, 15 bp, Artificial Sequence
  dgRNA
  Taf1d
aaatcgacgctcacc

SEQ ID NO: 16959 - DNA, 15 bp, Artificial Sequence
  dgRNA
  Taf1d
ctcaggttcgaacac

SEQ ID NO: 16960 - DNA, 15 bp, Artificial Sequence
  dgRNA
  Taf1d
gatagctctaggcca

SEQ ID NO: 16961 - DNA, 15 bp, Artificial Sequence
  dgRNA
  Taf1d
atagctctaggccaa

SEQ ID NO: 16962 - DNA, 15 bp, Artificial Sequence
  dgRNA
  Rhbdf2
aactgtgtgttgata

SEQ ID NO: 16963 - DNA, 15 bp, Artificial Sequence
  dgRNA
  Rhbdf2
ttgggtgtaacgtgt

SEQ ID NO: 16964 - DNA, 15 bp, Artificial Sequence
  dgRNA
  Rhbdf2
gttgggtgtaacgtg

SEQ ID NO: 16965 - DNA, 15 bp, Artificial Sequence
  dgRNA
  Rhbdf2
atgccgccctagccc

SEQ ID NO: 16966 - DNA, 15 bp, Artificial Sequence
  dgRNA
  5730559C18Rik
tcattcttccacgct

SEQ ID NO: 16967 - DNA, 15 bp, Artificial Sequence
  dgRNA
  5730559C18Rik
cattcttccacgctt

SEQ ID NO: 16968 - DNA, 15 bp, Artificial Sequence
  dgRNA
  5730559C18Rik
ccacgcttgggtctc

SEQ ID NO: 16969 - DNA, 15 bp, Artificial Sequence
  dgRNA
  5730559C18Rik
tgaaaggcggcccct

SEQ ID NO: 16970 - DNA, 15 bp, Artificial Sequence
  dgRNA
  Enox2
catgctcgggcctcg

SEQ ID NO: 16971 - DNA, 15 bp, Artificial Sequence
  dgRNA
  Enox2
gatgccctagccaat

SEQ ID NO: 16972 - DNA, 15 bp, Artificial Sequence
  dgRNA
  Enox2
cctagccaatgggag

SEQ ID NO: 16973 - DNA, 15 bp, Artificial Sequence
  dgRNA
  Enox2
caatagtcacctggt

SEQ ID NO: 16974 - DNA, 15 bp, Artificial Sequence
  dgRNA
  Ceacam5
gacacctaggtagga

SEQ ID NO: 16975 - DNA, 15 bp, Artificial Sequence
  dgRNA
  Tspo
tccaggcccacgatg

SEQ ID NO: 16976 - DNA, 15 bp, Artificial Sequence
  dgRNA
  Tspo
aggggtgcctggttg

SEQ ID NO: 16977 - DNA, 15 bp, Artificial Sequence
  dgRNA
  Tspo
ggggtgcctggttga

SEQ ID NO: 16978 - DNA, 15 bp, Artificial Sequence
  dgRNA
  Tspo
ggttgagggcgggcc

SEQ ID NO: 16979 - DNA, 15 bp, Artificial Sequence
  dgRNA
  Ypel3
tcgtagccgcatttc

SEQ ID NO: 16980 - DNA, 15 bp, Artificial Sequence
  dgRNA
  Ypel3
cgtagccgcatttcc

SEQ ID NO: 16981 - DNA, 15 bp, Artificial Sequence
  dgRNA
  Ypel3
catttccgggcgaga

SEQ ID NO: 16982 - DNA, 15 bp, Artificial Sequence
  dgRNA
  Ypel3
gggcgagacggctag

SEQ ID NO: 16983 - DNA, 15 bp, Artificial Sequence
  dgRNA
  Pfn4
cggacctctgtctcc

SEQ ID NO: 16984 - DNA, 15 bp, Artificial Sequence
  dgRNA
  Pfn4
cccctacgcgcccct

SEQ ID NO: 16985 - DNA, 15 bp, Artificial Sequence
  dgRNA
  Pfn4
gcgcccctcggccag

SEQ ID NO: 16986 - DNA, 15 bp, Artificial Sequence
  dgRNA
  Pfn4
cgcccctcggccagc

SEQ ID NO: 16987 - DNA, 15 bp, Artificial Sequence
  dgRNA
  Cxcl3
gtgggcaagaagcga

SEQ ID NO: 16988 - DNA, 15 bp, Artificial Sequence
  dgRNA
  Cxcl3
ctcatcaagagcccg

SEQ ID NO: 16989 - DNA, 15 bp, Artificial Sequence
  dgRNA
  Cxcl3
tcatcaagagcccgg

SEQ ID NO: 16990 - DNA, 15 bp, Artificial Sequence
  dgRNA
  Cxcl3
tcaagagcccggggg

SEQ ID NO: 16991 - DNA, 15 bp, Artificial Sequence
  dgRNA
  Dhrs13
ctgagcggagatctc

SEQ ID NO: 16992 - DNA, 15 bp, Artificial Sequence
  dgRNA
  Dhrs13
tgagcggagatctca

SEQ ID NO: 16993 - DNA, 15 bp, Artificial Sequence
  dgRNA
  Dhrs13
acccacccgtccctc

SEQ ID NO: 16994 - DNA, 15 bp, Artificial Sequence
  dgRNA
  Dhrs13
ccgagcacgcgttcc

SEQ ID NO: 16995 - DNA, 15 bp, Artificial Sequence
  dgRNA
  Ilf3
atcgcccacgtgatg

SEQ ID NO: 16996 - DNA, 15 bp, Artificial Sequence
  dgRNA
  Ilf3
tcgcccacgtgatgc

SEQ ID NO: 16997 - DNA, 15 bp, Artificial Sequence
  dgRNA
  Ilf3
cgcccacgtgatgcg

SEQ ID NO: 16998 - DNA, 15 bp, Artificial Sequence
  dgRNA
  Ilf3
gcccacgtgatgcgg

SEQ ID NO: 16999 - DNA, 15 bp, Artificial Sequence
  dgRNA
  Actn2
ctgggttgctgtccg

SEQ ID NO: 17000 - DNA, 15 bp, Artificial Sequence
  dgRNA
  Actn2
gtccgaggtgcccct

SEQ ID NO: 17001 - DNA, 15 bp, Artificial Sequence
  dgRNA
  Actn2
cccctaggtcatccc

SEQ ID NO: 17002 - DNA, 15 bp, Artificial Sequence
  dgRNA
  Actn2
agtggaacctgagcg

SEQ ID NO: 17003 - DNA, 15 bp, Artificial Sequence
  dgRNA
  Cyp26a1
tagtcccgcaccccc

SEQ ID NO: 17004 - DNA, 15 bp, Artificial Sequence
  dgRNA
  Cyp26a1
tcccgcacccccagg

SEQ ID NO: 17005 - DNA, 15 bp, Artificial Sequence
  dgRNA
  Cyp26a1
aggaggcgcgctcag

SEQ ID NO: 17006 - DNA, 15 bp, Artificial Sequence
  dgRNA
  Cyp26a1
ggaggcgcgctcaga

SEQ ID NO: 17007 - DNA, 15 bp, Artificial Sequence
  dgRNA
  Olfr1375
gctcctgaaaggcgg

SEQ ID NO: 17008 - DNA, 15 bp, Artificial Sequence
  dgRNA
  Nlrp14
cccaccaatccctgc

SEQ ID NO: 17009 - DNA, 15 bp, Artificial Sequence
  dgRNA
  Nlrp14
gcctgctccgcccaa

SEQ ID NO: 17010 - DNA, 15 bp, Artificial Sequence
  dgRNA
  Nlrp14
tgctccgcccaaagg

SEQ ID NO: 17011 - DNA, 15 bp, Artificial Sequence
  dgRNA
  Nlrp14
gcggtaacagcagag

SEQ ID NO: 17012 - DNA, 15 bp, Artificial Sequence
  dgRNA
  Klrc2
cctttttattgcgtc

SEQ ID NO: 17013 - DNA, 15 bp, Artificial Sequence
  dgRNA
  Klrc2
acgcaataaaaaggg

SEQ ID NO: 17014 - DNA, 15 bp, Artificial Sequence
  dgRNA
  Klrc2
ctgacgcaataaaaa

SEQ ID NO: 17015 - DNA, 15 bp, Artificial Sequence
  dgRNA
  Klrc2
cctgacgcaataaaa

SEQ ID NO: 17016 - DNA, 15 bp, Artificial Sequence
  dgRNA
  Gnat3
ctcttaagcttccat

SEQ ID NO: 17017 - DNA, 15 bp, Artificial Sequence
  dgRNA
  Gnat3
tccattggagttgca

SEQ ID NO: 17018 - DNA, 15 bp, Artificial Sequence
  dgRNA
  Gnat3
tgtcacctgatcaag

SEQ ID NO: 17019 - DNA, 15 bp, Artificial Sequence
  dgRNA
  Gm9112
aggaaccaggtgatt

SEQ ID NO: 17020 - DNA, 15 bp, Artificial Sequence
  dgRNA
  Gm9112
tgagagctaaggacg

SEQ ID NO: 17021 - DNA, 15 bp, Artificial Sequence
  dgRNA
  Gm9112
agctaaggacggggc

SEQ ID NO: 17022 - DNA, 15 bp, Artificial Sequence
  dgRNA
  Gm9112
gctaaggacggggcg

SEQ ID NO: 17023 - DNA, 15 bp, Artificial Sequence
  dgRNA
  Rnasek
agtcacccctcagag

SEQ ID NO: 17024 - DNA, 15 bp, Artificial Sequence
  dgRNA
  Rnasek
agtggtcggcgcccg

SEQ ID NO: 17025 - DNA, 15 bp, Artificial Sequence
  dgRNA
  Rnasek
gtggtgcagacgcta

SEQ ID NO: 17026 - DNA, 15 bp, Artificial Sequence
  dgRNA
  Rnasek
agtggtgcagacgct

SEQ ID NO: 17027 - DNA, 15 bp, Artificial Sequence
  dgRNA
  Ppp3r2
gaaaccgcattagag

SEQ ID NO: 17028 - DNA, 15 bp, Artificial Sequence
  dgRNA
  Ppp3r2
cagctatccctcgcc

SEQ ID NO: 17029 - DNA, 15 bp, Artificial Sequence
  dgRNA
  Ppp3r2
gggatagctgtaact

SEQ ID NO: 17030 - DNA, 15 bp, Artificial Sequence
  dgRNA
  Ppp3r2
agggatagctgtaac

SEQ ID NO: 17031 - DNA, 15 bp, Artificial Sequence
  dgRNA
  Irf4
cagcccttgacccgg

SEQ ID NO: 17032 - DNA, 15 bp, Artificial Sequence
  dgRNA
  Irf4
agcccttgacccggt

SEQ ID NO: 17033 - DNA, 15 bp, Artificial Sequence
  dgRNA
  Irf4
gggcggtcctgggta

SEQ ID NO: 17034 - DNA, 15 bp, Artificial Sequence
  dgRNA
  Irf4
ggcggtcctgggtat

SEQ ID NO: 17035 - DNA, 15 bp, Artificial Sequence
  dgRNA
  Rpusd1
acagtaagtaatccg

SEQ ID NO: 17036 - DNA, 15 bp, Artificial Sequence
  dgRNA
  Rpusd1
cagtaagtaatccgt

SEQ ID NO: 17037 - DNA, 15 bp, Artificial Sequence
  dgRNA
  Rpusd1
agtaagtaatccgtg

SEQ ID NO: 17038 - DNA, 15 bp, Artificial Sequence
  dgRNA
  Rpusd1
gtaagtaatccgtgg

SEQ ID NO: 17039 - DNA, 15 bp, Artificial Sequence
  dgRNA
  Appbp2
ggtgtctcgtccttt

SEQ ID NO: 17040 - DNA, 15 bp, Artificial Sequence
  dgRNA
  Appbp2
gccgcattccttccc

SEQ ID NO: 17041 - DNA, 15 bp, Artificial Sequence
  dgRNA
  Appbp2
ccttcccgggcgcgt

SEQ ID NO: 17042 - DNA, 15 bp, Artificial Sequence
  dgRNA
  Appbp2
ttatccagcgtgctg

SEQ ID NO: 17043 - DNA, 15 bp, Artificial Sequence
  dgRNA
  Tmem176b
ccccacccatcgcag

SEQ ID NO: 17044 - DNA, 15 bp, Artificial Sequence
  dgRNA
  Tmem176b
atcgcagaggacagc

SEQ ID NO: 17045 - DNA, 15 bp, Artificial Sequence
  dgRNA
  Tmem176b
cctctgcgatgggtg

SEQ ID NO: 17046 - DNA, 15 bp, Artificial Sequence
  dgRNA
  Tmem176b
gtcctctgcgatggg

SEQ ID NO: 17047 - DNA, 15 bp, Artificial Sequence
  dgRNA
  Tas1r3
ttactggatcactct

SEQ ID NO: 17048 - DNA, 15 bp, Artificial Sequence
  dgRNA
  Tas1r3
agtggagtatacaca

SEQ ID NO: 17049 - DNA, 15 bp, Artificial Sequence
  dgRNA
  Tas1r3
tatacacaaggcatc

SEQ ID NO: 17050 - DNA, 15 bp, Artificial Sequence
  dgRNA
  Tas1r3
acaaggcatcaggcg

SEQ ID NO: 17051 - DNA, 15 bp, Artificial Sequence
  dgRNA
  1110059G10Rik
ggcgatgagttcacc

SEQ ID NO: 17052 - DNA, 15 bp, Artificial Sequence
  dgRNA
  1110059G10Rik
acttacatttgcagc

SEQ ID NO: 17053 - DNA, 15 bp, Artificial Sequence
  dgRNA
  1110059G10Rik
ttacatttgcagccg

SEQ ID NO: 17054 - DNA, 15 bp, Artificial Sequence
  dgRNA
  1110059G10Rik
tacatttgcagccgg

SEQ ID NO: 17055 - DNA, 15 bp, Artificial Sequence
  dgRNA
  Kctd4
gagcaatgcgtaagc

SEQ ID NO: 17056 - DNA, 15 bp, Artificial Sequence
  dgRNA
  Kctd4
aatgcgtaagcagga

SEQ ID NO: 17057 - DNA, 15 bp, Artificial Sequence
  dgRNA
  Kctd4
atgcgtaagcaggaa

SEQ ID NO: 17058 - DNA, 15 bp, Artificial Sequence
  dgRNA
  Kctd4
agttctagttagcac

SEQ ID NO: 17059 - DNA, 15 bp, Artificial Sequence
  dgRNA
  Pde1a
tttccctggttaaat

SEQ ID NO: 17060 - DNA, 15 bp, Artificial Sequence
  dgRNA
  Pde1a
tccagcatcacttga

SEQ ID NO: 17061 - DNA, 15 bp, Artificial Sequence
  dgRNA
  Pde1a
ctcaataacaacctg

SEQ ID NO: 17062 - DNA, 15 bp, Artificial Sequence
  dgRNA
  Pde1a
ctgccaatttaacca

SEQ ID NO: 17063 - DNA, 15 bp, Artificial Sequence
  dgRNA
  Olfr1467
gcacagcatcatata

SEQ ID NO: 17064 - DNA, 15 bp, Artificial Sequence
  dgRNA
  Olfr1467
aaattttatctcgaa

SEQ ID NO: 17065 - DNA, 15 bp, Artificial Sequence
  dgRNA
  Parn
tggaattatagaccc

SEQ ID NO: 17066 - DNA, 15 bp, Artificial Sequence
  dgRNA
  Parn
gaattatagacccag

SEQ ID NO: 17067 - DNA, 15 bp, Artificial Sequence
  dgRNA
  Parn
tgatcaaccaggttc

SEQ ID NO: 17068 - DNA, 15 bp, Artificial Sequence
  dgRNA
  Parn
aaccaggttcaggac

SEQ ID NO: 17069 - DNA, 15 bp, Artificial Sequence
  dgRNA
  Natd1
gcgtgttttgcatat

SEQ ID NO: 17070 - DNA, 15 bp, Artificial Sequence
  dgRNA
  Natd1
gcatatgggtccgtg

SEQ ID NO: 17071 - DNA, 15 bp, Artificial Sequence
  dgRNA
  Natd1
catatgggtccgtgt

SEQ ID NO: 17072 - DNA, 15 bp, Artificial Sequence
  dgRNA
  Natd1
tcctaaaagtcattc

SEQ ID NO: 17073 - DNA, 15 bp, Artificial Sequence
  dgRNA
  Gm572
attaatgtcacccta

SEQ ID NO: 17074 - DNA, 15 bp, Artificial Sequence
  dgRNA
  Gm572
ttaatgtcaccctag

SEQ ID NO: 17075 - DNA, 15 bp, Artificial Sequence
  dgRNA
  Gm572
taatgtcaccctagg

SEQ ID NO: 17076 - DNA, 15 bp, Artificial Sequence
  dgRNA
  Gm572
cacctgagtaactct

SEQ ID NO: 17077 - DNA, 15 bp, Artificial Sequence
  dgRNA
  Rnase13
gggtgagacggtctt

SEQ ID NO: 17078 - DNA, 15 bp, Artificial Sequence
  dgRNA
  Rnase13
tgagacggtctttgg

SEQ ID NO: 17079 - DNA, 15 bp, Artificial Sequence
  dgRNA
  Rnase13
ttggtggtgaaccat

SEQ ID NO: 17080 - DNA, 15 bp, Artificial Sequence
  dgRNA
  Rnase13
gtggtgaaccatagg

SEQ ID NO: 17081 - DNA, 15 bp, Artificial Sequence
  dgRNA
  Phactr3
caattgctaggctgg

SEQ ID NO: 17082 - DNA, 15 bp, Artificial Sequence
  dgRNA
  Phactr3
gcgagtgaacgagcc

SEQ ID NO: 17083 - DNA, 15 bp, Artificial Sequence
  dgRNA
  Phactr3
cgagtgaacgagccc

SEQ ID NO: 17084 - DNA, 15 bp, Artificial Sequence
  dgRNA
  Phactr3
gagtgaacgagcccg

SEQ ID NO: 17085 - DNA, 15 bp, Artificial Sequence
  dgRNA
  E2f2
tagactaagcctttc

SEQ ID NO: 17086 - DNA, 15 bp, Artificial Sequence
  dgRNA
  E2f2
gactaagcctttccg

SEQ ID NO: 17087 - DNA, 15 bp, Artificial Sequence
  dgRNA
  E2f2
actaagcctttccgg

SEQ ID NO: 17088 - DNA, 15 bp, Artificial Sequence
  dgRNA
  E2f2
aagcctttccggggg

SEQ ID NO: 17089 - DNA, 15 bp, Artificial Sequence
  dgRNA
  Osr1
tcgagtgggattatc

SEQ ID NO: 17090 - DNA, 15 bp, Artificial Sequence
  dgRNA
  Osr1
cgagtgggattatca

SEQ ID NO: 17091 - DNA, 15 bp, Artificial Sequence
  dgRNA
  Osr1
gggattatcagggag

SEQ ID NO: 17092 - DNA, 15 bp, Artificial Sequence
  dgRNA
  Osr1
gaggggacaccggtc

SEQ ID NO: 17093 - DNA, 15 bp, Artificial Sequence
  dgRNA
  Gm11437
gacagttctcattgt

SEQ ID NO: 17094 - DNA, 15 bp, Artificial Sequence
  dgRNA
  Gm11437
atcattggtgaagtt

SEQ ID NO: 17095 - DNA, 15 bp, Artificial Sequence
  dgRNA
  Gm11437
actgtcattatctag

SEQ ID NO: 17096 - DNA, 15 bp, Artificial Sequence
  dgRNA
  Gm11437
aggaatacagctgat

SEQ ID NO: 17097 - DNA, 15 bp, Artificial Sequence
  dgRNA
  Fbxo33
ggtcgctgacgtcaa

SEQ ID NO: 17098 - DNA, 15 bp, Artificial Sequence
  dgRNA
  Fbxo33
cgtgccgcgcgatcc

SEQ ID NO: 17099 - DNA, 15 bp, Artificial Sequence
  dgRNA
  Fbxo33
gcgatccaggcaacc

SEQ ID NO: 17100 - DNA, 15 bp, Artificial Sequence
  dgRNA
  Fbxo33
gagctcccccggttc

SEQ ID NO: 17101 - DNA, 15 bp, Artificial Sequence
  dgRNA
  Dcn
gtgaatatacaattt

SEQ ID NO: 17102 - DNA, 15 bp, Artificial Sequence
  dgRNA
  Dcn
gacatcagacttgtt

SEQ ID NO: 17103 - DNA, 15 bp, Artificial Sequence
  dgRNA
  Dcn
atattgtgcaaggca

SEQ ID NO: 17104 - DNA, 15 bp, Artificial Sequence
  dgRNA
  Dcn
gaacaaggaatacta

SEQ ID NO: 17105 - DNA, 15 bp, Artificial Sequence
  dgRNA
  Ptafr
gttggcacgaggaga

SEQ ID NO: 17106 - DNA, 15 bp, Artificial Sequence
  dgRNA
  Ptafr
caaacagttggcacg

SEQ ID NO: 17107 - DNA, 15 bp, Artificial Sequence
  dgRNA
  Schip1
gccctgcgacaactg

SEQ ID NO: 17108 - DNA, 15 bp, Artificial Sequence
  dgRNA
  Schip1
aaagctgagctcgcc

SEQ ID NO: 17109 - DNA, 15 bp, Artificial Sequence
  dgRNA
  Schip1
tgagctcgcccggcg

SEQ ID NO: 17110 - DNA, 15 bp, Artificial Sequence
  dgRNA
  Schip1
agctcgcccggcgcg

SEQ ID NO: 17111 - DNA, 15 bp, Artificial Sequence
  dgRNA
  Nos1ap
ccactactagttaag

SEQ ID NO: 17112 - DNA, 15 bp, Artificial Sequence
  dgRNA
  Nos1ap
taagcggactgcgcc

SEQ ID NO: 17113 - DNA, 15 bp, Artificial Sequence
  dgRNA
  Nos1ap
atcgccacgctcctg

SEQ ID NO: 17114 - DNA, 15 bp, Artificial Sequence
  dgRNA
  Nos1ap
cacgctcctgcggtc

SEQ ID NO: 17115 - DNA, 15 bp, Artificial Sequence
  dgRNA
  Lim2
tcagcaaattccatt

SEQ ID NO: 17116 - DNA, 15 bp, Artificial Sequence
  dgRNA
  Lim2
aggcttaagggattt

SEQ ID NO: 17117 - DNA, 15 bp, Artificial Sequence
  dgRNA
  Lim2
tttgggggaaccacg

SEQ ID NO: 17118 - DNA, 15 bp, Artificial Sequence
  dgRNA
  Lim2
ggaatttgctgaagc

SEQ ID NO: 17119 - DNA, 15 bp, Artificial Sequence
  dgRNA
  Gm4791
tctgtaagcggtttc

SEQ ID NO: 17120 - DNA, 15 bp, Artificial Sequence
  dgRNA
  Gm4791
atctgtaagcggttt

SEQ ID NO: 17121 - DNA, 15 bp, Artificial Sequence
  dgRNA
  Gm4791
tctcttcaatcgcca

SEQ ID NO: 17122 - DNA, 15 bp, Artificial Sequence
  dgRNA
  Gm4791
atctcttcaatcgcc

SEQ ID NO: 17123 - DNA, 15 bp, Artificial Sequence
  dgRNA
  Syngr1
cgctattttgcaaag

SEQ ID NO: 17124 - DNA, 15 bp, Artificial Sequence
  dgRNA
  Syngr1
aagaggtcaccccgc

SEQ ID NO: 17125 - DNA, 15 bp, Artificial Sequence
  dgRNA
  Syngr1
ggtcaccccgctggc

SEQ ID NO: 17126 - DNA, 15 bp, Artificial Sequence
  dgRNA
  Syngr1
gtcaccccgctggct

SEQ ID NO: 17127 - DNA, 15 bp, Artificial Sequence
  dgRNA
  Mtss1l
gccggcccctcttgc

SEQ ID NO: 17128 - DNA, 15 bp, Artificial Sequence
  dgRNA
  Mtss1l
cttgccggaccagtc

SEQ ID NO: 17129 - DNA, 15 bp, Artificial Sequence
  dgRNA
  Mtss1l
ggcagcgccagagct

SEQ ID NO: 17130 - DNA, 15 bp, Artificial Sequence
  dgRNA
  Mtss1l
cggatttcaaagccc

SEQ ID NO: 17131 - DNA, 15 bp, Artificial Sequence
  dgRNA
  Srsf3
acccacctgacggaa

SEQ ID NO: 17132 - DNA, 15 bp, Artificial Sequence
  dgRNA
  Srsf3
acctgacggaacggc

SEQ ID NO: 17133 - DNA, 15 bp, Artificial Sequence
  dgRNA
  Srsf3
cgctcccagtaaccg

SEQ ID NO: 17134 - DNA, 15 bp, Artificial Sequence
  dgRNA
  Srsf3
tgcgccgcctctgat

SEQ ID NO: 17135 - DNA, 15 bp, Artificial Sequence
  dgRNA
  Cyp2b19
gccaacatctagggt

SEQ ID NO: 17136 - DNA, 15 bp, Artificial Sequence
  dgRNA
  Cyp2b19
ccaacatctagggtt

SEQ ID NO: 17137 - DNA, 15 bp, Artificial Sequence
  dgRNA
  Cyp2b19
caacatctagggttg

SEQ ID NO: 17138 - DNA, 15 bp, Artificial Sequence
  dgRNA
  Cyp2b19
agaggcgggaatagc

SEQ ID NO: 17139 - DNA, 15 bp, Artificial Sequence
  dgRNA
  Exoc8
ctgccgtttccgcgc

SEQ ID NO: 17140 - DNA, 15 bp, Artificial Sequence
  dgRNA
  Exoc8
gtccgcactccgccc

SEQ ID NO: 17141 - DNA, 15 bp, Artificial Sequence
  dgRNA
  Exoc8
tccgcactccgcccc

SEQ ID NO: 17142 - DNA, 15 bp, Artificial Sequence
  dgRNA
  Exoc8
caggcgcagtgcgag

SEQ ID NO: 17143 - DNA, 15 bp, Artificial Sequence
  dgRNA
  Lipc
atctctctttgggat

SEQ ID NO: 17144 - DNA, 15 bp, Artificial Sequence
  dgRNA
  Lipc
gcgactagaaagacc

SEQ ID NO: 17145 - DNA, 15 bp, Artificial Sequence
  dgRNA
  Lipc
cccattcaagtacta

SEQ ID NO: 17146 - DNA, 15 bp, Artificial Sequence
  dgRNA
  Lipc
ccattcaagtactat

SEQ ID NO: 17147 - DNA, 15 bp, Artificial Sequence
  dgRNA
  Gpm6b
ctcagtgaaagctat

SEQ ID NO: 17148 - DNA, 15 bp, Artificial Sequence
  dgRNA
  Gpm6b
aggcttgcaacagcg

SEQ ID NO: 17149 - DNA, 15 bp, Artificial Sequence
  dgRNA
  Gpm6b
gcaacagcgcggcca

SEQ ID NO: 17150 - DNA, 15 bp, Artificial Sequence
  dgRNA
  Gpm6b
gcgcggccacggcca

SEQ ID NO: 17151 - DNA, 15 bp, Artificial Sequence
  dgRNA
  Armc6
ggagcctgccgcgtg

SEQ ID NO: 17152 - DNA, 15 bp, Artificial Sequence
  dgRNA
  Armc6
cccttatccaccgcc

SEQ ID NO: 17153 - DNA, 15 bp, Artificial Sequence
  dgRNA
  Armc6
atccaccgcctggcg

SEQ ID NO: 17154 - DNA, 15 bp, Artificial Sequence
  dgRNA
  Armc6
caccgcctggcgagg

SEQ ID NO: 17155 - DNA, 15 bp, Artificial Sequence
  dgRNA
  1700001C02Rik
tatgaacacctaaac

SEQ ID NO: 17156 - DNA, 15 bp, Artificial Sequence
  dgRNA
  1700001C02Rik
cctaaactggatgcc

SEQ ID NO: 17157 - DNA, 15 bp, Artificial Sequence
  dgRNA
  1700001C02Rik
gggcggcgtcttctc

SEQ ID NO: 17158 - DNA, 15 bp, Artificial Sequence
  dgRNA
  1700001C02Rik
ggcggcgtcttctcc

SEQ ID NO: 17159 - DNA, 15 bp, Artificial Sequence
  dgRNA
  Lrrc55
ctggggtacctcaac

SEQ ID NO: 17160 - DNA, 15 bp, Artificial Sequence
  dgRNA
  Lrrc55
tggggtacctcaact

SEQ ID NO: 17161 - DNA, 15 bp, Artificial Sequence
  dgRNA
  Lrrc55
gggtccatgctcccc

SEQ ID NO: 17162 - DNA, 15 bp, Artificial Sequence
  dgRNA
  Lrrc55
catcctatgaatctt

SEQ ID NO: 17163 - DNA, 15 bp, Artificial Sequence
  dgRNA
  Hapln2
caggcctttttccgg

SEQ ID NO: 17164 - DNA, 15 bp, Artificial Sequence
  dgRNA
  Hapln2
ccaagggacgaataa

SEQ ID NO: 17165 - DNA, 15 bp, Artificial Sequence
  dgRNA
  Hapln2
caagggacgaataaa

SEQ ID NO: 17166 - DNA, 15 bp, Artificial Sequence
  dgRNA
  Hapln2
ctgttacccaacaat

SEQ ID NO: 17167 - DNA, 15 bp, Artificial Sequence
  dgRNA
  Gpr173
gatttgtgtgaagcg

SEQ ID NO: 17168 - DNA, 15 bp, Artificial Sequence
  dgRNA
  Gpr173
aagcggggtgattcc

SEQ ID NO: 17169 - DNA, 15 bp, Artificial Sequence
  dgRNA
  Gpr173
agcggggtgattccc

SEQ ID NO: 17170 - DNA, 15 bp, Artificial Sequence
  dgRNA
  Gpr173
ggtgattcccgggcc

SEQ ID NO: 17171 - DNA, 15 bp, Artificial Sequence
  dgRNA
  Cd209e
taccccttccggtgc

SEQ ID NO: 17172 - DNA, 15 bp, Artificial Sequence
  dgRNA
  Cd209e
tagctgctaggaacg

SEQ ID NO: 17173 - DNA, 15 bp, Artificial Sequence
  dgRNA
  Cd209e
ggaacgaggcacagt

SEQ ID NO: 17174 - DNA, 15 bp, Artificial Sequence
  dgRNA
  Cd209e
acgaggcacagtggg

SEQ ID NO: 17175 - DNA, 15 bp, Artificial Sequence
  dgRNA
  Noc4l
agcagcactcgagcc

SEQ ID NO: 17176 - DNA, 15 bp, Artificial Sequence
  dgRNA
  Noc4l
ctgccccgcggcctc

SEQ ID NO: 17177 - DNA, 15 bp, Artificial Sequence
  dgRNA
  Noc4l
tgccccgcggcctct

SEQ ID NO: 17178 - DNA, 15 bp, Artificial Sequence
  dgRNA
  Noc4l
gcgtaccgcgctatg

SEQ ID NO: 17179 - DNA, 15 bp, Artificial Sequence
  dgRNA
  Ptrh1
cagggtgacgcgtcg

SEQ ID NO: 17180 - DNA, 15 bp, Artificial Sequence
  dgRNA
  Ptrh1
ggtgacgcgtcgcgg

SEQ ID NO: 17181 - DNA, 15 bp, Artificial Sequence
  dgRNA
  Ptrh1
acccagacactcgcc

SEQ ID NO: 17182 - DNA, 15 bp, Artificial Sequence
  dgRNA
  Ptrh1
cgccccgcagagaca

SEQ ID NO: 17183 - DNA, 15 bp, Artificial Sequence
  dgRNA
  Usp3
agtacccacacttgt

SEQ ID NO: 17184 - DNA, 15 bp, Artificial Sequence
  dgRNA
  Usp3
gtacccacacttgtc

SEQ ID NO: 17185 - DNA, 15 bp, Artificial Sequence
  dgRNA
  Usp3
cgggttcccaagaat

SEQ ID NO: 17186 - DNA, 15 bp, Artificial Sequence
  dgRNA
  Usp3
aagaatcggctgcag

SEQ ID NO: 17187 - DNA, 15 bp, Artificial Sequence
  dgRNA
  Lamtor5
tgtcttcttagcgat

SEQ ID NO: 17188 - DNA, 15 bp, Artificial Sequence
  dgRNA
  Lamtor5
aaccaggtctacgtc

SEQ ID NO: 17189 - DNA, 15 bp, Artificial Sequence
  dgRNA
  Lamtor5
ggtctacgtctggtt

SEQ ID NO: 17190 - DNA, 15 bp, Artificial Sequence
  dgRNA
  Lamtor5
acgtctggttaggac

SEQ ID NO: 17191 - DNA, 15 bp, Artificial Sequence
  dgRNA
  Tgfbr3
gccttctctgcccga

SEQ ID NO: 17192 - DNA, 15 bp, Artificial Sequence
  dgRNA
  Tgfbr3
ccttctctgcccgaa

SEQ ID NO: 17193 - DNA, 15 bp, Artificial Sequence
  dgRNA
  Tgfbr3
gcggccgagcccccg

SEQ ID NO: 17194 - DNA, 15 bp, Artificial Sequence
  dgRNA
  Tgfbr3
agcccccgaggcccg

SEQ ID NO: 17195 - DNA, 15 bp, Artificial Sequence
  dgRNA
  Spsb3
agcgtggctacgtcc

SEQ ID NO: 17196 - DNA, 15 bp, Artificial Sequence
  dgRNA
  Spsb3
gcgtggctacgtcca

SEQ ID NO: 17197 - DNA, 15 bp, Artificial Sequence
  dgRNA
  Spsb3
gtgcgcggccccgcc

SEQ ID NO: 17198 - DNA, 15 bp, Artificial Sequence
  dgRNA
  Spsb3
cggcttctttgtgga

SEQ ID NO: 17199 - DNA, 15 bp, Artificial Sequence
  dgRNA
  Sapcd2
tcgttaagtctccca

SEQ ID NO: 17200 - DNA, 15 bp, Artificial Sequence
  dgRNA
  Sapcd2
cgttaagtctcccaa

SEQ ID NO: 17201 - DNA, 15 bp, Artificial Sequence
  dgRNA
  Sapcd2
ctcccaagggccgga

SEQ ID NO: 17202 - DNA, 15 bp, Artificial Sequence
  dgRNA
  Sapcd2
aagggccggatggtg

SEQ ID NO: 17203 - DNA, 15 bp, Artificial Sequence
  dgRNA
  Smco1
cgctctgtgatagca

SEQ ID NO: 17204 - DNA, 15 bp, Artificial Sequence
  dgRNA
  Smco1
gtcacagtgcgcgcc

SEQ ID NO: 17205 - DNA, 15 bp, Artificial Sequence
  dgRNA
  Smco1
gcgcgccaggacacc

SEQ ID NO: 17206 - DNA, 15 bp, Artificial Sequence
  dgRNA
  Smco1
cgcgccaggacacct

SEQ ID NO: 17207 - DNA, 15 bp, Artificial Sequence
  dgRNA
  Cmah
gcatactctagaacg

SEQ ID NO: 17208 - DNA, 15 bp, Artificial Sequence
  dgRNA
  Cmah
tggcgtctactatag

SEQ ID NO: 17209 - DNA, 15 bp, Artificial Sequence
  dgRNA
  Cmah
ggcgtctactatagt

SEQ ID NO: 17210 - DNA, 15 bp, Artificial Sequence
  dgRNA
  Cmah
gtctactatagtggg

SEQ ID NO: 17211 - DNA, 15 bp, Artificial Sequence
  dgRNA
  4930550C14Rik
ctaagaaggttgcta

SEQ ID NO: 17212 - DNA, 15 bp, Artificial Sequence
  dgRNA
  4930550C14Rik
gacgggccttgctga

SEQ ID NO: 17213 - DNA, 15 bp, Artificial Sequence
  dgRNA
  4930550C14Rik
tctcgggcatgtgac

SEQ ID NO: 17214 - DNA, 15 bp, Artificial Sequence
  dgRNA
  4930550C14Rik
atctcgggcatgtga

SEQ ID NO: 17215 - DNA, 15 bp, Artificial Sequence
  dgRNA
  Tnip1
tgccagaggcgggat

SEQ ID NO: 17216 - DNA, 15 bp, Artificial Sequence
  dgRNA
  Tnip1
ctcagctcggccttg

SEQ ID NO: 17217 - DNA, 15 bp, Artificial Sequence
  dgRNA
  Tnip1
tcagctcggccttgt

SEQ ID NO: 17218 - DNA, 15 bp, Artificial Sequence
  dgRNA
  Tnip1
cagctcggccttgtg

SEQ ID NO: 17219 - DNA, 15 bp, Artificial Sequence
  dgRNA
  Ston2
ctttccagatcaact

SEQ ID NO: 17220 - DNA, 15 bp, Artificial Sequence
  dgRNA
  Ston2
agcgccagcgtggtg

SEQ ID NO: 17221 - DNA, 15 bp, Artificial Sequence
  dgRNA
  Ston2
cgtggtgaggtcatt

SEQ ID NO: 17222 - DNA, 15 bp, Artificial Sequence
  dgRNA
  Ston2
caagggcgtcttccc

SEQ ID NO: 17223 - DNA, 15 bp, Artificial Sequence
  dgRNA
  1700123O20Rik
cttaatctagtcgag

SEQ ID NO: 17224 - DNA, 15 bp, Artificial Sequence
  dgRNA
  1700123O20Rik
ctgctcgccccctta

SEQ ID NO: 17225 - DNA, 15 bp, Artificial Sequence
  dgRNA
  1700123O20Rik
ggccagccacaccgg

SEQ ID NO: 17226 - DNA, 15 bp, Artificial Sequence
  dgRNA
  1700123O20Rik
caccggtggttgtag

SEQ ID NO: 17227 - DNA, 15 bp, Artificial Sequence
  dgRNA
  Vmn2r11
tttcccgatgtatcc

SEQ ID NO: 17228 - DNA, 15 bp, Artificial Sequence
  dgRNA
  Vmn2r11
ttatatcatgctccc

SEQ ID NO: 17229 - DNA, 15 bp, Artificial Sequence
  dgRNA
  Grap
ctgcatcgtcctaat

SEQ ID NO: 17230 - DNA, 15 bp, Artificial Sequence
  dgRNA
  Grap
tgcatcgtcctaatg

SEQ ID NO: 17231 - DNA, 15 bp, Artificial Sequence
  dgRNA
  Grap
gtttctcccccatca

SEQ ID NO: 17232 - DNA, 15 bp, Artificial Sequence
  dgRNA
  Grap
tttctcccccatcaa

SEQ ID NO: 17233 - DNA, 15 bp, Artificial Sequence
  dgRNA
  Golga1
agggcggccagattg

SEQ ID NO: 17234 - DNA, 15 bp, Artificial Sequence
  dgRNA
  Golga1
tcgctgacgtgtcag

SEQ ID NO: 17235 - DNA, 15 bp, Artificial Sequence
  dgRNA
  Golga1
tgacgtgtcagtggc

SEQ ID NO: 17236 - DNA, 15 bp, Artificial Sequence
  dgRNA
  Golga1
gtggccggccaacac

SEQ ID NO: 17237 - DNA, 15 bp, Artificial Sequence
  dgRNA
  Zc4h2
ttgccgcacattggt

SEQ ID NO: 17238 - DNA, 15 bp, Artificial Sequence
  dgRNA
  Zc4h2
tgccgcacattggta

SEQ ID NO: 17239 - DNA, 15 bp, Artificial Sequence
  dgRNA
  Zc4h2
ttaaagtgccgctac

SEQ ID NO: 17240 - DNA, 15 bp, Artificial Sequence
  dgRNA
  Zc4h2
tgccgctacaggaac

SEQ ID NO: 17241 - DNA, 15 bp, Artificial Sequence
  dgRNA
  Pdhx
gggacctcgtccctt

SEQ ID NO: 17242 - DNA, 15 bp, Artificial Sequence
  dgRNA
  Pdhx
ttggagaatctgcgg

SEQ ID NO: 17243 - DNA, 15 bp, Artificial Sequence
  dgRNA
  Pdhx
tgcggcggcgcaaac

SEQ ID NO: 17244 - DNA, 15 bp, Artificial Sequence
  dgRNA
  Pdhx
gcggcgcaaaccggc

SEQ ID NO: 17245 - DNA, 15 bp, Artificial Sequence
  dgRNA
  Bpifb3
tgggcaagtgaatca

SEQ ID NO: 17246 - DNA, 15 bp, Artificial Sequence
  dgRNA
  Bpifb3
gcaagtgaatcaagg

SEQ ID NO: 17247 - DNA, 15 bp, Artificial Sequence
  dgRNA
  Bpifb3
tggaccccgcattac

SEQ ID NO: 17248 - DNA, 15 bp, Artificial Sequence
  dgRNA
  Bpifb3
cccgcattactggag

SEQ ID NO: 17249 - DNA, 15 bp, Artificial Sequence
  dgRNA
  Aqp5
gcacgcacgtcgacc

SEQ ID NO: 17250 - DNA, 15 bp, Artificial Sequence
  dgRNA
  Aqp5
cgcacgtcgaccagg

SEQ ID NO: 17251 - DNA, 15 bp, Artificial Sequence
  dgRNA
  Aqp5
gcacgtcgaccagga

SEQ ID NO: 17252 - DNA, 15 bp, Artificial Sequence
  dgRNA
  Aqp5
tcgaccaggagggcg

SEQ ID NO: 17253 - DNA, 15 bp, Artificial Sequence
  dgRNA
  Kirrel3
ctcgttcgctcgctg

SEQ ID NO: 17254 - DNA, 15 bp, Artificial Sequence
  dgRNA
  Kirrel3
tcgttcgctcgctgt

SEQ ID NO: 17255 - DNA, 15 bp, Artificial Sequence
  dgRNA
  Kirrel3
ttcgctcgctgtggg

SEQ ID NO: 17256 - DNA, 15 bp, Artificial Sequence
  dgRNA
  Kirrel3
ctttgcaaaacggga

SEQ ID NO: 17257 - DNA, 15 bp, Artificial Sequence
  dgRNA
  Sybu
acggaatttttccaa

SEQ ID NO: 17258 - DNA, 15 bp, Artificial Sequence
  dgRNA
  Sybu
cttaggttcgtgcta

SEQ ID NO: 17259 - DNA, 15 bp, Artificial Sequence
  dgRNA
  Sybu
cgtgctacggtttcc

SEQ ID NO: 17260 - DNA, 15 bp, Artificial Sequence
  dgRNA
  Sybu
atctcccgccctaga

SEQ ID NO: 17261 - DNA, 15 bp, Artificial Sequence
  dgRNA
  Timp3
agagattatgcagga

SEQ ID NO: 17262 - DNA, 15 bp, Artificial Sequence
  dgRNA
  Timp3
ccttgtttaggtcca

SEQ ID NO: 17263 - DNA, 15 bp, Artificial Sequence
  dgRNA
  Timp3
ctcatagagaggcgg

SEQ ID NO: 17264 - DNA, 15 bp, Artificial Sequence
  dgRNA
  Timp3
tcatagagaggcggt

SEQ ID NO: 17265 - DNA, 15 bp, Artificial Sequence
  dgRNA
  Il4ra
acgctgagtaaacat

SEQ ID NO: 17266 - DNA, 15 bp, Artificial Sequence
  dgRNA
  Il4ra
cgctgagtaaacatt

SEQ ID NO: 17267 - DNA, 15 bp, Artificial Sequence
  dgRNA
  Il4ra
cgagtcccgcagtcg

SEQ ID NO: 17268 - DNA, 15 bp, Artificial Sequence
  dgRNA
  Il4ra
gagtcccgcagtcgt

SEQ ID NO: 17269 - DNA, 15 bp, Artificial Sequence
  dgRNA
  Foxp3
ggcgcttaataataa

SEQ ID NO: 17270 - DNA, 15 bp, Artificial Sequence
  dgRNA
  Foxp3
gccacagtttagcaa

SEQ ID NO: 17271 - DNA, 15 bp, Artificial Sequence
  dgRNA
  Foxp3
tctgcgctcaatacc

SEQ ID NO: 17272 - DNA, 15 bp, Artificial Sequence
  dgRNA
  Foxp3
atctgcgctcaatac

SEQ ID NO: 17273 - DNA, 15 bp, Artificial Sequence
  dgRNA
  Rhpn1
cgcgctctgccgcac

SEQ ID NO: 17274 - DNA, 15 bp, Artificial Sequence
  dgRNA
  Rhpn1
gccgcaccggtcagt

SEQ ID NO: 17275 - DNA, 15 bp, Artificial Sequence
  dgRNA
  Rhpn1
tcagtcggaccctcc

SEQ ID NO: 17276 - DNA, 15 bp, Artificial Sequence
  dgRNA
  Rhpn1
gtcggaccctccagg

SEQ ID NO: 17277 - DNA, 15 bp, Artificial Sequence
  dgRNA
  Dcbld2
ctcccggccccggct

SEQ ID NO: 17278 - DNA, 15 bp, Artificial Sequence
  dgRNA
  Dcbld2
tcccggccccggctt

SEQ ID NO: 17279 - DNA, 15 bp, Artificial Sequence
  dgRNA
  Dcbld2
cccggccccggcttg

SEQ ID NO: 17280 - DNA, 15 bp, Artificial Sequence
  dgRNA
  Dcbld2
ccggccccggcttgg

SEQ ID NO: 17281 - DNA, 15 bp, Artificial Sequence
  dgRNA
  Pcmtd2
ctgaccaatcaggca

SEQ ID NO: 17282 - DNA, 15 bp, Artificial Sequence
  dgRNA
  Pcmtd2
cttaactcaaaccag

SEQ ID NO: 17283 - DNA, 15 bp, Artificial Sequence
  dgRNA
  Pcmtd2
actcaaaccagtggg

SEQ ID NO: 17284 - DNA, 15 bp, Artificial Sequence
  dgRNA
  Pcmtd2
aaagtggcaggctcg

SEQ ID NO: 17285 - DNA, 15 bp, Artificial Sequence
  dgRNA
  Cyp4v3
gctcagaagttgttc

SEQ ID NO: 17286 - DNA, 15 bp, Artificial Sequence
  dgRNA
  Cyp4v3
cgccttgaaccccag

SEQ ID NO: 17287 - DNA, 15 bp, Artificial Sequence
  dgRNA
  Cyp4v3
tacgcagactcgtgc

SEQ ID NO: 17288 - DNA, 15 bp, Artificial Sequence
  dgRNA
  Cyp4v3
acgcagactcgtgca

SEQ ID NO: 17289 - DNA, 15 bp, Artificial Sequence
  dgRNA
  Taar5
ttgatccagtactca

SEQ ID NO: 17290 - DNA, 15 bp, Artificial Sequence
  dgRNA
  5-Mar
gaaacgggagggcgc

SEQ ID NO: 17291 - DNA, 15 bp, Artificial Sequence
  dgRNA
  5-Mar
gggagggcgccggcc

SEQ ID NO: 17292 - DNA, 15 bp, Artificial Sequence
  dgRNA
  5-Mar
agggcgccggcccgg

SEQ ID NO: 17293 - DNA, 15 bp, Artificial Sequence
  dgRNA
  5-Mar
gcgccggcccggcgg

SEQ ID NO: 17294 - DNA, 15 bp, Artificial Sequence
  dgRNA
  Fcrls
gaaggcgtcctacgc

SEQ ID NO: 17295 - DNA, 15 bp, Artificial Sequence
  dgRNA
  Fcrls
ttttgcagcacccat

SEQ ID NO: 17296 - DNA, 15 bp, Artificial Sequence
  dgRNA
  Fcrls
cagcacccattgggt

SEQ ID NO: 17297 - DNA, 15 bp, Artificial Sequence
  dgRNA
  Fcrls
agcacccattgggtt

SEQ ID NO: 17298 - DNA, 15 bp, Artificial Sequence
  dgRNA
  Gm16286
cgacgcgctcaccga

SEQ ID NO: 17299 - DNA, 15 bp, Artificial Sequence
  dgRNA
  Gm16286
gcaggcccagctcgc

SEQ ID NO: 17300 - DNA, 15 bp, Artificial Sequence
  dgRNA
  Gm16286
cgctgggcggcgacc

SEQ ID NO: 17301 - DNA, 15 bp, Artificial Sequence
  dgRNA
  Gm16286
gctgggcggcgacca

SEQ ID NO: 17302 - DNA, 15 bp, Artificial Sequence
  dgRNA
  Spaca4
gccatcggtaaagtg

SEQ ID NO: 17303 - DNA, 15 bp, Artificial Sequence
  dgRNA
  Spaca4
gccgagccaatgtgt

SEQ ID NO: 17304 - DNA, 15 bp, Artificial Sequence
  dgRNA
  Spaca4
aatgtgtcggcgtta

SEQ ID NO: 17305 - DNA, 15 bp, Artificial Sequence
  dgRNA
  Spaca4
atgtgtcggcgttat

SEQ ID NO: 17306 - DNA, 15 bp, Artificial Sequence
  dgRNA
  Cisd3
gagagggcggcgacc

SEQ ID NO: 17307 - DNA, 15 bp, Artificial Sequence
  dgRNA
  Cisd3
gcggcgacccggacg

SEQ ID NO: 17308 - DNA, 15 bp, Artificial Sequence
  dgRNA
  Cisd3
cggctacgcgcagag

SEQ ID NO: 17309 - DNA, 15 bp, Artificial Sequence
  dgRNA
  Cisd3
cggccatgcgcagcg

SEQ ID NO: 17310 - DNA, 15 bp, Artificial Sequence
  dgRNA
  D030056L22Rik
gccgccagggggtag

SEQ ID NO: 17311 - DNA, 15 bp, Artificial Sequence
  dgRNA
  D030056L22Rik
cagagggcgcacttc

SEQ ID NO: 17312 - DNA, 15 bp, Artificial Sequence
  dgRNA
  D030056L22Rik
gcacttccggccgca

SEQ ID NO: 17313 - DNA, 15 bp, Artificial Sequence
  dgRNA
  D030056L22Rik
cacttccggccgcaa

SEQ ID NO: 17314 - DNA, 15 bp, Artificial Sequence
  dgRNA
  Olfr1053
aacgtttaattcttt

SEQ ID NO: 17315 - DNA, 15 bp, Artificial Sequence
  dgRNA
  Olfr1053
cacacgtgtaaaaca

SEQ ID NO: 17316 - DNA, 15 bp, Artificial Sequence
  dgRNA
  Ppp1r3f
tacgtcactcccgcg

SEQ ID NO: 17317 - DNA, 15 bp, Artificial Sequence
  dgRNA
  Ppp1r3f
cgcgtggctgtccat

SEQ ID NO: 17318 - DNA, 15 bp, Artificial Sequence
  dgRNA
  Ppp1r3f
ccgcctacgctccac

SEQ ID NO: 17319 - DNA, 15 bp, Artificial Sequence
  dgRNA
  Ppp1r3f
aggccctgcccccgc

SEQ ID NO: 17320 - DNA, 15 bp, Artificial Sequence
  dgRNA
  Ppp6r3
caaagccaatcgaag

SEQ ID NO: 17321 - DNA, 15 bp, Artificial Sequence
  dgRNA
  Ppp6r3
atcgaagtggagtcg

SEQ ID NO: 17322 - DNA, 15 bp, Artificial Sequence
  dgRNA
  Ppp6r3
tcgaagtggagtcga

SEQ ID NO: 17323 - DNA, 15 bp, Artificial Sequence
  dgRNA
  Ppp6r3
agtcgagggaaccgc

SEQ ID NO: 17324 - DNA, 15 bp, Artificial Sequence
  dgRNA
  Arl14ep
gctagggagtttgtt

SEQ ID NO: 17325 - DNA, 15 bp, Artificial Sequence
  dgRNA
  Arl14ep
taatgccctcatgaa

SEQ ID NO: 17326 - DNA, 15 bp, Artificial Sequence
  dgRNA
  Arl14ep
atggcagcctcctag

SEQ ID NO: 17327 - DNA, 15 bp, Artificial Sequence
  dgRNA
  Arl14ep
cagtggttacactgg

SEQ ID NO: 17328 - DNA, 15 bp, Artificial Sequence
  dgRNA
  Olfr615
aacactatccttcac

SEQ ID NO: 17329 - DNA, 15 bp, Artificial Sequence
  dgRNA
  Olfr615
aaggatagtgttatt

SEQ ID NO: 17330 - DNA, 15 bp, Artificial Sequence
  dgRNA
  Olfr615
gaaggatagtgttat

SEQ ID NO: 17331 - DNA, 15 bp, Artificial Sequence
  dgRNA
  Odf2l
gagacaaccccccgc

SEQ ID NO: 17332 - DNA, 15 bp, Artificial Sequence
  dgRNA
  Odf2l
accaattagctgcgt

SEQ ID NO: 17333 - DNA, 15 bp, Artificial Sequence
  dgRNA
  Odf2l
ttagctgcgtcggag

SEQ ID NO: 17334 - DNA, 15 bp, Artificial Sequence
  dgRNA
  Odf2l
tagctgcgtcggagc

SEQ ID NO: 17335 - DNA, 15 bp, Artificial Sequence
  dgRNA
  Inpp5k
gggaatgcggagcct

SEQ ID NO: 17336 - DNA, 15 bp, Artificial Sequence
  dgRNA
  Inpp5k
aatgcggagcctagg

SEQ ID NO: 17337 - DNA, 15 bp, Artificial Sequence
  dgRNA
  Inpp5k
gcccactcccgcgtc

SEQ ID NO: 17338 - DNA, 15 bp, Artificial Sequence
  dgRNA
  Inpp5k
ctcccgcgtccgggc

SEQ ID NO: 17339 - DNA, 15 bp, Artificial Sequence
  dgRNA
  Il9
taaatacagctagac

SEQ ID NO: 17340 - DNA, 15 bp, Artificial Sequence
  dgRNA
  Il9
tgctcttcaaatagt

SEQ ID NO: 17341 - DNA, 15 bp, Artificial Sequence
  dgRNA
  Il9
taaagctcttcaaac

SEQ ID NO: 17342 - DNA, 15 bp, Artificial Sequence
  dgRNA
  4933415F23Rik
tttatacttcgttta

SEQ ID NO: 17343 - DNA, 15 bp, Artificial Sequence
  dgRNA
  4933415F23Rik
ggcaatccccctagt

SEQ ID NO: 17344 - DNA, 15 bp, Artificial Sequence
  dgRNA
  4933415F23Rik
gcaatccccctagta

SEQ ID NO: 17345 - DNA, 15 bp, Artificial Sequence
  dgRNA
  4933415F23Rik
tcatgaaccacacta

SEQ ID NO: 17346 - DNA, 15 bp, Artificial Sequence
  dgRNA
  Hgs
agctaccacgcaatg

SEQ ID NO: 17347 - DNA, 15 bp, Artificial Sequence
  dgRNA
  Hgs
ccgcttagctttcat

SEQ ID NO: 17348 - DNA, 15 bp, Artificial Sequence
  dgRNA
  Hgs
atagaccgctcgtcc

SEQ ID NO: 17349 - DNA, 15 bp, Artificial Sequence
  dgRNA
  Hgs
tcccaatggactgag

SEQ ID NO: 17350 - DNA, 15 bp, Artificial Sequence
  dgRNA
  Psmd6
aaaggggacagcgcc

SEQ ID NO: 17351 - DNA, 15 bp, Artificial Sequence
  dgRNA
  Psmd6
ccgccgatgtccagc

SEQ ID NO: 17352 - DNA, 15 bp, Artificial Sequence
  dgRNA
  Psmd6
cgccgatgtccagca

SEQ ID NO: 17353 - DNA, 15 bp, Artificial Sequence
  dgRNA
  Psmd6
gccgatgtccagcag

SEQ ID NO: 17354 - DNA, 15 bp, Artificial Sequence
  dgRNA
  Ndufab1
agtcggtttctcttt

SEQ ID NO: 17355 - DNA, 15 bp, Artificial Sequence
  dgRNA
  Ndufab1
gtcggtttctctttt

SEQ ID NO: 17356 - DNA, 15 bp, Artificial Sequence
  dgRNA
  Ndufab1
ttgtccttctaaagg

SEQ ID NO: 17357 - DNA, 15 bp, Artificial Sequence
  dgRNA
  Ndufab1
tgggtgcagcgcggc

SEQ ID NO: 17358 - DNA, 15 bp, Artificial Sequence
  dgRNA
  Ndufaf6
ggcacccatcccttt

SEQ ID NO: 17359 - DNA, 15 bp, Artificial Sequence
  dgRNA
  Ndufaf6
tcccttttggcgttc

SEQ ID NO: 17360 - DNA, 15 bp, Artificial Sequence
  dgRNA
  Ndufaf6
cccttttggcgttct

SEQ ID NO: 17361 - DNA, 15 bp, Artificial Sequence
  dgRNA
  Ndufaf6
tgtgggagtggacgc

SEQ ID NO: 17362 - DNA, 15 bp, Artificial Sequence
  dgRNA
  Tnrc18
tataggaatggctga

SEQ ID NO: 17363 - DNA, 15 bp, Artificial Sequence
  dgRNA
  Tnrc18
tttacatgcgcgtga

SEQ ID NO: 17364 - DNA, 15 bp, Artificial Sequence
  dgRNA
  Tnrc18
ttacatgcgcgtgat

SEQ ID NO: 17365 - DNA, 15 bp, Artificial Sequence
  dgRNA
  Tnrc18
catgcgcgtgatggg

SEQ ID NO: 17366 - DNA, 15 bp, Artificial Sequence
  dgRNA
  Slc25a43
agaaaaacgtgatgc

SEQ ID NO: 17367 - DNA, 15 bp, Artificial Sequence
  dgRNA
  Slc25a43
ccctgaggcgctgct

SEQ ID NO: 17368 - DNA, 15 bp, Artificial Sequence
  dgRNA
  Slc25a43
cttaggtattccctt

SEQ ID NO: 17369 - DNA, 15 bp, Artificial Sequence
  dgRNA
  Slc25a43
catcacgtttttctt

SEQ ID NO: 17370 - DNA, 15 bp, Artificial Sequence
  dgRNA
  Luc7l3
ctccaagtaaaaaag

SEQ ID NO: 17371 - DNA, 15 bp, Artificial Sequence
  dgRNA
  Luc7l3
aaaagaggccgacac

SEQ ID NO: 17372 - DNA, 15 bp, Artificial Sequence
  dgRNA
  Luc7l3
cgtccaccgctccgt

SEQ ID NO: 17373 - DNA, 15 bp, Artificial Sequence
  dgRNA
  Luc7l3
gtccaccgctccgtt

SEQ ID NO: 17374 - DNA, 15 bp, Artificial Sequence
  dgRNA
  Trpc4ap
gttcccataaggcgt

SEQ ID NO: 17375 - DNA, 15 bp, Artificial Sequence
  dgRNA
  Trpc4ap
ttcccataaggcgtc

SEQ ID NO: 17376 - DNA, 15 bp, Artificial Sequence
  dgRNA
  Trpc4ap
tcccataaggcgtcg

SEQ ID NO: 17377 - DNA, 15 bp, Artificial Sequence
  dgRNA
  Trpc4ap
ccgcgtcagtccact

SEQ ID NO: 17378 - DNA, 15 bp, Artificial Sequence
  dgRNA
  Cntn4
caggtgctacgccta

SEQ ID NO: 17379 - DNA, 15 bp, Artificial Sequence
  dgRNA
  Cntn4
aggtgctacgcctaa

SEQ ID NO: 17380 - DNA, 15 bp, Artificial Sequence
  dgRNA
  Cntn4
tgagtcttccgctag

SEQ ID NO: 17381 - DNA, 15 bp, Artificial Sequence
  dgRNA
  Cntn4
cgctagtggctgcaa

SEQ ID NO: 17382 - DNA, 15 bp, Artificial Sequence
  dgRNA
  Ndst3
cagaggtataggatc

SEQ ID NO: 17383 - DNA, 15 bp, Artificial Sequence
  dgRNA
  Ndst3
tgggagtccactact

SEQ ID NO: 17384 - DNA, 15 bp, Artificial Sequence
  dgRNA
  Ndst3
ctgggagtccactac

SEQ ID NO: 17385 - DNA, 15 bp, Artificial Sequence
  dgRNA
  Ndst3
ttgtgagaagctact

SEQ ID NO: 17386 - DNA, 15 bp, Artificial Sequence
  dgRNA
  Dnase1
cctacgacccacccc

SEQ ID NO: 17387 - DNA, 15 bp, Artificial Sequence
  dgRNA
  Dnase1
ttatgtctggtctag

SEQ ID NO: 17388 - DNA, 15 bp, Artificial Sequence
  dgRNA
  Dnase1
cttatgtctggtcta

SEQ ID NO: 17389 - DNA, 15 bp, Artificial Sequence
  dgRNA
  Dnase1
acttatgtctggtct

SEQ ID NO: 17390 - DNA, 15 bp, Artificial Sequence
  dgRNA
  Lrrc16b
gatagctcggacacc

SEQ ID NO: 17391 - DNA, 15 bp, Artificial Sequence
  dgRNA
  Lrrc16b
ccaggcgccgcgctc

SEQ ID NO: 17392 - DNA, 15 bp, Artificial Sequence
  dgRNA
  Lrrc16b
caggcgccgcgctcc

SEQ ID NO: 17393 - DNA, 15 bp, Artificial Sequence
  dgRNA
  Lrrc16b
tccgggcttctcacg

SEQ ID NO: 17394 - DNA, 15 bp, Artificial Sequence
  dgRNA
  Tm2d3
agtgaggggctattc

SEQ ID NO: 17395 - DNA, 15 bp, Artificial Sequence
  dgRNA
  Tm2d3
cagagcacggcgaca

SEQ ID NO: 17396 - DNA, 15 bp, Artificial Sequence
  dgRNA
  Tm2d3
acccaacctccgagc

SEQ ID NO: 17397 - DNA, 15 bp, Artificial Sequence
  dgRNA
  Tm2d3
cccaacctccgagct

SEQ ID NO: 17398 - DNA, 15 bp, Artificial Sequence
  dgRNA
  Apcs
cccagatttcattgc

SEQ ID NO: 17399 - DNA, 15 bp, Artificial Sequence
  dgRNA
  Apcs
gattagcccctgtgc

SEQ ID NO: 17400 - DNA, 15 bp, Artificial Sequence
  dgRNA
  Ly6g
cctgcaagtcaattg

SEQ ID NO: 17401 - DNA, 15 bp, Artificial Sequence
  dgRNA
  Ly6g
tcctccccaactgag

SEQ ID NO: 17402 - DNA, 15 bp, Artificial Sequence
  dgRNA
  Ly6g
ccacaattgacttgc

SEQ ID NO: 17403 - DNA, 15 bp, Artificial Sequence
  dgRNA
  Ly6g
agagcgtaggagcag

SEQ ID NO: 17404 - DNA, 15 bp, Artificial Sequence
  dgRNA
  Cyb5rl
ctgaggatcctaatc

SEQ ID NO: 17405 - DNA, 15 bp, Artificial Sequence
  dgRNA
  Cyb5rl
tgaggatcctaatca

SEQ ID NO: 17406 - DNA, 15 bp, Artificial Sequence
  dgRNA
  Cyb5rl
acatattatggacgc

SEQ ID NO: 17407 - DNA, 15 bp, Artificial Sequence
  dgRNA
  Cyb5rl
gacgcaggttaactg

SEQ ID NO: 17408 - DNA, 15 bp, Artificial Sequence
  dgRNA
  Tmem67
tgtttcccgcgtgcg

SEQ ID NO: 17409 - DNA, 15 bp, Artificial Sequence
  dgRNA
  Tmem67
caaccaggcgtcgca

SEQ ID NO: 17410 - DNA, 15 bp, Artificial Sequence
  dgRNA
  Tmem67
gtccaatcagctcag

SEQ ID NO: 17411 - DNA, 15 bp, Artificial Sequence
  dgRNA
  Tmem67
tcagcggactcaccg

SEQ ID NO: 17412 - DNA, 15 bp, Artificial Sequence
  dgRNA
  Tmsb10
aacgcaagagacttg

SEQ ID NO: 17413 - DNA, 15 bp, Artificial Sequence
  dgRNA
  Tmsb10
agacttgaggcgacg

SEQ ID NO: 17414 - DNA, 15 bp, Artificial Sequence
  dgRNA
  Tmsb10
gacttgaggcgacgc

SEQ ID NO: 17415 - DNA, 15 bp, Artificial Sequence
  dgRNA
  Tmsb10
ttgaggcgacgcggg

SEQ ID NO: 17416 - DNA, 15 bp, Artificial Sequence
  dgRNA
  Rem1
gtgccccgtaagtgg

SEQ ID NO: 17417 - DNA, 15 bp, Artificial Sequence
  dgRNA
  Rem1
tgccccgtaagtggt

SEQ ID NO: 17418 - DNA, 15 bp, Artificial Sequence
  dgRNA
  Rem1
gccccgtaagtggtg

SEQ ID NO: 17419 - DNA, 15 bp, Artificial Sequence
  dgRNA
  Rem1
ccccgtaagtggtgg

SEQ ID NO: 17420 - DNA, 15 bp, Artificial Sequence
  dgRNA
  AI314180
ggctcgcagctcgct

SEQ ID NO: 17421 - DNA, 15 bp, Artificial Sequence
  dgRNA
  AI314180
gctcgcagctcgctc

SEQ ID NO: 17422 - DNA, 15 bp, Artificial Sequence
  dgRNA
  AI314180
cgcagctcgctcggg

SEQ ID NO: 17423 - DNA, 15 bp, Artificial Sequence
  dgRNA
  AI314180
cgggaggctaacgtt

SEQ ID NO: 17424 - DNA, 15 bp, Artificial Sequence
  dgRNA
  Plekhj1
ttcaagcctccccga

SEQ ID NO: 17425 - DNA, 15 bp, Artificial Sequence
  dgRNA
  Plekhj1
tcctcaccaacgcta

SEQ ID NO: 17426 - DNA, 15 bp, Artificial Sequence
  dgRNA
  Plekhj1
taaggcctcgctatc

SEQ ID NO: 17427 - DNA, 15 bp, Artificial Sequence
  dgRNA
  Plekhj1
aaggcctcgctatcc

SEQ ID NO: 17428 - DNA, 15 bp, Artificial Sequence
  dgRNA
  Slc22a5
cctcaggcgcacgcg

SEQ ID NO: 17429 - DNA, 15 bp, Artificial Sequence
  dgRNA
  Slc22a5
cgcacgcgcggccga

SEQ ID NO: 17430 - DNA, 15 bp, Artificial Sequence
  dgRNA
  Slc22a5
cgcgcggccgatggc

SEQ ID NO: 17431 - DNA, 15 bp, Artificial Sequence
  dgRNA
  Slc22a5
cactgtgcgtcactc

SEQ ID NO: 17432 - DNA, 15 bp, Artificial Sequence
  dgRNA
  Abcc9
caggtagggatgatc

SEQ ID NO: 17433 - DNA, 15 bp, Artificial Sequence
  dgRNA
  Abcc9
gggatgatccgggca

SEQ ID NO: 17434 - DNA, 15 bp, Artificial Sequence
  dgRNA
  Abcc9
atgatccgggcaagg

SEQ ID NO: 17435 - DNA, 15 bp, Artificial Sequence
  dgRNA
  Abcc9
tgatccgggcaagga

SEQ ID NO: 17436 - DNA, 15 bp, Artificial Sequence
  dgRNA
  Tlr13
cacggcaagtaactc

SEQ ID NO: 17437 - DNA, 15 bp, Artificial Sequence
  dgRNA
  Tlr13
acggcaagtaactca

SEQ ID NO: 17438 - DNA, 15 bp, Artificial Sequence
  dgRNA
  Tlr13
cggcaagtaactcag

SEQ ID NO: 17439 - DNA, 15 bp, Artificial Sequence
  dgRNA
  Tlr13
aactcaggggatcta

SEQ ID NO: 17440 - DNA, 15 bp, Artificial Sequence
  dgRNA
  Tnfrsf17
tggctactgcacttt

SEQ ID NO: 17441 - DNA, 15 bp, Artificial Sequence
  dgRNA
  Tnfrsf17
tcggcttgatgcccc

SEQ ID NO: 17442 - DNA, 15 bp, Artificial Sequence
  dgRNA
  Tnfrsf17
attgcaactgttacc

SEQ ID NO: 17443 - DNA, 15 bp, Artificial Sequence
  dgRNA
  Tnfrsf17
ttgcaactgttacct

SEQ ID NO: 17444 - DNA, 15 bp, Artificial Sequence
  dgRNA
  Smg9
gtctaacgcgcacgt

SEQ ID NO: 17445 - DNA, 15 bp, Artificial Sequence
  dgRNA
  Smg9
tctaacgcgcacgtt

SEQ ID NO: 17446 - DNA, 15 bp, Artificial Sequence
  dgRNA
  Smg9
tcgagttcgaatccc

SEQ ID NO: 17447 - DNA, 15 bp, Artificial Sequence
  dgRNA
  Smg9
ttcgagttcgaatcc

SEQ ID NO: 17448 - DNA, 15 bp, Artificial Sequence
  dgRNA
  Actn4
ggttaaagccggatg

SEQ ID NO: 17449 - DNA, 15 bp, Artificial Sequence
  dgRNA
  Actn4
gaatcattcatgact

SEQ ID NO: 17450 - DNA, 15 bp, Artificial Sequence
  dgRNA
  Actn4
tgggccccgcccaca

SEQ ID NO: 17451 - DNA, 15 bp, Artificial Sequence
  dgRNA
  Actn4
cccgctagaagcgcc

SEQ ID NO: 17452 - DNA, 15 bp, Artificial Sequence
  dgRNA
  Zfp386
agccacaggtcgccc

SEQ ID NO: 17453 - DNA, 15 bp, Artificial Sequence
  dgRNA
  Zfp386
gcccgcctcaaaaac

SEQ ID NO: 17454 - DNA, 15 bp, Artificial Sequence
  dgRNA
  Zfp386
ctttcggacctcatt

SEQ ID NO: 17455 - DNA, 15 bp, Artificial Sequence
  dgRNA
  Zfp386
gacctcattcggccg

SEQ ID NO: 17456 - DNA, 15 bp, Artificial Sequence
  dgRNA
  Fbll1
ctatgtagggacgtc

SEQ ID NO: 17457 - DNA, 15 bp, Artificial Sequence
  dgRNA
  Fbll1
tatgtagggacgtct

SEQ ID NO: 17458 - DNA, 15 bp, Artificial Sequence
  dgRNA
  Fbll1
ctgggtttctatccg

SEQ ID NO: 17459 - DNA, 15 bp, Artificial Sequence
  dgRNA
  Fbll1
cgtccagtcagcacc

SEQ ID NO: 17460 - DNA, 15 bp, Artificial Sequence
  dgRNA
  Pcdhb5
tatacaacttaaagc

SEQ ID NO: 17461 - DNA, 15 bp, Artificial Sequence
  dgRNA
  Pcdhb5
tttcaatatgaacgc

SEQ ID NO: 17462 - DNA, 15 bp, Artificial Sequence
  dgRNA
  Pcdhb5
ttcaatatgaacgca

SEQ ID NO: 17463 - DNA, 15 bp, Artificial Sequence
  dgRNA
  Pcdhb5
aatatgaacgcaggg

SEQ ID NO: 17464 - DNA, 15 bp, Artificial Sequence
  dgRNA
  Pkdrej
tgaaccgccttattc

SEQ ID NO: 17465 - DNA, 15 bp, Artificial Sequence
  dgRNA
  Pkdrej
cgccttattccggag

SEQ ID NO: 17466 - DNA, 15 bp, Artificial Sequence
  dgRNA
  Pkdrej
cttattccggagtgg

SEQ ID NO: 17467 - DNA, 15 bp, Artificial Sequence
  dgRNA
  Pkdrej
gcgcccatcccctcc

SEQ ID NO: 17468 - DNA, 15 bp, Artificial Sequence
  dgRNA
  Cdh1
ggattcgaacgaccg

SEQ ID NO: 17469 - DNA, 15 bp, Artificial Sequence
  dgRNA
  Cdh1
gaacgaccgtggaat

SEQ ID NO: 17470 - DNA, 15 bp, Artificial Sequence
  dgRNA
  Cdh1
cgtggaataggaagc

SEQ ID NO: 17471 - DNA, 15 bp, Artificial Sequence
  dgRNA
  Cdh1
gccaatcagcggcgc

SEQ ID NO: 17472 - DNA, 15 bp, Artificial Sequence
  dgRNA
  Ascl5
ctatgactcacatta

SEQ ID NO: 17473 - DNA, 15 bp, Artificial Sequence
  dgRNA
  Ascl5
agagggcctcactct

SEQ ID NO: 17474 - DNA, 15 bp, Artificial Sequence
  dgRNA
  Ascl5
tgctgcgagttgcta

SEQ ID NO: 17475 - DNA, 15 bp, Artificial Sequence
  dgRNA
  Ascl5
tgcacgggctctgtg

SEQ ID NO: 17476 - DNA, 15 bp, Artificial Sequence
  dgRNA
  Tcl1b3
actctcagggcaccg

SEQ ID NO: 17477 - DNA, 15 bp, Artificial Sequence
  dgRNA
  Tcl1b3
caccgaggtctgcag

SEQ ID NO: 17478 - DNA, 15 bp, Artificial Sequence
  dgRNA
  Tcl1b3
accgaggtctgcagt

SEQ ID NO: 17479 - DNA, 15 bp, Artificial Sequence
  dgRNA
  Tcl1b3
caccgagctttgcag

SEQ ID NO: 17480 - DNA, 15 bp, Artificial Sequence
  dgRNA
  Igfbp5
gtgtagggagcgaag

SEQ ID NO: 17481 - DNA, 15 bp, Artificial Sequence
  dgRNA
  Igfbp5
gcccccgtgtctaga

SEQ ID NO: 17482 - DNA, 15 bp, Artificial Sequence
  dgRNA
  Igfbp5
cgctgcaaagctcct

SEQ ID NO: 17483 - DNA, 15 bp, Artificial Sequence
  dgRNA
  Igfbp5
ttggcatccttgcat

SEQ ID NO: 17484 - DNA, 15 bp, Artificial Sequence
  dgRNA
  Ptprk
gccaccgagcccagg

SEQ ID NO: 17485 - DNA, 15 bp, Artificial Sequence
  dgRNA
  Ptprk
ccaggtggcgaacaa

SEQ ID NO: 17486 - DNA, 15 bp, Artificial Sequence
  dgRNA
  Ptprk
ggtggcgaacaaagg

SEQ ID NO: 17487 - DNA, 15 bp, Artificial Sequence
  dgRNA
  Ptprk
cgaacaaaggcggcg

SEQ ID NO: 17488 - DNA, 15 bp, Artificial Sequence
  dgRNA
  Vgf
agggccctactgcgc

SEQ ID NO: 17489 - DNA, 15 bp, Artificial Sequence
  dgRNA
  Vgf
ctactgcgcaggtgc

SEQ ID NO: 17490 - DNA, 15 bp, Artificial Sequence
  dgRNA
  Vgf
gcgcaggtgcaggcc

SEQ ID NO: 17491 - DNA, 15 bp, Artificial Sequence
  dgRNA
  Vgf
ttatcctccaatcat

SEQ ID NO: 17492 - DNA, 15 bp, Artificial Sequence
  dgRNA
  B4galt7
tggtcgcctttgact

SEQ ID NO: 17493 - DNA, 15 bp, Artificial Sequence
  dgRNA
  B4galt7
ggtcgcctttgactt

SEQ ID NO: 17494 - DNA, 15 bp, Artificial Sequence
  dgRNA
  B4galt7
cttgtgacatccagt

SEQ ID NO: 17495 - DNA, 15 bp, Artificial Sequence
  dgRNA
  B4galt7
agtgagaacctagct

SEQ ID NO: 17496 - DNA, 15 bp, Artificial Sequence
  dgRNA
  Mmp28
ctcccgcgccctttt

SEQ ID NO: 17497 - DNA, 15 bp, Artificial Sequence
  dgRNA
  Mmp28
tcccgcgcccttttt

SEQ ID NO: 17498 - DNA, 15 bp, Artificial Sequence
  dgRNA
  Mmp28
gcacagagttgcggc

SEQ ID NO: 17499 - DNA, 15 bp, Artificial Sequence
  dgRNA
  Mmp28
gagcggctacaccgc

SEQ ID NO: 17500 - DNA, 15 bp, Artificial Sequence
  dgRNA
  Timm22
gaactgcagcctaac

SEQ ID NO: 17501 - DNA, 15 bp, Artificial Sequence
  dgRNA
  Timm22
ccgaccgctcttcag

SEQ ID NO: 17502 - DNA, 15 bp, Artificial Sequence
  dgRNA
  Timm22
tccagtgagcacgca

SEQ ID NO: 17503 - DNA, 15 bp, Artificial Sequence
  dgRNA
  Timm22
tagaactacaaatcc

SEQ ID NO: 17504 - DNA, 15 bp, Artificial Sequence
  dgRNA
  Minos1
cttccgctatctcca

SEQ ID NO: 17505 - DNA, 15 bp, Artificial Sequence
  dgRNA
  Minos1
cgagcgaagaaaagc

SEQ ID NO: 17506 - DNA, 15 bp, Artificial Sequence
  dgRNA
  Minos1
gaaaagccggaagcc

SEQ ID NO: 17507 - DNA, 15 bp, Artificial Sequence
  dgRNA
  Minos1
ttggagatagcggaa

SEQ ID NO: 17508 - DNA, 15 bp, Artificial Sequence
  dgRNA
  Ces2e
atatacctttctagg

SEQ ID NO: 17509 - DNA, 15 bp, Artificial Sequence
  dgRNA
  Ces2e
aaattcactagggcg

SEQ ID NO: 17510 - DNA, 15 bp, Artificial Sequence
  dgRNA
  Ces2e
gaaattcactagggc

SEQ ID NO: 17511 - DNA, 15 bp, Artificial Sequence
  dgRNA
  Ces2e
ggaaattcactaggg

SEQ ID NO: 17512 - DNA, 15 bp, Artificial Sequence
  dgRNA
  Tmem100
tccggaattctccaa

SEQ ID NO: 17513 - DNA, 15 bp, Artificial Sequence
  dgRNA
  Tmem100
atagcggcgcactga

SEQ ID NO: 17514 - DNA, 15 bp, Artificial Sequence
  dgRNA
  Tmem100
tccggaaaggagagt

SEQ ID NO: 17515 - DNA, 15 bp, Artificial Sequence
  dgRNA
  Tmem100
ttccggaaaggagag

SEQ ID NO: 17516 - DNA, 15 bp, Artificial Sequence
  dgRNA
  l7Rn6
tcccggctcgccctc

SEQ ID NO: 17517 - DNA, 15 bp, Artificial Sequence
  dgRNA
  l7Rn6
cccggctcgccctct

SEQ ID NO: 17518 - DNA, 15 bp, Artificial Sequence
  dgRNA
  l7Rn6
ggctcgccctctggg

SEQ ID NO: 17519 - DNA, 15 bp, Artificial Sequence
  dgRNA
  l7Rn6
tggcgcactgcacta

SEQ ID NO: 17520 - DNA, 15 bp, Artificial Sequence
  dgRNA
  1700010I14Rik
cgcccggccacaggg

SEQ ID NO: 17521 - DNA, 15 bp, Artificial Sequence
  dgRNA
  1700010I14Rik
tggcgcccggccaca

SEQ ID NO: 17522 - DNA, 15 bp, Artificial Sequence
  dgRNA
  1700010I14Rik
ctggcgcccggccac

SEQ ID NO: 17523 - DNA, 15 bp, Artificial Sequence
  dgRNA
  1700010I14Rik
ccctcagtgtaactc

SEQ ID NO: 17524 - DNA, 15 bp, Artificial Sequence
  dgRNA
  Cacna2d2
gctccggggtgaacg

SEQ ID NO: 17525 - DNA, 15 bp, Artificial Sequence
  dgRNA
  Cacna2d2
gggtgaacggggacg

SEQ ID NO: 17526 - DNA, 15 bp, Artificial Sequence
  dgRNA
  Cacna2d2
ggtgaacggggacga

SEQ ID NO: 17527 - DNA, 15 bp, Artificial Sequence
  dgRNA
  Cacna2d2
gtgaacggggacgag

SEQ ID NO: 17528 - DNA, 15 bp, Artificial Sequence
  dgRNA
  Lrriq1
gtcctgctagggcac

SEQ ID NO: 17529 - DNA, 15 bp, Artificial Sequence
  dgRNA
  Lrriq1
gctagggcaccggta

SEQ ID NO: 17530 - DNA, 15 bp, Artificial Sequence
  dgRNA
  Lrriq1
gggcaccggtaagga

SEQ ID NO: 17531 - DNA, 15 bp, Artificial Sequence
  dgRNA
  Lrriq1
ggcaccggtaaggaa

SEQ ID NO: 17532 - DNA, 15 bp, Artificial Sequence
  dgRNA
  Olfr958
aagaagcatcggtgg

SEQ ID NO: 17533 - DNA, 15 bp, Artificial Sequence
  dgRNA
  Olfr958
aagaagaagcatcgg

SEQ ID NO: 17534 - DNA, 15 bp, Artificial Sequence
  dgRNA
  Arhgap24
ttagactcccttcaa

SEQ ID NO: 17535 - DNA, 15 bp, Artificial Sequence
  dgRNA
  Arhgap24
cagcatttttttacc

SEQ ID NO: 17536 - DNA, 15 bp, Artificial Sequence
  dgRNA
  Arhgap24
acctggctcaatagc

SEQ ID NO: 17537 - DNA, 15 bp, Artificial Sequence
  dgRNA
  Arhgap24
ctggctcaatagccg

SEQ ID NO: 17538 - DNA, 15 bp, Artificial Sequence
  dgRNA
  Hsdl2
ctacagactcgggaa

SEQ ID NO: 17539 - DNA, 15 bp, Artificial Sequence
  dgRNA
  Hsdl2
tacagactcgggaaa

SEQ ID NO: 17540 - DNA, 15 bp, Artificial Sequence
  dgRNA
  Hsdl2
acagactcgggaaag

SEQ ID NO: 17541 - DNA, 15 bp, Artificial Sequence
  dgRNA
  Hsdl2
actcgggaaaggggc

SEQ ID NO: 17542 - DNA, 15 bp, Artificial Sequence
  dgRNA
  Ociad1
gagcatcgaacctag

SEQ ID NO: 17543 - DNA, 15 bp, Artificial Sequence
  dgRNA
  Ociad1
gccgcagtgcagctc

SEQ ID NO: 17544 - DNA, 15 bp, Artificial Sequence
  dgRNA
  Ociad1
agctctggagcgccg

SEQ ID NO: 17545 - DNA, 15 bp, Artificial Sequence
  dgRNA
  Ociad1
tggagcgccgcggcc

SEQ ID NO: 17546 - DNA, 15 bp, Artificial Sequence
  dgRNA
  Tas2r125
tacattcacctacat

SEQ ID NO: 17547 - DNA, 15 bp, Artificial Sequence
  dgRNA
  Tas2r125
gcttgtcattatatt

SEQ ID NO: 17548 - DNA, 15 bp, Artificial Sequence
  dgRNA
  Tas2r125
aagatgtaccaatgt

SEQ ID NO: 17549 - DNA, 15 bp, Artificial Sequence
  dgRNA
  Tas2r125
tagtcgctgaagaat

SEQ ID NO: 17550 - DNA, 15 bp, Artificial Sequence
  dgRNA
  Myef2
gctaccggtgctcgc

SEQ ID NO: 17551 - DNA, 15 bp, Artificial Sequence
  dgRNA
  Myef2
accggtgctcgctgg

SEQ ID NO: 17552 - DNA, 15 bp, Artificial Sequence
  dgRNA
  Myef2
ccggtgctcgctggc

SEQ ID NO: 17553 - DNA, 15 bp, Artificial Sequence
  dgRNA
  Myef2
atccacccgcagaga

SEQ ID NO: 17554 - DNA, 15 bp, Artificial Sequence
  dgRNA
  Cwc15
cgtgtctttgctgat

SEQ ID NO: 17555 - DNA, 15 bp, Artificial Sequence
  dgRNA
  Cwc15
ctccggaattgcttc

SEQ ID NO: 17556 - DNA, 15 bp, Artificial Sequence
  dgRNA
  Cwc15
tccggaattgcttcc

SEQ ID NO: 17557 - DNA, 15 bp, Artificial Sequence
  dgRNA
  Cwc15
aattgcttccgggtg

SEQ ID NO: 17558 - DNA, 15 bp, Artificial Sequence
  dgRNA
  Mtfr1l
gttgacactaaacac

SEQ ID NO: 17559 - DNA, 15 bp, Artificial Sequence
  dgRNA
  Mtfr1l
gggaagcaactccta

SEQ ID NO: 17560 - DNA, 15 bp, Artificial Sequence
  dgRNA
  Mtfr1l
ggcagcaactaaact

SEQ ID NO: 17561 - DNA, 15 bp, Artificial Sequence
  dgRNA
  Mtfr1l
gcagcaactaaactt

SEQ ID NO: 17562 - DNA, 15 bp, Artificial Sequence
  dgRNA
  Mrpl1
aacccgagccacgaa

SEQ ID NO: 17563 - DNA, 15 bp, Artificial Sequence
  dgRNA
  Mrpl1
agacagggaaccgac

SEQ ID NO: 17564 - DNA, 15 bp, Artificial Sequence
  dgRNA
  Mrpl1
aggaacctcgccacg

SEQ ID NO: 17565 - DNA, 15 bp, Artificial Sequence
  dgRNA
  Mrpl1
ggaacctcgccacga

SEQ ID NO: 17566 - DNA, 15 bp, Artificial Sequence
  dgRNA
  Gng10
aatggccatagatag

SEQ ID NO: 17567 - DNA, 15 bp, Artificial Sequence
  dgRNA
  Gng10
atggccatagatagt

SEQ ID NO: 17568 - DNA, 15 bp, Artificial Sequence
  dgRNA
  Gng10
atcagaccaacgagc

SEQ ID NO: 17569 - DNA, 15 bp, Artificial Sequence
  dgRNA
  Gng10
gtttgactagctctt

SEQ ID NO: 17570 - DNA, 15 bp, Artificial Sequence
  dgRNA
  Josd2
ggctgctttgtccga

SEQ ID NO: 17571 - DNA, 15 bp, Artificial Sequence
  dgRNA
  Josd2
gctgctttgtccgat

SEQ ID NO: 17572 - DNA, 15 bp, Artificial Sequence
  dgRNA
  Josd2
agttgtagtcccacg

SEQ ID NO: 17573 - DNA, 15 bp, Artificial Sequence
  dgRNA
  Josd2
gccccggaggacttc

SEQ ID NO: 17574 - DNA, 15 bp, Artificial Sequence
  dgRNA
  Irf7
caccctagtgacgtc

SEQ ID NO: 17575 - DNA, 15 bp, Artificial Sequence
  dgRNA
  Irf7
ctccagacgtcacta

SEQ ID NO: 17576 - DNA, 15 bp, Artificial Sequence
  dgRNA
  Irf7
gctccagacgtcact

SEQ ID NO: 17577 - DNA, 15 bp, Artificial Sequence
  dgRNA
  Ephx2
ggattgacacttggg

SEQ ID NO: 17578 - DNA, 15 bp, Artificial Sequence
  dgRNA
  Ephx2
gattgacacttgggt

SEQ ID NO: 17579 - DNA, 15 bp, Artificial Sequence
  dgRNA
  Ephx2
aagaagctccgggct

SEQ ID NO: 17580 - DNA, 15 bp, Artificial Sequence
  dgRNA
  Ephx2
agctgatcagtaggc

SEQ ID NO: 17581 - DNA, 15 bp, Artificial Sequence
  dgRNA
  Klhl7
tgggaagtcggcctt

SEQ ID NO: 17582 - DNA, 15 bp, Artificial Sequence
  dgRNA
  Klhl7
aagcacacgcgagct

SEQ ID NO: 17583 - DNA, 15 bp, Artificial Sequence
  dgRNA
  Klhl7
acgcgagcttggatc

SEQ ID NO: 17584 - DNA, 15 bp, Artificial Sequence
  dgRNA
  Klhl7
cttggatcaggccga

SEQ ID NO: 17585 - DNA, 15 bp, Artificial Sequence
  dgRNA
  Mrps30
aaggagcatactgat

SEQ ID NO: 17586 - DNA, 15 bp, Artificial Sequence
  dgRNA
  Mrps30
tgattggttgcaaac

SEQ ID NO: 17587 - DNA, 15 bp, Artificial Sequence
  dgRNA
  Mrps30
cctccaagaagcgat

SEQ ID NO: 17588 - DNA, 15 bp, Artificial Sequence
  dgRNA
  Mrps30
agcgattggtcccta

SEQ ID NO: 17589 - DNA, 15 bp, Artificial Sequence
  dgRNA
  Olfr810
aaagtgggctatact

SEQ ID NO: 17590 - DNA, 15 bp, Artificial Sequence
  dgRNA
  Olfr810
gcaacatctctaaag

SEQ ID NO: 17591 - DNA, 15 bp, Artificial Sequence
  dgRNA
  Rgs2
gtgcgcacgaggatg

SEQ ID NO: 17592 - DNA, 15 bp, Artificial Sequence
  dgRNA
  Rgs2
agcgccctcgcttcc

SEQ ID NO: 17593 - DNA, 15 bp, Artificial Sequence
  dgRNA
  Rgs2
cgcttccaggccctt

SEQ ID NO: 17594 - DNA, 15 bp, Artificial Sequence
  dgRNA
  Rgs2
cttccaggcccttcg

SEQ ID NO: 17595 - DNA, 15 bp, Artificial Sequence
  dgRNA
  Ndufc2
agacaatttcgattg

SEQ ID NO: 17596 - DNA, 15 bp, Artificial Sequence
  dgRNA
  Ndufc2
ttcgattgtggtaac

SEQ ID NO: 17597 - DNA, 15 bp, Artificial Sequence
  dgRNA
  Ndufc2
agccttcacgcgttg

SEQ ID NO: 17598 - DNA, 15 bp, Artificial Sequence
  dgRNA
  Ndufc2
gccttcacgcgttgt

SEQ ID NO: 17599 - DNA, 15 bp, Artificial Sequence
  dgRNA
  Mrs2
agctcctcgaaacaa

SEQ ID NO: 17600 - DNA, 15 bp, Artificial Sequence
  dgRNA
  Mrs2
cacacttgcacgtcc

SEQ ID NO: 17601 - DNA, 15 bp, Artificial Sequence
  dgRNA
  Mrs2
gttacggacgcagac

SEQ ID NO: 17602 - DNA, 15 bp, Artificial Sequence
  dgRNA
  Mrs2
ttacggacgcagacc

SEQ ID NO: 17603 - DNA, 15 bp, Artificial Sequence
  dgRNA
  Xaf1
gtcacggtagcacag

SEQ ID NO: 17604 - DNA, 15 bp, Artificial Sequence
  dgRNA
  Xaf1
caaggggcatgacag

SEQ ID NO: 17605 - DNA, 15 bp, Artificial Sequence
  dgRNA
  Xaf1
gagtgtctagctgcc

SEQ ID NO: 17606 - DNA, 15 bp, Artificial Sequence
  dgRNA
  Xaf1
ctgccgctgtgagtc

SEQ ID NO: 17607 - DNA, 15 bp, Artificial Sequence
  dgRNA
  Zfyve26
cagtcctgtagctag

SEQ ID NO: 17608 - DNA, 15 bp, Artificial Sequence
  dgRNA
  Zfyve26
gtccccgtagcaatc

SEQ ID NO: 17609 - DNA, 15 bp, Artificial Sequence
  dgRNA
  Zfyve26
cccgtagcaatcagg

SEQ ID NO: 17610 - DNA, 15 bp, Artificial Sequence
  dgRNA
  Zfyve26
ctgagccaataagag

SEQ ID NO: 17611 - DNA, 15 bp, Artificial Sequence
  dgRNA
  Sox30
gaacgtgcctgtgat

SEQ ID NO: 17612 - DNA, 15 bp, Artificial Sequence
  dgRNA
  Sox30
gctggcgggagacac

SEQ ID NO: 17613 - DNA, 15 bp, Artificial Sequence
  dgRNA
  Sox30
ctggcgggagacacc

SEQ ID NO: 17614 - DNA, 15 bp, Artificial Sequence
  dgRNA
  Sox30
cgggccgctcctgat

SEQ ID NO: 17615 - DNA, 15 bp, Artificial Sequence
  dgRNA
  Trf
ggcaagtagaagccc

SEQ ID NO: 17616 - DNA, 15 bp, Artificial Sequence
  dgRNA
  Trf
gtgataacaaagagt

SEQ ID NO: 17617 - DNA, 15 bp, Artificial Sequence
  dgRNA
  Trf
tgattgtcgtggtag

SEQ ID NO: 17618 - DNA, 15 bp, Artificial Sequence
  dgRNA
  Trf
tcatcaaccttatag

SEQ ID NO: 17619 - DNA, 15 bp, Artificial Sequence
  dgRNA
  Gm11128
cacggcccatctact

SEQ ID NO: 17620 - DNA, 15 bp, Artificial Sequence
  dgRNA
  Gm11128
caagtagatgggccg

SEQ ID NO: 17621 - DNA, 15 bp, Artificial Sequence
  dgRNA
  Wfikkn2
tagctcgctcccact

SEQ ID NO: 17622 - DNA, 15 bp, Artificial Sequence
  dgRNA
  Wfikkn2
agctcgctcccactc

SEQ ID NO: 17623 - DNA, 15 bp, Artificial Sequence
  dgRNA
  Wfikkn2
tcgctcccactcggg

SEQ ID NO: 17624 - DNA, 15 bp, Artificial Sequence
  dgRNA
  Wfikkn2
tcgggtggtgcgccc

SEQ ID NO: 17625 - DNA, 15 bp, Artificial Sequence
  dgRNA
  Sgpl1
cccgacaccacagcc

SEQ ID NO: 17626 - DNA, 15 bp, Artificial Sequence
  dgRNA
  Sgpl1
cccggacccagcagt

SEQ ID NO: 17627 - DNA, 15 bp, Artificial Sequence
  dgRNA
  Sgpl1
ccagcagtaggcggg

SEQ ID NO: 17628 - DNA, 15 bp, Artificial Sequence
  dgRNA
  Sgpl1
cagtaggcgggcgga

SEQ ID NO: 17629 - DNA, 15 bp, Artificial Sequence
  dgRNA
  S100a1
ctgtcggaggcgcac

SEQ ID NO: 17630 - DNA, 15 bp, Artificial Sequence
  dgRNA
  S100a1
cacctacttcccgct

SEQ ID NO: 17631 - DNA, 15 bp, Artificial Sequence
  dgRNA
  S100a1
cttcccgctaggctc

SEQ ID NO: 17632 - DNA, 15 bp, Artificial Sequence
  dgRNA
  S100a1
ccgctaggctcaggg

SEQ ID NO: 17633 - DNA, 15 bp, Artificial Sequence
  dgRNA
  3830406C13Rik
ctaaggccccttttg

SEQ ID NO: 17634 - DNA, 15 bp, Artificial Sequence
  dgRNA
  3830406C13Rik
gccaagccaagtagc

SEQ ID NO: 17635 - DNA, 15 bp, Artificial Sequence
  dgRNA
  3830406C13Rik
ccaagccaagtagct

SEQ ID NO: 17636 - DNA, 15 bp, Artificial Sequence
  dgRNA
  3830406C13Rik
actctgactgacgtc

SEQ ID NO: 17637 - DNA, 15 bp, Artificial Sequence
  dgRNA
  Wwtr1
cccgccccaagtcag

SEQ ID NO: 17638 - DNA, 15 bp, Artificial Sequence
  dgRNA
  Wwtr1
atgcagataggcgct

SEQ ID NO: 17639 - DNA, 15 bp, Artificial Sequence
  dgRNA
  Wwtr1
cagataggcgctcgg

SEQ ID NO: 17640 - DNA, 15 bp, Artificial Sequence
  dgRNA
  Wwtr1
agataggcgctcggc

SEQ ID NO: 17641 - DNA, 15 bp, Artificial Sequence
  dgRNA
  Ceacam3
agccgttgttctctg

SEQ ID NO: 17642 - DNA, 15 bp, Artificial Sequence
  dgRNA
  Ceacam3
gccgttgttctctga

SEQ ID NO: 17643 - DNA, 15 bp, Artificial Sequence
  dgRNA
  Ceacam3
caacggctcgtccca

SEQ ID NO: 17644 - DNA, 15 bp, Artificial Sequence
  dgRNA
  Ceacam3
aatccaaggggctgt

SEQ ID NO: 17645 - DNA, 15 bp, Artificial Sequence
  dgRNA
  Tas2r117
gtagacacattatca

SEQ ID NO: 17646 - DNA, 15 bp, Artificial Sequence
  dgRNA
  Trp53i13
ggcgactaacttttc

SEQ ID NO: 17647 - DNA, 15 bp, Artificial Sequence
  dgRNA
  Trp53i13
taacttttccggctt

SEQ ID NO: 17648 - DNA, 15 bp, Artificial Sequence
  dgRNA
  Trp53i13
aacttttccggcttt

SEQ ID NO: 17649 - DNA, 15 bp, Artificial Sequence
  dgRNA
  Trp53i13
tccggctttgggttc

SEQ ID NO: 17650 - DNA, 15 bp, Artificial Sequence
  dgRNA
  Cd274
tctaaagtcatccgc

SEQ ID NO: 17651 - DNA, 15 bp, Artificial Sequence
  dgRNA
  Cd274
taaactcatgctcaa

SEQ ID NO: 17652 - DNA, 15 bp, Artificial Sequence
  dgRNA
  Cd274
catgctcaaagggac

SEQ ID NO: 17653 - DNA, 15 bp, Artificial Sequence
  dgRNA
  Cd274
cggtttcacagacag

SEQ ID NO: 17654 - DNA, 15 bp, Artificial Sequence
  dgRNA
  Kif24
ctcaagctgaaccat

SEQ ID NO: 17655 - DNA, 15 bp, Artificial Sequence
  dgRNA
  Kif24
aagctgaaccattgg

SEQ ID NO: 17656 - DNA, 15 bp, Artificial Sequence
  dgRNA
  Kif24
tgattggccttttag

SEQ ID NO: 17657 - DNA, 15 bp, Artificial Sequence
  dgRNA
  Kif24
ggccttttagaggag

SEQ ID NO: 17658 - DNA, 15 bp, Artificial Sequence
  dgRNA
  Olfr78
gcaagtggagtcctc

SEQ ID NO: 17659 - DNA, 15 bp, Artificial Sequence
  dgRNA
  Olfr78
caagtggagtcctcg

SEQ ID NO: 17660 - DNA, 15 bp, Artificial Sequence
  dgRNA
  Olfr78
tgtgggcactccccg

SEQ ID NO: 17661 - DNA, 15 bp, Artificial Sequence
  dgRNA
  Atp6v0a1
gatgacttccaaact

SEQ ID NO: 17662 - DNA, 15 bp, Artificial Sequence
  dgRNA
  Atp6v0a1
tagaaatcacaacgc

SEQ ID NO: 17663 - DNA, 15 bp, Artificial Sequence
  dgRNA
  Atp6v0a1
acgccggaacaaaga

SEQ ID NO: 17664 - DNA, 15 bp, Artificial Sequence
  dgRNA
  Atp6v0a1
tggcgactgcacacc

SEQ ID NO: 17665 - DNA, 15 bp, Artificial Sequence
  dgRNA
  Cnppd1
ctgcgcggccgccgc

SEQ ID NO: 17666 - DNA, 15 bp, Artificial Sequence
  dgRNA
  Cnppd1
tgcgcggccgccgcc

SEQ ID NO: 17667 - DNA, 15 bp, Artificial Sequence
  dgRNA
  Cnppd1
cgggggcgcgtcaga

SEQ ID NO: 17668 - DNA, 15 bp, Artificial Sequence
  dgRNA
  Cnppd1
ggcgcgtcagacgga

SEQ ID NO: 17669 - DNA, 15 bp, Artificial Sequence
  dgRNA
  Rdh13
acttcaggacgccct

SEQ ID NO: 17670 - DNA, 15 bp, Artificial Sequence
  dgRNA
  Rdh13
aggacgcccttggat

SEQ ID NO: 17671 - DNA, 15 bp, Artificial Sequence
  dgRNA
  Rdh13
tgatgacatttgatc

SEQ ID NO: 17672 - DNA, 15 bp, Artificial Sequence
  dgRNA
  Rdh13
cacgcctgtcaacct

SEQ ID NO: 17673 - DNA, 15 bp, Artificial Sequence
  dgRNA
  Slc26a10
ggcccccaggttctt

SEQ ID NO: 17674 - DNA, 15 bp, Artificial Sequence
  dgRNA
  Slc26a10
ggaaacgcctaacac

SEQ ID NO: 17675 - DNA, 15 bp, Artificial Sequence
  dgRNA
  Slc26a10
gaaacgcctaacaca

SEQ ID NO: 17676 - DNA, 15 bp, Artificial Sequence
  dgRNA
  Slc26a10
gagagtactccctac

SEQ ID NO: 17677 - DNA, 15 bp, Artificial Sequence
  dgRNA
  Crb2
gctgaggcctccgaa

SEQ ID NO: 17678 - DNA, 15 bp, Artificial Sequence
  dgRNA
  Crb2
ctgaggcctccgaag

SEQ ID NO: 17679 - DNA, 15 bp, Artificial Sequence
  dgRNA
  Crb2
gtttgtgaggagcgg

SEQ ID NO: 17680 - DNA, 15 bp, Artificial Sequence
  dgRNA
  Crb2
tttgtgaggagcggt

SEQ ID NO: 17681 - DNA, 15 bp, Artificial Sequence
  dgRNA
  Defb10
cttatgccccttgcc

SEQ ID NO: 17682 - DNA, 15 bp, Artificial Sequence
  dgRNA
  Defb10
gttgcctgcccctga

SEQ ID NO: 17683 - DNA, 15 bp, Artificial Sequence
  dgRNA
  Olfr464
atgcgacaccagatg

SEQ ID NO: 17684 - DNA, 15 bp, Artificial Sequence
  dgRNA
  Olfr464
acaccagatgtggtc

SEQ ID NO: 17685 - DNA, 15 bp, Artificial Sequence
  dgRNA
  Olfr464
cgtcaagccatacct

SEQ ID NO: 17686 - DNA, 15 bp, Artificial Sequence
  dgRNA
  Olfr464
ctggtgtcgcatcat

SEQ ID NO: 17687 - DNA, 15 bp, Artificial Sequence
  dgRNA
  Bsg
ctcctgtagcgcgag

SEQ ID NO: 17688 - DNA, 15 bp, Artificial Sequence
  dgRNA
  Bsg
tcctgtagcgcgagc

SEQ ID NO: 17689 - DNA, 15 bp, Artificial Sequence
  dgRNA
  Bsg
tagcgcgagcgggag

SEQ ID NO: 17690 - DNA, 15 bp, Artificial Sequence
  dgRNA
  Bsg
cgcgagcgggagcgg

SEQ ID NO: 17691 - DNA, 15 bp, Artificial Sequence
  dgRNA
  Timeless
aaacccatagcgttt

SEQ ID NO: 17692 - DNA, 15 bp, Artificial Sequence
  dgRNA
  Timeless
tcgtctagagtcaag

SEQ ID NO: 17693 - DNA, 15 bp, Artificial Sequence
  dgRNA
  Timeless
tcaagatcgaattaa

SEQ ID NO: 17694 - DNA, 15 bp, Artificial Sequence
  dgRNA
  Timeless
atcaagatcgaatta

SEQ ID NO: 17695 - DNA, 15 bp, Artificial Sequence
  dgRNA
  Dyrk2
cgcggccccgatgtg

SEQ ID NO: 17696 - DNA, 15 bp, Artificial Sequence
  dgRNA
  Dyrk2
gcggccccgatgtga

SEQ ID NO: 17697 - DNA, 15 bp, Artificial Sequence
  dgRNA
  Dyrk2
ccgatgtgagggagt

SEQ ID NO: 17698 - DNA, 15 bp, Artificial Sequence
  dgRNA
  Dyrk2
cgatgtgagggagtc

SEQ ID NO: 17699 - DNA, 15 bp, Artificial Sequence
  dgRNA
  Chtop
ggtacttagcgatta

SEQ ID NO: 17700 - DNA, 15 bp, Artificial Sequence
  dgRNA
  Chtop
agcgattacggccac

SEQ ID NO: 17701 - DNA, 15 bp, Artificial Sequence
  dgRNA
  Chtop
ccacgcccccgaagg

SEQ ID NO: 17702 - DNA, 15 bp, Artificial Sequence
  dgRNA
  Chtop
actacacgtaactta

SEQ ID NO: 17703 - DNA, 15 bp, Artificial Sequence
  dgRNA
  4930430A15Rik
aggcagattttcatc

SEQ ID NO: 17704 - DNA, 15 bp, Artificial Sequence
  dgRNA
  4930430A15Rik
gcttgttcatgcaca

SEQ ID NO: 17705 - DNA, 15 bp, Artificial Sequence
  dgRNA
  4930430A15Rik
cgcccttaaatctca

SEQ ID NO: 17706 - DNA, 15 bp, Artificial Sequence
  dgRNA
  4930430A15Rik
gcccttaaatctcaa

SEQ ID NO: 17707 - DNA, 15 bp, Artificial Sequence
  dgRNA
  Rgr
atgtggagattatta

SEQ ID NO: 17708 - DNA, 15 bp, Artificial Sequence
  dgRNA
  Fv1
cggttacgcaatttc

SEQ ID NO: 17709 - DNA, 15 bp, Artificial Sequence
  dgRNA
  Fv1
ctaatggcagtggat

SEQ ID NO: 17710 - DNA, 15 bp, Artificial Sequence
  dgRNA
  Fv1
tttgaccttttcacg

SEQ ID NO: 17711 - DNA, 15 bp, Artificial Sequence
  dgRNA
  Fv1
ttgccagggacgaac

SEQ ID NO: 17712 - DNA, 15 bp, Artificial Sequence
  dgRNA
  Acat2
taacccgacacacct

SEQ ID NO: 17713 - DNA, 15 bp, Artificial Sequence
  dgRNA
  Acat2
ccgacacacctaggt

SEQ ID NO: 17714 - DNA, 15 bp, Artificial Sequence
  dgRNA
  Acat2
cgacacacctaggtt

SEQ ID NO: 17715 - DNA, 15 bp, Artificial Sequence
  dgRNA
  Acat2
catcttacacaattc

SEQ ID NO: 17716 - DNA, 15 bp, Artificial Sequence
  dgRNA
  Ndufs7
gtcacaggacgaccg

SEQ ID NO: 17717 - DNA, 15 bp, Artificial Sequence
  dgRNA
  Ndufs7
gtggcgcactctgcg

SEQ ID NO: 17718 - DNA, 15 bp, Artificial Sequence
  dgRNA
  Ndufs7
cgcggacgcgaccac

SEQ ID NO: 17719 - DNA, 15 bp, Artificial Sequence
  dgRNA
  Ndufs7
accacaggtataaag

SEQ ID NO: 17720 - DNA, 15 bp, Artificial Sequence
  dgRNA
  Rnf123
ggtaggagttaagac

SEQ ID NO: 17721 - DNA, 15 bp, Artificial Sequence
  dgRNA
  Rnf123
agtccctgctacggc

SEQ ID NO: 17722 - DNA, 15 bp, Artificial Sequence
  dgRNA
  Rnf123
gtccctgctacggct

SEQ ID NO: 17723 - DNA, 15 bp, Artificial Sequence
  dgRNA
  Rnf123
tgctacggctgggct

SEQ ID NO: 17724 - DNA, 15 bp, Artificial Sequence
  dgRNA
  Neu2
ggcacccacacagcg

SEQ ID NO: 17725 - DNA, 15 bp, Artificial Sequence
  dgRNA
  Neu2
gcacccacacagcga

SEQ ID NO: 17726 - DNA, 15 bp, Artificial Sequence
  dgRNA
  Neu2
ctactaatggggttg

SEQ ID NO: 17727 - DNA, 15 bp, Artificial Sequence
  dgRNA
  Neu2
atctgcctactaatg

SEQ ID NO: 17728 - DNA, 15 bp, Artificial Sequence
  dgRNA
  Osbpl1a
gctttccgagaaagg

SEQ ID NO: 17729 - DNA, 15 bp, Artificial Sequence
  dgRNA
  Osbpl1a
ctttccgagaaagga

SEQ ID NO: 17730 - DNA, 15 bp, Artificial Sequence
  dgRNA
  Osbpl1a
ggctccgccccacgg

SEQ ID NO: 17731 - DNA, 15 bp, Artificial Sequence
  dgRNA
  Osbpl1a
tccgccccacggcgg

SEQ ID NO: 17732 - DNA, 15 bp, Artificial Sequence
  dgRNA
  Pvrl2
gccctaggatcggct

SEQ ID NO: 17733 - DNA, 15 bp, Artificial Sequence
  dgRNA
  Pvrl2
atcggcttggcgaag

SEQ ID NO: 17734 - DNA, 15 bp, Artificial Sequence
  dgRNA
  Pvrl2
tcggcttggcgaaga

SEQ ID NO: 17735 - DNA, 15 bp, Artificial Sequence
  dgRNA
  Pvrl2
cggcttggcgaagag

SEQ ID NO: 17736 - DNA, 15 bp, Artificial Sequence
  dgRNA
  Olfr601
ctaacatgatacttt

SEQ ID NO: 17737 - DNA, 15 bp, Artificial Sequence
  dgRNA
  Olfr601
catgttctgctaagg

SEQ ID NO: 17738 - DNA, 15 bp, Artificial Sequence
  dgRNA
  Itpr1
cccctggtcagcgcg

SEQ ID NO: 17739 - DNA, 15 bp, Artificial Sequence
  dgRNA
  Itpr1
ccctggtcagcgcgc

SEQ ID NO: 17740 - DNA, 15 bp, Artificial Sequence
  dgRNA
  Itpr1
cgcagccccaggcgc

SEQ ID NO: 17741 - DNA, 15 bp, Artificial Sequence
  dgRNA
  Itpr1
ggcgccggcacgacc

SEQ ID NO: 17742 - DNA, 15 bp, Artificial Sequence
  dgRNA
  Ddx23
caaacaccgaacctt

SEQ ID NO: 17743 - DNA, 15 bp, Artificial Sequence
  dgRNA
  Ddx23
gaagaccttacggcc

SEQ ID NO: 17744 - DNA, 15 bp, Artificial Sequence
  dgRNA
  Ddx23
accttacggcctggc

SEQ ID NO: 17745 - DNA, 15 bp, Artificial Sequence
  dgRNA
  Ddx23
tcgcgccgtgcattc

SEQ ID NO: 17746 - DNA, 15 bp, Artificial Sequence
  dgRNA
  Ube2l3
gtatgtacttgccat

SEQ ID NO: 17747 - DNA, 15 bp, Artificial Sequence
  dgRNA
  Ube2l3
tacttgccataggat

SEQ ID NO: 17748 - DNA, 15 bp, Artificial Sequence
  dgRNA
  Ube2l3
ttgccataggattgg

SEQ ID NO: 17749 - DNA, 15 bp, Artificial Sequence
  dgRNA
  Ube2l3
aggcgccataaagta

SEQ ID NO: 17750 - DNA, 15 bp, Artificial Sequence
  dgRNA
  Atp1a4
aggtttgtgcgttct

SEQ ID NO: 17751 - DNA, 15 bp, Artificial Sequence
  dgRNA
  Atp1a4
gcccattatgatgcc

SEQ ID NO: 17752 - DNA, 15 bp, Artificial Sequence
  dgRNA
  Atp1a4
cgccatagcacccag

SEQ ID NO: 17753 - DNA, 15 bp, Artificial Sequence
  dgRNA
  Atp1a4
aagtcttcgcatgca

SEQ ID NO: 17754 - DNA, 15 bp, Artificial Sequence
  dgRNA
  Ablim1
cactagtctcatctg

SEQ ID NO: 17755 - DNA, 15 bp, Artificial Sequence
  dgRNA
  Ablim1
tggactggcccgtcg

SEQ ID NO: 17756 - DNA, 15 bp, Artificial Sequence
  dgRNA
  Ablim1
aatggtccccggggc

SEQ ID NO: 17757 - DNA, 15 bp, Artificial Sequence
  dgRNA
  Ablim1
ctgtaatggtccccg

SEQ ID NO: 17758 - DNA, 15 bp, Artificial Sequence
  dgRNA
  Rpl23
cgccaattacttccg

SEQ ID NO: 17759 - DNA, 15 bp, Artificial Sequence
  dgRNA
  Rpl23
ttacttccgaggcgt

SEQ ID NO: 17760 - DNA, 15 bp, Artificial Sequence
  dgRNA
  Rpl23
tacttccgaggcgtt

SEQ ID NO: 17761 - DNA, 15 bp, Artificial Sequence
  dgRNA
  Rpl23
ctttcccacgcagaa

SEQ ID NO: 17762 - DNA, 15 bp, Artificial Sequence
  dgRNA
  Arid4b
gaactggtgggtaaa

SEQ ID NO: 17763 - DNA, 15 bp, Artificial Sequence
  dgRNA
  Arid4b
atcctacccaatcct

SEQ ID NO: 17764 - DNA, 15 bp, Artificial Sequence
  dgRNA
  Arid4b
cctaggtcgtctgag

SEQ ID NO: 17765 - DNA, 15 bp, Artificial Sequence
  dgRNA
  Arid4b
aggcatccgggaaag

SEQ ID NO: 17766 - DNA, 15 bp, Artificial Sequence
  dgRNA
  Gabra2
ggcttggccaggatt

SEQ ID NO: 17767 - DNA, 15 bp, Artificial Sequence
  dgRNA
  Gabra2
gcttggccaggattg

SEQ ID NO: 17768 - DNA, 15 bp, Artificial Sequence
  dgRNA
  Gabra2
gggtcccctattccc

SEQ ID NO: 17769 - DNA, 15 bp, Artificial Sequence
  dgRNA
  Gabra2
tccgcgcccccaccc

SEQ ID NO: 17770 - DNA, 15 bp, Artificial Sequence
  dgRNA
  Rfx7
acccgaccgctccct

SEQ ID NO: 17771 - DNA, 15 bp, Artificial Sequence
  dgRNA
  Rfx7
cccgaccgctccctc

SEQ ID NO: 17772 - DNA, 15 bp, Artificial Sequence
  dgRNA
  Rfx7
ccgaccgctccctcg

SEQ ID NO: 17773 - DNA, 15 bp, Artificial Sequence
  dgRNA
  Rfx7
tcggggcccccgccg

SEQ ID NO: 17774 - DNA, 15 bp, Artificial Sequence
  dgRNA
  Hes2
cctgtcagccgaccc

SEQ ID NO: 17775 - DNA, 15 bp, Artificial Sequence
  dgRNA
  Hes2
ctgtcagccgaccca

SEQ ID NO: 17776 - DNA, 15 bp, Artificial Sequence
  dgRNA
  Hes2
tcagccgacccaggg

SEQ ID NO: 17777 - DNA, 15 bp, Artificial Sequence
  dgRNA
  Hes2
cagccgacccaggga

SEQ ID NO: 17778 - DNA, 15 bp, Artificial Sequence
  dgRNA
  2700060E02Rik
gtccattgtacaact

SEQ ID NO: 17779 - DNA, 15 bp, Artificial Sequence
  dgRNA
  2700060E02Rik
cgacgtgcaccgacg

SEQ ID NO: 17780 - DNA, 15 bp, Artificial Sequence
  dgRNA
  2700060E02Rik
agcagcagcgatgat

SEQ ID NO: 17781 - DNA, 15 bp, Artificial Sequence
  dgRNA
  2700060E02Rik
ttggccagcgcttgc

SEQ ID NO: 17782 - DNA, 15 bp, Artificial Sequence
  dgRNA
  Wwc2
ctaccgcctcccacc

SEQ ID NO: 17783 - DNA, 15 bp, Artificial Sequence
  dgRNA
  Wwc2
gccccggcagctgca

SEQ ID NO: 17784 - DNA, 15 bp, Artificial Sequence
  dgRNA
  Wwc2
tgcagggttaagctc

SEQ ID NO: 17785 - DNA, 15 bp, Artificial Sequence
  dgRNA
  Wwc2
cagatgaggcgggcg

SEQ ID NO: 17786 - DNA, 15 bp, Artificial Sequence
  dgRNA
  Col11a1
gactgggcgggttca

SEQ ID NO: 17787 - DNA, 15 bp, Artificial Sequence
  dgRNA
  Col11a1
gcgggttcaaggctg

SEQ ID NO: 17788 - DNA, 15 bp, Artificial Sequence
  dgRNA
  Col11a1
cgggttcaaggctgc

SEQ ID NO: 17789 - DNA, 15 bp, Artificial Sequence
  dgRNA
  Col11a1
gggttcaaggctgcg

SEQ ID NO: 17790 - DNA, 15 bp, Artificial Sequence
  dgRNA
  Srrd
gcccaccgggacccc

SEQ ID NO: 17791 - DNA, 15 bp, Artificial Sequence
  dgRNA
  Srrd
accccgggctctgtc

SEQ ID NO: 17792 - DNA, 15 bp, Artificial Sequence
  dgRNA
  Srrd
ctgtctggccgcccg

SEQ ID NO: 17793 - DNA, 15 bp, Artificial Sequence
  dgRNA
  Srrd
tgtctggccgcccgc

SEQ ID NO: 17794 - DNA, 15 bp, Artificial Sequence
  dgRNA
  Huwe1
ttaggagcgtgcacc

SEQ ID NO: 17795 - DNA, 15 bp, Artificial Sequence
  dgRNA
  Huwe1
tgtttcctaaaggcg

SEQ ID NO: 17796 - DNA, 15 bp, Artificial Sequence
  dgRNA
  Huwe1
cctaaaggcgaggcg

SEQ ID NO: 17797 - DNA, 15 bp, Artificial Sequence
  dgRNA
  Huwe1
ctaaaggcgaggcgc

SEQ ID NO: 17798 - DNA, 15 bp, Artificial Sequence
  dgRNA
  Tsacc
gcaagttagatagag

SEQ ID NO: 17799 - DNA, 15 bp, Artificial Sequence
  dgRNA
  Tsacc
gagggcatgatgtag

SEQ ID NO: 17800 - DNA, 15 bp, Artificial Sequence
  dgRNA
  Tsacc
catgatgtaggggac

SEQ ID NO: 17801 - DNA, 15 bp, Artificial Sequence
  dgRNA
  Tsacc
atgatgtaggggact

SEQ ID NO: 17802 - DNA, 15 bp, Artificial Sequence
  dgRNA
  Clk1
atccctcgcccattt

SEQ ID NO: 17803 - DNA, 15 bp, Artificial Sequence
  dgRNA
  Clk1
cgcccatttgggcag

SEQ ID NO: 17804 - DNA, 15 bp, Artificial Sequence
  dgRNA
  Clk1
gcccatttgggcagc

SEQ ID NO: 17805 - DNA, 15 bp, Artificial Sequence
  dgRNA
  Clk1
ctgcgcactcaggac

SEQ ID NO: 17806 - DNA, 15 bp, Artificial Sequence
  dgRNA
  Dcun1d4
tgagatatgctaaac

SEQ ID NO: 17807 - DNA, 15 bp, Artificial Sequence
  dgRNA
  Dcun1d4
gagatatgctaaaca

SEQ ID NO: 17808 - DNA, 15 bp, Artificial Sequence
  dgRNA
  Dcun1d4
ttgctgtaagctcct

SEQ ID NO: 17809 - DNA, 15 bp, Artificial Sequence
  dgRNA
  Dcun1d4
ctcctggggttgccg

SEQ ID NO: 17810 - DNA, 15 bp, Artificial Sequence
  dgRNA
  Dab2
gcacgctcctttttc

SEQ ID NO: 17811 - DNA, 15 bp, Artificial Sequence
  dgRNA
  Dab2
gcgatcgcccccagc

SEQ ID NO: 17812 - DNA, 15 bp, Artificial Sequence
  dgRNA
  Dab2
tcgcccccagctggc

SEQ ID NO: 17813 - DNA, 15 bp, Artificial Sequence
  dgRNA
  Dab2
agctggccgggcgca

SEQ ID NO: 17814 - DNA, 15 bp, Artificial Sequence
  dgRNA
  Dynll1
cggggctccgccttc

SEQ ID NO: 17815 - DNA, 15 bp, Artificial Sequence
  dgRNA
  Dynll1
ggggctccgccttca

SEQ ID NO: 17816 - DNA, 15 bp, Artificial Sequence
  dgRNA
  Dynll1
cgccttcagggtgtg

SEQ ID NO: 17817 - DNA, 15 bp, Artificial Sequence
  dgRNA
  Dynll1
gtgccgcgcatcgcc

SEQ ID NO: 17818 - DNA, 15 bp, Artificial Sequence
  dgRNA
  Eral1
acgactgttatactc

SEQ ID NO: 17819 - DNA, 15 bp, Artificial Sequence
  dgRNA
  Eral1
ctgttatactcaggc

SEQ ID NO: 17820 - DNA, 15 bp, Artificial Sequence
  dgRNA
  Eral1
tcccttgttgtagaa

SEQ ID NO: 17821 - DNA, 15 bp, Artificial Sequence
  dgRNA
  Eral1
ccactcgttggtccg

SEQ ID NO: 17822 - DNA, 15 bp, Artificial Sequence
  dgRNA
  Tacc3
aacggagtccaagtc

SEQ ID NO: 17823 - DNA, 15 bp, Artificial Sequence
  dgRNA
  Tacc3
tccaagtccggctac

SEQ ID NO: 17824 - DNA, 15 bp, Artificial Sequence
  dgRNA
  Tacc3
aagtccggctactgg

SEQ ID NO: 17825 - DNA, 15 bp, Artificial Sequence
  dgRNA
  Tacc3
agtccggctactggc

SEQ ID NO: 17826 - DNA, 15 bp, Artificial Sequence
  dgRNA
  Ptprr
cccccgcccagattt

SEQ ID NO: 17827 - DNA, 15 bp, Artificial Sequence
  dgRNA
  Ptprr
caactaaatgcttgc

SEQ ID NO: 17828 - DNA, 15 bp, Artificial Sequence
  dgRNA
  Ptprr
tttttgaatcacgcg

SEQ ID NO: 17829 - DNA, 15 bp, Artificial Sequence
  dgRNA
  Ptprr
agggggccactcatc

SEQ ID NO: 17830 - DNA, 15 bp, Artificial Sequence
  dgRNA
  Nek2
tagcgacttcagcca

SEQ ID NO: 17831 - DNA, 15 bp, Artificial Sequence
  dgRNA
  Nek2
ggaatggaattaccg

SEQ ID NO: 17832 - DNA, 15 bp, Artificial Sequence
  dgRNA
  Nek2
taccgaggccccaac

SEQ ID NO: 17833 - DNA, 15 bp, Artificial Sequence
  dgRNA
  Nek2
gcgatcccaaatccc

SEQ ID NO: 17834 - DNA, 15 bp, Artificial Sequence
  dgRNA
  Gcg
agcgtaatatctgca

SEQ ID NO: 17835 - DNA, 15 bp, Artificial Sequence
  dgRNA
  Gcg
gggttgagaccgcag

SEQ ID NO: 17836 - DNA, 15 bp, Artificial Sequence
  dgRNA
  Gcg
ttttacgctgatacc

SEQ ID NO: 17837 - DNA, 15 bp, Artificial Sequence
  dgRNA
  Gcg
tttttacgctgatac

SEQ ID NO: 17838 - DNA, 15 bp, Artificial Sequence
  dgRNA
  Nkx2-4
tttgcctccgttatc

SEQ ID NO: 17839 - DNA, 15 bp, Artificial Sequence
  dgRNA
  Nkx2-4
cctccgttatctgga

SEQ ID NO: 17840 - DNA, 15 bp, Artificial Sequence
  dgRNA
  Nkx2-4
ctccgttatctggaa

SEQ ID NO: 17841 - DNA, 15 bp, Artificial Sequence
  dgRNA
  Nkx2-4
tccgttatctggaag

SEQ ID NO: 17842 - DNA, 15 bp, Artificial Sequence
  dgRNA
  Pex11g
gagttgcctaagcag

SEQ ID NO: 17843 - DNA, 15 bp, Artificial Sequence
  dgRNA
  Pex11g
ttgcctaagcagcgg

SEQ ID NO: 17844 - DNA, 15 bp, Artificial Sequence
  dgRNA
  Pex11g
ggagcgaatttcaac

SEQ ID NO: 17845 - DNA, 15 bp, Artificial Sequence
  dgRNA
  Pex11g
ttcaacaggcttaga

SEQ ID NO: 17846 - DNA, 15 bp, Artificial Sequence
  dgRNA
  Bicc1
aatgagcgcgcgagg

SEQ ID NO: 17847 - DNA, 15 bp, Artificial Sequence
  dgRNA
  Bicc1
gcggctctgtgcgct

SEQ ID NO: 17848 - DNA, 15 bp, Artificial Sequence
  dgRNA
  Bicc1
tctgtgcgctcggag

SEQ ID NO: 17849 - DNA, 15 bp, Artificial Sequence
  dgRNA
  Bicc1
ctgtgcgctcggagc

SEQ ID NO: 17850 - DNA, 15 bp, Artificial Sequence
  dgRNA
  Ldhal6b
atacttcaagggttc

SEQ ID NO: 17851 - DNA, 15 bp, Artificial Sequence
  dgRNA
  Ldhal6b
tcaagggttctgggt

SEQ ID NO: 17852 - DNA, 15 bp, Artificial Sequence
  dgRNA
  Ldhal6b
acagtatgtccttgc

SEQ ID NO: 17853 - DNA, 15 bp, Artificial Sequence
  dgRNA
  Ldhal6b
cgctttataaagcca

SEQ ID NO: 17854 - DNA, 15 bp, Artificial Sequence
  dgRNA
  Stab1
tctcccctagacccc

SEQ ID NO: 17855 - DNA, 15 bp, Artificial Sequence
  dgRNA
  Stab1
ggctaatggtgggtc

SEQ ID NO: 17856 - DNA, 15 bp, Artificial Sequence
  dgRNA
  Stab1
tggacctctagacta

SEQ ID NO: 17857 - DNA, 15 bp, Artificial Sequence
  dgRNA
  Stab1
ctagactatggtgcc

SEQ ID NO: 17858 - DNA, 15 bp, Artificial Sequence
  dgRNA
  Chtf18
gattacttactgtac

SEQ ID NO: 17859 - DNA, 15 bp, Artificial Sequence
  dgRNA
  Chtf18
cccgcccttccccgc

SEQ ID NO: 17860 - DNA, 15 bp, Artificial Sequence
  dgRNA
  Chtf18
ttccccgctggccaa

SEQ ID NO: 17861 - DNA, 15 bp, Artificial Sequence
  dgRNA
  Chtf18
cccgctggccaatgg

SEQ ID NO: 17862 - DNA, 15 bp, Artificial Sequence
  dgRNA
  Tmcc1
tgacctgcgcccgcg

SEQ ID NO: 17863 - DNA, 15 bp, Artificial Sequence
  dgRNA
  Tmcc1
gacctgcgcccgcgt

SEQ ID NO: 17864 - DNA, 15 bp, Artificial Sequence
  dgRNA
  Tmcc1
acctgcgcccgcgtg

SEQ ID NO: 17865 - DNA, 15 bp, Artificial Sequence
  dgRNA
  Tmcc1
cctgcgcccgcgtgg

SEQ ID NO: 17866 - DNA, 15 bp, Artificial Sequence
  dgRNA
  Kcnq2
gcggccgggccaggt

SEQ ID NO: 17867 - DNA, 15 bp, Artificial Sequence
  dgRNA
  Kcnq2
agccgcctcgccatg

SEQ ID NO: 17868 - DNA, 15 bp, Artificial Sequence
  dgRNA
  Kcnq2
cgttcctacctggcc

SEQ ID NO: 17869 - DNA, 15 bp, Artificial Sequence
  dgRNA
  Kcnq2
ctctgcgttcctacc

SEQ ID NO: 17870 - DNA, 15 bp, Artificial Sequence
  dgRNA
  Trmt1l
gagcccgctgcacac

SEQ ID NO: 17871 - DNA, 15 bp, Artificial Sequence
  dgRNA
  Trmt1l
ggagccgaacgctcc

SEQ ID NO: 17872 - DNA, 15 bp, Artificial Sequence
  dgRNA
  Trmt1l
tgagcaccgcccatg

SEQ ID NO: 17873 - DNA, 15 bp, Artificial Sequence
  dgRNA
  Trmt1l
aggcgcgatgcctcc

SEQ ID NO: 17874 - DNA, 15 bp, Artificial Sequence
  dgRNA
  Nfkbia
ccagtggctcatcgc

SEQ ID NO: 17875 - DNA, 15 bp, Artificial Sequence
  dgRNA
  Nfkbia
cagtggctcatcgca

SEQ ID NO: 17876 - DNA, 15 bp, Artificial Sequence
  dgRNA
  Nfkbia
ttctccgatgaaccc

SEQ ID NO: 17877 - DNA, 15 bp, Artificial Sequence
  dgRNA
  Nfkbia
gatgaaccccggccc

SEQ ID NO: 17878 - DNA, 15 bp, Artificial Sequence
  dgRNA
  Suds3
aagcctccgcccatc

SEQ ID NO: 17879 - DNA, 15 bp, Artificial Sequence
  dgRNA
  Suds3
actccaggcgccgcc

SEQ ID NO: 17880 - DNA, 15 bp, Artificial Sequence
  dgRNA
  Suds3
ccaggcgccgcctgg

SEQ ID NO: 17881 - DNA, 15 bp, Artificial Sequence
  dgRNA
  Suds3
cgacctgatgggcgg

SEQ ID NO: 17882 - DNA, 15 bp, Artificial Sequence
  dgRNA
  Mkks
tgacgtcactcggac

SEQ ID NO: 17883 - DNA, 15 bp, Artificial Sequence
  dgRNA
  Mkks
gtcactcggaccggc

SEQ ID NO: 17884 - DNA, 15 bp, Artificial Sequence
  dgRNA
  Mkks
tcactcggaccggca

SEQ ID NO: 17885 - DNA, 15 bp, Artificial Sequence
  dgRNA
  Mkks
ctcggaccggcaggg

SEQ ID NO: 17886 - DNA, 15 bp, Artificial Sequence
  dgRNA
  Adssl1
acctctcacgtccta

SEQ ID NO: 17887 - DNA, 15 bp, Artificial Sequence
  dgRNA
  Adssl1
ttgcccaagtcgtgt

SEQ ID NO: 17888 - DNA, 15 bp, Artificial Sequence
  dgRNA
  Adssl1
tgcccaagtcgtgtc

SEQ ID NO: 17889 - DNA, 15 bp, Artificial Sequence
  dgRNA
  Adssl1
gcccaagtcgtgtcg

SEQ ID NO: 17890 - DNA, 15 bp, Artificial Sequence
  dgRNA
  Onecut2
cgccccccgagcccg

SEQ ID NO: 17891 - DNA, 15 bp, Artificial Sequence
  dgRNA
  Onecut2
gcctagccagcccgc

SEQ ID NO: 17892 - DNA, 15 bp, Artificial Sequence
  dgRNA
  Onecut2
gtgcgtgcgggagag

SEQ ID NO: 17893 - DNA, 15 bp, Artificial Sequence
  dgRNA
  Onecut2
cgtgcgtgcgggaga

SEQ ID NO: 17894 - DNA, 15 bp, Artificial Sequence
  dgRNA
  Trp63
gattgtgaccacaac

SEQ ID NO: 17895 - DNA, 15 bp, Artificial Sequence
  dgRNA
  Trp63
accacaacaggcggt

SEQ ID NO: 17896 - DNA, 15 bp, Artificial Sequence
  dgRNA
  Trp63
aggcggttggctgaa

SEQ ID NO: 17897 - DNA, 15 bp, Artificial Sequence
  dgRNA
  Trp63
ggcggttggctgaaa

SEQ ID NO: 17898 - DNA, 15 bp, Artificial Sequence
  dgRNA
  Aebp1
ccagaccctctaaac

SEQ ID NO: 17899 - DNA, 15 bp, Artificial Sequence
  dgRNA
  Aebp1
cagaccctctaaact

SEQ ID NO: 17900 - DNA, 15 bp, Artificial Sequence
  dgRNA
  Aebp1
acgctgctattagtc

SEQ ID NO: 17901 - DNA, 15 bp, Artificial Sequence
  dgRNA
  Aebp1
cgctgctattagtct

SEQ ID NO: 17902 - DNA, 15 bp, Artificial Sequence
  dgRNA
  Clnk
gtccatatgtccgcc

SEQ ID NO: 17903 - DNA, 15 bp, Artificial Sequence
  dgRNA
  Clnk
gtatgacacgacgtc

SEQ ID NO: 17904 - DNA, 15 bp, Artificial Sequence
  dgRNA
  Clnk
tgcctggcggacata

SEQ ID NO: 17905 - DNA, 15 bp, Artificial Sequence
  dgRNA
  Gbx2
agcacgctccaaccg

SEQ ID NO: 17906 - DNA, 15 bp, Artificial Sequence
  dgRNA
  Gbx2
ctccaaccgtggcgc

SEQ ID NO: 17907 - DNA, 15 bp, Artificial Sequence
  dgRNA
  Gbx2
ccggtagcccatttg

SEQ ID NO: 17908 - DNA, 15 bp, Artificial Sequence
  dgRNA
  Gbx2
catttgcggcccgcc

SEQ ID NO: 17909 - DNA, 15 bp, Artificial Sequence
  dgRNA
  Cngb1
ccctagtaactcaaa

SEQ ID NO: 17910 - DNA, 15 bp, Artificial Sequence
  dgRNA
  Cngb1
aagggccctatgtct

SEQ ID NO: 17911 - DNA, 15 bp, Artificial Sequence
  dgRNA
  Cngb1
tgtctaggacactgc

SEQ ID NO: 17912 - DNA, 15 bp, Artificial Sequence
  dgRNA
  Cngb1
acactgctggacccg

SEQ ID NO: 17913 - DNA, 15 bp, Artificial Sequence
  dgRNA
  Ndufa10
acccgagctcaaagc

SEQ ID NO: 17914 - DNA, 15 bp, Artificial Sequence
  dgRNA
  Ndufa10
cccgagctcaaagct

SEQ ID NO: 17915 - DNA, 15 bp, Artificial Sequence
  dgRNA
  Ndufa10
acttgtctaggatct

SEQ ID NO: 17916 - DNA, 15 bp, Artificial Sequence
  dgRNA
  Ndufa10
gccccgtcccagttc

SEQ ID NO: 17917 - DNA, 15 bp, Artificial Sequence
  dgRNA
  Shmt2
gtctaagaacttttc

SEQ ID NO: 17918 - DNA, 15 bp, Artificial Sequence
  dgRNA
  Shmt2
cgggacttgtataga

SEQ ID NO: 17919 - DNA, 15 bp, Artificial Sequence
  dgRNA
  Shmt2
gggacttgtatagat

SEQ ID NO: 17920 - DNA, 15 bp, Artificial Sequence
  dgRNA
  Shmt2
gtactgcgcatgcgc

SEQ ID NO: 17921 - DNA, 15 bp, Artificial Sequence
  dgRNA
  Jagn1
ttcggttctgcacga

SEQ ID NO: 17922 - DNA, 15 bp, Artificial Sequence
  dgRNA
  Jagn1
tcggttctgcacgat

SEQ ID NO: 17923 - DNA, 15 bp, Artificial Sequence
  dgRNA
  Jagn1
gcacgatgggatctc

SEQ ID NO: 17924 - DNA, 15 bp, Artificial Sequence
  dgRNA
  Jagn1
cacgatgggatctct

SEQ ID NO: 17925 - DNA, 15 bp, Artificial Sequence
  dgRNA
  Irf9
agcccgcggatggag

SEQ ID NO: 17926 - DNA, 15 bp, Artificial Sequence
  dgRNA
  Irf9
aggcccggctattac

SEQ ID NO: 17927 - DNA, 15 bp, Artificial Sequence
  dgRNA
  Irf9
gagaagaggtaccct

SEQ ID NO: 17928 - DNA, 15 bp, Artificial Sequence
  dgRNA
  Irf9
agaagaggtaccctt

SEQ ID NO: 17929 - DNA, 15 bp, Artificial Sequence
  dgRNA
  Ncald
tcatcgtagacctat

SEQ ID NO: 17930 - DNA, 15 bp, Artificial Sequence
  dgRNA
  Ncald
ctattggtgcaagag

SEQ ID NO: 17931 - DNA, 15 bp, Artificial Sequence
  dgRNA
  Ncald
tattggtgcaagaga

SEQ ID NO: 17932 - DNA, 15 bp, Artificial Sequence
  dgRNA
  Ncald
agagggttttttgcg

SEQ ID NO: 17933 - DNA, 15 bp, Artificial Sequence
  dgRNA
  Cdr2
ttcctaagctattat

SEQ ID NO: 17934 - DNA, 15 bp, Artificial Sequence
  dgRNA
  Cdr2
gctattattggctga

SEQ ID NO: 17935 - DNA, 15 bp, Artificial Sequence
  dgRNA
  Cdr2
tcgctgtcactctat

SEQ ID NO: 17936 - DNA, 15 bp, Artificial Sequence
  dgRNA
  Cdr2
cggctcattcgtgat

SEQ ID NO: 17937 - DNA, 15 bp, Artificial Sequence
  dgRNA
  Cdc14a
gacccgcggggcgcc

SEQ ID NO: 17938 - DNA, 15 bp, Artificial Sequence
  dgRNA
  Cdc14a
ggggcgcctggtaac

SEQ ID NO: 17939 - DNA, 15 bp, Artificial Sequence
  dgRNA
  Cdc14a
gggcgcctggtaact

SEQ ID NO: 17940 - DNA, 15 bp, Artificial Sequence
  dgRNA
  Cdc14a
ggcgcctggtaactg

SEQ ID NO: 17941 - DNA, 15 bp, Artificial Sequence
  dgRNA
  Exosc10
tccagttctcaggcg

SEQ ID NO: 17942 - DNA, 15 bp, Artificial Sequence
  dgRNA
  Exosc10
ctcaggcgaggccac

SEQ ID NO: 17943 - DNA, 15 bp, Artificial Sequence
  dgRNA
  Exosc10
atttccccatcgtta

SEQ ID NO: 17944 - DNA, 15 bp, Artificial Sequence
  dgRNA
  Exosc10
caaagctacgctact

SEQ ID NO: 17945 - DNA, 15 bp, Artificial Sequence
  dgRNA
  Igfbp6
tacactcatgctaac

SEQ ID NO: 17946 - DNA, 15 bp, Artificial Sequence
  dgRNA
  Igfbp6
ccgggcgagattccc

SEQ ID NO: 17947 - DNA, 15 bp, Artificial Sequence
  dgRNA
  Igfbp6
ggaagtaaacagcgg

SEQ ID NO: 17948 - DNA, 15 bp, Artificial Sequence
  dgRNA
  Igfbp6
agcggcggagaagaa

SEQ ID NO: 17949 - DNA, 15 bp, Artificial Sequence
  dgRNA
  Polr2e
cagatctgcttgccg

SEQ ID NO: 17950 - DNA, 15 bp, Artificial Sequence
  dgRNA
  Polr2e
tctgcttgccgagga

SEQ ID NO: 17951 - DNA, 15 bp, Artificial Sequence
  dgRNA
  Polr2e
ctgcttgccgaggac

SEQ ID NO: 17952 - DNA, 15 bp, Artificial Sequence
  dgRNA
  Polr2e
gcgtggactacagcc

SEQ ID NO: 17953 - DNA, 15 bp, Artificial Sequence
  dgRNA
  Grhl2
gccaccgctccactc

SEQ ID NO: 17954 - DNA, 15 bp, Artificial Sequence
  dgRNA
  Grhl2
gcgcgcctctgccaa

SEQ ID NO: 17955 - DNA, 15 bp, Artificial Sequence
  dgRNA
  Grhl2
aatcaccgcgcagct

SEQ ID NO: 17956 - DNA, 15 bp, Artificial Sequence
  dgRNA
  Grhl2
gcgcagctcggccct

SEQ ID NO: 17957 - DNA, 15 bp, Artificial Sequence
  dgRNA
  Dusp4
tcgagtccccgtgac

SEQ ID NO: 17958 - DNA, 15 bp, Artificial Sequence
  dgRNA
  Dusp4
cgagtccccgtgact

SEQ ID NO: 17959 - DNA, 15 bp, Artificial Sequence
  dgRNA
  Dusp4
ccgtgactgggtgcg

SEQ ID NO: 17960 - DNA, 15 bp, Artificial Sequence
  dgRNA
  Dusp4
cgtgactgggtgcga

SEQ ID NO: 17961 - DNA, 15 bp, Artificial Sequence
  dgRNA
  Atf3
tgtcccgggcgtgcg

SEQ ID NO: 17962 - DNA, 15 bp, Artificial Sequence
  dgRNA
  Atf3
gcgtgcgaggaacgc

SEQ ID NO: 17963 - DNA, 15 bp, Artificial Sequence
  dgRNA
  Atf3
gcatcaccaagtccg

SEQ ID NO: 17964 - DNA, 15 bp, Artificial Sequence
  dgRNA
  Atf3
atctccttatcaggc

SEQ ID NO: 17965 - DNA, 15 bp, Artificial Sequence
  dgRNA
  Nol11
tctgtctctactagc

SEQ ID NO: 17966 - DNA, 15 bp, Artificial Sequence
  dgRNA
  Nol11
tctctactagccggg

SEQ ID NO: 17967 - DNA, 15 bp, Artificial Sequence
  dgRNA
  Nol11
actagccgggaggcg

SEQ ID NO: 17968 - DNA, 15 bp, Artificial Sequence
  dgRNA
  Nol11
ttgagcgttcgcacg

SEQ ID NO: 17969 - DNA, 15 bp, Artificial Sequence
  dgRNA
  Slc43a2
ggtaacagcccgaca

SEQ ID NO: 17970 - DNA, 15 bp, Artificial Sequence
  dgRNA
  Slc43a2
gtaacagcccgacac

SEQ ID NO: 17971 - DNA, 15 bp, Artificial Sequence
  dgRNA
  Slc43a2
taacagcccgacacg

SEQ ID NO: 17972 - DNA, 15 bp, Artificial Sequence
  dgRNA
  Slc43a2
aacagcccgacacgg

SEQ ID NO: 17973 - DNA, 15 bp, Artificial Sequence
  dgRNA
  Rab4b
acgccccttttgact

SEQ ID NO: 17974 - DNA, 15 bp, Artificial Sequence
  dgRNA
  Rab4b
caccaatcactgcgt

SEQ ID NO: 17975 - DNA, 15 bp, Artificial Sequence
  dgRNA
  Rab4b
tgcgttgggcgagcg

SEQ ID NO: 17976 - DNA, 15 bp, Artificial Sequence
  dgRNA
  Rab4b
tgggcgagcgtggcc

SEQ ID NO: 17977 - DNA, 15 bp, Artificial Sequence
  dgRNA
  Pam16
aaccctattatactc

SEQ ID NO: 17978 - DNA, 15 bp, Artificial Sequence
  dgRNA
  Pam16
aaactgcaccaagtc

SEQ ID NO: 17979 - DNA, 15 bp, Artificial Sequence
  dgRNA
  Pam16
aactgcaccaagtct

SEQ ID NO: 17980 - DNA, 15 bp, Artificial Sequence
  dgRNA
  Pam16
tctggggccgcccac

SEQ ID NO: 17981 - DNA, 15 bp, Artificial Sequence
  dgRNA
  Cxxc1
gatggccacgccctt

SEQ ID NO: 17982 - DNA, 15 bp, Artificial Sequence
  dgRNA
  Cxxc1
tcggaagccgcgatc

SEQ ID NO: 17983 - DNA, 15 bp, Artificial Sequence
  dgRNA
  Cxxc1
tactatttgttgcct

SEQ ID NO: 17984 - DNA, 15 bp, Artificial Sequence
  dgRNA
  Cxxc1
ttgcctaggaacgca

SEQ ID NO: 17985 - DNA, 15 bp, Artificial Sequence
  dgRNA
  Nfasc
ctccattatgcatgg

SEQ ID NO: 17986 - DNA, 15 bp, Artificial Sequence
  dgRNA
  Nfasc
ccattatgcatggag

SEQ ID NO: 17987 - DNA, 15 bp, Artificial Sequence
  dgRNA
  Nfasc
cattatgcatggagg

SEQ ID NO: 17988 - DNA, 15 bp, Artificial Sequence
  dgRNA
  Nfasc
attatgcatggaggg

SEQ ID NO: 17989 - DNA, 15 bp, Artificial Sequence
  dgRNA
  Zfp606
aaccaccgcccttct

SEQ ID NO: 17990 - DNA, 15 bp, Artificial Sequence
  dgRNA
  Zfp606
cgcccttctaggcct

SEQ ID NO: 17991 - DNA, 15 bp, Artificial Sequence
  dgRNA
  Zfp606
ggcctcggaaacaag

SEQ ID NO: 17992 - DNA, 15 bp, Artificial Sequence
  dgRNA
  Zfp606
ggaacctaagagtct

SEQ ID NO: 17993 - DNA, 15 bp, Artificial Sequence
  dgRNA
  Serpinb1a
tttgacagccctcca

SEQ ID NO: 17994 - DNA, 15 bp, Artificial Sequence
  dgRNA
  Serpinb1a
acagccctccaaggt

SEQ ID NO: 17995 - DNA, 15 bp, Artificial Sequence
  dgRNA
  Serpinb1a
cgcctccacccagct

SEQ ID NO: 17996 - DNA, 15 bp, Artificial Sequence
  dgRNA
  Serpinb1a
ttctgcatgctataa

SEQ ID NO: 17997 - DNA, 15 bp, Artificial Sequence
  dgRNA
  Tnfrsf26
gctgcttagtgccag

SEQ ID NO: 17998 - DNA, 15 bp, Artificial Sequence
  dgRNA
  Tnfrsf26
cagctcaattgagca

SEQ ID NO: 17999 - DNA, 15 bp, Artificial Sequence
  dgRNA
  Tnfrsf26
ctttggaccggaagc

SEQ ID NO: 18000 - DNA, 15 bp, Artificial Sequence
  dgRNA
  Tnfrsf26
tttggaccggaagca

SEQ ID NO: 18001 - DNA, 15 bp, Artificial Sequence
  dgRNA
  Capns1
ataaccctcccgcgc

SEQ ID NO: 18002 - DNA, 15 bp, Artificial Sequence
  dgRNA
  Capns1
aggcgcagtctgcaa

SEQ ID NO: 18003 - DNA, 15 bp, Artificial Sequence
  dgRNA
  Capns1
cgcagtctgcaatgg

SEQ ID NO: 18004 - DNA, 15 bp, Artificial Sequence
  dgRNA
  Capns1
ggaccgcgcagacga

SEQ ID NO: 18005 - DNA, 15 bp, Artificial Sequence
  dgRNA
  Rasgef1a
gcaccacaaaccctg

SEQ ID NO: 18006 - DNA, 15 bp, Artificial Sequence
  dgRNA
  Rasgef1a
gctagtgctcctccc

SEQ ID NO: 18007 - DNA, 15 bp, Artificial Sequence
  dgRNA
  Rasgef1a
agggtcttgttcacg

SEQ ID NO: 18008 - DNA, 15 bp, Artificial Sequence
  dgRNA
  Rasgef1a
cagccccgccccggg

SEQ ID NO: 18009 - DNA, 15 bp, Artificial Sequence
  dgRNA
  Ept1
cacctattttgactc

SEQ ID NO: 18010 - DNA, 15 bp, Artificial Sequence
  dgRNA
  Ept1
atgaagcgacgaaga

SEQ ID NO: 18011 - DNA, 15 bp, Artificial Sequence
  dgRNA
  Ept1
agcgacgaagacggt

SEQ ID NO: 18012 - DNA, 15 bp, Artificial Sequence
  dgRNA
  Ept1
gacgaagacggtagg

SEQ ID NO: 18013 - DNA, 15 bp, Artificial Sequence
  dgRNA
  Fyco1
tccagttgcacccga

SEQ ID NO: 18014 - DNA, 15 bp, Artificial Sequence
  dgRNA
  Fyco1
ccagttgcacccgat

SEQ ID NO: 18015 - DNA, 15 bp, Artificial Sequence
  dgRNA
  Fyco1
cccgatgggagttgt

SEQ ID NO: 18016 - DNA, 15 bp, Artificial Sequence
  dgRNA
  Fyco1
tgtaggccatccgtg

SEQ ID NO: 18017 - DNA, 15 bp, Artificial Sequence
  dgRNA
  Rgag1
gcctctatgaatcat

SEQ ID NO: 18018 - DNA, 15 bp, Artificial Sequence
  dgRNA
  Rgag1
gagttgtcacatata

SEQ ID NO: 18019 - DNA, 15 bp, Artificial Sequence
  dgRNA
  Rgag1
tccaatgattcatag

SEQ ID NO: 18020 - DNA, 15 bp, Artificial Sequence
  dgRNA
  Sfxn5
gtaggaactaagacc

SEQ ID NO: 18021 - DNA, 15 bp, Artificial Sequence
  dgRNA
  Sfxn5
aagaccaggtctgcg

SEQ ID NO: 18022 - DNA, 15 bp, Artificial Sequence
  dgRNA
  Sfxn5
aagcccctgcgcgcc

SEQ ID NO: 18023 - DNA, 15 bp, Artificial Sequence
  dgRNA
  Sfxn5
gcgcccggttcgctg

SEQ ID NO: 18024 - DNA, 15 bp, Artificial Sequence
  dgRNA
  Calr
gtcccccacaacgcg

SEQ ID NO: 18025 - DNA, 15 bp, Artificial Sequence
  dgRNA
  Calr
gtggtcgaccctcat

SEQ ID NO: 18026 - DNA, 15 bp, Artificial Sequence
  dgRNA
  Calr
tctaaaccagtcaaa

SEQ ID NO: 18027 - DNA, 15 bp, Artificial Sequence
  dgRNA
  Calr
cagtcaaaaggaccg

SEQ ID NO: 18028 - DNA, 15 bp, Artificial Sequence
  dgRNA
  Krtap31-2
tcagagcattgggta

SEQ ID NO: 18029 - DNA, 15 bp, Artificial Sequence
  dgRNA
  Gm12253
tagcacatacctgat

SEQ ID NO: 18030 - DNA, 15 bp, Artificial Sequence
  dgRNA
  Gm12253
gatttcactatgcct

SEQ ID NO: 18031 - DNA, 15 bp, Artificial Sequence
  dgRNA
  Gm12253
cactatgccttggcc

SEQ ID NO: 18032 - DNA, 15 bp, Artificial Sequence
  dgRNA
  Gm12253
aagttgtcacgcaac

SEQ ID NO: 18033 - DNA, 15 bp, Artificial Sequence
  dgRNA
  Mad2l2
acgtaggaggggccg

SEQ ID NO: 18034 - DNA, 15 bp, Artificial Sequence
  dgRNA
  Mad2l2
cgcgacctcccgccg

SEQ ID NO: 18035 - DNA, 15 bp, Artificial Sequence
  dgRNA
  Mad2l2
gcgacctcccgccga

SEQ ID NO: 18036 - DNA, 15 bp, Artificial Sequence
  dgRNA
  Mad2l2
ccgagggccagcccc

SEQ ID NO: 18037 - DNA, 15 bp, Artificial Sequence
  dgRNA
  Zpbp2
actcgtcacaccacc

SEQ ID NO: 18038 - DNA, 15 bp, Artificial Sequence
  dgRNA
  Zpbp2
tagagagcgggaaca

SEQ ID NO: 18039 - DNA, 15 bp, Artificial Sequence
  dgRNA
  Zpbp2
ggaacacgggaccca

SEQ ID NO: 18040 - DNA, 15 bp, Artificial Sequence
  dgRNA
  Zpbp2
acgggacccaaggag

SEQ ID NO: 18041 - DNA, 15 bp, Artificial Sequence
  dgRNA
  Osbp2
ccctagatatagcag

SEQ ID NO: 18042 - DNA, 15 bp, Artificial Sequence
  dgRNA
  Osbp2
accccgccccattgc

SEQ ID NO: 18043 - DNA, 15 bp, Artificial Sequence
  dgRNA
  Osbp2
ttcccacccatcggc

SEQ ID NO: 18044 - DNA, 15 bp, Artificial Sequence
  dgRNA
  Osbp2
ttggggcccagcaat

SEQ ID NO: 18045 - DNA, 15 bp, Artificial Sequence
  dgRNA
  Lcn9
acatatccattcaag

SEQ ID NO: 18046 - DNA, 15 bp, Artificial Sequence
  dgRNA
  Lcn9
catatccattcaagt

SEQ ID NO: 18047 - DNA, 15 bp, Artificial Sequence
  dgRNA
  Lcn9
gtgaccagttaaatg

SEQ ID NO: 18048 - DNA, 15 bp, Artificial Sequence
  dgRNA
  Lcn9
ttaaatggggacctt

SEQ ID NO: 18049 - DNA, 15 bp, Artificial Sequence
  dgRNA
  Kncn
cagggtcgacagagc

SEQ ID NO: 18050 - DNA, 15 bp, Artificial Sequence
  dgRNA
  Kncn
gtttctcggaggtac

SEQ ID NO: 18051 - DNA, 15 bp, Artificial Sequence
  dgRNA
  Kncn
gcaaggcgggggtca

SEQ ID NO: 18052 - DNA, 15 bp, Artificial Sequence
  dgRNA
  Kncn
tgcaaggcgggggtc

SEQ ID NO: 18053 - DNA, 15 bp, Artificial Sequence
  dgRNA
  Zbtb24
tctaatcagcggatg

SEQ ID NO: 18054 - DNA, 15 bp, Artificial Sequence
  dgRNA
  Zbtb24
tctactgaggtctaa

SEQ ID NO: 18055 - DNA, 15 bp, Artificial Sequence
  dgRNA
  Zbtb24
aaaggaaactcagcg

SEQ ID NO: 18056 - DNA, 15 bp, Artificial Sequence
  dgRNA
  Zbtb24
actcagcggggtaac

SEQ ID NO: 18057 - DNA, 15 bp, Artificial Sequence
  dgRNA
  Mb
gcagttgttgtagcc

SEQ ID NO: 18058 - DNA, 15 bp, Artificial Sequence
  dgRNA
  Mb
aggcgactgatgcag

SEQ ID NO: 18059 - DNA, 15 bp, Artificial Sequence
  dgRNA
  Mb
tggctttcgtcaatg

SEQ ID NO: 18060 - DNA, 15 bp, Artificial Sequence
  dgRNA
  Mb
ctacaacaactgcag

SEQ ID NO: 18061 - DNA, 15 bp, Artificial Sequence
  dgRNA
  Slc16a3
tctataggagttgag

SEQ ID NO: 18062 - DNA, 15 bp, Artificial Sequence
  dgRNA
  Slc16a3
atctgactttgttgc

SEQ ID NO: 18063 - DNA, 15 bp, Artificial Sequence
  dgRNA
  Slc16a3
cagggccccgaccac

SEQ ID NO: 18064 - DNA, 15 bp, Artificial Sequence
  dgRNA
  Slc16a3
agggccccgaccaca

SEQ ID NO: 18065 - DNA, 15 bp, Artificial Sequence
  dgRNA
  Tlr1
aaacgtagaaccata

SEQ ID NO: 18066 - DNA, 15 bp, Artificial Sequence
  dgRNA
  Tlr1
ttatgtctaccaatt

SEQ ID NO: 18067 - DNA, 15 bp, Artificial Sequence
  dgRNA
  Tlr1
ccagtaattagctgc

SEQ ID NO: 18068 - DNA, 15 bp, Artificial Sequence
  dgRNA
  Tlr1
gtaattagctgcagg

SEQ ID NO: 18069 - DNA, 15 bp, Artificial Sequence
  dgRNA
  Prickle4
gcactttggctcacc

SEQ ID NO: 18070 - DNA, 15 bp, Artificial Sequence
  dgRNA
  Prickle4
cgaaagcttactgaa

SEQ ID NO: 18071 - DNA, 15 bp, Artificial Sequence
  dgRNA
  Prickle4
ggtgttcttaccgaa

SEQ ID NO: 18072 - DNA, 15 bp, Artificial Sequence
  dgRNA
  Prickle4
gtgttcttaccgaat

SEQ ID NO: 18073 - DNA, 15 bp, Artificial Sequence
  dgRNA
  Nme8
ttagagactgcaact

SEQ ID NO: 18074 - DNA, 15 bp, Artificial Sequence
  dgRNA
  Nme8
ctgcaacttggtagg

SEQ ID NO: 18075 - DNA, 15 bp, Artificial Sequence
  dgRNA
  Nme8
tcggggaggaatttt

SEQ ID NO: 18076 - DNA, 15 bp, Artificial Sequence
  dgRNA
  Nme8
ctctaagactgtaca

SEQ ID NO: 18077 - DNA, 15 bp, Artificial Sequence
  dgRNA
  Fam131b
cgacggaggctgccg

SEQ ID NO: 18078 - DNA, 15 bp, Artificial Sequence
  dgRNA
  Fam131b
gacggaggctgccgt

SEQ ID NO: 18079 - DNA, 15 bp, Artificial Sequence
  dgRNA
  Fam131b
acggaggctgccgtg

SEQ ID NO: 18080 - DNA, 15 bp, Artificial Sequence
  dgRNA
  4930427A07Rik
agtcgaggtgctgat

SEQ ID NO: 18081 - DNA, 15 bp, Artificial Sequence
  dgRNA
  4930427A07Rik
attggtgagttccaa

SEQ ID NO: 18082 - DNA, 15 bp, Artificial Sequence
  dgRNA
  4930427A07Rik
gagttccaacggagt

SEQ ID NO: 18083 - DNA, 15 bp, Artificial Sequence
  dgRNA
  4930427A07Rik
gcctacgggatagac

SEQ ID NO: 18084 - DNA, 15 bp, Artificial Sequence
  dgRNA
  Cd6
gagtgcgcagcacac

SEQ ID NO: 18085 - DNA, 15 bp, Artificial Sequence
  dgRNA
  Cdc23
tagttcttgccaatc

SEQ ID NO: 18086 - DNA, 15 bp, Artificial Sequence
  dgRNA
  Cdc23
cccccatcgcctttt

SEQ ID NO: 18087 - DNA, 15 bp, Artificial Sequence
  dgRNA
  Cdc23
ggaacattacgaaga

SEQ ID NO: 18088 - DNA, 15 bp, Artificial Sequence
  dgRNA
  Cdc23
tggttgcttcgtgca

SEQ ID NO: 18089 - DNA, 15 bp, Artificial Sequence
  dgRNA
  Ier5
taagagcttgctccg

SEQ ID NO: 18090 - DNA, 15 bp, Artificial Sequence
  dgRNA
  Ier5
gactaacgtttgaac

SEQ ID NO: 18091 - DNA, 15 bp, Artificial Sequence
  dgRNA
  Ier5
cgtttgaacaggccc

SEQ ID NO: 18092 - DNA, 15 bp, Artificial Sequence
  dgRNA
  Ier5
gcctctgattggtcg

SEQ ID NO: 18093 - DNA, 15 bp, Artificial Sequence
  dgRNA
  Timm9
cagattccgttgccg

SEQ ID NO: 18094 - DNA, 15 bp, Artificial Sequence
  dgRNA
  Timm9
ccgttgccgtggaaa

SEQ ID NO: 18095 - DNA, 15 bp, Artificial Sequence
  dgRNA
  Timm9
acgaatctgcgtcta

SEQ ID NO: 18096 - DNA, 15 bp, Artificial Sequence
  dgRNA
  Timm9
cgaatctgcgtctaa

SEQ ID NO: 18097 - DNA, 15 bp, Artificial Sequence
  dgRNA
  Pdlim4
aagcggaccctattc

SEQ ID NO: 18098 - DNA, 15 bp, Artificial Sequence
  dgRNA
  Pdlim4
agcggaccctattct

SEQ ID NO: 18099 - DNA, 15 bp, Artificial Sequence
  dgRNA
  Pdlim4
gcggaccctattctg

SEQ ID NO: 18100 - DNA, 15 bp, Artificial Sequence
  dgRNA
  Pdlim4
cggaccctattctgg

SEQ ID NO: 18101 - DNA, 15 bp, Artificial Sequence
  dgRNA
  Grrp1
gcactaatgtaagtc

SEQ ID NO: 18102 - DNA, 15 bp, Artificial Sequence
  dgRNA
  Grrp1
ttgagacggagctct

SEQ ID NO: 18103 - DNA, 15 bp, Artificial Sequence
  dgRNA
  Grrp1
gcaagagttaaccta

SEQ ID NO: 18104 - DNA, 15 bp, Artificial Sequence
  dgRNA
  Grrp1
caagagttaacctag

SEQ ID NO: 18105 - DNA, 15 bp, Artificial Sequence
  dgRNA
  Tcn2
ttcgctgtcgcctca

SEQ ID NO: 18106 - DNA, 15 bp, Artificial Sequence
  dgRNA
  Tcn2
tacttgccctgaact

SEQ ID NO: 18107 - DNA, 15 bp, Artificial Sequence
  dgRNA
  Tcn2
tctgccaaggaggcg

SEQ ID NO: 18108 - DNA, 15 bp, Artificial Sequence
  dgRNA
  Tcn2
gctgttctgccaagg

SEQ ID NO: 18109 - DNA, 15 bp, Artificial Sequence
  dgRNA
  Ptpn6
gctagggttacttcc

SEQ ID NO: 18110 - DNA, 15 bp, Artificial Sequence
  dgRNA
  Ptpn6
ctagggttacttcct

SEQ ID NO: 18111 - DNA, 15 bp, Artificial Sequence
  dgRNA
  Ptpn6
gaagtaggcctggac

SEQ ID NO: 18112 - DNA, 15 bp, Artificial Sequence
  dgRNA
  Ptpn6
tggggaatttggccg

SEQ ID NO: 18113 - DNA, 15 bp, Artificial Sequence
  dgRNA
  Cyp2t4
gcagcagcgacatta

SEQ ID NO: 18114 - DNA, 15 bp, Artificial Sequence
  dgRNA
  Cyp2t4
gacattagggaagcc

SEQ ID NO: 18115 - DNA, 15 bp, Artificial Sequence
  dgRNA
  Cyp2t4
tgttactacaccccc

SEQ ID NO: 18116 - DNA, 15 bp, Artificial Sequence
  dgRNA
  Cyp2t4
tcaactctatccccc

SEQ ID NO: 18117 - DNA, 15 bp, Artificial Sequence
  dgRNA
  Tasp1
gagacgctatagcct

SEQ ID NO: 18118 - DNA, 15 bp, Artificial Sequence
  dgRNA
  Tasp1
atagcctaggcgatt

SEQ ID NO: 18119 - DNA, 15 bp, Artificial Sequence
  dgRNA
  Tasp1
aggcgattaggactc

SEQ ID NO: 18120 - DNA, 15 bp, Artificial Sequence
  dgRNA
  Tasp1
taggactcaggctcg

SEQ ID NO: 18121 - DNA, 15 bp, Artificial Sequence
  dgRNA
  Ofd1
gcctggatgcccccg

SEQ ID NO: 18122 - DNA, 15 bp, Artificial Sequence
  dgRNA
  Ofd1
atgcccccgcggacc

SEQ ID NO: 18123 - DNA, 15 bp, Artificial Sequence
  dgRNA
  Ofd1
tcgggagcctcagcc

SEQ ID NO: 18124 - DNA, 15 bp, Artificial Sequence
  dgRNA
  Ofd1
cgggagcctcagcct

SEQ ID NO: 18125 - DNA, 15 bp, Artificial Sequence
  dgRNA
  Lamb3
ccctctagacaccta

SEQ ID NO: 18126 - DNA, 15 bp, Artificial Sequence
  dgRNA
  Lamb3
cctctagacacctaa

SEQ ID NO: 18127 - DNA, 15 bp, Artificial Sequence
  dgRNA
  Lamb3
tagacacctaagggc

SEQ ID NO: 18128 - DNA, 15 bp, Artificial Sequence
  dgRNA
  Lamb3
gacatcagatgggcg

SEQ ID NO: 18129 - DNA, 15 bp, Artificial Sequence
  dgRNA
  Wdr44
ttgcgccattttgac

SEQ ID NO: 18130 - DNA, 15 bp, Artificial Sequence
  dgRNA
  Wdr44
ataagattgcctctc

SEQ ID NO: 18131 - DNA, 15 bp, Artificial Sequence
  dgRNA
  Wdr44
taagattgcctctct

SEQ ID NO: 18132 - DNA, 15 bp, Artificial Sequence
  dgRNA
  Wdr44
ccacgctttaccggc

SEQ ID NO: 18133 - DNA, 15 bp, Artificial Sequence
  dgRNA
  Olfr918
ctggcaaacttattg

SEQ ID NO: 18134 - DNA, 15 bp, Artificial Sequence
  dgRNA
  Clca4a
aactgttatgtaacc

SEQ ID NO: 18135 - DNA, 15 bp, Artificial Sequence
  dgRNA
  Clca4a
cctcaatgagctaac

SEQ ID NO: 18136 - DNA, 15 bp, Artificial Sequence
  dgRNA
  Clca4a
cctgttagctcattg

SEQ ID NO: 18137 - DNA, 15 bp, Artificial Sequence
  dgRNA
  Vmn1r31
ttactagttgaagat

SEQ ID NO: 18138 - DNA, 15 bp, Artificial Sequence
  dgRNA
  Fam212b
tgctcgctcgctcgt

SEQ ID NO: 18139 - DNA, 15 bp, Artificial Sequence
  dgRNA
  Fam212b
tcgctcgtggggagc

SEQ ID NO: 18140 - DNA, 15 bp, Artificial Sequence
  dgRNA
  Fam212b
ggagctggcaccgcc

SEQ ID NO: 18141 - DNA, 15 bp, Artificial Sequence
  dgRNA
  Fam212b
gagctggcaccgccc

SEQ ID NO: 18142 - DNA, 15 bp, Artificial Sequence
  dgRNA
  Hira
catgcaatcgagctc

SEQ ID NO: 18143 - DNA, 15 bp, Artificial Sequence
  dgRNA
  Hira
atgcaatcgagctca

SEQ ID NO: 18144 - DNA, 15 bp, Artificial Sequence
  dgRNA
  Hira
ccgctagatgcatgc

SEQ ID NO: 18145 - DNA, 15 bp, Artificial Sequence
  dgRNA
  Hira
atgctggcgcccgcc

SEQ ID NO: 18146 - DNA, 15 bp, Artificial Sequence
  dgRNA
  Man2a1
gcggcgcgctgtgat

SEQ ID NO: 18147 - DNA, 15 bp, Artificial Sequence
  dgRNA
  Man2a1
cggcgcgctgtgatt

SEQ ID NO: 18148 - DNA, 15 bp, Artificial Sequence
  dgRNA
  Man2a1
ctgtgattgggcgcc

SEQ ID NO: 18149 - DNA, 15 bp, Artificial Sequence
  dgRNA
  Man2a1
tgtgattgggcgcca

SEQ ID NO: 18150 - DNA, 15 bp, Artificial Sequence
  dgRNA
  Prss57
gccagataatctagt

SEQ ID NO: 18151 - DNA, 15 bp, Artificial Sequence
  dgRNA
  Prss57
gataatctagtagga

SEQ ID NO: 18152 - DNA, 15 bp, Artificial Sequence
  dgRNA
  Prss57
tagtaggaaggtaca

SEQ ID NO: 18153 - DNA, 15 bp, Artificial Sequence
  dgRNA
  Prss57
cccggaacaactttc

SEQ ID NO: 18154 - DNA, 15 bp, Artificial Sequence
  dgRNA
  Tsr3
agcgacgccagcgcg

SEQ ID NO: 18155 - DNA, 15 bp, Artificial Sequence
  dgRNA
  Tsr3
gcgacgccagcgcgc

SEQ ID NO: 18156 - DNA, 15 bp, Artificial Sequence
  dgRNA
  Tsr3
cgacgccagcgcgcg

SEQ ID NO: 18157 - DNA, 15 bp, Artificial Sequence
  dgRNA
  Tsr3
gacgccagcgcgcgg

SEQ ID NO: 18158 - DNA, 15 bp, Artificial Sequence
  dgRNA
  Pef1
cccgaggtccgctgc

SEQ ID NO: 18159 - DNA, 15 bp, Artificial Sequence
  dgRNA
  Pef1
acaaacgagccacta

SEQ ID NO: 18160 - DNA, 15 bp, Artificial Sequence
  dgRNA
  Pef1
cttccgtttgttgac

SEQ ID NO: 18161 - DNA, 15 bp, Artificial Sequence
  dgRNA
  Pef1
ccgtccaatcacaat

SEQ ID NO: 18162 - DNA, 15 bp, Artificial Sequence
  dgRNA
  Cfap206
gtccgccccgccctc

SEQ ID NO: 18163 - DNA, 15 bp, Artificial Sequence
  dgRNA
  Cfap206
cgcgttccgtttcca

SEQ ID NO: 18164 - DNA, 15 bp, Artificial Sequence
  dgRNA
  Cfap206
acgcgactgccgctt

SEQ ID NO: 18165 - DNA, 15 bp, Artificial Sequence
  dgRNA
  Cfap206
ctgccgcttaggatc

SEQ ID NO: 18166 - DNA, 15 bp, Artificial Sequence
  dgRNA
  Ranbp17
gctgaggcgggcagt

SEQ ID NO: 18167 - DNA, 15 bp, Artificial Sequence
  dgRNA
  Ranbp17
ctgaggcgggcagtt

SEQ ID NO: 18168 - DNA, 15 bp, Artificial Sequence
  dgRNA
  Ranbp17
cgggcagttgggtcg

SEQ ID NO: 18169 - DNA, 15 bp, Artificial Sequence
  dgRNA
  Ranbp17
gcagttgggtcgtgg

SEQ ID NO: 18170 - DNA, 15 bp, Artificial Sequence
  dgRNA
  Rfc4
tgctgggccgaggtc

SEQ ID NO: 18171 - DNA, 15 bp, Artificial Sequence
  dgRNA
  Rfc4
gccgaggtctggccg

SEQ ID NO: 18172 - DNA, 15 bp, Artificial Sequence
  dgRNA
  Rfc4
ccgcggagtctacac

SEQ ID NO: 18173 - DNA, 15 bp, Artificial Sequence
  dgRNA
  Rfc4
acaggatcacctccg

SEQ ID NO: 18174 - DNA, 15 bp, Artificial Sequence
  dgRNA
  Frmpd1
cctgccgccgccaga

SEQ ID NO: 18175 - DNA, 15 bp, Artificial Sequence
  dgRNA
  Frmpd1
cgccgccagacggcg

SEQ ID NO: 18176 - DNA, 15 bp, Artificial Sequence
  dgRNA
  Frmpd1
gccgccagacggcgc

SEQ ID NO: 18177 - DNA, 15 bp, Artificial Sequence
  dgRNA
  Frmpd1
cggcgcgggcgcagc

SEQ ID NO: 18178 - DNA, 15 bp, Artificial Sequence
  dgRNA
  Crat
agccatgtttgtgcg

SEQ ID NO: 18179 - DNA, 15 bp, Artificial Sequence
  dgRNA
  Crat
gtttgtgcggggcgt

SEQ ID NO: 18180 - DNA, 15 bp, Artificial Sequence
  dgRNA
  Crat
tttgtgcggggcgtc

SEQ ID NO: 18181 - DNA, 15 bp, Artificial Sequence
  dgRNA
  Crat
tattcttgcggagca

SEQ ID NO: 18182 - DNA, 15 bp, Artificial Sequence
  dgRNA
  Olfr91
cagtaagacaagacg

SEQ ID NO: 18183 - DNA, 15 bp, Artificial Sequence
  dgRNA
  Olfr91
caagacgaggagcgg

SEQ ID NO: 18184 - DNA, 15 bp, Artificial Sequence
  dgRNA
  Olfr91
aagacgaggagcggt

SEQ ID NO: 18185 - DNA, 15 bp, Artificial Sequence
  dgRNA
  Olfr91
cggtgggaaaaaaca

SEQ ID NO: 18186 - DNA, 15 bp, Artificial Sequence
  dgRNA
  Olfr733
tgttctagttagaag

SEQ ID NO: 18187 - DNA, 15 bp, Artificial Sequence
  dgRNA
  Olfr733
agcatagttagacac

SEQ ID NO: 18188 - DNA, 15 bp, Artificial Sequence
  dgRNA
  Olfr801
gtgatattagttgtt

SEQ ID NO: 18189 - DNA, 15 bp, Artificial Sequence
  dgRNA
  Olfr801
gatattagttgtttg

SEQ ID NO: 18190 - DNA, 15 bp, Artificial Sequence
  dgRNA
  Ankdd1b
aaaccctagagtaca

SEQ ID NO: 18191 - DNA, 15 bp, Artificial Sequence
  dgRNA
  Ankdd1b
aaccctagagtacat

SEQ ID NO: 18192 - DNA, 15 bp, Artificial Sequence
  dgRNA
  Ankdd1b
tgccacacctaaagg

SEQ ID NO: 18193 - DNA, 15 bp, Artificial Sequence
  dgRNA
  Ankdd1b
ttggctctacacaaa

SEQ ID NO: 18194 - DNA, 15 bp, Artificial Sequence
  dgRNA
  A230065H16Rik
cctcatattctaacc

SEQ ID NO: 18195 - DNA, 15 bp, Artificial Sequence
  dgRNA
  A230065H16Rik
gccaggtccttccgg

SEQ ID NO: 18196 - DNA, 15 bp, Artificial Sequence
  dgRNA
  A230065H16Rik
ctgcgagcgcgtgtg

SEQ ID NO: 18197 - DNA, 15 bp, Artificial Sequence
  dgRNA
  A230065H16Rik
tgcgagcgcgtgtgt

SEQ ID NO: 18198 - DNA, 15 bp, Artificial Sequence
  dgRNA
  Kctd3
acctaaatcttgtgc

SEQ ID NO: 18199 - DNA, 15 bp, Artificial Sequence
  dgRNA
  Kctd3
ttcctaggccatcgg

SEQ ID NO: 18200 - DNA, 15 bp, Artificial Sequence
  dgRNA
  Kctd3
gccccgcccatcgcc

SEQ ID NO: 18201 - DNA, 15 bp, Artificial Sequence
  dgRNA
  Kctd3
gtaagcgtgaagcgc

SEQ ID NO: 18202 - DNA, 15 bp, Artificial Sequence
  dgRNA
  Pskh1
cccagcggtgtctag

SEQ ID NO: 18203 - DNA, 15 bp, Artificial Sequence
  dgRNA
  Pskh1
cccgaagacgttgat

SEQ ID NO: 18204 - DNA, 15 bp, Artificial Sequence
  dgRNA
  Pskh1
aagacgttgattggc

SEQ ID NO: 18205 - DNA, 15 bp, Artificial Sequence
  dgRNA
  Pskh1
acttgcgttcgcgtc

SEQ ID NO: 18206 - DNA, 15 bp, Artificial Sequence
  dgRNA
  Sptan1
ctctgcagggcggac

SEQ ID NO: 18207 - DNA, 15 bp, Artificial Sequence
  dgRNA
  Sptan1
tctgcagggcggact

SEQ ID NO: 18208 - DNA, 15 bp, Artificial Sequence
  dgRNA
  Sptan1
cggggcaggattgct

SEQ ID NO: 18209 - DNA, 15 bp, Artificial Sequence
  dgRNA
  Sptan1
tcgggtcccacgccg

SEQ ID NO: 18210 - DNA, 15 bp, Artificial Sequence
  dgRNA
  Pitrm1
tcccgcccgttttcc

SEQ ID NO: 18211 - DNA, 15 bp, Artificial Sequence
  dgRNA
  Pitrm1
cgctcctccccacgg

SEQ ID NO: 18212 - DNA, 15 bp, Artificial Sequence
  dgRNA
  Pitrm1
tcctccccacggcgg

SEQ ID NO: 18213 - DNA, 15 bp, Artificial Sequence
  dgRNA
  Pitrm1
cccgcgtcgtgcgtc

SEQ ID NO: 18214 - DNA, 15 bp, Artificial Sequence
  dgRNA
  Specc1
cggggcgagtcattc

SEQ ID NO: 18215 - DNA, 15 bp, Artificial Sequence
  dgRNA
  Specc1
ggcgagtcattcagg

SEQ ID NO: 18216 - DNA, 15 bp, Artificial Sequence
  dgRNA
  Specc1
gcgagtcattcaggc

SEQ ID NO: 18217 - DNA, 15 bp, Artificial Sequence
  dgRNA
  Specc1
gcgggatgtagataa

SEQ ID NO: 18218 - DNA, 15 bp, Artificial Sequence
  dgRNA
  Nfatc2ip
gcgcctttgttttag

SEQ ID NO: 18219 - DNA, 15 bp, Artificial Sequence
  dgRNA
  Nfatc2ip
agaccaatgagaacg

SEQ ID NO: 18220 - DNA, 15 bp, Artificial Sequence
  dgRNA
  Nfatc2ip
aatgagaacgtggat

SEQ ID NO: 18221 - DNA, 15 bp, Artificial Sequence
  dgRNA
  Nfatc2ip
gagaacgtggatagg

SEQ ID NO: 18222 - DNA, 15 bp, Artificial Sequence
  dgRNA
  Tbx21
acttacacttaggag

SEQ ID NO: 18223 - DNA, 15 bp, Artificial Sequence
  dgRNA
  Tbx21
gctgtattagccacg

SEQ ID NO: 18224 - DNA, 15 bp, Artificial Sequence
  dgRNA
  Tbx21
ctgtattagccacga

SEQ ID NO: 18225 - DNA, 15 bp, Artificial Sequence
  dgRNA
  Tbx21
tgtattagccacgag

SEQ ID NO: 18226 - DNA, 15 bp, Artificial Sequence
  dgRNA
  Gm5108
aagtgagagcgtaat

SEQ ID NO: 18227 - DNA, 15 bp, Artificial Sequence
  dgRNA
  Gm5108
tccactgttgctagg

SEQ ID NO: 18228 - DNA, 15 bp, Artificial Sequence
  dgRNA
  Hpca
gggaatcagcattgc

SEQ ID NO: 18229 - DNA, 15 bp, Artificial Sequence
  dgRNA
  Hpca
cgtgtgcttgtgaat

SEQ ID NO: 18230 - DNA, 15 bp, Artificial Sequence
  dgRNA
  Hpca
tgaatgggcttgaca

SEQ ID NO: 18231 - DNA, 15 bp, Artificial Sequence
  dgRNA
  Hpca
cacggagagccagaa

SEQ ID NO: 18232 - DNA, 15 bp, Artificial Sequence
  dgRNA
  1700025G04Rik
cctcgagtgagcgcc

SEQ ID NO: 18233 - DNA, 15 bp, Artificial Sequence
  dgRNA
  1700025G04Rik
ctcgagtgagcgcct

SEQ ID NO: 18234 - DNA, 15 bp, Artificial Sequence
  dgRNA
  1700025G04Rik
gtgagcgcctgggcg

SEQ ID NO: 18235 - DNA, 15 bp, Artificial Sequence
  dgRNA
  1700025G04Rik
agcgcctgggcgcgg

SEQ ID NO: 18236 - DNA, 15 bp, Artificial Sequence
  dgRNA
  Tcp11x2
ggactcttgatctgt

SEQ ID NO: 18237 - DNA, 15 bp, Artificial Sequence
  dgRNA
  Tcp11x2
ggggtgtgccccatg

SEQ ID NO: 18238 - DNA, 15 bp, Artificial Sequence
  dgRNA
  Tcp11x2
gccccataatttcaa

SEQ ID NO: 18239 - DNA, 15 bp, Artificial Sequence
  dgRNA
  Tcp11x2
atgaactcctctacc

SEQ ID NO: 18240 - DNA, 15 bp, Artificial Sequence
  dgRNA
  Qpct
ccacttatagccccc

SEQ ID NO: 18241 - DNA, 15 bp, Artificial Sequence
  dgRNA
  Qpct
cacttatagccccca

SEQ ID NO: 18242 - DNA, 15 bp, Artificial Sequence
  dgRNA
  Qpct
ctcttttcgtatcta

SEQ ID NO: 18243 - DNA, 15 bp, Artificial Sequence
  dgRNA
  Qpct
gtatctatggactac

SEQ ID NO: 18244 - DNA, 15 bp, Artificial Sequence
  dgRNA
  Rarb
ggagcaccgcgcggc

SEQ ID NO: 18245 - DNA, 15 bp, Artificial Sequence
  dgRNA
  Rarb
ccgcgcggctggccg

SEQ ID NO: 18246 - DNA, 15 bp, Artificial Sequence
  dgRNA
  Rarb
tggccgcggactcgc

SEQ ID NO: 18247 - DNA, 15 bp, Artificial Sequence
  dgRNA
  Rarb
ggactcgctggctga

SEQ ID NO: 18248 - DNA, 15 bp, Artificial Sequence
  dgRNA
  Mars
cttcaacgaccagta

SEQ ID NO: 18249 - DNA, 15 bp, Artificial Sequence
  dgRNA
  Mars
tcgcgtcgtctccat

SEQ ID NO: 18250 - DNA, 15 bp, Artificial Sequence
  dgRNA
  Mars
cggatcgctttacag

SEQ ID NO: 18251 - DNA, 15 bp, Artificial Sequence
  dgRNA
  Mars
ttcaaaggaccctct

SEQ ID NO: 18252 - DNA, 15 bp, Artificial Sequence
  dgRNA
  Cyfip2
ggtcaggggtgcgca

SEQ ID NO: 18253 - DNA, 15 bp, Artificial Sequence
  dgRNA
  Cyfip2
cgccgcagccatttc

SEQ ID NO: 18254 - DNA, 15 bp, Artificial Sequence
  dgRNA
  Cyfip2
agcagccgcggcgaa

SEQ ID NO: 18255 - DNA, 15 bp, Artificial Sequence
  dgRNA
  Cyfip2
gcagccgcggcgaag

SEQ ID NO: 18256 - DNA, 15 bp, Artificial Sequence
  dgRNA
  Klhl15
ggaagccgtgggtta

SEQ ID NO: 18257 - DNA, 15 bp, Artificial Sequence
  dgRNA
  Klhl15
tggaagccgtgggtt

SEQ ID NO: 18258 - DNA, 15 bp, Artificial Sequence
  dgRNA
  Klhl15
gggactggaagccgt

SEQ ID NO: 18259 - DNA, 15 bp, Artificial Sequence
  dgRNA
  Plpp3
attatcctacgtttt

SEQ ID NO: 18260 - DNA, 15 bp, Artificial Sequence
  dgRNA
  Plpp3
gttttaggcagctta

SEQ ID NO: 18261 - DNA, 15 bp, Artificial Sequence
  dgRNA
  Plpp3
tgttggagccaagta

SEQ ID NO: 18262 - DNA, 15 bp, Artificial Sequence
  dgRNA
  Plpp3
cccctcgctttttaa

SEQ ID NO: 18263 - DNA, 15 bp, Artificial Sequence
  dgRNA
  Aebp2
gcagcagcggcgatg

SEQ ID NO: 18264 - DNA, 15 bp, Artificial Sequence
  dgRNA
  Aebp2
cagcggcgatgggga

SEQ ID NO: 18265 - DNA, 15 bp, Artificial Sequence
  dgRNA
  Aebp2
agcggcgatggggac

SEQ ID NO: 18266 - DNA, 15 bp, Artificial Sequence
  dgRNA
  Aebp2
gagcccaagggaccg

SEQ ID NO: 18267 - DNA, 15 bp, Artificial Sequence
  dgRNA
  Axl
ctctccaaggcgccc

SEQ ID NO: 18268 - DNA, 15 bp, Artificial Sequence
  dgRNA
  Axl
ggctggggccctagt

SEQ ID NO: 18269 - DNA, 15 bp, Artificial Sequence
  dgRNA
  Axl
ggccctagtgggcgg

SEQ ID NO: 18270 - DNA, 15 bp, Artificial Sequence
  dgRNA
  Axl
ggctgaggccgatcc

SEQ ID NO: 18271 - DNA, 15 bp, Artificial Sequence
  dgRNA
  Mpo
ctccgaaatcagctc

SEQ ID NO: 18272 - DNA, 15 bp, Artificial Sequence
  dgRNA
  Mpo
tccgaaatcagctct

SEQ ID NO: 18273 - DNA, 15 bp, Artificial Sequence
  dgRNA
  Mpo
attctcccccaagga

SEQ ID NO: 18274 - DNA, 15 bp, Artificial Sequence
  dgRNA
  Mpo
aggcattctccccca

SEQ ID NO: 18275 - DNA, 15 bp, Artificial Sequence
  dgRNA
  Itgal
agaggtttcacaacc

SEQ ID NO: 18276 - DNA, 15 bp, Artificial Sequence
  dgRNA
  Itgal
tttcacaacccggac

SEQ ID NO: 18277 - DNA, 15 bp, Artificial Sequence
  dgRNA
  Kit
agccgcctggactga

SEQ ID NO: 18278 - DNA, 15 bp, Artificial Sequence
  dgRNA
  Kit
ctgaaggaccaccga

SEQ ID NO: 18279 - DNA, 15 bp, Artificial Sequence
  dgRNA
  Kit
aaggaccaccgatgg

SEQ ID NO: 18280 - DNA, 15 bp, Artificial Sequence
  dgRNA
  Kit
aggaccaccgatgga

SEQ ID NO: 18281 - DNA, 15 bp, Artificial Sequence
  dgRNA
  Prkd3
cgcgctccgagcgcc

SEQ ID NO: 18282 - DNA, 15 bp, Artificial Sequence
  dgRNA
  Prkd3
gctccgagcgcccgg

SEQ ID NO: 18283 - DNA, 15 bp, Artificial Sequence
  dgRNA
  Prkd3
ctccgagcgcccggt

SEQ ID NO: 18284 - DNA, 15 bp, Artificial Sequence
  dgRNA
  Prkd3
tccgagcgcccggtg

SEQ ID NO: 18285 - DNA, 15 bp, Artificial Sequence
  dgRNA
  Pde10a
gcgcgtctcccgaga

SEQ ID NO: 18286 - DNA, 15 bp, Artificial Sequence
  dgRNA
  Pde10a
cgcgtctcccgagaa

SEQ ID NO: 18287 - DNA, 15 bp, Artificial Sequence
  dgRNA
  Pde10a
gtctcccgagaaggg

SEQ ID NO: 18288 - DNA, 15 bp, Artificial Sequence
  dgRNA
  Pde10a
tctcccgagaaggga

SEQ ID NO: 18289 - DNA, 15 bp, Artificial Sequence
  dgRNA
  Tnfsf15
gtacataaatatgct

SEQ ID NO: 18290 - DNA, 15 bp, Artificial Sequence
  dgRNA
  Tnfsf15
ggcgcattccctagc

SEQ ID NO: 18291 - DNA, 15 bp, Artificial Sequence
  dgRNA
  Tnfsf15
gcgcattccctagcc

SEQ ID NO: 18292 - DNA, 15 bp, Artificial Sequence
  dgRNA
  Tnfsf15
attccctagccgggc

SEQ ID NO: 18293 - DNA, 15 bp, Artificial Sequence
  dgRNA
  Kif20a
ttcacgcctgagaat

SEQ ID NO: 18294 - DNA, 15 bp, Artificial Sequence
  dgRNA
  Kif20a
tcacgcctgagaatt

SEQ ID NO: 18295 - DNA, 15 bp, Artificial Sequence
  dgRNA
  Kif20a
ggccttgactataaa

SEQ ID NO: 18296 - DNA, 15 bp, Artificial Sequence
  dgRNA
  Kif20a
cgacgtcttcaacgt

SEQ ID NO: 18297 - DNA, 15 bp, Artificial Sequence
  dgRNA
  Pde6d
agccatcgctcctct

SEQ ID NO: 18298 - DNA, 15 bp, Artificial Sequence
  dgRNA
  Pde6d
cgggactctccaaga

SEQ ID NO: 18299 - DNA, 15 bp, Artificial Sequence
  dgRNA
  Pde6d
gctgagcgttgctat

SEQ ID NO: 18300 - DNA, 15 bp, Artificial Sequence
  dgRNA
  Pde6d
gccaatcgccaaggc

SEQ ID NO: 18301 - DNA, 15 bp, Artificial Sequence
  dgRNA
  Cyp26c1
gaaaatggcccaatt

SEQ ID NO: 18302 - DNA, 15 bp, Artificial Sequence
  dgRNA
  Cyp26c1
ggcccaatttggatg

SEQ ID NO: 18303 - DNA, 15 bp, Artificial Sequence
  dgRNA
  Cyp26c1
tttttaacggacatc

SEQ ID NO: 18304 - DNA, 15 bp, Artificial Sequence
  dgRNA
  Cyp26c1
atattatctctggct

SEQ ID NO: 18305 - DNA, 15 bp, Artificial Sequence
  dgRNA
  Tctn1
cttccgattttctga

SEQ ID NO: 18306 - DNA, 15 bp, Artificial Sequence
  dgRNA
  Tctn1
tctccgattccgccc

SEQ ID NO: 18307 - DNA, 15 bp, Artificial Sequence
  dgRNA
  Tctn1
ctcccgccccattcg

SEQ ID NO: 18308 - DNA, 15 bp, Artificial Sequence
  dgRNA
  Tctn1
tcccgccccattcgc

SEQ ID NO: 18309 - DNA, 15 bp, Artificial Sequence
  dgRNA
  Extl2
atggtccatttcagg

SEQ ID NO: 18310 - DNA, 15 bp, Artificial Sequence
  dgRNA
  Extl2
agatacaagcctgtt

SEQ ID NO: 18311 - DNA, 15 bp, Artificial Sequence
  dgRNA
  Extl2
acaagcctgttgggt

SEQ ID NO: 18312 - DNA, 15 bp, Artificial Sequence
  dgRNA
  Extl2
ttagacaaggtcagc

SEQ ID NO: 18313 - DNA, 15 bp, Artificial Sequence
  dgRNA
  Tulp3
cttccgacccaaccc

SEQ ID NO: 18314 - DNA, 15 bp, Artificial Sequence
  dgRNA
  Tulp3
ttccgacccaacccc

SEQ ID NO: 18315 - DNA, 15 bp, Artificial Sequence
  dgRNA
  Tulp3
tccgacccaaccccg

SEQ ID NO: 18316 - DNA, 15 bp, Artificial Sequence
  dgRNA
  Tulp3
ccgacccaaccccgg

SEQ ID NO: 18317 - DNA, 15 bp, Artificial Sequence
  dgRNA
  Calu
agagtccccacgggc

SEQ ID NO: 18318 - DNA, 15 bp, Artificial Sequence
  dgRNA
  Calu
gagtccccacgggct

SEQ ID NO: 18319 - DNA, 15 bp, Artificial Sequence
  dgRNA
  Calu
ctgggcaacccgagc

SEQ ID NO: 18320 - DNA, 15 bp, Artificial Sequence
  dgRNA
  Calu
tgggcaacccgagct

SEQ ID NO: 18321 - DNA, 15 bp, Artificial Sequence
  dgRNA
  Acvr2a
gccgtcccgtctgct

SEQ ID NO: 18322 - DNA, 15 bp, Artificial Sequence
  dgRNA
  Acvr2a
ccgtctgctcggtct

SEQ ID NO: 18323 - DNA, 15 bp, Artificial Sequence
  dgRNA
  Acvr2a
ctcgcgagcgcgctc

SEQ ID NO: 18324 - DNA, 15 bp, Artificial Sequence
  dgRNA
  Acvr2a
agcgcgctccggatc

SEQ ID NO: 18325 - DNA, 15 bp, Artificial Sequence
  dgRNA
  Ccnc
agagcctctcgccac

SEQ ID NO: 18326 - DNA, 15 bp, Artificial Sequence
  dgRNA
  Ccnc
gagcctctcgccacc

SEQ ID NO: 18327 - DNA, 15 bp, Artificial Sequence
  dgRNA
  Ccnc
cctcaacaagcccat

SEQ ID NO: 18328 - DNA, 15 bp, Artificial Sequence
  dgRNA
  Ccnc
caacaagcccattgg

SEQ ID NO: 18329 - DNA, 15 bp, Artificial Sequence
  dgRNA
  4930522H14Rik
atgagttgcttcgaa

SEQ ID NO: 18330 - DNA, 15 bp, Artificial Sequence
  dgRNA
  4930522H14Rik
tttcgaagcaactca

SEQ ID NO: 18331 - DNA, 15 bp, Artificial Sequence
  dgRNA
  4930522H14Rik
ggtgcggtctacagt

SEQ ID NO: 18332 - DNA, 15 bp, Artificial Sequence
  dgRNA
  Knop1
acgcaactctctgac

SEQ ID NO: 18333 - DNA, 15 bp, Artificial Sequence
  dgRNA
  Knop1
cgcaactctctgacc

SEQ ID NO: 18334 - DNA, 15 bp, Artificial Sequence
  dgRNA
  Knop1
ctctttctccgcgtg

SEQ ID NO: 18335 - DNA, 15 bp, Artificial Sequence
  dgRNA
  Knop1
tctttctccgcgtgt

SEQ ID NO: 18336 - DNA, 15 bp, Artificial Sequence
  dgRNA
  Ghrl
caactgtcccgactt

SEQ ID NO: 18337 - DNA, 15 bp, Artificial Sequence
  dgRNA
  Ghrl
aaggcttcctatata

SEQ ID NO: 18338 - DNA, 15 bp, Artificial Sequence
  dgRNA
  Ghrl
tcgggacagttggct

SEQ ID NO: 18339 - DNA, 15 bp, Artificial Sequence
  dgRNA
  Ghrl
caaagtcgggacagt

SEQ ID NO: 18340 - DNA, 15 bp, Artificial Sequence
  dgRNA
  Carm1
cagcgaccgttcccg

SEQ ID NO: 18341 - DNA, 15 bp, Artificial Sequence
  dgRNA
  Carm1
agcgaccgttcccgc

SEQ ID NO: 18342 - DNA, 15 bp, Artificial Sequence
  dgRNA
  Carm1
gcgaccgttcccgcg

SEQ ID NO: 18343 - DNA, 15 bp, Artificial Sequence
  dgRNA
  Carm1
accgttcccgcgggg

SEQ ID NO: 18344 - DNA, 15 bp, Artificial Sequence
  dgRNA
  Fis1
cccctggtactcatt

SEQ ID NO: 18345 - DNA, 15 bp, Artificial Sequence
  dgRNA
  Fis1
attgaagataatcca

SEQ ID NO: 18346 - DNA, 15 bp, Artificial Sequence
  dgRNA
  Fis1
cagggtcctagagtg

SEQ ID NO: 18347 - DNA, 15 bp, Artificial Sequence
  dgRNA
  Fis1
gaggggttcttacac

SEQ ID NO: 18348 - DNA, 15 bp, Artificial Sequence
  dgRNA
  Gtpbp6
ccaagtttttcgctg

SEQ ID NO: 18349 - DNA, 15 bp, Artificial Sequence
  dgRNA
  Gtpbp6
caagtttttcgctgc

SEQ ID NO: 18350 - DNA, 15 bp, Artificial Sequence
  dgRNA
  Gtpbp6
cagagccacccttcg

SEQ ID NO: 18351 - DNA, 15 bp, Artificial Sequence
  dgRNA
  Gtpbp6
atgcggcgaggggcg

SEQ ID NO: 18352 - DNA, 15 bp, Artificial Sequence
  dgRNA
  Smim8
cggacccctgctcta

SEQ ID NO: 18353 - DNA, 15 bp, Artificial Sequence
  dgRNA
  Smim8
ctgctctacggcctc

SEQ ID NO: 18354 - DNA, 15 bp, Artificial Sequence
  dgRNA
  Smim8
cctccggagcataga

SEQ ID NO: 18355 - DNA, 15 bp, Artificial Sequence
  dgRNA
  Smim8
gcatagatggcgctg

SEQ ID NO: 18356 - DNA, 15 bp, Artificial Sequence
  dgRNA
  Bclaf1
ggctacactcaaccg

SEQ ID NO: 18357 - DNA, 15 bp, Artificial Sequence
  dgRNA
  Bclaf1
ttcgccagtcgcgcc

SEQ ID NO: 18358 - DNA, 15 bp, Artificial Sequence
  dgRNA
  Bclaf1
tcgccagtcgcgcct

SEQ ID NO: 18359 - DNA, 15 bp, Artificial Sequence
  dgRNA
  Bclaf1
ccagtcgcgcctggg

SEQ ID NO: 18360 - DNA, 15 bp, Artificial Sequence
  dgRNA
  Acot3
ctagggacttcttat

SEQ ID NO: 18361 - DNA, 15 bp, Artificial Sequence
  dgRNA
  Acot3
agtggaccaacactg

SEQ ID NO: 18362 - DNA, 15 bp, Artificial Sequence
  dgRNA
  Acot3
tagattatctgagta

SEQ ID NO: 18363 - DNA, 15 bp, Artificial Sequence
  dgRNA
  Acot3
agattatctgagtat

SEQ ID NO: 18364 - DNA, 15 bp, Artificial Sequence
  dgRNA
  Maml3
cacacacgggtcaaa

SEQ ID NO: 18365 - DNA, 15 bp, Artificial Sequence
  dgRNA
  Maml3
cttcctggcaggtcg

SEQ ID NO: 18366 - DNA, 15 bp, Artificial Sequence
  dgRNA
  Maml3
gcgcccgctcccgcc

SEQ ID NO: 18367 - DNA, 15 bp, Artificial Sequence
  dgRNA
  Maml3
cgcccgctcccgcca

SEQ ID NO: 18368 - DNA, 15 bp, Artificial Sequence
  dgRNA
  Agpat2
gccgcgggacgagtg

SEQ ID NO: 18369 - DNA, 15 bp, Artificial Sequence
  dgRNA
  Agpat2
ccgcgggacgagtga

SEQ ID NO: 18370 - DNA, 15 bp, Artificial Sequence
  dgRNA
  Agpat2
caatgtcctgccgca

SEQ ID NO: 18371 - DNA, 15 bp, Artificial Sequence
  dgRNA
  Agpat2
aatgtcctgccgcaa

SEQ ID NO: 18372 - DNA, 15 bp, Artificial Sequence
  dgRNA
  Sh3tc1
aagtccacgggaggc

SEQ ID NO: 18373 - DNA, 15 bp, Artificial Sequence
  dgRNA
  Sh3tc1
ggggaagtccacggg

SEQ ID NO: 18374 - DNA, 15 bp, Artificial Sequence
  dgRNA
  Sh3tc1
attggggaagtccac

SEQ ID NO: 18375 - DNA, 15 bp, Artificial Sequence
  dgRNA
  Sh3tc1
ggccggggacaccct

SEQ ID NO: 18376 - DNA, 15 bp, Artificial Sequence
  dgRNA
  Rabl6
tcgaggcgaagctca

SEQ ID NO: 18377 - DNA, 15 bp, Artificial Sequence
  dgRNA
  Rabl6
cgaggcgaagctcaa

SEQ ID NO: 18378 - DNA, 15 bp, Artificial Sequence
  dgRNA
  Rabl6
aaaagtaaacctgtc

SEQ ID NO: 18379 - DNA, 15 bp, Artificial Sequence
  dgRNA
  Rabl6
aactacactagagga

SEQ ID NO: 18380 - DNA, 15 bp, Artificial Sequence
  dgRNA
  Zfp385b
ccacagtggagcgaa

SEQ ID NO: 18381 - DNA, 15 bp, Artificial Sequence
  dgRNA
  Zfp385b
cacagtggagcgaat

SEQ ID NO: 18382 - DNA, 15 bp, Artificial Sequence
  dgRNA
  Zfp385b
cagtggagcgaatgg

SEQ ID NO: 18383 - DNA, 15 bp, Artificial Sequence
  dgRNA
  Zfp385b
agcgaatgggggaat

SEQ ID NO: 18384 - DNA, 15 bp, Artificial Sequence
  dgRNA
  C1qtnf1
agtgtttccccctgg

SEQ ID NO: 18385 - DNA, 15 bp, Artificial Sequence
  dgRNA
  C1qtnf1
gggaaacacttaagg

SEQ ID NO: 18386 - DNA, 15 bp, Artificial Sequence
  dgRNA
  C1qtnf1
agggggaaacactta

SEQ ID NO: 18387 - DNA, 15 bp, Artificial Sequence
  dgRNA
  C1qtnf1
taggctaggtcagga

SEQ ID NO: 18388 - DNA, 15 bp, Artificial Sequence
  dgRNA
  Acvrl1
agaacggacctatct

SEQ ID NO: 18389 - DNA, 15 bp, Artificial Sequence
  dgRNA
  Acvrl1
ggtttctttagcccg

SEQ ID NO: 18390 - DNA, 15 bp, Artificial Sequence
  dgRNA
  Acvrl1
actgtggacaacgga

SEQ ID NO: 18391 - DNA, 15 bp, Artificial Sequence
  dgRNA
  Acvrl1
ctgtggacaacggaa

SEQ ID NO: 18392 - DNA, 15 bp, Artificial Sequence
  dgRNA
  Slc30a4
gcgaccacgccccct

SEQ ID NO: 18393 - DNA, 15 bp, Artificial Sequence
  dgRNA
  Slc30a4
cggcgcgcccccaag

SEQ ID NO: 18394 - DNA, 15 bp, Artificial Sequence
  dgRNA
  Slc30a4
cgcgcccccaagcgg

SEQ ID NO: 18395 - DNA, 15 bp, Artificial Sequence
  dgRNA
  Slc30a4
tcccctcgcgcctcg

SEQ ID NO: 18396 - DNA, 15 bp, Artificial Sequence
  dgRNA
  Spns1
actatctcgtgaaat

SEQ ID NO: 18397 - DNA, 15 bp, Artificial Sequence
  dgRNA
  Spns1
gtgaaatcggataaa

SEQ ID NO: 18398 - DNA, 15 bp, Artificial Sequence
  dgRNA
  Spns1
tgaaatcggataaat

SEQ ID NO: 18399 - DNA, 15 bp, Artificial Sequence
  dgRNA
  Spns1
ttacaccagcttgcg

SEQ ID NO: 18400 - DNA, 15 bp, Artificial Sequence
  dgRNA
  Rnf207
gcaacactttgagga

SEQ ID NO: 18401 - DNA, 15 bp, Artificial Sequence
  dgRNA
  Rnf207
cgccatcctcactcc

SEQ ID NO: 18402 - DNA, 15 bp, Artificial Sequence
  dgRNA
  Rnf207
cccagaggacgtcgt

SEQ ID NO: 18403 - DNA, 15 bp, Artificial Sequence
  dgRNA
  Rnf207
ccagaggacgtcgta

SEQ ID NO: 18404 - DNA, 15 bp, Artificial Sequence
  dgRNA
  Crls1
ctctactcactagtc

SEQ ID NO: 18405 - DNA, 15 bp, Artificial Sequence
  dgRNA
  Crls1
ggtcttcctaacctg

SEQ ID NO: 18406 - DNA, 15 bp, Artificial Sequence
  dgRNA
  Crls1
gtcttcctaacctgc

SEQ ID NO: 18407 - DNA, 15 bp, Artificial Sequence
  dgRNA
  Crls1
ctcgccgctgccgcg

SEQ ID NO: 18408 - DNA, 15 bp, Artificial Sequence
  dgRNA
  Trim71
aaggtcgtcacactg

SEQ ID NO: 18409 - DNA, 15 bp, Artificial Sequence
  dgRNA
  Trim71
cgtcacactgaggcc

SEQ ID NO: 18410 - DNA, 15 bp, Artificial Sequence
  dgRNA
  Trim71
cgatcgtctcccccg

SEQ ID NO: 18411 - DNA, 15 bp, Artificial Sequence
  dgRNA
  Trim71
cgtctcccccgcggc

SEQ ID NO: 18412 - DNA, 15 bp, Artificial Sequence
  dgRNA
  Ttyh2
acgcaccatcaaacc

SEQ ID NO: 18413 - DNA, 15 bp, Artificial Sequence
  dgRNA
  Ttyh2
cgcaccatcaaacct

SEQ ID NO: 18414 - DNA, 15 bp, Artificial Sequence
  dgRNA
  Ttyh2
ttgatagcaaggatc

SEQ ID NO: 18415 - DNA, 15 bp, Artificial Sequence
  dgRNA
  Ttyh2
tttgagcccaatttc

SEQ ID NO: 18416 - DNA, 15 bp, Artificial Sequence
  dgRNA
  Iqub
agaactcccggagaa

SEQ ID NO: 18417 - DNA, 15 bp, Artificial Sequence
  dgRNA
  Iqub
aacaatctctacttc

SEQ ID NO: 18418 - DNA, 15 bp, Artificial Sequence
  dgRNA
  Iqub
tcctttcccactgcg

SEQ ID NO: 18419 - DNA, 15 bp, Artificial Sequence
  dgRNA
  Iqub
ctttcccactgcgcg

SEQ ID NO: 18420 - DNA, 15 bp, Artificial Sequence
  dgRNA
  Pigp
cagccgcagacccag

SEQ ID NO: 18421 - DNA, 15 bp, Artificial Sequence
  dgRNA
  Pigp
gcgtccccgagcgct

SEQ ID NO: 18422 - DNA, 15 bp, Artificial Sequence
  dgRNA
  Pigp
cgagcgctcggaacg

SEQ ID NO: 18423 - DNA, 15 bp, Artificial Sequence
  dgRNA
  Pigp
gagcgctcggaacgc

SEQ ID NO: 18424 - DNA, 15 bp, Artificial Sequence
  dgRNA
  Zfp422
aagagagcgggtaac

SEQ ID NO: 18425 - DNA, 15 bp, Artificial Sequence
  dgRNA
  Zfp422
gggtaacaggcctta

SEQ ID NO: 18426 - DNA, 15 bp, Artificial Sequence
  dgRNA
  Zfp422
aggccttaaggtcct

SEQ ID NO: 18427 - DNA, 15 bp, Artificial Sequence
  dgRNA
  Zfp422
accggaagaatccgc

SEQ ID NO: 18428 - DNA, 15 bp, Artificial Sequence
  dgRNA
  Mgat4d
ggaccacgatgtgcc

SEQ ID NO: 18429 - DNA, 15 bp, Artificial Sequence
  dgRNA
  Mgat4d
gaccacgatgtgcct

SEQ ID NO: 18430 - DNA, 15 bp, Artificial Sequence
  dgRNA
  Mgat4d
tgaggaccgtagcaa

SEQ ID NO: 18431 - DNA, 15 bp, Artificial Sequence
  dgRNA
  Mgat4d
gtagcaacggcccct

SEQ ID NO: 18432 - DNA, 15 bp, Artificial Sequence
  dgRNA
  Myoc
ctatccccccatggc

SEQ ID NO: 18433 - DNA, 15 bp, Artificial Sequence
  dgRNA
  Myoc
aaaacaaagtgccgg

SEQ ID NO: 18434 - DNA, 15 bp, Artificial Sequence
  dgRNA
  Myoc
tggaccagccatggg

SEQ ID NO: 18435 - DNA, 15 bp, Artificial Sequence
  dgRNA
  Myoc
gttggaccagccatg

SEQ ID NO: 18436 - DNA, 15 bp, Artificial Sequence
  dgRNA
  Adgrg6
tgaaagttcttcgcc

SEQ ID NO: 18437 - DNA, 15 bp, Artificial Sequence
  dgRNA
  Adgrg6
gaaagttcttcgccc

SEQ ID NO: 18438 - DNA, 15 bp, Artificial Sequence
  dgRNA
  Adgrg6
agttcttcgcccggg

SEQ ID NO: 18439 - DNA, 15 bp, Artificial Sequence
  dgRNA
  Adgrg6
cggcagaacctgccg

SEQ ID NO: 18440 - DNA, 15 bp, Artificial Sequence
  dgRNA
  Ano6
tgcagcgctccccgc

SEQ ID NO: 18441 - DNA, 15 bp, Artificial Sequence
  dgRNA
  Ano6
cgctccccgcaggcg

SEQ ID NO: 18442 - DNA, 15 bp, Artificial Sequence
  dgRNA
  Ano6
ggctcctcgcagccg

SEQ ID NO: 18443 - DNA, 15 bp, Artificial Sequence
  dgRNA
  Ano6
tcctcgcagccgggg

SEQ ID NO: 18444 - DNA, 15 bp, Artificial Sequence
  dgRNA
  Tlr1
agagatgcaaccgga

SEQ ID NO: 18445 - DNA, 15 bp, Artificial Sequence
  dgRNA
  Tlr1
gtccccatctctcgc

SEQ ID NO: 18446 - DNA, 15 bp, Artificial Sequence
  dgRNA
  Tlr1
cgccggatgctgcgc

SEQ ID NO: 18447 - DNA, 15 bp, Artificial Sequence
  dgRNA
  Tlr1
gccggatgctgcgct

SEQ ID NO: 18448 - DNA, 15 bp, Artificial Sequence
  dgRNA
  Pdcd11
gaaccccaaactcgg

SEQ ID NO: 18449 - DNA, 15 bp, Artificial Sequence
  dgRNA
  Pdcd11
acctagcgacgagct

SEQ ID NO: 18450 - DNA, 15 bp, Artificial Sequence
  dgRNA
  Pdcd11
cgagctcggcccgac

SEQ ID NO: 18451 - DNA, 15 bp, Artificial Sequence
  dgRNA
  Pdcd11
ccgcacgcgaccgac

SEQ ID NO: 18452 - DNA, 15 bp, Artificial Sequence
  dgRNA
  Hadhb
actaagcgagccgaa

SEQ ID NO: 18453 - DNA, 15 bp, Artificial Sequence
  dgRNA
  Hadhb
gactaaggacctccg

SEQ ID NO: 18454 - DNA, 15 bp, Artificial Sequence
  dgRNA
  Hadhb
aggacctccgaggag

SEQ ID NO: 18455 - DNA, 15 bp, Artificial Sequence
  dgRNA
  Hadhb
ggacctccgaggaga

SEQ ID NO: 18456 - DNA, 15 bp, Artificial Sequence
  dgRNA
  Itih1
ggcacctaccaacaa

SEQ ID NO: 18457 - DNA, 15 bp, Artificial Sequence
  dgRNA
  Itih1
ttaactaacagtctg

SEQ ID NO: 18458 - DNA, 15 bp, Artificial Sequence
  dgRNA
  Itih1
taactaacagtctga

SEQ ID NO: 18459 - DNA, 15 bp, Artificial Sequence
  dgRNA
  Itih1
ggatttaattcctag

SEQ ID NO: 18460 - DNA, 15 bp, Artificial Sequence
  dgRNA
  Ttc13
cctgcttccggccgc

SEQ ID NO: 18461 - DNA, 15 bp, Artificial Sequence
  dgRNA
  Ttc13
ctggcggaagacgcc

SEQ ID NO: 18462 - DNA, 15 bp, Artificial Sequence
  dgRNA
  Ttc13
ggaagacgcctggac

SEQ ID NO: 18463 - DNA, 15 bp, Artificial Sequence
  dgRNA
  Ttc13
cgcctggactggcct

SEQ ID NO: 18464 - DNA, 15 bp, Artificial Sequence
  dgRNA
  Hykk
gagccgagattgaca

SEQ ID NO: 18465 - DNA, 15 bp, Artificial Sequence
  dgRNA
  Hykk
tctgaactctattgg

SEQ ID NO: 18466 - DNA, 15 bp, Artificial Sequence
  dgRNA
  Hykk
gtagtgtgtactgac

SEQ ID NO: 18467 - DNA, 15 bp, Artificial Sequence
  dgRNA
  Hykk
tagtgtgtactgact

SEQ ID NO: 18468 - DNA, 15 bp, Artificial Sequence
  dgRNA
  Dll1
tggcgatccattgag

SEQ ID NO: 18469 - DNA, 15 bp, Artificial Sequence
  dgRNA
  Dll1
cgatccattgagagg

SEQ ID NO: 18470 - DNA, 15 bp, Artificial Sequence
  dgRNA
  Dll1
cagctctcgccagat

SEQ ID NO: 18471 - DNA, 15 bp, Artificial Sequence
  dgRNA
  Dll1
agctctcgccagatt

SEQ ID NO: 18472 - DNA, 15 bp, Artificial Sequence
  dgRNA
  Sypl
cgtcagcggttcagc

SEQ ID NO: 18473 - DNA, 15 bp, Artificial Sequence
  dgRNA
  Sypl
tcagccggctgagtc

SEQ ID NO: 18474 - DNA, 15 bp, Artificial Sequence
  dgRNA
  Sypl
cggctgagtcaggtg

SEQ ID NO: 18475 - DNA, 15 bp, Artificial Sequence
  dgRNA
  Sypl
tgagtcaggtgcggc

SEQ ID NO: 18476 - DNA, 15 bp, Artificial Sequence
  dgRNA
  Mamstr
ccctcgaagtgagcc

SEQ ID NO: 18477 - DNA, 15 bp, Artificial Sequence
  dgRNA
  Mamstr
cgaagtgagccaggc

SEQ ID NO: 18478 - DNA, 15 bp, Artificial Sequence
  dgRNA
  Mamstr
gtcccgccccttttc

SEQ ID NO: 18479 - DNA, 15 bp, Artificial Sequence
  dgRNA
  Mamstr
tcccgccccttttct

SEQ ID NO: 18480 - DNA, 15 bp, Artificial Sequence
  dgRNA
  H2-M10.3
agaactggtgcaagt

SEQ ID NO: 18481 - DNA, 15 bp, Artificial Sequence
  dgRNA
  H2-M10.3
gaactggtgcaagtt

SEQ ID NO: 18482 - DNA, 15 bp, Artificial Sequence
  dgRNA
  H2-M10.3
aactggtgcaagttg

SEQ ID NO: 18483 - DNA, 15 bp, Artificial Sequence
  dgRNA
  H2-M10.3
actggtgcaagttgg

SEQ ID NO: 18484 - DNA, 15 bp, Artificial Sequence
  dgRNA
  Pmpca
ccgtcgggaaccaca

SEQ ID NO: 18485 - DNA, 15 bp, Artificial Sequence
  dgRNA
  Pmpca
ccgcgtccgcgatag

SEQ ID NO: 18486 - DNA, 15 bp, Artificial Sequence
  dgRNA
  Pmpca
cgcgtccgcgataga

SEQ ID NO: 18487 - DNA, 15 bp, Artificial Sequence
  dgRNA
  Pmpca
gcgtccgcgatagag

SEQ ID NO: 18488 - DNA, 15 bp, Artificial Sequence
  dgRNA
  Mcm5
atcatcttgggaacc

SEQ ID NO: 18489 - DNA, 15 bp, Artificial Sequence
  dgRNA
  Mcm5
gaggcgggactcaac

SEQ ID NO: 18490 - DNA, 15 bp, Artificial Sequence
  dgRNA
  Mcm5
tccaatagctatccg

SEQ ID NO: 18491 - DNA, 15 bp, Artificial Sequence
  dgRNA
  Mcm5
gctgaacgaaccaat

SEQ ID NO: 18492 - DNA, 15 bp, Artificial Sequence
  dgRNA
  Atp6ap1l
gatggagccattgtc

SEQ ID NO: 18493 - DNA, 15 bp, Artificial Sequence
  dgRNA
  Atp6ap1l
cccaatagtgcatcc

SEQ ID NO: 18494 - DNA, 15 bp, Artificial Sequence
  dgRNA
  Atp6ap1l
ccaatagtgcatcct

SEQ ID NO: 18495 - DNA, 15 bp, Artificial Sequence
  dgRNA
  Atp6ap1l
aagctatttttgtat

SEQ ID NO: 18496 - DNA, 15 bp, Artificial Sequence
  dgRNA
  Gtf3c4
tctccgcgtgtctgc

SEQ ID NO: 18497 - DNA, 15 bp, Artificial Sequence
  dgRNA
  Gtf3c4
tctgcaggcgcgcct

SEQ ID NO: 18498 - DNA, 15 bp, Artificial Sequence
  dgRNA
  Gtf3c4
ctgcaggcgcgcctc

SEQ ID NO: 18499 - DNA, 15 bp, Artificial Sequence
  dgRNA
  Gtf3c4
tcgggtcagccctac

SEQ ID NO: 18500 - DNA, 15 bp, Artificial Sequence
  dgRNA
  Mrpl44
acaagcgagactgat

SEQ ID NO: 18501 - DNA, 15 bp, Artificial Sequence
  dgRNA
  Mrpl44
caagcgagactgata

SEQ ID NO: 18502 - DNA, 15 bp, Artificial Sequence
  dgRNA
  Mrpl44
ccatacttacagaat

SEQ ID NO: 18503 - DNA, 15 bp, Artificial Sequence
  dgRNA
  Mrpl44
cccattctgtaagta

SEQ ID NO: 18504 - DNA, 15 bp, Artificial Sequence
  dgRNA
  B230118H07Rik
cctcctgcccccgtt

SEQ ID NO: 18505 - DNA, 15 bp, Artificial Sequence
  dgRNA
  B230118H07Rik
gacactactttattg

SEQ ID NO: 18506 - DNA, 15 bp, Artificial Sequence
  dgRNA
  B230118H07Rik
ttggacctattttag

SEQ ID NO: 18507 - DNA, 15 bp, Artificial Sequence
  dgRNA
  B230118H07Rik
gacctattttagtgg

SEQ ID NO: 18508 - DNA, 15 bp, Artificial Sequence
  dgRNA
  Rbmxl1
aagctatattgacgg

SEQ ID NO: 18509 - DNA, 15 bp, Artificial Sequence
  dgRNA
  Rbmxl1
acccgcggcgtgcgc

SEQ ID NO: 18510 - DNA, 15 bp, Artificial Sequence
  dgRNA
  Rbmxl1
cccgcggcgtgcgct

SEQ ID NO: 18511 - DNA, 15 bp, Artificial Sequence
  dgRNA
  Rbmxl1
cggcgtgcgctgggc

SEQ ID NO: 18512 - DNA, 15 bp, Artificial Sequence
  dgRNA
  Mrpl18
tctgagaccgtttaa

SEQ ID NO: 18513 - DNA, 15 bp, Artificial Sequence
  dgRNA
  Mrpl18
gtttaacggccacca

SEQ ID NO: 18514 - DNA, 15 bp, Artificial Sequence
  dgRNA
  Mrpl18
taacggccaccacgg

SEQ ID NO: 18515 - DNA, 15 bp, Artificial Sequence
  dgRNA
  Mrpl18
acggccaccacggcg

SEQ ID NO: 18516 - DNA, 15 bp, Artificial Sequence
  dgRNA
  Thnsl1
tttcctcggtacatc

SEQ ID NO: 18517 - DNA, 15 bp, Artificial Sequence
  dgRNA
  Thnsl1
tctacaatagggagc

SEQ ID NO: 18518 - DNA, 15 bp, Artificial Sequence
  dgRNA
  Thnsl1
tagtttccaacattc

SEQ ID NO: 18519 - DNA, 15 bp, Artificial Sequence
  dgRNA
  Thnsl1
caggccgcgcccctg

SEQ ID NO: 18520 - DNA, 15 bp, Artificial Sequence
  dgRNA
  Rasl12
caaggagtgcaaccc

SEQ ID NO: 18521 - DNA, 15 bp, Artificial Sequence
  dgRNA
  Rasl12
tgcaaccctggttgc

SEQ ID NO: 18522 - DNA, 15 bp, Artificial Sequence
  dgRNA
  Rasl12
gcaaccctggttgca

SEQ ID NO: 18523 - DNA, 15 bp, Artificial Sequence
  dgRNA
  Rasl12
ggttgcagggtgctc

SEQ ID NO: 18524 - DNA, 15 bp, Artificial Sequence
  dgRNA
  Epb41
gcggggagcccgaac

SEQ ID NO: 18525 - DNA, 15 bp, Artificial Sequence
  dgRNA
  Epb41
cggggagcccgaaca

SEQ ID NO: 18526 - DNA, 15 bp, Artificial Sequence
  dgRNA
  Epb41
cctcagccaatgctc

SEQ ID NO: 18527 - DNA, 15 bp, Artificial Sequence
  dgRNA
  Epb41
agccaatgctctggc

SEQ ID NO: 18528 - DNA, 15 bp, Artificial Sequence
  dgRNA
  Lrrfip1
gaggcgggcataggg

SEQ ID NO: 18529 - DNA, 15 bp, Artificial Sequence
  dgRNA
  Lrrfip1
aggcgggcatagggt

SEQ ID NO: 18530 - DNA, 15 bp, Artificial Sequence
  dgRNA
  Lrrfip1
cgggcatagggtggg

SEQ ID NO: 18531 - DNA, 15 bp, Artificial Sequence
  dgRNA
  Lrrfip1
cgcgctctttccagg

SEQ ID NO: 18532 - DNA, 15 bp, Artificial Sequence
  dgRNA
  Homer3
cagccccagacttta

SEQ ID NO: 18533 - DNA, 15 bp, Artificial Sequence
  dgRNA
  Homer3
caaagacagcggggt

SEQ ID NO: 18534 - DNA, 15 bp, Artificial Sequence
  dgRNA
  Homer3
cggacaaagacagcg

SEQ ID NO: 18535 - DNA, 15 bp, Artificial Sequence
  dgRNA
  Homer3
gcggacaaagacagc

SEQ ID NO: 18536 - DNA, 15 bp, Artificial Sequence
  dgRNA
  Cyp7a1
ccaagttcaagttat

SEQ ID NO: 18537 - DNA, 15 bp, Artificial Sequence
  dgRNA
  Cyp7a1
caagttattggatca

SEQ ID NO: 18538 - DNA, 15 bp, Artificial Sequence
  dgRNA
  Cyp7a1
tagtcgataagccga

SEQ ID NO: 18539 - DNA, 15 bp, Artificial Sequence
  dgRNA
  Cyp7a1
ccaataacttgaact

SEQ ID NO: 18540 - DNA, 15 bp, Artificial Sequence
  dgRNA
  Ahsa2
gcggagccttaggac

SEQ ID NO: 18541 - DNA, 15 bp, Artificial Sequence
  dgRNA
  Ahsa2
cggagccttaggacc

SEQ ID NO: 18542 - DNA, 15 bp, Artificial Sequence
  dgRNA
  Ahsa2
ggagccttaggaccg

SEQ ID NO: 18543 - DNA, 15 bp, Artificial Sequence
  dgRNA
  Ahsa2
gagccttaggaccgg

SEQ ID NO: 18544 - DNA, 15 bp, Artificial Sequence
  dgRNA
  Stambpl1
aggtggtccaaccta

SEQ ID NO: 18545 - DNA, 15 bp, Artificial Sequence
  dgRNA
  Stambpl1
gggcaacgagtatgc

SEQ ID NO: 18546 - DNA, 15 bp, Artificial Sequence
  dgRNA
  Stambpl1
agtatgcaggtagac

SEQ ID NO: 18547 - DNA, 15 bp, Artificial Sequence
  dgRNA
  Stambpl1
tatgcaggtagaccg

SEQ ID NO: 18548 - DNA, 15 bp, Artificial Sequence
  dgRNA
  Foxp1
ggcggggccgagcgt

SEQ ID NO: 18549 - DNA, 15 bp, Artificial Sequence
  dgRNA
  Foxp1
ttcacctgccgcgcg

SEQ ID NO: 18550 - DNA, 15 bp, Artificial Sequence
  dgRNA
  Foxp1
acctgccgcgcgcgg

SEQ ID NO: 18551 - DNA, 15 bp, Artificial Sequence
  dgRNA
  Foxp1
cctgccgcgcgcgga

SEQ ID NO: 18552 - DNA, 15 bp, Artificial Sequence
  dgRNA
  Arhgef40
gcgaggcttgtggcc

SEQ ID NO: 18553 - DNA, 15 bp, Artificial Sequence
  dgRNA
  Arhgef40
gttgggggggcttct

SEQ ID NO: 18554 - DNA, 15 bp, Artificial Sequence
  dgRNA
  Arhgef40
gggggcttctcggct

SEQ ID NO: 18555 - DNA, 15 bp, Artificial Sequence
  dgRNA
  Arhgef40
ggggcttctcggctg

SEQ ID NO: 18556 - DNA, 15 bp, Artificial Sequence
  dgRNA
  Fasn
acgaccgcgcttgcg

SEQ ID NO: 18557 - DNA, 15 bp, Artificial Sequence
  dgRNA
  Fasn
cgaccgcgcttgcgc

SEQ ID NO: 18558 - DNA, 15 bp, Artificial Sequence
  dgRNA
  Fasn
gaccgcgcttgcgcg

SEQ ID NO: 18559 - DNA, 15 bp, Artificial Sequence
  dgRNA
  Fasn
accgcgcttgcgcgg

SEQ ID NO: 18560 - DNA, 15 bp, Artificial Sequence
  dgRNA
  10-Mar
cgttcccacggcaac

SEQ ID NO: 18561 - DNA, 15 bp, Artificial Sequence
  dgRNA
  10-Mar
agagccgcccacgtg

SEQ ID NO: 18562 - DNA, 15 bp, Artificial Sequence
  dgRNA
  10-Mar
gactcaggacccccg

SEQ ID NO: 18563 - DNA, 15 bp, Artificial Sequence
  dgRNA
  10-Mar
ttccctcgcgactag

SEQ ID NO: 18564 - DNA, 15 bp, Artificial Sequence
  dgRNA
  B3gnt3
ggtaaatctggacgc

SEQ ID NO: 18565 - DNA, 15 bp, Artificial Sequence
  dgRNA
  B3gnt3
gtaaatctggacgca

SEQ ID NO: 18566 - DNA, 15 bp, Artificial Sequence
  dgRNA
  B3gnt3
aatctggacgcaggg

SEQ ID NO: 18567 - DNA, 15 bp, Artificial Sequence
  dgRNA
  B3gnt3
cagggtggcgcctag

SEQ ID NO: 18568 - DNA, 15 bp, Artificial Sequence
  dgRNA
  Spaca3
catcttatgactgaa

SEQ ID NO: 18569 - DNA, 15 bp, Artificial Sequence
  dgRNA
  Spaca3
tccgtgagtgagagc

SEQ ID NO: 18570 - DNA, 15 bp, Artificial Sequence
  dgRNA
  Spaca3
ggacgatgagctcac

SEQ ID NO: 18571 - DNA, 15 bp, Artificial Sequence
  dgRNA
  Spaca3
gacgatgagctcaca

SEQ ID NO: 18572 - DNA, 15 bp, Artificial Sequence
  dgRNA
  Asap1
cgcccgccgctccgc

SEQ ID NO: 18573 - DNA, 15 bp, Artificial Sequence
  dgRNA
  Asap1
agcgagcgccccagt

SEQ ID NO: 18574 - DNA, 15 bp, Artificial Sequence
  dgRNA
  Asap1
gcttgtcagcgccac

SEQ ID NO: 18575 - DNA, 15 bp, Artificial Sequence
  dgRNA
  Asap1
tcagcgccaccggag

SEQ ID NO: 18576 - DNA, 15 bp, Artificial Sequence
  dgRNA
  Bcam
agctcgaggcttgac

SEQ ID NO: 18577 - DNA, 15 bp, Artificial Sequence
  dgRNA
  Bcam
tcgaggcttgactgg

SEQ ID NO: 18578 - DNA, 15 bp, Artificial Sequence
  dgRNA
  Bcam
cgaggcttgactgga

SEQ ID NO: 18579 - DNA, 15 bp, Artificial Sequence
  dgRNA
  Bcam
gcttgactggagggt

SEQ ID NO: 18580 - DNA, 15 bp, Artificial Sequence
  dgRNA
  Cdhr2
acacagcgcagactt

SEQ ID NO: 18581 - DNA, 15 bp, Artificial Sequence
  dgRNA
  St7l
cggcgcgaggcaggc

SEQ ID NO: 18582 - DNA, 15 bp, Artificial Sequence
  dgRNA
  St7l
ggcgcgaggcaggcc

SEQ ID NO: 18583 - DNA, 15 bp, Artificial Sequence
  dgRNA
  St7l
gtggcggaatcaccg

SEQ ID NO: 18584 - DNA, 15 bp, Artificial Sequence
  dgRNA
  St7l
tggcggaatcaccga

SEQ ID NO: 18585 - DNA, 15 bp, Artificial Sequence
  dgRNA
  Gtf3c6
ccacgttcttcaaag

SEQ ID NO: 18586 - DNA, 15 bp, Artificial Sequence
  dgRNA
  Gtf3c6
cacgttcttcaaagt

SEQ ID NO: 18587 - DNA, 15 bp, Artificial Sequence
  dgRNA
  Gtf3c6
acgttcttcaaagtg

SEQ ID NO: 18588 - DNA, 15 bp, Artificial Sequence
  dgRNA
  Gtf3c6
taaattcccgaagct

SEQ ID NO: 18589 - DNA, 15 bp, Artificial Sequence
  dgRNA
  Rab1b
ccagaaggccgttcg

SEQ ID NO: 18590 - DNA, 15 bp, Artificial Sequence
  dgRNA
  Rab1b
cagaaggccgttcgc

SEQ ID NO: 18591 - DNA, 15 bp, Artificial Sequence
  dgRNA
  Rab1b
aaggccgttcgcggg

SEQ ID NO: 18592 - DNA, 15 bp, Artificial Sequence
  dgRNA
  Rab1b
ttcgcgggtggcttc

SEQ ID NO: 18593 - DNA, 15 bp, Artificial Sequence
  dgRNA
  Thumpd2
gctcgctgtagtttc

SEQ ID NO: 18594 - DNA, 15 bp, Artificial Sequence
  dgRNA
  Thumpd2
ctcgctgtagtttcc

SEQ ID NO: 18595 - DNA, 15 bp, Artificial Sequence
  dgRNA
  Thumpd2
cgggacgccccatag

SEQ ID NO: 18596 - DNA, 15 bp, Artificial Sequence
  dgRNA
  Thumpd2
gggacgccccataga

SEQ ID NO: 18597 - DNA, 15 bp, Artificial Sequence
  dgRNA
  Zgpat
ctgctcagatcttgg

SEQ ID NO: 18598 - DNA, 15 bp, Artificial Sequence
  dgRNA
  Zgpat
gtgcctgacggaaca

SEQ ID NO: 18599 - DNA, 15 bp, Artificial Sequence
  dgRNA
  Zgpat
cggaacaaggagcga

SEQ ID NO: 18600 - DNA, 15 bp, Artificial Sequence
  dgRNA
  Zgpat
gcgaaggacggagca

SEQ ID NO: 18601 - DNA, 15 bp, Artificial Sequence
  dgRNA
  Nlk
ctgaagcttccggcc

SEQ ID NO: 18602 - DNA, 15 bp, Artificial Sequence
  dgRNA
  Nlk
tgaagcttccggcca

SEQ ID NO: 18603 - DNA, 15 bp, Artificial Sequence
  dgRNA
  Nlk
cttccggccagggat

SEQ ID NO: 18604 - DNA, 15 bp, Artificial Sequence
  dgRNA
  Nlk
ccggccagggattgg

SEQ ID NO: 18605 - DNA, 15 bp, Artificial Sequence
  dgRNA
  Als2
aagtgcgcccgccct

SEQ ID NO: 18606 - DNA, 15 bp, Artificial Sequence
  dgRNA
  Als2
ccgccctaggacgat

SEQ ID NO: 18607 - DNA, 15 bp, Artificial Sequence
  dgRNA
  Als2
agtcactgatgcgtt

SEQ ID NO: 18608 - DNA, 15 bp, Artificial Sequence
  dgRNA
  Als2
gtcggacgccgtcac

SEQ ID NO: 18609 - DNA, 15 bp, Artificial Sequence
  dgRNA
  Dmwd
agccaaccaaacgcg

SEQ ID NO: 18610 - DNA, 15 bp, Artificial Sequence
  dgRNA
  Dmwd
gccaaccaaacgcga

SEQ ID NO: 18611 - DNA, 15 bp, Artificial Sequence
  dgRNA
  Dmwd
cccgcctccggctct

SEQ ID NO: 18612 - DNA, 15 bp, Artificial Sequence
  dgRNA
  Dmwd
gggtgccaatcgtag

SEQ ID NO: 18613 - DNA, 15 bp, Artificial Sequence
  dgRNA
  Casp8
gggtttctgcgtgaa

SEQ ID NO: 18614 - DNA, 15 bp, Artificial Sequence
  dgRNA
  Casp8
tttctgcgtgaaagg

SEQ ID NO: 18615 - DNA, 15 bp, Artificial Sequence
  dgRNA
  Casp8
gcactctcggaggta

SEQ ID NO: 18616 - DNA, 15 bp, Artificial Sequence
  dgRNA
  Casp8
agcactctcggaggt

SEQ ID NO: 18617 - DNA, 15 bp, Artificial Sequence
  dgRNA
  Vav3
aggaagccgcgccga

SEQ ID NO: 18618 - DNA, 15 bp, Artificial Sequence
  dgRNA
  Vav3
ggaagccgcgccgat

SEQ ID NO: 18619 - DNA, 15 bp, Artificial Sequence
  dgRNA
  Vav3
cgatgggctaatccc

SEQ ID NO: 18620 - DNA, 15 bp, Artificial Sequence
  dgRNA
  Vav3
atccctggacgcccc

SEQ ID NO: 18621 - DNA, 15 bp, Artificial Sequence
  dgRNA
  Tbx20
actgtgcgtcttctc

SEQ ID NO: 18622 - DNA, 15 bp, Artificial Sequence
  dgRNA
  Tbx20
tctccggctctccac

SEQ ID NO: 18623 - DNA, 15 bp, Artificial Sequence
  dgRNA
  Tbx20
ctccggctctccacc

SEQ ID NO: 18624 - DNA, 15 bp, Artificial Sequence
  dgRNA
  Tbx20
ccaccgggagcgcag

SEQ ID NO: 18625 - DNA, 15 bp, Artificial Sequence
  dgRNA
  Vti1b
acgggatatgaagtc

SEQ ID NO: 18626 - DNA, 15 bp, Artificial Sequence
  dgRNA
  Vti1b
actgcgatgacagcg

SEQ ID NO: 18627 - DNA, 15 bp, Artificial Sequence
  dgRNA
  Vti1b
ctgcgatgacagcga

SEQ ID NO: 18628 - DNA, 15 bp, Artificial Sequence
  dgRNA
  Vti1b
tgcgatgacagcgag

SEQ ID NO: 18629 - DNA, 15 bp, Artificial Sequence
  dgRNA
  R3hdml
ctgagcccaacatta

SEQ ID NO: 18630 - DNA, 15 bp, Artificial Sequence
  dgRNA
  R3hdml
tgagcccaacattat

SEQ ID NO: 18631 - DNA, 15 bp, Artificial Sequence
  dgRNA
  R3hdml
ccaacattatgggat

SEQ ID NO: 18632 - DNA, 15 bp, Artificial Sequence
  dgRNA
  R3hdml
aggcatttggccaga

SEQ ID NO: 18633 - DNA, 15 bp, Artificial Sequence
  dgRNA
  Cwc27
cggagcacacgcggt

SEQ ID NO: 18634 - DNA, 15 bp, Artificial Sequence
  dgRNA
  Cwc27
cggtcggaaccattt

SEQ ID NO: 18635 - DNA, 15 bp, Artificial Sequence
  dgRNA
  Cwc27
catttcggcccgctt

SEQ ID NO: 18636 - DNA, 15 bp, Artificial Sequence
  dgRNA
  Cwc27
atttcggcccgcttc

SEQ ID NO: 18637 - DNA, 15 bp, Artificial Sequence
  dgRNA
  Rxfp2
ggtgcaagtcactcc

SEQ ID NO: 18638 - DNA, 15 bp, Artificial Sequence
  dgRNA
  Rxfp2
ggtgtaagaagggta

SEQ ID NO: 18639 - DNA, 15 bp, Artificial Sequence
  dgRNA
  Rxfp2
atcacggtgtaagaa

SEQ ID NO: 18640 - DNA, 15 bp, Artificial Sequence
  dgRNA
  Rxfp2
catcacggtgtaaga

SEQ ID NO: 18641 - DNA, 15 bp, Artificial Sequence
  dgRNA
  Speg
gggggcgacacaccg

SEQ ID NO: 18642 - DNA, 15 bp, Artificial Sequence
  dgRNA
  Speg
ggggcgacacaccgt

SEQ ID NO: 18643 - DNA, 15 bp, Artificial Sequence
  dgRNA
  Speg
gggcgacacaccgtg

SEQ ID NO: 18644 - DNA, 15 bp, Artificial Sequence
  dgRNA
  Speg
ggcgacacaccgtgg

SEQ ID NO: 18645 - DNA, 15 bp, Artificial Sequence
  dgRNA
  Nhej1
cttatgagtacctgt

SEQ ID NO: 18646 - DNA, 15 bp, Artificial Sequence
  dgRNA
  Nhej1
atgagtacctgttgg

SEQ ID NO: 18647 - DNA, 15 bp, Artificial Sequence
  dgRNA
  Ifitm5
ctgcccatgtggcgc

SEQ ID NO: 18648 - DNA, 15 bp, Artificial Sequence
  dgRNA
  Ifitm5
tgcccatgtggcgca

SEQ ID NO: 18649 - DNA, 15 bp, Artificial Sequence
  dgRNA
  Ifitm5
gcccatgtggcgcag

SEQ ID NO: 18650 - DNA, 15 bp, Artificial Sequence
  dgRNA
  Ifitm5
cgcaggggcctttga

SEQ ID NO: 18651 - DNA, 15 bp, Artificial Sequence
  dgRNA
  Btbd11
gcttgtgcagagtcg

SEQ ID NO: 18652 - DNA, 15 bp, Artificial Sequence
  dgRNA
  Btbd11
agagtcgaggccaga

SEQ ID NO: 18653 - DNA, 15 bp, Artificial Sequence
  dgRNA
  Btbd11
gagtcgaggccagaa

SEQ ID NO: 18654 - DNA, 15 bp, Artificial Sequence
  dgRNA
  Btbd11
atctggagtaatgcc

SEQ ID NO: 18655 - DNA, 15 bp, Artificial Sequence
  dgRNA
  Prlr
ggaccttttgcacgc

SEQ ID NO: 18656 - DNA, 15 bp, Artificial Sequence
  dgRNA
  Prlr
gacggagatagttgg

SEQ ID NO: 18657 - DNA, 15 bp, Artificial Sequence
  dgRNA
  Prlr
tgacggagatagttg

SEQ ID NO: 18658 - DNA, 15 bp, Artificial Sequence
  dgRNA
  Prlr
gtgacggagatagtt

SEQ ID NO: 18659 - DNA, 15 bp, Artificial Sequence
  dgRNA
  Cyp46a1
cgctctgggcgggaa

SEQ ID NO: 18660 - DNA, 15 bp, Artificial Sequence
  dgRNA
  Cyp46a1
tgggcgggaacggcg

SEQ ID NO: 18661 - DNA, 15 bp, Artificial Sequence
  dgRNA
  Cyp46a1
gcgggaacggcgtgg

SEQ ID NO: 18662 - DNA, 15 bp, Artificial Sequence
  dgRNA
  Cyp46a1
gaacggcgtggcggc

SEQ ID NO: 18663 - DNA, 15 bp, Artificial Sequence
  dgRNA
  Ino80
gaaccccggtccgcg

SEQ ID NO: 18664 - DNA, 15 bp, Artificial Sequence
  dgRNA
  Ino80
aaccccggtccgcgc

SEQ ID NO: 18665 - DNA, 15 bp, Artificial Sequence
  dgRNA
  Ino80
accccggtccgcgcg

SEQ ID NO: 18666 - DNA, 15 bp, Artificial Sequence
  dgRNA
  Ino80
gtccgcgcggggcgt

SEQ ID NO: 18667 - DNA, 15 bp, Artificial Sequence
  dgRNA
  Cs
tccattttgggccaa

SEQ ID NO: 18668 - DNA, 15 bp, Artificial Sequence
  dgRNA
  Cs
ttgggccaatggtcg

SEQ ID NO: 18669 - DNA, 15 bp, Artificial Sequence
  dgRNA
  Cs
gccaatggtcgaggc

SEQ ID NO: 18670 - DNA, 15 bp, Artificial Sequence
  dgRNA
  Cs
ccaatggtcgaggcc

SEQ ID NO: 18671 - DNA, 15 bp, Artificial Sequence
  dgRNA
  Klf6
aggcctttaatgaag

SEQ ID NO: 18672 - DNA, 15 bp, Artificial Sequence
  dgRNA
  Klf6
aggctcggtcacgcc

SEQ ID NO: 18673 - DNA, 15 bp, Artificial Sequence
  dgRNA
  Klf6
ctcggtcacgccagg

SEQ ID NO: 18674 - DNA, 15 bp, Artificial Sequence
  dgRNA
  Klf6
tcggtcacgccaggc

SEQ ID NO: 18675 - DNA, 15 bp, Artificial Sequence
  dgRNA
  Smad1
tttaggacgactgag

SEQ ID NO: 18676 - DNA, 15 bp, Artificial Sequence
  dgRNA
  Smad1
ttaggacgactgagt

SEQ ID NO: 18677 - DNA, 15 bp, Artificial Sequence
  dgRNA
  Smad1
actgagtgggctcga

SEQ ID NO: 18678 - DNA, 15 bp, Artificial Sequence
  dgRNA
  Smad1
atttgactggcagct

SEQ ID NO: 18679 - DNA, 15 bp, Artificial Sequence
  dgRNA
  Rab11fip3
catgggggcgtgatc

SEQ ID NO: 18680 - DNA, 15 bp, Artificial Sequence
  dgRNA
  Rab11fip3
cgtgatcaggttaca

SEQ ID NO: 18681 - DNA, 15 bp, Artificial Sequence
  dgRNA
  Rab11fip3
tgacgtcacgcgcga

SEQ ID NO: 18682 - DNA, 15 bp, Artificial Sequence
  dgRNA
  Rab11fip3
cgtcacgcgcgacgg

SEQ ID NO: 18683 - DNA, 15 bp, Artificial Sequence
  dgRNA
  Glra3
cccttgcttggtaag

SEQ ID NO: 18684 - DNA, 15 bp, Artificial Sequence
  dgRNA
  Glra3
cgcgctccgctccgt

SEQ ID NO: 18685 - DNA, 15 bp, Artificial Sequence
  dgRNA
  Glra3
gtgggatttatgcaa

SEQ ID NO: 18686 - DNA, 15 bp, Artificial Sequence
  dgRNA
  Glra3
ggatttatgcaaagg

SEQ ID NO: 18687 - DNA, 15 bp, Artificial Sequence
  dgRNA
  Dnajc2
ggaactgatgcgtct

SEQ ID NO: 18688 - DNA, 15 bp, Artificial Sequence
  dgRNA
  Dnajc2
ttccttcgagctcct

SEQ ID NO: 18689 - DNA, 15 bp, Artificial Sequence
  dgRNA
  Dnajc2
gtgagagcaagacgg

SEQ ID NO: 18690 - DNA, 15 bp, Artificial Sequence
  dgRNA
  Dnajc2
cacgtgagagcaaga

SEQ ID NO: 18691 - DNA, 15 bp, Artificial Sequence
  dgRNA
  Rab17
gaacacgcgattgcc

SEQ ID NO: 18692 - DNA, 15 bp, Artificial Sequence
  dgRNA
  Rab17
aacacgcgattgcct

SEQ ID NO: 18693 - DNA, 15 bp, Artificial Sequence
  dgRNA
  Rab17
caattacctgctcca

SEQ ID NO: 18694 - DNA, 15 bp, Artificial Sequence
  dgRNA
  Rab17
ccggccctgcccatc

SEQ ID NO: 18695 - DNA, 15 bp, Artificial Sequence
  dgRNA
  Atp6v1h
acatctcagcgggcc

SEQ ID NO: 18696 - DNA, 15 bp, Artificial Sequence
  dgRNA
  Xkr8
aatccaaaccagtag

SEQ ID NO: 18697 - DNA, 15 bp, Artificial Sequence
  dgRNA
  Xkr8
cggggtctgggcggt

SEQ ID NO: 18698 - DNA, 15 bp, Artificial Sequence
  dgRNA
  Xkr8
cggtggggccagtgt

SEQ ID NO: 18699 - DNA, 15 bp, Artificial Sequence
  dgRNA
  Xkr8
gccagtgtaggggcg

SEQ ID NO: 18700 - DNA, 15 bp, Artificial Sequence
  dgRNA
  Htr2c
cctacgccacagctc

SEQ ID NO: 18701 - DNA, 15 bp, Artificial Sequence
  dgRNA
  Htr2c
ctacgccacagctca

SEQ ID NO: 18702 - DNA, 15 bp, Artificial Sequence
  dgRNA
  Htr2c
gattccagacgcact

SEQ ID NO: 18703 - DNA, 15 bp, Artificial Sequence
  dgRNA
  Htr2c
gacgcactaggattc

SEQ ID NO: 18704 - DNA, 15 bp, Artificial Sequence
  dgRNA
  Ank1
gcctgcggggctcgg

SEQ ID NO: 18705 - DNA, 15 bp, Artificial Sequence
  dgRNA
  Ank1
tgcggggctcggcgg

SEQ ID NO: 18706 - DNA, 15 bp, Artificial Sequence
  dgRNA
  Ank1
gggcctgcccccggt

SEQ ID NO: 18707 - DNA, 15 bp, Artificial Sequence
  dgRNA
  Ank1
ggcctgcccccggtt

SEQ ID NO: 18708 - DNA, 15 bp, Artificial Sequence
  dgRNA
  Rbm10
caatgtgcgcagctg

SEQ ID NO: 18709 - DNA, 15 bp, Artificial Sequence
  dgRNA
  Rbm10
gacaaaaatcgcgct

SEQ ID NO: 18710 - DNA, 15 bp, Artificial Sequence
  dgRNA
  Rbm10
cgacaaaaatcgcgc

SEQ ID NO: 18711 - DNA, 15 bp, Artificial Sequence
  dgRNA
  Rbm10
gggatctatttagca

SEQ ID NO: 18712 - DNA, 15 bp, Artificial Sequence
  dgRNA
  Dhx30
gacactcaggagcga

SEQ ID NO: 18713 - DNA, 15 bp, Artificial Sequence
  dgRNA
  Dhx30
cgacactcaggagcg

SEQ ID NO: 18714 - DNA, 15 bp, Artificial Sequence
  dgRNA
  Dhx30
gccacatcgacactc

SEQ ID NO: 18715 - DNA, 15 bp, Artificial Sequence
  dgRNA
  Dhx30
gacgactgcgagtct

SEQ ID NO: 18716 - DNA, 15 bp, Artificial Sequence
  dgRNA
  1810026J23Rik
ccgcatcgcactctg

SEQ ID NO: 18717 - DNA, 15 bp, Artificial Sequence
  dgRNA
  1810026J23Rik
actgatgcttccgtc

SEQ ID NO: 18718 - DNA, 15 bp, Artificial Sequence
  dgRNA
  1810026J23Rik
gcctaatacacggaa

SEQ ID NO: 18719 - DNA, 15 bp, Artificial Sequence
  dgRNA
  1810026J23Rik
acggtgagtggagcc

SEQ ID NO: 18720 - DNA, 15 bp, Artificial Sequence
  dgRNA
  U2af1
gccgcaagcaatgcg

SEQ ID NO: 18721 - DNA, 15 bp, Artificial Sequence
  dgRNA
  U2af1
ccgcaagcaatgcgc

SEQ ID NO: 18722 - DNA, 15 bp, Artificial Sequence
  dgRNA
  U2af1
tgcgcgggacccgcc

SEQ ID NO: 18723 - DNA, 15 bp, Artificial Sequence
  dgRNA
  U2af1
gcgcgggacccgccc

SEQ ID NO: 18724 - DNA, 15 bp, Artificial Sequence
  dgRNA
  Klhl42
acactcctgctgcgg

SEQ ID NO: 18725 - DNA, 15 bp, Artificial Sequence
  dgRNA
  Klhl42
gctccgtttccgcgt

SEQ ID NO: 18726 - DNA, 15 bp, Artificial Sequence
  dgRNA
  Klhl42
ctccgtttccgcgta

SEQ ID NO: 18727 - DNA, 15 bp, Artificial Sequence
  dgRNA
  Klhl42
aaccgcccttacctc

SEQ ID NO: 18728 - DNA, 15 bp, Artificial Sequence
  dgRNA
  Dap3
ttgaagagcgagcga

SEQ ID NO: 18729 - DNA, 15 bp, Artificial Sequence
  dgRNA
  Dap3
cgagcgaaggtacct

SEQ ID NO: 18730 - DNA, 15 bp, Artificial Sequence
  dgRNA
  Dap3
taggcgcggacctcc

SEQ ID NO: 18731 - DNA, 15 bp, Artificial Sequence
  dgRNA
  Dap3
aggcgcggacctcct

SEQ ID NO: 18732 - DNA, 15 bp, Artificial Sequence
  dgRNA
  Mmadhc
cactagatcgccttc

SEQ ID NO: 18733 - DNA, 15 bp, Artificial Sequence
  dgRNA
  Mmadhc
tcgaagatcgaccga

SEQ ID NO: 18734 - DNA, 15 bp, Artificial Sequence
  dgRNA
  Mmadhc
gaccgacggcatcga

SEQ ID NO: 18735 - DNA, 15 bp, Artificial Sequence
  dgRNA
  Mmadhc
accgacggcatcgat

SEQ ID NO: 18736 - DNA, 15 bp, Artificial Sequence
  dgRNA
  Ror2
gcctagaagtcccgg

SEQ ID NO: 18737 - DNA, 15 bp, Artificial Sequence
  dgRNA
  Ror2
aagtcccggaggcgc

SEQ ID NO: 18738 - DNA, 15 bp, Artificial Sequence
  dgRNA
  Ror2
tcccggaggcgctgg

SEQ ID NO: 18739 - DNA, 15 bp, Artificial Sequence
  dgRNA
  Ror2
cccggaggcgctggc

SEQ ID NO: 18740 - DNA, 15 bp, Artificial Sequence
  dgRNA
  Galnt7
gggaaggtaaagccg

SEQ ID NO: 18741 - DNA, 15 bp, Artificial Sequence
  dgRNA
  Galnt7
gaaggtaaagccgag

SEQ ID NO: 18742 - DNA, 15 bp, Artificial Sequence
  dgRNA
  Galnt7
agccgaggggagttc

SEQ ID NO: 18743 - DNA, 15 bp, Artificial Sequence
  dgRNA
  Galnt7
ggggagttccggatc

SEQ ID NO: 18744 - DNA, 15 bp, Artificial Sequence
  dgRNA
  Hist1h3e
ggacggaattaccat

SEQ ID NO: 18745 - DNA, 15 bp, Artificial Sequence
  dgRNA
  Hist1h3e
caaaaatcgtactac

SEQ ID NO: 18746 - DNA, 15 bp, Artificial Sequence
  dgRNA
  Hist1h3e
tcgtactacaggaat

SEQ ID NO: 18747 - DNA, 15 bp, Artificial Sequence
  dgRNA
  Hist1h3e
acgcctgagtgctgc

SEQ ID NO: 18748 - DNA, 15 bp, Artificial Sequence
  dgRNA
  Heca
cgtcacccagagccg

SEQ ID NO: 18749 - DNA, 15 bp, Artificial Sequence
  dgRNA
  Heca
gtcacccagagccga

SEQ ID NO: 18750 - DNA, 15 bp, Artificial Sequence
  dgRNA
  Heca
cgagcgtgacgtcac

SEQ ID NO: 18751 - DNA, 15 bp, Artificial Sequence
  dgRNA
  Heca
gagcgtgacgtcacg

SEQ ID NO: 18752 - DNA, 15 bp, Artificial Sequence
  dgRNA
  Rhoj
aaaggatggaacccg

SEQ ID NO: 18753 - DNA, 15 bp, Artificial Sequence
  dgRNA
  Rhoj
aggggaaaacactag

SEQ ID NO: 18754 - DNA, 15 bp, Artificial Sequence
  dgRNA
  Rhoj
ggccaggacacggag

SEQ ID NO: 18755 - DNA, 15 bp, Artificial Sequence
  dgRNA
  Rhoj
aaggcggcaacaatg

SEQ ID NO: 18756 - DNA, 15 bp, Artificial Sequence
  dgRNA
  Serping1
tccaagaggaactcc

SEQ ID NO: 18757 - DNA, 15 bp, Artificial Sequence
  dgRNA
  Serping1
gaactccgggctaac

SEQ ID NO: 18758 - DNA, 15 bp, Artificial Sequence
  dgRNA
  Serping1
cccatccgtcccatc

SEQ ID NO: 18759 - DNA, 15 bp, Artificial Sequence
  dgRNA
  Serping1
cccatccggatttac

SEQ ID NO: 18760 - DNA, 15 bp, Artificial Sequence
  dgRNA
  Tnfrsf11a
tggggacactcggac

SEQ ID NO: 18761 - DNA, 15 bp, Artificial Sequence
  dgRNA
  Tnfrsf11a
ggacaggactccgcg

SEQ ID NO: 18762 - DNA, 15 bp, Artificial Sequence
  dgRNA
  Tnfrsf11a
gacaggactccgcgc

SEQ ID NO: 18763 - DNA, 15 bp, Artificial Sequence
  dgRNA
  Tnfrsf11a
ggtctgaagcactcg

SEQ ID NO: 18764 - DNA, 15 bp, Artificial Sequence
  dgRNA
  Fbln1
tgtctggcggctgcc

SEQ ID NO: 18765 - DNA, 15 bp, Artificial Sequence
  dgRNA
  Fbln1
gtctggcggctgcca

SEQ ID NO: 18766 - DNA, 15 bp, Artificial Sequence
  dgRNA
  Fbln1
ctatcctgacaattt

SEQ ID NO: 18767 - DNA, 15 bp, Artificial Sequence
  dgRNA
  Fbln1
ccccgcaggagagtc

SEQ ID NO: 18768 - DNA, 15 bp, Artificial Sequence
  dgRNA
  Dapk2
aagttgattcgttcc

SEQ ID NO: 18769 - DNA, 15 bp, Artificial Sequence
  dgRNA
  Dapk2
ttgattcgttccagg

SEQ ID NO: 18770 - DNA, 15 bp, Artificial Sequence
  dgRNA
  Dapk2
caagtcctcacctcg

SEQ ID NO: 18771 - DNA, 15 bp, Artificial Sequence
  dgRNA
  Dapk2
gtcctcacctcgggg

SEQ ID NO: 18772 - DNA, 15 bp, Artificial Sequence
  dgRNA
  Tmem70
agccgaccaaatact

SEQ ID NO: 18773 - DNA, 15 bp, Artificial Sequence
  dgRNA
  Tmem70
caaatactaggaatt

SEQ ID NO: 18774 - DNA, 15 bp, Artificial Sequence
  dgRNA
  Tmem70
cccatcatcttaagc

SEQ ID NO: 18775 - DNA, 15 bp, Artificial Sequence
  dgRNA
  Tmem70
tcttaagcagggagt

SEQ ID NO: 18776 - DNA, 15 bp, Artificial Sequence
  dgRNA
  Ccdc154
gtagccctagagcca

SEQ ID NO: 18777 - DNA, 15 bp, Artificial Sequence
  dgRNA
  Ccdc154
gggagtctgcaagac

SEQ ID NO: 18778 - DNA, 15 bp, Artificial Sequence
  dgRNA
  Ccdc154
ggagtctgcaagaca

SEQ ID NO: 18779 - DNA, 15 bp, Artificial Sequence
  dgRNA
  Ccdc154
ggcatatgagggttc

SEQ ID NO: 18780 - DNA, 15 bp, Artificial Sequence
  dgRNA
  Ift57
cgcctttaaggcgcg

SEQ ID NO: 18781 - DNA, 15 bp, Artificial Sequence
  dgRNA
  Ift57
gcctttaaggcgcgc

SEQ ID NO: 18782 - DNA, 15 bp, Artificial Sequence
  dgRNA
  Ift57
taaggcgcgcgggag

SEQ ID NO: 18783 - DNA, 15 bp, Artificial Sequence
  dgRNA
  Ift57
atgcgccacgcccat

SEQ ID NO: 18784 - DNA, 15 bp, Artificial Sequence
  dgRNA
  Jchain
cattcttgctagtct

SEQ ID NO: 18785 - DNA, 15 bp, Artificial Sequence
  dgRNA
  Jchain
cagctttctattaga

SEQ ID NO: 18786 - DNA, 15 bp, Artificial Sequence
  dgRNA
  Jchain
ctggaaagacgcaca

SEQ ID NO: 18787 - DNA, 15 bp, Artificial Sequence
  dgRNA
  Speg
gaagggtcgccaggt

SEQ ID NO: 18788 - DNA, 15 bp, Artificial Sequence
  dgRNA
  Speg
cgccaggtggggcgc

SEQ ID NO: 18789 - DNA, 15 bp, Artificial Sequence
  dgRNA
  Speg
ggcgcaggctggcgg

SEQ ID NO: 18790 - DNA, 15 bp, Artificial Sequence
  dgRNA
  Speg
ccacctcggctcctg

SEQ ID NO: 18791 - DNA, 15 bp, Artificial Sequence
  dgRNA
  Rpl28
cccggcgcctcatca

SEQ ID NO: 18792 - DNA, 15 bp, Artificial Sequence
  dgRNA
  Rpl28
accgcgagaactcgc

SEQ ID NO: 18793 - DNA, 15 bp, Artificial Sequence
  dgRNA
  Rpl28
ccgcgagaactcgcc

SEQ ID NO: 18794 - DNA, 15 bp, Artificial Sequence
  dgRNA
  Rpl28
gacgaagagctccga

SEQ ID NO: 18795 - DNA, 15 bp, Artificial Sequence
  dgRNA
  Sec11a
acaccgacttcgcgc

SEQ ID NO: 18796 - DNA, 15 bp, Artificial Sequence
  dgRNA
  Sec11a
gcgctggcgcagact

SEQ ID NO: 18797 - DNA, 15 bp, Artificial Sequence
  dgRNA
  Sec11a
gactcggcttccgat

SEQ ID NO: 18798 - DNA, 15 bp, Artificial Sequence
  dgRNA
  Sec11a
gccaggcctgtccaa

SEQ ID NO: 18799 - DNA, 15 bp, Artificial Sequence
  dgRNA
  Zfand4
ctagtacataattag

SEQ ID NO: 18800 - DNA, 15 bp, Artificial Sequence
  dgRNA
  Zfand4
gttgtaccttgaagc

SEQ ID NO: 18801 - DNA, 15 bp, Artificial Sequence
  dgRNA
  Adipor1
gcagtccgccagtgt

SEQ ID NO: 18802 - DNA, 15 bp, Artificial Sequence
  dgRNA
  Adipor1
cagtccgccagtgta

SEQ ID NO: 18803 - DNA, 15 bp, Artificial Sequence
  dgRNA
  Adipor1
agtgtagggccaagc

SEQ ID NO: 18804 - DNA, 15 bp, Artificial Sequence
  dgRNA
  Adipor1
gtgtagggccaagct

SEQ ID NO: 18805 - DNA, 15 bp, Artificial Sequence
  dgRNA
  Zfp280b
cagtccctccgcccg

SEQ ID NO: 18806 - DNA, 15 bp, Artificial Sequence
  dgRNA
  Zfp280b
cccgcggcagtcact

SEQ ID NO: 18807 - DNA, 15 bp, Artificial Sequence
  dgRNA
  Zfp280b
ccgcggcagtcacta

SEQ ID NO: 18808 - DNA, 15 bp, Artificial Sequence
  dgRNA
  Zfp280b
cgcggcagtcactag

SEQ ID NO: 18809 - DNA, 15 bp, Artificial Sequence
  dgRNA
  Unc50
ccgccctcaccacac

SEQ ID NO: 18810 - DNA, 15 bp, Artificial Sequence
  dgRNA
  Unc50
ctggatcacggccct

SEQ ID NO: 18811 - DNA, 15 bp, Artificial Sequence
  dgRNA
  Unc50
ctcggtcaccccgca

SEQ ID NO: 18812 - DNA, 15 bp, Artificial Sequence
  dgRNA
  Unc50
ccgcacggcccggaa

SEQ ID NO: 18813 - DNA, 15 bp, Artificial Sequence
  dgRNA
  Zfp326
tcccccgcgatcccc

SEQ ID NO: 18814 - DNA, 15 bp, Artificial Sequence
  dgRNA
  Zfp326
cccccgcgatcccca

SEQ ID NO: 18815 - DNA, 15 bp, Artificial Sequence
  dgRNA
  Zfp326
gcgatccccagggtc

SEQ ID NO: 18816 - DNA, 15 bp, Artificial Sequence
  dgRNA
  Zfp326
cccaccaccccgcgt

SEQ ID NO: 18817 - DNA, 15 bp, Artificial Sequence
  dgRNA
  Ccnt2
aggcgcagagcattg

SEQ ID NO: 18818 - DNA, 15 bp, Artificial Sequence
  dgRNA
  Ccnt2
agcattgtggtcccg

SEQ ID NO: 18819 - DNA, 15 bp, Artificial Sequence
  dgRNA
  Ccnt2
aagaccagcgcgagc

SEQ ID NO: 18820 - DNA, 15 bp, Artificial Sequence
  dgRNA
  Ccnt2
ccagcgcgagccggc

SEQ ID NO: 18821 - DNA, 15 bp, Artificial Sequence
  dgRNA
  Strn3
ccgcctcccgaagag

SEQ ID NO: 18822 - DNA, 15 bp, Artificial Sequence
  dgRNA
  Strn3
ctcagtgcgcctgcg

SEQ ID NO: 18823 - DNA, 15 bp, Artificial Sequence
  dgRNA
  Strn3
tcagtgcgcctgcgt

SEQ ID NO: 18824 - DNA, 15 bp, Artificial Sequence
  dgRNA
  Strn3
cagtgcgcctgcgtg

SEQ ID NO: 18825 - DNA, 15 bp, Artificial Sequence
  dgRNA
  Aff1
agtggccgcggagcc

SEQ ID NO: 18826 - DNA, 15 bp, Artificial Sequence
  dgRNA
  Aff1
cggagcccggggcaa

SEQ ID NO: 18827 - DNA, 15 bp, Artificial Sequence
  dgRNA
  Aff1
gggcaagggcggcgc

SEQ ID NO: 18828 - DNA, 15 bp, Artificial Sequence
  dgRNA
  Aff1
caagggcggcgcggg

SEQ ID NO: 18829 - DNA, 15 bp, Artificial Sequence
  dgRNA
  Atp2a3
cgacatgaaagcagt

SEQ ID NO: 18830 - DNA, 15 bp, Artificial Sequence
  dgRNA
  Atp2a3
tgcagaccgagttcg

SEQ ID NO: 18831 - DNA, 15 bp, Artificial Sequence
  dgRNA
  Atp2a3
cttcagtatgtggac

SEQ ID NO: 18832 - DNA, 15 bp, Artificial Sequence
  dgRNA
  Atp2a3
gtcccccgccaccct

SEQ ID NO: 18833 - DNA, 15 bp, Artificial Sequence
  dgRNA
  Plin5
cgcaggcgagggtag

SEQ ID NO: 18834 - DNA, 15 bp, Artificial Sequence
  dgRNA
  Plin5
gccctgacccaaact

SEQ ID NO: 18835 - DNA, 15 bp, Artificial Sequence
  dgRNA
  Plin5
tgacccaaactcggc

SEQ ID NO: 18836 - DNA, 15 bp, Artificial Sequence
  dgRNA
  Plin5
gacccaaactcggca

SEQ ID NO: 18837 - DNA, 15 bp, Artificial Sequence
  dgRNA
  Magi1
tcccgcccccttcac

SEQ ID NO: 18838 - DNA, 15 bp, Artificial Sequence
  dgRNA
  Magi1
agccctaatcccccc

SEQ ID NO: 18839 - DNA, 15 bp, Artificial Sequence
  dgRNA
  Magi1
cctggcctagatatc

SEQ ID NO: 18840 - DNA, 15 bp, Artificial Sequence
  dgRNA
  Magi1
cggcttaaatacaga

SEQ ID NO: 18841 - DNA, 15 bp, Artificial Sequence
  dgRNA
  Megf10
cggggagttcggcga

SEQ ID NO: 18842 - DNA, 15 bp, Artificial Sequence
  dgRNA
  Megf10
ggggagttcggcgac

SEQ ID NO: 18843 - DNA, 15 bp, Artificial Sequence
  dgRNA
  Megf10
gggagttcggcgacg

SEQ ID NO: 18844 - DNA, 15 bp, Artificial Sequence
  dgRNA
  Megf10
ggagttcggcgacgg

SEQ ID NO: 18845 - DNA, 15 bp, Artificial Sequence
  dgRNA
  Olfr1480
agtgagttatttacc

SEQ ID NO: 18846 - DNA, 15 bp, Artificial Sequence
  dgRNA
  Olfr1480
gtctaaacttaattc

SEQ ID NO: 18847 - DNA, 15 bp, Artificial Sequence
  dgRNA
  Enah
ggacggacgggcgcg

SEQ ID NO: 18848 - DNA, 15 bp, Artificial Sequence
  dgRNA
  Enah
acgggcgcgcggccc

SEQ ID NO: 18849 - DNA, 15 bp, Artificial Sequence
  dgRNA
  Enah
ggctcccgtctgaag

SEQ ID NO: 18850 - DNA, 15 bp, Artificial Sequence
  dgRNA
  Enah
tcccgtctgaagcgg

SEQ ID NO: 18851 - DNA, 15 bp, Artificial Sequence
  dgRNA
  Pak1
tctggtacctcttgt

SEQ ID NO: 18852 - DNA, 15 bp, Artificial Sequence
  dgRNA
  Pak1
cctcttgttggagcc

SEQ ID NO: 18853 - DNA, 15 bp, Artificial Sequence
  dgRNA
  Pak1
ccaggctccaacaag

SEQ ID NO: 18854 - DNA, 15 bp, Artificial Sequence
  dgRNA
  Mospd2
gtgccaggaggtcgt

SEQ ID NO: 18855 - DNA, 15 bp, Artificial Sequence
  dgRNA
  Mospd2
caggaggtcgtcgga

SEQ ID NO: 18856 - DNA, 15 bp, Artificial Sequence
  dgRNA
  Mospd2
gaggtcgtcggaagg

SEQ ID NO: 18857 - DNA, 15 bp, Artificial Sequence
  dgRNA
  Mospd2
aggtcgtcggaaggc

SEQ ID NO: 18858 - DNA, 15 bp, Artificial Sequence
  dgRNA
  Chtop
cggcgccattttagc

SEQ ID NO: 18859 - DNA, 15 bp, Artificial Sequence
  dgRNA
  Chtop
ccggtcacgctgcac

SEQ ID NO: 18860 - DNA, 15 bp, Artificial Sequence
  dgRNA
  Chtop
gtcacgctgcactgg

SEQ ID NO: 18861 - DNA, 15 bp, Artificial Sequence
  dgRNA
  Chtop
tcacgctgcactggt

SEQ ID NO: 18862 - DNA, 15 bp, Artificial Sequence
  dgRNA
  Abi1
ggactcccgttgtca

SEQ ID NO: 18863 - DNA, 15 bp, Artificial Sequence
  dgRNA
  Abi1
gactcccgttgtcat

SEQ ID NO: 18864 - DNA, 15 bp, Artificial Sequence
  dgRNA
  Abi1
actcccgttgtcatg

SEQ ID NO: 18865 - DNA, 15 bp, Artificial Sequence
  dgRNA
  Abi1
ctcccgttgtcatgg

SEQ ID NO: 18866 - DNA, 15 bp, Artificial Sequence
  dgRNA
  Zdhhc12
caggaggcggagtta

SEQ ID NO: 18867 - DNA, 15 bp, Artificial Sequence
  dgRNA
  Zdhhc12
taggctgtgcgcgcg

SEQ ID NO: 18868 - DNA, 15 bp, Artificial Sequence
  dgRNA
  Zdhhc12
aggctgtgcgcgcgc

SEQ ID NO: 18869 - DNA, 15 bp, Artificial Sequence
  dgRNA
  Zdhhc12
cgccttcagcctcct

SEQ ID NO: 18870 - DNA, 15 bp, Artificial Sequence
  dgRNA
  Arhgef7
cggagcagggcccga

SEQ ID NO: 18871 - DNA, 15 bp, Artificial Sequence
  dgRNA
  Arhgef7
agggcccgaaggaga

SEQ ID NO: 18872 - DNA, 15 bp, Artificial Sequence
  dgRNA
  Arhgef7
aggagacggagcgcg

SEQ ID NO: 18873 - DNA, 15 bp, Artificial Sequence
  dgRNA
  Arhgef7
acggagcgcgtggtg

SEQ ID NO: 18874 - DNA, 15 bp, Artificial Sequence
  dgRNA
  Mog
tgcccttcccaagac

SEQ ID NO: 18875 - DNA, 15 bp, Artificial Sequence
  dgRNA
  Mog
agactggatccatgg

SEQ ID NO: 18876 - DNA, 15 bp, Artificial Sequence
  dgRNA
  Mog
actggatccatggag

SEQ ID NO: 18877 - DNA, 15 bp, Artificial Sequence
  dgRNA
  Mog
tcggaaagcaaaccc

SEQ ID NO: 18878 - DNA, 15 bp, Artificial Sequence
  dgRNA
  Slc37a2
gttcgagaaaacaga

SEQ ID NO: 18879 - DNA, 15 bp, Artificial Sequence
  dgRNA
  Slc37a2
ctcggcgcgacctag

SEQ ID NO: 18880 - DNA, 15 bp, Artificial Sequence
  dgRNA
  Slc37a2
tcggcgcgacctaga

SEQ ID NO: 18881 - DNA, 15 bp, Artificial Sequence
  dgRNA
  Slc37a2
cgcgacctagagggc

SEQ ID NO: 18882 - DNA, 15 bp, Artificial Sequence
  dgRNA
  Ipo5
gagggggggcggcct

SEQ ID NO: 18883 - DNA, 15 bp, Artificial Sequence
  dgRNA
  Ipo5
cgcgccgcgagccaa

SEQ ID NO: 18884 - DNA, 15 bp, Artificial Sequence
  dgRNA
  Ipo5
gcgccgcgagccaat

SEQ ID NO: 18885 - DNA, 15 bp, Artificial Sequence
  dgRNA
  Ipo5
gagccaatgggacgc

SEQ ID NO: 18886 - DNA, 15 bp, Artificial Sequence
  dgRNA
  Edn1
gcccgccccagtagc

SEQ ID NO: 18887 - DNA, 15 bp, Artificial Sequence
  dgRNA
  Edn1
cccgccccagtagct

SEQ ID NO: 18888 - DNA, 15 bp, Artificial Sequence
  dgRNA
  Edn1
ttcaagagcgaagag

SEQ ID NO: 18889 - DNA, 15 bp, Artificial Sequence
  dgRNA
  Edn1
tcaagagcgaagagt

SEQ ID NO: 18890 - DNA, 15 bp, Artificial Sequence
  dgRNA
  Ephb1
gtgctcgcgcctgat

SEQ ID NO: 18891 - DNA, 15 bp, Artificial Sequence
  dgRNA
  Ephb1
gcgcctgattggatg

SEQ ID NO: 18892 - DNA, 15 bp, Artificial Sequence
  dgRNA
  Ephb1
attccttgattggac

SEQ ID NO: 18893 - DNA, 15 bp, Artificial Sequence
  dgRNA
  Ephb1
tcgcgctccctcttg

SEQ ID NO: 18894 - DNA, 15 bp, Artificial Sequence
  dgRNA
  Rab7
gttcttggcccaata

SEQ ID NO: 18895 - DNA, 15 bp, Artificial Sequence
  dgRNA
  Rab7
gcccccatctagaaa

SEQ ID NO: 18896 - DNA, 15 bp, Artificial Sequence
  dgRNA
  Rab7
agggcctgacgcgac

SEQ ID NO: 18897 - DNA, 15 bp, Artificial Sequence
  dgRNA
  Rab7
ccggaacgtgacgca

SEQ ID NO: 18898 - DNA, 15 bp, Artificial Sequence
  dgRNA
  Tgfbr2
agcccagacttggcg

SEQ ID NO: 18899 - DNA, 15 bp, Artificial Sequence
  dgRNA
  Tgfbr2
gttgcgtgggagcgc

SEQ ID NO: 18900 - DNA, 15 bp, Artificial Sequence
  dgRNA
  Tgfbr2
ttgcgtgggagcgct

SEQ ID NO: 18901 - DNA, 15 bp, Artificial Sequence
  dgRNA
  Tgfbr2
tccagcggccttgat

SEQ ID NO: 18902 - DNA, 15 bp, Artificial Sequence
  dgRNA
  Hsd17b1
tcccttgatcaacta

SEQ ID NO: 18903 - DNA, 15 bp, Artificial Sequence
  dgRNA
  Hsd17b1
gctttgacccacacc

SEQ ID NO: 18904 - DNA, 15 bp, Artificial Sequence
  dgRNA
  Hsd17b1
gacacaacaaggggt

SEQ ID NO: 18905 - DNA, 15 bp, Artificial Sequence
  dgRNA
  Hsd17b1
gggtggggccgctgt

SEQ ID NO: 18906 - DNA, 15 bp, Artificial Sequence
  dgRNA
  4933434E20Rik
taggggctgtccacc

SEQ ID NO: 18907 - DNA, 15 bp, Artificial Sequence
  dgRNA
  4933434E20Rik
gggtctcaagaaatt

SEQ ID NO: 18908 - DNA, 15 bp, Artificial Sequence
  dgRNA
  4933434E20Rik
ctagtgacatccctt

SEQ ID NO: 18909 - DNA, 15 bp, Artificial Sequence
  dgRNA
  4933434E20Rik
gcgcaacacaatcca

SEQ ID NO: 18910 - DNA, 15 bp, Artificial Sequence
  dgRNA
  Senp8
cgcacgtgacgctgc

SEQ ID NO: 18911 - DNA, 15 bp, Artificial Sequence
  dgRNA
  Senp8
tgacgctgctggagc

SEQ ID NO: 18912 - DNA, 15 bp, Artificial Sequence
  dgRNA
  Senp8
ctgcctgcgcttgcg

SEQ ID NO: 18913 - DNA, 15 bp, Artificial Sequence
  dgRNA
  Senp8
tttccaccctccgaa

SEQ ID NO: 18914 - DNA, 15 bp, Artificial Sequence
  dgRNA
  Dock3
tggccttcctcacgc

SEQ ID NO: 18915 - DNA, 15 bp, Artificial Sequence
  dgRNA
  Dock3
cacgaccccgttctg

SEQ ID NO: 18916 - DNA, 15 bp, Artificial Sequence
  dgRNA
  Dock3
cagatttccctccgc

SEQ ID NO: 18917 - DNA, 15 bp, Artificial Sequence
  dgRNA
  Dock3
tccgctggcccgcag

SEQ ID NO: 18918 - DNA, 15 bp, Artificial Sequence
  dgRNA
  Kmo
attagctatgaattc

SEQ ID NO: 18919 - DNA, 15 bp, Artificial Sequence
  dgRNA
  Kmo
aacttgtgttatctg

SEQ ID NO: 18920 - DNA, 15 bp, Artificial Sequence
  dgRNA
  Kmo
ttttcattcgaaatg

SEQ ID NO: 18921 - DNA, 15 bp, Artificial Sequence
  dgRNA
  Kmo
taaatagcatcctcg

SEQ ID NO: 18922 - DNA, 15 bp, Artificial Sequence
  dgRNA
  Arhgef9
cccccacgtaaaaac

SEQ ID NO: 18923 - DNA, 15 bp, Artificial Sequence
  dgRNA
  Arhgef9
cgactctgtgagcgt

SEQ ID NO: 18924 - DNA, 15 bp, Artificial Sequence
  dgRNA
  Arhgef9
gactctgtgagcgtt

SEQ ID NO: 18925 - DNA, 15 bp, Artificial Sequence
  dgRNA
  Arhgef9
gttgggtcctccgat

SEQ ID NO: 18926 - DNA, 15 bp, Artificial Sequence
  dgRNA
  Smyd3
cgcggaataaaatac

SEQ ID NO: 18927 - DNA, 15 bp, Artificial Sequence
  dgRNA
  Smyd3
atcccgagctgtagt

SEQ ID NO: 18928 - DNA, 15 bp, Artificial Sequence
  dgRNA
  Smyd3
ctcgtctccgccccc

SEQ ID NO: 18929 - DNA, 15 bp, Artificial Sequence
  dgRNA
  Smyd3
tagcaaagactgatc

SEQ ID NO: 18930 - DNA, 15 bp, Artificial Sequence
  dgRNA
  Scgb3a1
atatgcgagcctccc

SEQ ID NO: 18931 - DNA, 15 bp, Artificial Sequence
  dgRNA
  Scgb3a1
tatgcgagcctccca

SEQ ID NO: 18932 - DNA, 15 bp, Artificial Sequence
  dgRNA
  Scgb3a1
tccactgaccataag

SEQ ID NO: 18933 - DNA, 15 bp, Artificial Sequence
  dgRNA
  Scgb3a1
gtgaggttccactcc

SEQ ID NO: 18934 - DNA, 15 bp, Artificial Sequence
  dgRNA
  Osbpl6
ggaccagatgggcgc

SEQ ID NO: 18935 - DNA, 15 bp, Artificial Sequence
  dgRNA
  Osbpl6
ctggatcccgcacga

SEQ ID NO: 18936 - DNA, 15 bp, Artificial Sequence
  dgRNA
  Osbpl6
tggatcccgcacgaa

SEQ ID NO: 18937 - DNA, 15 bp, Artificial Sequence
  dgRNA
  Osbpl6
ggatcccgcacgaag

SEQ ID NO: 18938 - DNA, 15 bp, Artificial Sequence
  dgRNA
  Nckap5
catttaaagtgcagc

SEQ ID NO: 18939 - DNA, 15 bp, Artificial Sequence
  dgRNA
  Nckap5
gcgatcccgatcacg

SEQ ID NO: 18940 - DNA, 15 bp, Artificial Sequence
  dgRNA
  Nckap5
tcacgaggagaactt

SEQ ID NO: 18941 - DNA, 15 bp, Artificial Sequence
  dgRNA
  Nckap5
cacgaggagaacttc

SEQ ID NO: 18942 - DNA, 15 bp, Artificial Sequence
  dgRNA
  Rasgef1b
acggccgcagcgtca

SEQ ID NO: 18943 - DNA, 15 bp, Artificial Sequence
  dgRNA
  Rasgef1b
cggccgcagcgtcac

SEQ ID NO: 18944 - DNA, 15 bp, Artificial Sequence
  dgRNA
  Rasgef1b
gggagtccctacccg

SEQ ID NO: 18945 - DNA, 15 bp, Artificial Sequence
  dgRNA
  Rasgef1b
ctacccgcggaaccc

SEQ ID NO: 18946 - DNA, 15 bp, Artificial Sequence
  dgRNA
  G630090E17Rik
aacaagaggtctccc

SEQ ID NO: 18947 - DNA, 15 bp, Artificial Sequence
  dgRNA
  G630090E17Rik
cgtttcgcttccagc

SEQ ID NO: 18948 - DNA, 15 bp, Artificial Sequence
  dgRNA
  G630090E17Rik
agaccccgccctcac

SEQ ID NO: 18949 - DNA, 15 bp, Artificial Sequence
  dgRNA
  G630090E17Rik
gaccccgccctcact

SEQ ID NO: 18950 - DNA, 15 bp, Artificial Sequence
  dgRNA
  Tpm3
tgcgggctgcccgag

SEQ ID NO: 18951 - DNA, 15 bp, Artificial Sequence
  dgRNA
  Tpm3
gcgttcccgcctgct

SEQ ID NO: 18952 - DNA, 15 bp, Artificial Sequence
  dgRNA
  Tpm3
tcccgcctgcttggc

SEQ ID NO: 18953 - DNA, 15 bp, Artificial Sequence
  dgRNA
  Tpm3
cccgcctgcttggca

SEQ ID NO: 18954 - DNA, 15 bp, Artificial Sequence
  dgRNA
  D630039A03Rik
tgaccttgtacacat

SEQ ID NO: 18955 - DNA, 15 bp, Artificial Sequence
  dgRNA
  D630039A03Rik
gctcattaagccagc

SEQ ID NO: 18956 - DNA, 15 bp, Artificial Sequence
  dgRNA
  D630039A03Rik
caccctaaggtttga

SEQ ID NO: 18957 - DNA, 15 bp, Artificial Sequence
  dgRNA
  D630039A03Rik
tacaaggtcacccta

SEQ ID NO: 18958 - DNA, 15 bp, Artificial Sequence
  dgRNA
  Scrn1
ctcccctcccaggcg

SEQ ID NO: 18959 - DNA, 15 bp, Artificial Sequence
  dgRNA
  Scrn1
aactctctcgaaggg

SEQ ID NO: 18960 - DNA, 15 bp, Artificial Sequence
  dgRNA
  Scrn1
tgaaactctctcgaa

SEQ ID NO: 18961 - DNA, 15 bp, Artificial Sequence
  dgRNA
  Scrn1
ttgaaactctctcga

SEQ ID NO: 18962 - DNA, 15 bp, Artificial Sequence
  dgRNA
  Rgs3
tcacagagcgtccca

SEQ ID NO: 18963 - DNA, 15 bp, Artificial Sequence
  dgRNA
  Rgs3
cgccagccaggcccg

SEQ ID NO: 18964 - DNA, 15 bp, Artificial Sequence
  dgRNA
  Rgs3
tactaactagttgac

SEQ ID NO: 18965 - DNA, 15 bp, Artificial Sequence
  dgRNA
  Rgs3
agggcgcctttgttc

SEQ ID NO: 18966 - DNA, 15 bp, Artificial Sequence
  dgRNA
  Cd55
ctgacacagagtact

SEQ ID NO: 18967 - DNA, 15 bp, Artificial Sequence
  dgRNA
  Cd55
gcgccctcctttaga

SEQ ID NO: 18968 - DNA, 15 bp, Artificial Sequence
  dgRNA
  Cd55
agaccccactcccgc

SEQ ID NO: 18969 - DNA, 15 bp, Artificial Sequence
  dgRNA
  Cd55
tcccgccggacaact

SEQ ID NO: 18970 - DNA, 15 bp, Artificial Sequence
  dgRNA
  Camkmt
gcgacgccgctgctt

SEQ ID NO: 18971 - DNA, 15 bp, Artificial Sequence
  dgRNA
  Camkmt
aggagacgctaatac

SEQ ID NO: 18972 - DNA, 15 bp, Artificial Sequence
  dgRNA
  Camkmt
ctaataccggaaatg

SEQ ID NO: 18973 - DNA, 15 bp, Artificial Sequence
  dgRNA
  Camkmt
cggaaatgcggaatt

SEQ ID NO: 18974 - DNA, 15 bp, Artificial Sequence
  dgRNA
  Erc1
ttaccttcgcggcct

SEQ ID NO: 18975 - DNA, 15 bp, Artificial Sequence
  dgRNA
  Erc1
cgcacttgtcgatcc

SEQ ID NO: 18976 - DNA, 15 bp, Artificial Sequence
  dgRNA
  Erc1
gtcgatcctggcgcg

SEQ ID NO: 18977 - DNA, 15 bp, Artificial Sequence
  dgRNA
  Erc1
tggcgcgcggtcccg

SEQ ID NO: 18978 - DNA, 15 bp, Artificial Sequence
  dgRNA
  Chmp1a
ccccgccgctccagc

SEQ ID NO: 18979 - DNA, 15 bp, Artificial Sequence
  dgRNA
  Chmp1a
cccgccgctccagcc

SEQ ID NO: 18980 - DNA, 15 bp, Artificial Sequence
  dgRNA
  Chmp1a
ccagccgggcggcct

SEQ ID NO: 18981 - DNA, 15 bp, Artificial Sequence
  dgRNA
  Chmp1a
cagccgggcggcctc

SEQ ID NO: 18982 - DNA, 15 bp, Artificial Sequence
  dgRNA
  Prmt8
aacagtaatccgcgc

SEQ ID NO: 18983 - DNA, 15 bp, Artificial Sequence
  dgRNA
  Prmt8
gtaatccgcgcagga

SEQ ID NO: 18984 - DNA, 15 bp, Artificial Sequence
  dgRNA
  Prmt8
gcgcaggaaggatcc

SEQ ID NO: 18985 - DNA, 15 bp, Artificial Sequence
  dgRNA
  Prmt8
gatccaggaatcgac

SEQ ID NO: 18986 - DNA, 15 bp, Artificial Sequence
  dgRNA
  Gm10471
gctatgccccaaaaa

SEQ ID NO: 18987 - DNA, 15 bp, Artificial Sequence
  dgRNA
  Gm10471
gagctgccctttttt

SEQ ID NO: 18988 - DNA, 15 bp, Artificial Sequence
  dgRNA
  Cacnb4
cacctaggcaggcgt

SEQ ID NO: 18989 - DNA, 15 bp, Artificial Sequence
  dgRNA
  Cacnb4
tatacacacctaggc

SEQ ID NO: 18990 - DNA, 15 bp, Artificial Sequence
  dgRNA
  Cacnb4
gggatggtaaggcac

SEQ ID NO: 18991 - DNA, 15 bp, Artificial Sequence
  dgRNA
  Pqlc1
cgcgttaggacccag

SEQ ID NO: 18992 - DNA, 15 bp, Artificial Sequence
  dgRNA
  Pqlc1
gcgttaggacccagc

SEQ ID NO: 18993 - DNA, 15 bp, Artificial Sequence
  dgRNA
  Pqlc1
cgttaggacccagcg

SEQ ID NO: 18994 - DNA, 15 bp, Artificial Sequence
  dgRNA
  Pqlc1
ccagcggggtagccg

SEQ ID NO: 18995 - DNA, 15 bp, Artificial Sequence
  dgRNA
  Nop16
ggtaggacacaaatc

SEQ ID NO: 18996 - DNA, 15 bp, Artificial Sequence
  dgRNA
  Nop16
cacaaatccggacac

SEQ ID NO: 18997 - DNA, 15 bp, Artificial Sequence
  dgRNA
  Nop16
ccccgccttctgatg

SEQ ID NO: 18998 - DNA, 15 bp, Artificial Sequence
  dgRNA
  Nop16
tgatgaggtcactac

SEQ ID NO: 18999 - DNA, 15 bp, Artificial Sequence
  dgRNA
  Setdb1
aactagccccttatc

SEQ ID NO: 19000 - DNA, 15 bp, Artificial Sequence
  dgRNA
  Setdb1
gctatgcaataaatt

SEQ ID NO: 19001 - DNA, 15 bp, Artificial Sequence
  dgRNA
  Setdb1
taaatttggtccctt

SEQ ID NO: 19002 - DNA, 15 bp, Artificial Sequence
  dgRNA
  Setdb1
aaatttggtcccttc

SEQ ID NO: 19003 - DNA, 15 bp, Artificial Sequence
  dgRNA
  Rfx8
ccgttagcccaacgt

SEQ ID NO: 19004 - DNA, 15 bp, Artificial Sequence
  dgRNA
  Rfx8
aacgttggccagaga

SEQ ID NO: 19005 - DNA, 15 bp, Artificial Sequence
  dgRNA
  Rfx8
acgttggccagagag

SEQ ID NO: 19006 - DNA, 15 bp, Artificial Sequence
  dgRNA
  Rfx8
gaagggcggcagcat

SEQ ID NO: 19007 - DNA, 15 bp, Artificial Sequence
  dgRNA
  Acot13
actgatcgcgaacgc

SEQ ID NO: 19008 - DNA, 15 bp, Artificial Sequence
  dgRNA
  Acot13
cgccggaacctgcgc

SEQ ID NO: 19009 - DNA, 15 bp, Artificial Sequence
  dgRNA
  Acot13
tccgcgtcaaccttc

SEQ ID NO: 19010 - DNA, 15 bp, Artificial Sequence
  dgRNA
  Acot13
gaagaccgccctctc

SEQ ID NO: 19011 - DNA, 15 bp, Artificial Sequence
  dgRNA
  Syt1
ggtccctgtccgctg

SEQ ID NO: 19012 - DNA, 15 bp, Artificial Sequence
  dgRNA
  Syt1
gtccctgtccgctgt

SEQ ID NO: 19013 - DNA, 15 bp, Artificial Sequence
  dgRNA
  Syt1
tgtccgctgtgggga

SEQ ID NO: 19014 - DNA, 15 bp, Artificial Sequence
  dgRNA
  Syt1
agactctaacagtac

SEQ ID NO: 19015 - DNA, 15 bp, Artificial Sequence
  dgRNA
  Cdx1
atccacctcccgctt

SEQ ID NO: 19016 - DNA, 15 bp, Artificial Sequence
  dgRNA
  Cdx1
tccacctcccgctta

SEQ ID NO: 19017 - DNA, 15 bp, Artificial Sequence
  dgRNA
  Cdx1
acctcccgcttaggg

SEQ ID NO: 19018 - DNA, 15 bp, Artificial Sequence
  dgRNA
  Cdx1
aaccccctcgcccga

SEQ ID NO: 19019 - DNA, 15 bp, Artificial Sequence
  dgRNA
  Map6
agacgcagccagccc

SEQ ID NO: 19020 - DNA, 15 bp, Artificial Sequence
  dgRNA
  Map6
gacgcagccagccca

SEQ ID NO: 19021 - DNA, 15 bp, Artificial Sequence
  dgRNA
  Map6
tcggatgcagttgcc

SEQ ID NO: 19022 - DNA, 15 bp, Artificial Sequence
  dgRNA
  Map6
cggatgcagttgccc

SEQ ID NO: 19023 - DNA, 15 bp, Artificial Sequence
  dgRNA
  Nav3
gagtctaccagactg

SEQ ID NO: 19024 - DNA, 15 bp, Artificial Sequence
  dgRNA
  Nav3
aaactagcagtcatc

SEQ ID NO: 19025 - DNA, 15 bp, Artificial Sequence
  dgRNA
  Nav3
ctcttaacctcagtc

SEQ ID NO: 19026 - DNA, 15 bp, Artificial Sequence
  dgRNA
  Pttg1
gacagacgcgagagc

SEQ ID NO: 19027 - DNA, 15 bp, Artificial Sequence
  dgRNA
  Pttg1
acagacgcgagagct

SEQ ID NO: 19028 - DNA, 15 bp, Artificial Sequence
  dgRNA
  Pttg1
gacgcgagagctggg

SEQ ID NO: 19029 - DNA, 15 bp, Artificial Sequence
  dgRNA
  Pttg1
gcgagagctgggcgg

SEQ ID NO: 19030 - DNA, 15 bp, Artificial Sequence
  dgRNA
  Nfu1
agggggtgaattcgg

SEQ ID NO: 19031 - DNA, 15 bp, Artificial Sequence
  dgRNA
  Nfu1
gggggtgaattcgga

SEQ ID NO: 19032 - DNA, 15 bp, Artificial Sequence
  dgRNA
  Nfu1
ggggtgaattcggag

SEQ ID NO: 19033 - DNA, 15 bp, Artificial Sequence
  dgRNA
  Nfu1
tcggaggggaagtgt

SEQ ID NO: 19034 - DNA, 15 bp, Artificial Sequence
  dgRNA
  Pnkp
atcctcactgcgcat

SEQ ID NO: 19035 - DNA, 15 bp, Artificial Sequence
  dgRNA
  Pnkp
gcattggaaccgttg

SEQ ID NO: 19036 - DNA, 15 bp, Artificial Sequence
  dgRNA
  Pnkp
accgttgtggtagct

SEQ ID NO: 19037 - DNA, 15 bp, Artificial Sequence
  dgRNA
  Pnkp
ccgttgtggtagctt

SEQ ID NO: 19038 - DNA, 15 bp, Artificial Sequence
  dgRNA
  Arrb1
gtgcacgcgctcccg

SEQ ID NO: 19039 - DNA, 15 bp, Artificial Sequence
  dgRNA
  Arrb1
cccgtggaccagccg

SEQ ID NO: 19040 - DNA, 15 bp, Artificial Sequence
  dgRNA
  Arrb1
tggaccagccgcggc

SEQ ID NO: 19041 - DNA, 15 bp, Artificial Sequence
  dgRNA
  Arrb1
acgcagagccgcgca

SEQ ID NO: 19042 - DNA, 15 bp, Artificial Sequence
  dgRNA
  Mmp8
tgttagaatgtgatt

SEQ ID NO: 19043 - DNA, 15 bp, Artificial Sequence
  dgRNA
  Tmem221
acccctctacagggg

SEQ ID NO: 19044 - DNA, 15 bp, Artificial Sequence
  dgRNA
  Tmem221
cgggatctcctagca

SEQ ID NO: 19045 - DNA, 15 bp, Artificial Sequence
  dgRNA
  Tmem221
ccccagcacacccgg

SEQ ID NO: 19046 - DNA, 15 bp, Artificial Sequence
  dgRNA
  Tmem221
cagcacacccggggg

SEQ ID NO: 19047 - DNA, 15 bp, Artificial Sequence
  dgRNA
  Tyro3
gccgggtgcctgtcc

SEQ ID NO: 19048 - DNA, 15 bp, Artificial Sequence
  dgRNA
  Tyro3
ccgggtgcctgtcca

SEQ ID NO: 19049 - DNA, 15 bp, Artificial Sequence
  dgRNA
  Tyro3
cctgtccagggagcg

SEQ ID NO: 19050 - DNA, 15 bp, Artificial Sequence
  dgRNA
  Tyro3
gcaggtcctccgcag

SEQ ID NO: 19051 - DNA, 15 bp, Artificial Sequence
  dgRNA
  Ubxn7
tccggaattcagaga

SEQ ID NO: 19052 - DNA, 15 bp, Artificial Sequence
  dgRNA
  Ubxn7
caaagcggcggctcg

SEQ ID NO: 19053 - DNA, 15 bp, Artificial Sequence
  dgRNA
  Ubxn7
aaaacgcgcacagac

SEQ ID NO: 19054 - DNA, 15 bp, Artificial Sequence
  dgRNA
  Ubxn7
aaacgcgcacagaca

SEQ ID NO: 19055 - DNA, 15 bp, Artificial Sequence
  dgRNA
  Nphp3
cacgccccgaaagta

SEQ ID NO: 19056 - DNA, 15 bp, Artificial Sequence
  dgRNA
  Nphp3
cgccccttctcaaga

SEQ ID NO: 19057 - DNA, 15 bp, Artificial Sequence
  dgRNA
  Nphp3
ttctccccaatcacc

SEQ ID NO: 19058 - DNA, 15 bp, Artificial Sequence
  dgRNA
  Nphp3
cgtagcagcgagagg

SEQ ID NO: 19059 - DNA, 15 bp, Artificial Sequence
  dgRNA
  Hist1h4j
cctcccccacggccg

SEQ ID NO: 19060 - DNA, 15 bp, Artificial Sequence
  dgRNA
  Hist1h4j
ctcccccacggccgc

SEQ ID NO: 19061 - DNA, 15 bp, Artificial Sequence
  dgRNA
  Hist1h4j
aaaaagacggcgctc

SEQ ID NO: 19062 - DNA, 15 bp, Artificial Sequence
  dgRNA
  Hist1h4j
cggcgctcaggctcc

SEQ ID NO: 19063 - DNA, 15 bp, Artificial Sequence
  dgRNA
  Rnf128
ttattactaatagtc

SEQ ID NO: 19064 - DNA, 15 bp, Artificial Sequence
  dgRNA
  Grm4
ctaatatcggctatc

SEQ ID NO: 19065 - DNA, 15 bp, Artificial Sequence
  dgRNA
  Grm4
atcggctatcaggat

SEQ ID NO: 19066 - DNA, 15 bp, Artificial Sequence
  dgRNA
  Grm4
atcaggataggagcg

SEQ ID NO: 19067 - DNA, 15 bp, Artificial Sequence
  dgRNA
  Grm4
ccagacacggatatc

SEQ ID NO: 19068 - DNA, 15 bp, Artificial Sequence
  dgRNA
  Vil1
caagggcggggcaca

SEQ ID NO: 19069 - DNA, 15 bp, Artificial Sequence
  dgRNA
  Vil1
ggcacacggcagctc

SEQ ID NO: 19070 - DNA, 15 bp, Artificial Sequence
  dgRNA
  Vil1
ctatcttcccttata

SEQ ID NO: 19071 - DNA, 15 bp, Artificial Sequence
  dgRNA
  Vil1
tcccttatatggtga

SEQ ID NO: 19072 - DNA, 15 bp, Artificial Sequence
  dgRNA
  Utp18
tccgagaagttgtgt

SEQ ID NO: 19073 - DNA, 15 bp, Artificial Sequence
  dgRNA
  Utp18
ccgagaagttgtgtt

SEQ ID NO: 19074 - DNA, 15 bp, Artificial Sequence
  dgRNA
  Utp18
ctccacccggaagat

SEQ ID NO: 19075 - DNA, 15 bp, Artificial Sequence
  dgRNA
  Utp18
gatcggccttccctg

SEQ ID NO: 19076 - DNA, 15 bp, Artificial Sequence
  dgRNA
  Rab7
ccataaagcccaagg

SEQ ID NO: 19077 - DNA, 15 bp, Artificial Sequence
  dgRNA
  Rab7
taaagcccaaggcgg

SEQ ID NO: 19078 - DNA, 15 bp, Artificial Sequence
  dgRNA
  Rab7
ccaaggcggcggcgt

SEQ ID NO: 19079 - DNA, 15 bp, Artificial Sequence
  dgRNA
  Rab7
gttggcggcggtgtt

SEQ ID NO: 19080 - DNA, 15 bp, Artificial Sequence
  dgRNA
  Men1
ccgcggtgccttgtg

SEQ ID NO: 19081 - DNA, 15 bp, Artificial Sequence
  dgRNA
  Men1
cgcggtgccttgtgt

SEQ ID NO: 19082 - DNA, 15 bp, Artificial Sequence
  dgRNA
  Men1
tgtgggatgtaagcg

SEQ ID NO: 19083 - DNA, 15 bp, Artificial Sequence
  dgRNA
  Men1
gggatgtaagcgcgg

SEQ ID NO: 19084 - DNA, 15 bp, Artificial Sequence
  dgRNA
  Snx14
tccggataaggaaag

SEQ ID NO: 19085 - DNA, 15 bp, Artificial Sequence
  dgRNA
  Snx14
ccggataaggaaagt

SEQ ID NO: 19086 - DNA, 15 bp, Artificial Sequence
  dgRNA
  Snx14
ccccagtcctcccgc

SEQ ID NO: 19087 - DNA, 15 bp, Artificial Sequence
  dgRNA
  Snx14
agtcctcccgcggga

SEQ ID NO: 19088 - DNA, 15 bp, Artificial Sequence
  dgRNA
  11-Mar
cccgcgcgcctggca

SEQ ID NO: 19089 - DNA, 15 bp, Artificial Sequence
  dgRNA
  11-Mar
ccgcgcgcctggcac

SEQ ID NO: 19090 - DNA, 15 bp, Artificial Sequence
  dgRNA
  11-Mar
acgggcagccgaact

SEQ ID NO: 19091 - DNA, 15 bp, Artificial Sequence
  dgRNA
  11-Mar
ccatcagagccgagc

SEQ ID NO: 19092 - DNA, 15 bp, Artificial Sequence
  dgRNA
  Gltp
atcccaacctgggcg

SEQ ID NO: 19093 - DNA, 15 bp, Artificial Sequence
  dgRNA
  Gltp
tgggcgcggctcacc

SEQ ID NO: 19094 - DNA, 15 bp, Artificial Sequence
  dgRNA
  Gltp
ccgcctccagaccaa

SEQ ID NO: 19095 - DNA, 15 bp, Artificial Sequence
  dgRNA
  Gltp
tccagaccaatggcg

SEQ ID NO: 19096 - DNA, 15 bp, Artificial Sequence
  dgRNA
  Epb41l4a
tgaattgcttgtgca

SEQ ID NO: 19097 - DNA, 15 bp, Artificial Sequence
  dgRNA
  Epb41l4a
acacgacgacccgcc

SEQ ID NO: 19098 - DNA, 15 bp, Artificial Sequence
  dgRNA
  Epb41l4a
cacgacgacccgcca

SEQ ID NO: 19099 - DNA, 15 bp, Artificial Sequence
  dgRNA
  Epb41l4a
acgacgacccgccag

SEQ ID NO: 19100 - DNA, 15 bp, Artificial Sequence
  dgRNA
  Sult1c2
cttagtgaaacctgc

SEQ ID NO: 19101 - DNA, 15 bp, Artificial Sequence
  dgRNA
  Sult1c2
tagtttggcacagct

SEQ ID NO: 19102 - DNA, 15 bp, Artificial Sequence
  dgRNA
  Sult1c2
atcacgagtcctgaa

SEQ ID NO: 19103 - DNA, 15 bp, Artificial Sequence
  dgRNA
  Sult1c2
tcctgaaaggtgaat

SEQ ID NO: 19104 - DNA, 15 bp, Artificial Sequence
  dgRNA
  Chit1
agtgtggattggccc

SEQ ID NO: 19105 - DNA, 15 bp, Artificial Sequence
  dgRNA
  Chit1
gtgtggattggccca

SEQ ID NO: 19106 - DNA, 15 bp, Artificial Sequence
  dgRNA
  Chit1
ttaagatccccctag

SEQ ID NO: 19107 - DNA, 15 bp, Artificial Sequence
  dgRNA
  Chit1
gatccccctagaggc

SEQ ID NO: 19108 - DNA, 15 bp, Artificial Sequence
  dgRNA
  Cox8a
gtagcttgtgtgatt

SEQ ID NO: 19109 - DNA, 15 bp, Artificial Sequence
  dgRNA
  Cox8a
cactctcgaagaaag

SEQ ID NO: 19110 - DNA, 15 bp, Artificial Sequence
  dgRNA
  Cox8a
tctcgaagaaagtgg

SEQ ID NO: 19111 - DNA, 15 bp, Artificial Sequence
  dgRNA
  Cox8a
taggatgatgtcggt

SEQ ID NO: 19112 - DNA, 15 bp, Artificial Sequence
  dgRNA
  Rhbdd3
cggattgttggcgat

SEQ ID NO: 19113 - DNA, 15 bp, Artificial Sequence
  dgRNA
  Rhbdd3
attgttggcgattgg

SEQ ID NO: 19114 - DNA, 15 bp, Artificial Sequence
  dgRNA
  Rhbdd3
ttgttggcgattggt

SEQ ID NO: 19115 - DNA, 15 bp, Artificial Sequence
  dgRNA
  Rhbdd3
tgttggcgattggtg

SEQ ID NO: 19116 - DNA, 15 bp, Artificial Sequence
  dgRNA
  Atp5b
tcccatgggccaatt

SEQ ID NO: 19117 - DNA, 15 bp, Artificial Sequence
  dgRNA
  Atp5b
gccaattaggtttcg

SEQ ID NO: 19118 - DNA, 15 bp, Artificial Sequence
  dgRNA
  Atp5b
ggtttcgaggcttag

SEQ ID NO: 19119 - DNA, 15 bp, Artificial Sequence
  dgRNA
  Atp5b
gtttcgaggcttaga

SEQ ID NO: 19120 - DNA, 15 bp, Artificial Sequence
  dgRNA
  Runx2
gtggtaaggccttcc

SEQ ID NO: 19121 - DNA, 15 bp, Artificial Sequence
  dgRNA
  Runx2
ctgacaaaaggcttg

SEQ ID NO: 19122 - DNA, 15 bp, Artificial Sequence
  dgRNA
  Barhl2
tcagaaactcggctc

SEQ ID NO: 19123 - DNA, 15 bp, Artificial Sequence
  dgRNA
  Barhl2
cggctccgggactgc

SEQ ID NO: 19124 - DNA, 15 bp, Artificial Sequence
  dgRNA
  Barhl2
ctgccgggtcacgca

SEQ ID NO: 19125 - DNA, 15 bp, Artificial Sequence
  dgRNA
  Barhl2
ccgggtcacgcacgg

SEQ ID NO: 19126 - DNA, 15 bp, Artificial Sequence
  dgRNA
  Pcdh19
cattggagcctgcgc

SEQ ID NO: 19127 - DNA, 15 bp, Artificial Sequence
  dgRNA
  Pcdh19
gcctccgggccgccc

SEQ ID NO: 19128 - DNA, 15 bp, Artificial Sequence
  dgRNA
  Pcdh19
cctccgggccgccct

SEQ ID NO: 19129 - DNA, 15 bp, Artificial Sequence
  dgRNA
  Pcdh19
gcgggactcctcccg

SEQ ID NO: 19130 - DNA, 15 bp, Artificial Sequence
  dgRNA
  Tenm2
ttttatgcttctagg

SEQ ID NO: 19131 - DNA, 15 bp, Artificial Sequence
  dgRNA
  Tenm2
tttatgcttctaggt

SEQ ID NO: 19132 - DNA, 15 bp, Artificial Sequence
  dgRNA
  Tenm2
cttttctaaaagtcg

SEQ ID NO: 19133 - DNA, 15 bp, Artificial Sequence
  dgRNA
  Tenm2
ctgccaaccttcttt

SEQ ID NO: 19134 - DNA, 15 bp, Artificial Sequence
  dgRNA
  Zfp516
tcaggccgtggacgc

SEQ ID NO: 19135 - DNA, 15 bp, Artificial Sequence
  dgRNA
  Zfp516
caggccgtggacgcc

SEQ ID NO: 19136 - DNA, 15 bp, Artificial Sequence
  dgRNA
  Zfp516
ccctccgagccctgc

SEQ ID NO: 19137 - DNA, 15 bp, Artificial Sequence
  dgRNA
  Zfp516
gccctgctggcgcct

SEQ ID NO: 19138 - DNA, 15 bp, Artificial Sequence
  dgRNA
  Adprh
ggcagggcgagcacg

SEQ ID NO: 19139 - DNA, 15 bp, Artificial Sequence
  dgRNA
  Adprh
gggcgagcacgaggc

SEQ ID NO: 19140 - DNA, 15 bp, Artificial Sequence
  dgRNA
  Adprh
ggacaccactccact

SEQ ID NO: 19141 - DNA, 15 bp, Artificial Sequence
  dgRNA
  Adprh
ggcccacacgcagcg

SEQ ID NO: 19142 - DNA, 15 bp, Artificial Sequence
  dgRNA
  Dph7
aaggtcacgagttac

SEQ ID NO: 19143 - DNA, 15 bp, Artificial Sequence
  dgRNA
  Dph7
aggtcacgagttact

SEQ ID NO: 19144 - DNA, 15 bp, Artificial Sequence
  dgRNA
  Dph7
ggtcacgagttactg

SEQ ID NO: 19145 - DNA, 15 bp, Artificial Sequence
  dgRNA
  Dph7
gtcacgagttactgg

SEQ ID NO: 19146 - DNA, 15 bp, Artificial Sequence
  dgRNA
  Zfp27
attgagagggcttgt

SEQ ID NO: 19147 - DNA, 15 bp, Artificial Sequence
  dgRNA
  Usp37
attacagtgtcgtca

SEQ ID NO: 19148 - DNA, 15 bp, Artificial Sequence
  dgRNA
  Usp37
acagtgtcgtcacgg

SEQ ID NO: 19149 - DNA, 15 bp, Artificial Sequence
  dgRNA
  Usp37
cagtgtcgtcacggc

SEQ ID NO: 19150 - DNA, 15 bp, Artificial Sequence
  dgRNA
  Usp37
agtgtcgtcacggcg

SEQ ID NO: 19151 - DNA, 15 bp, Artificial Sequence
  dgRNA
  Snapc3
acaatgcatccagcc

SEQ ID NO: 19152 - DNA, 15 bp, Artificial Sequence
  dgRNA
  Snapc3
gaccgagccgcgccc

SEQ ID NO: 19153 - DNA, 15 bp, Artificial Sequence
  dgRNA
  Snapc3
cgagccgcgcccagg

SEQ ID NO: 19154 - DNA, 15 bp, Artificial Sequence
  dgRNA
  Snapc3
cggtagccagcctgc

SEQ ID NO: 19155 - DNA, 15 bp, Artificial Sequence
  dgRNA
  Camk2d
cgaagctggcagccg

SEQ ID NO: 19156 - DNA, 15 bp, Artificial Sequence
  dgRNA
  Camk2d
cggctcgggcgaagc

SEQ ID NO: 19157 - DNA, 15 bp, Artificial Sequence
  dgRNA
  Camk2d
gcgctcgctcggctc

SEQ ID NO: 19158 - DNA, 15 bp, Artificial Sequence
  dgRNA
  Camk2d
tgcgctcgctcggct

SEQ ID NO: 19159 - DNA, 15 bp, Artificial Sequence
  dgRNA
  BC028528
atctacggagcgagt

SEQ ID NO: 19160 - DNA, 15 bp, Artificial Sequence
  dgRNA
  BC028528
tacggagcgagtagg

SEQ ID NO: 19161 - DNA, 15 bp, Artificial Sequence
  dgRNA
  BC028528
gcggggtaagtgtgg

SEQ ID NO: 19162 - DNA, 15 bp, Artificial Sequence
  dgRNA
  BC028528
cggggtaagtgtggt

SEQ ID NO: 19163 - DNA, 15 bp, Artificial Sequence
  dgRNA
  Actg1
cccgcgagcaagaac

SEQ ID NO: 19164 - DNA, 15 bp, Artificial Sequence
  dgRNA
  Actg1
ccgcgagcaagaacc

SEQ ID NO: 19165 - DNA, 15 bp, Artificial Sequence
  dgRNA
  Actg1
aagaaccgggcctcc

SEQ ID NO: 19166 - DNA, 15 bp, Artificial Sequence
  dgRNA
  Actg1
agaaccgggcctccc

SEQ ID NO: 19167 - DNA, 15 bp, Artificial Sequence
  dgRNA
  Ngef
tattaccttgcagcc

SEQ ID NO: 19168 - DNA, 15 bp, Artificial Sequence
  dgRNA
  Ngef
ttaccttgcagccag

SEQ ID NO: 19169 - DNA, 15 bp, Artificial Sequence
  dgRNA
  Ngef
cagccaggggccgtt

SEQ ID NO: 19170 - DNA, 15 bp, Artificial Sequence
  dgRNA
  Ngef
agccaggggccgttt

SEQ ID NO: 19171 - DNA, 15 bp, Artificial Sequence
  dgRNA
  CAAA01180111.1
catggtcgtgaaacc

SEQ ID NO: 19172 - DNA, 15 bp, Artificial Sequence
  dgRNA
  CAAA01180111.1
atggtcgtgaaacct

SEQ ID NO: 19173 - DNA, 15 bp, Artificial Sequence
  dgRNA
  CAAA01180111.1
gacactcaaacacta

SEQ ID NO: 19174 - DNA, 15 bp, Artificial Sequence
  dgRNA
  CAAA01180111.1
taagggaggtgttcg

SEQ ID NO: 19175 - DNA, 15 bp, Artificial Sequence
  dgRNA
  Olfr807
gagtatctgatacat

SEQ ID NO: 19176 - DNA, 15 bp, Artificial Sequence
  dgRNA
  Slc39a3
ccagagtagactagt

SEQ ID NO: 19177 - DNA, 15 bp, Artificial Sequence
  dgRNA
  Slc39a3
ctagtaggccccgtg

SEQ ID NO: 19178 - DNA, 15 bp, Artificial Sequence
  dgRNA
  Slc39a3
ggtgatacagggcta

SEQ ID NO: 19179 - DNA, 15 bp, Artificial Sequence
  dgRNA
  Slc39a3
cgcttatacaactga

SEQ ID NO: 19180 - DNA, 15 bp, Artificial Sequence
  dgRNA
  Slc2a13
aaccccgcccacaga

SEQ ID NO: 19181 - DNA, 15 bp, Artificial Sequence
  dgRNA
  Slc2a13
gaggtggcagcgtcc

SEQ ID NO: 19182 - DNA, 15 bp, Artificial Sequence
  dgRNA
  Slc2a13
aggtggcagcgtcca

SEQ ID NO: 19183 - DNA, 15 bp, Artificial Sequence
  dgRNA
  Slc2a13
ggtggcagcgtccag

SEQ ID NO: 19184 - DNA, 15 bp, Artificial Sequence
  dgRNA
  Olfr18
tttcaagaccctata

SEQ ID NO: 19185 - DNA, 15 bp, Artificial Sequence
  dgRNA
  Olfr18
ttcaagaccctataa

SEQ ID NO: 19186 - DNA, 15 bp, Artificial Sequence
  dgRNA
  Olfr18
tcagttccccttata

SEQ ID NO: 19187 - DNA, 15 bp, Artificial Sequence
  dgRNA
  Olfr18
gtcagttccccttat

SEQ ID NO: 19188 - DNA, 15 bp, Artificial Sequence
  dgRNA
  Tns3
cgggtgtccagcacc

SEQ ID NO: 19189 - DNA, 15 bp, Artificial Sequence
  dgRNA
  Tns3
agcacctggaaacgc

SEQ ID NO: 19190 - DNA, 15 bp, Artificial Sequence
  dgRNA
  Tns3
acgcaggacattgtt

SEQ ID NO: 19191 - DNA, 15 bp, Artificial Sequence
  dgRNA
  Tns3
gaccaggtgaccggc

SEQ ID NO: 19192 - DNA, 15 bp, Artificial Sequence
  dgRNA
  Abcc12
gtggttactcaacca

SEQ ID NO: 19193 - DNA, 15 bp, Artificial Sequence
  dgRNA
  Abcc12
gttactcaaccaggg

SEQ ID NO: 19194 - DNA, 15 bp, Artificial Sequence
  dgRNA
  Abcc12
ttactcaaccagggt

SEQ ID NO: 19195 - DNA, 15 bp, Artificial Sequence
  dgRNA
  Abcc12
tactcaaccagggtg

SEQ ID NO: 19196 - DNA, 15 bp, Artificial Sequence
  dgRNA
  Rbm33
tcccgcctgaagcct

SEQ ID NO: 19197 - DNA, 15 bp, Artificial Sequence
  dgRNA
  Rbm33
ctcggccttccagcc

SEQ ID NO: 19198 - DNA, 15 bp, Artificial Sequence
  dgRNA
  Rbm33
tctagcgcgcgccgc

SEQ ID NO: 19199 - DNA, 15 bp, Artificial Sequence
  dgRNA
  Rbm33
ctagcgcgcgccgcc

SEQ ID NO: 19200 - DNA, 15 bp, Artificial Sequence
  dgRNA
  Fam204a
cgcttggttaaagtg

SEQ ID NO: 19201 - DNA, 15 bp, Artificial Sequence
  dgRNA
  Fam204a
ttagcagaggcgttt

SEQ ID NO: 19202 - DNA, 15 bp, Artificial Sequence
  dgRNA
  Fam204a
gcgtttaggcaagcc

SEQ ID NO: 19203 - DNA, 15 bp, Artificial Sequence
  dgRNA
  Fam204a
accatagagccagaa

SEQ ID NO: 19204 - DNA, 15 bp, Artificial Sequence
  dgRNA
  Gm5414
tgtaaactcaccatc

SEQ ID NO: 19205 - DNA, 15 bp, Artificial Sequence
  dgRNA
  Gm5414
atgtacaaatgggct

SEQ ID NO: 19206 - DNA, 15 bp, Artificial Sequence
  dgRNA
  Gm5414
gagtaagttgcattc

SEQ ID NO: 19207 - DNA, 15 bp, Artificial Sequence
  dgRNA
  Odam
agtgtagctatttat

SEQ ID NO: 19208 - DNA, 15 bp, Artificial Sequence
  dgRNA
  Odam
gcaagttgtgacaca

SEQ ID NO: 19209 - DNA, 15 bp, Artificial Sequence
  dgRNA
  Snrnp40
tgcactgcgcgcccg

SEQ ID NO: 19210 - DNA, 15 bp, Artificial Sequence
  dgRNA
  Snrnp40
gcactgcgcgcccga

SEQ ID NO: 19211 - DNA, 15 bp, Artificial Sequence
  dgRNA
  Snrnp40
actgcgcgcccgagg

SEQ ID NO: 19212 - DNA, 15 bp, Artificial Sequence
  dgRNA
  Snrnp40
tgacgtcatcagaat

SEQ ID NO: 19213 - DNA, 15 bp, Artificial Sequence
  dgRNA
  Nol4
cctagctgcctcata

SEQ ID NO: 19214 - DNA, 15 bp, Artificial Sequence
  dgRNA
  Nol4
ctagctgcctcataa

SEQ ID NO: 19215 - DNA, 15 bp, Artificial Sequence
  dgRNA
  Nol4
ctcacctagagtgag

SEQ ID NO: 19216 - DNA, 15 bp, Artificial Sequence
  dgRNA
  Nol4
gagtgagcggtgtgg

SEQ ID NO: 19217 - DNA, 15 bp, Artificial Sequence
  dgRNA
  Nkain3
tgcggtgggctgtct

SEQ ID NO: 19218 - DNA, 15 bp, Artificial Sequence
  dgRNA
  Nkain3
gtgcggtgggctgtc

SEQ ID NO: 19219 - DNA, 15 bp, Artificial Sequence
  dgRNA
  Nkain3
tctggaaagtgcggt

SEQ ID NO: 19220 - DNA, 15 bp, Artificial Sequence
  dgRNA
  Nkain3
gtctggaaagtgcgg

SEQ ID NO: 19221 - DNA, 15 bp, Artificial Sequence
  dgRNA
  Sox15
gtctcgctgaagcag

SEQ ID NO: 19222 - DNA, 15 bp, Artificial Sequence
  dgRNA
  Sox15
agaacactacctctc

SEQ ID NO: 19223 - DNA, 15 bp, Artificial Sequence
  dgRNA
  Sox15
ctacctctccggtaa

SEQ ID NO: 19224 - DNA, 15 bp, Artificial Sequence
  dgRNA
  Sox15
tacctctccggtaaa

SEQ ID NO: 19225 - DNA, 15 bp, Artificial Sequence
  dgRNA
  Uba7
gcctcttgtaacact

SEQ ID NO: 19226 - DNA, 15 bp, Artificial Sequence
  dgRNA
  Uba7
gcgataaaccccagt

SEQ ID NO: 19227 - DNA, 15 bp, Artificial Sequence
  dgRNA
  Uba7
tcccagtgttacaag

SEQ ID NO: 19228 - DNA, 15 bp, Artificial Sequence
  dgRNA
  Uba7
ctggggtttatcgct

SEQ ID NO: 19229 - DNA, 15 bp, Artificial Sequence
  dgRNA
  Erich6
agaaggtccggctcc

SEQ ID NO: 19230 - DNA, 15 bp, Artificial Sequence
  dgRNA
  Erich6
gaaggtccggctcca

SEQ ID NO: 19231 - DNA, 15 bp, Artificial Sequence
  dgRNA
  Erich6
aaagaagcttggcgc

SEQ ID NO: 19232 - DNA, 15 bp, Artificial Sequence
  dgRNA
  Erich6
aagaagcttggcgca

SEQ ID NO: 19233 - DNA, 15 bp, Artificial Sequence
  dgRNA
  Stx5a
ttgttctcgcacttc

SEQ ID NO: 19234 - DNA, 15 bp, Artificial Sequence
  dgRNA
  Stx5a
tgttctcgcacttca

SEQ ID NO: 19235 - DNA, 15 bp, Artificial Sequence
  dgRNA
  Stx5a
gttctcgcacttcag

SEQ ID NO: 19236 - DNA, 15 bp, Artificial Sequence
  dgRNA
  Stx5a
tcgcacttcaggggc

SEQ ID NO: 19237 - DNA, 15 bp, Artificial Sequence
  dgRNA
  Rgs20
ttgcgattataagag

SEQ ID NO: 19238 - DNA, 15 bp, Artificial Sequence
  dgRNA
  Rgs20
tccgctcgcccgatt

SEQ ID NO: 19239 - DNA, 15 bp, Artificial Sequence
  dgRNA
  Rgs20
ccgctcgcccgattt

SEQ ID NO: 19240 - DNA, 15 bp, Artificial Sequence
  dgRNA
  Rgs20
gcccgatttgggact

SEQ ID NO: 19241 - DNA, 15 bp, Artificial Sequence
  dgRNA
  Sap130
ggccccgccctctta

SEQ ID NO: 19242 - DNA, 15 bp, Artificial Sequence
  dgRNA
  Sap130
ccgccctcttagggc

SEQ ID NO: 19243 - DNA, 15 bp, Artificial Sequence
  dgRNA
  Sap130
cgccctcttagggct

SEQ ID NO: 19244 - DNA, 15 bp, Artificial Sequence
  dgRNA
  Sap130
tcctagaggcctctt

SEQ ID NO: 19245 - DNA, 15 bp, Artificial Sequence
  dgRNA
  Dcaf12l1
cgcccccttctggct

SEQ ID NO: 19246 - DNA, 15 bp, Artificial Sequence
  dgRNA
  Dcaf12l1
cggactcgtcgctca

SEQ ID NO: 19247 - DNA, 15 bp, Artificial Sequence
  dgRNA
  Dcaf12l1
gacagacgtgatggg

SEQ ID NO: 19248 - DNA, 15 bp, Artificial Sequence
  dgRNA
  Dcaf12l1
aatgacagacgtgat

SEQ ID NO: 19249 - DNA, 15 bp, Artificial Sequence
  dgRNA
  Catsperg1
cccttttgcccgtgc

SEQ ID NO: 19250 - DNA, 15 bp, Artificial Sequence
  dgRNA
  Catsperg1
ccttttgcccgtgct

SEQ ID NO: 19251 - DNA, 15 bp, Artificial Sequence
  dgRNA
  Catsperg1
gggctctagcaagcc

SEQ ID NO: 19252 - DNA, 15 bp, Artificial Sequence
  dgRNA
  Catsperg1
aaagggcttaagagc

SEQ ID NO: 19253 - DNA, 15 bp, Artificial Sequence
  dgRNA
  Olfr322
gtcatacggagaaac

SEQ ID NO: 19254 - DNA, 15 bp, Artificial Sequence
  dgRNA
  Olfr322
aagtcagatgtcata

SEQ ID NO: 19255 - DNA, 15 bp, Artificial Sequence
  dgRNA
  Pou3f3
agcaaccaatcggaa

SEQ ID NO: 19256 - DNA, 15 bp, Artificial Sequence
  dgRNA
  Pou3f3
accaatcggaacggc

SEQ ID NO: 19257 - DNA, 15 bp, Artificial Sequence
  dgRNA
  Pou3f3
atcggaacggccgga

SEQ ID NO: 19258 - DNA, 15 bp, Artificial Sequence
  dgRNA
  Pou3f3
tcggaacggccggaa

SEQ ID NO: 19259 - DNA, 15 bp, Artificial Sequence
  dgRNA
  Nkrf
cgcctcgcttgcccc

SEQ ID NO: 19260 - DNA, 15 bp, Artificial Sequence
  dgRNA
  Nkrf
ttgcccccggccagt

SEQ ID NO: 19261 - DNA, 15 bp, Artificial Sequence
  dgRNA
  Nkrf
ccccggccagttggt

SEQ ID NO: 19262 - DNA, 15 bp, Artificial Sequence
  dgRNA
  Nkrf
ggtaggcatcgtccc

SEQ ID NO: 19263 - DNA, 15 bp, Artificial Sequence
  dgRNA
  Map4k1
aaaggggagtcccat

SEQ ID NO: 19264 - DNA, 15 bp, Artificial Sequence
  dgRNA
  Map4k1
cccaacactctattt

SEQ ID NO: 19265 - DNA, 15 bp, Artificial Sequence
  dgRNA
  Map4k1
cttaaatgcaacctg

SEQ ID NO: 19266 - DNA, 15 bp, Artificial Sequence
  dgRNA
  Map4k1
tcttaaatgcaacct

SEQ ID NO: 19267 - DNA, 15 bp, Artificial Sequence
  dgRNA
  Fam114a2
ggagggcggacatcc

SEQ ID NO: 19268 - DNA, 15 bp, Artificial Sequence
  dgRNA
  Fam114a2
cgccttccgccctag

SEQ ID NO: 19269 - DNA, 15 bp, Artificial Sequence
  dgRNA
  Fam114a2
ggaagtactcctcga

SEQ ID NO: 19270 - DNA, 15 bp, Artificial Sequence
  dgRNA
  Fam114a2
cccgcctccgcgctg

SEQ ID NO: 19271 - DNA, 15 bp, Artificial Sequence
  dgRNA
  Mfng
ttcccacctcgtgga

SEQ ID NO: 19272 - DNA, 15 bp, Artificial Sequence
  dgRNA
  Mfng
acctcgtggagggtt

SEQ ID NO: 19273 - DNA, 15 bp, Artificial Sequence
  dgRNA
  Mfng
agctaagtggcccgg

SEQ ID NO: 19274 - DNA, 15 bp, Artificial Sequence
  dgRNA
  Mfng
gctaagtggcccgga

SEQ ID NO: 19275 - DNA, 15 bp, Artificial Sequence
  dgRNA
  Cul3
ccgccgccatcgcgg

SEQ ID NO: 19276 - DNA, 15 bp, Artificial Sequence
  dgRNA
  Cul3
ggaggagcgcgataa

SEQ ID NO: 19277 - DNA, 15 bp, Artificial Sequence
  dgRNA
  Cul3
gaggagcgcgataaa

SEQ ID NO: 19278 - DNA, 15 bp, Artificial Sequence
  dgRNA
  Cul3
aaagggagccgagcc

SEQ ID NO: 19279 - DNA, 15 bp, Artificial Sequence
  dgRNA
  Kcnip2
gaagccccgcaattg

SEQ ID NO: 19280 - DNA, 15 bp, Artificial Sequence
  dgRNA
  Kcnip2
aagccccgcaattgt

SEQ ID NO: 19281 - DNA, 15 bp, Artificial Sequence
  dgRNA
  Kcnip2
ccccgcaattgtggg

SEQ ID NO: 19282 - DNA, 15 bp, Artificial Sequence
  dgRNA
  Kcnip2
gttcaccccttcacc

SEQ ID NO: 19283 - DNA, 15 bp, Artificial Sequence
  dgRNA
  Polb
cctccgtctgcatct

SEQ ID NO: 19284 - DNA, 15 bp, Artificial Sequence
  dgRNA
  Polb
gactattctcagacc

SEQ ID NO: 19285 - DNA, 15 bp, Artificial Sequence
  dgRNA
  Polb
ggctaactcaccagg

SEQ ID NO: 19286 - DNA, 15 bp, Artificial Sequence
  dgRNA
  Polb
ggacgttggctgctg

SEQ ID NO: 19287 - DNA, 15 bp, Artificial Sequence
  dgRNA
  Skint6
gcttatagaatcatt

SEQ ID NO: 19288 - DNA, 15 bp, Artificial Sequence
  dgRNA
  Skint6
atctctatctgactc

SEQ ID NO: 19289 - DNA, 15 bp, Artificial Sequence
  dgRNA
  Skint6
aaattacgacagggc

SEQ ID NO: 19290 - DNA, 15 bp, Artificial Sequence
  dgRNA
  Skint6
ctgaaaattacgaca

SEQ ID NO: 19291 - DNA, 15 bp, Artificial Sequence
  dgRNA
  Hr
aacagaccagatatc

SEQ ID NO: 19292 - DNA, 15 bp, Artificial Sequence
  dgRNA
  Hr
accagatatcaggtc

SEQ ID NO: 19293 - DNA, 15 bp, Artificial Sequence
  dgRNA
  Hr
cgacactatgaagag

SEQ ID NO: 19294 - DNA, 15 bp, Artificial Sequence
  dgRNA
  Hr
aagagtggcttagcc

SEQ ID NO: 19295 - DNA, 15 bp, Artificial Sequence
  dgRNA
  Idh3g
tccgcttccctagcc

SEQ ID NO: 19296 - DNA, 15 bp, Artificial Sequence
  dgRNA
  Idh3g
ccgcttccctagcca

SEQ ID NO: 19297 - DNA, 15 bp, Artificial Sequence
  dgRNA
  Idh3g
gcggaacagtgctct

SEQ ID NO: 19298 - DNA, 15 bp, Artificial Sequence
  dgRNA
  Idh3g
gctctaggcaccgga

SEQ ID NO: 19299 - DNA, 15 bp, Artificial Sequence
  dgRNA
  Rpl39
cccctctcgcagaag

SEQ ID NO: 19300 - DNA, 15 bp, Artificial Sequence
  dgRNA
  Rpl39
cctctcgcagaagcg

SEQ ID NO: 19301 - DNA, 15 bp, Artificial Sequence
  dgRNA
  Rpl39
ctctcgcagaagcgg

SEQ ID NO: 19302 - DNA, 15 bp, Artificial Sequence
  dgRNA
  Rpl39
tctcgcagaagcggg

SEQ ID NO: 19303 - DNA, 15 bp, Artificial Sequence
  dgRNA
  Gm5741
agccaggtcagtatt

SEQ ID NO: 19304 - DNA, 15 bp, Artificial Sequence
  dgRNA
  Gm5741
tccccaatactgacc

SEQ ID NO: 19305 - DNA, 15 bp, Artificial Sequence
  dgRNA
  Gm5741
tcacctaccctactc

SEQ ID NO: 19306 - DNA, 15 bp, Artificial Sequence
  dgRNA
  Atg9a
cgtagagcacactat

SEQ ID NO: 19307 - DNA, 15 bp, Artificial Sequence
  dgRNA
  Atg9a
ttccgtcctgccccc

SEQ ID NO: 19308 - DNA, 15 bp, Artificial Sequence
  dgRNA
  Atg9a
tccgtcctgccccct

SEQ ID NO: 19309 - DNA, 15 bp, Artificial Sequence
  dgRNA
  Atg9a
ccctgggctaagaat

SEQ ID NO: 19310 - DNA, 15 bp, Artificial Sequence
  dgRNA
  Mapk10
tgaattcgcatattt

SEQ ID NO: 19311 - DNA, 15 bp, Artificial Sequence
  dgRNA
  Mapk10
ttttgccagaaaacg

SEQ ID NO: 19312 - DNA, 15 bp, Artificial Sequence
  dgRNA
  Mapk10
tcagcgtgcgggggg

SEQ ID NO: 19313 - DNA, 15 bp, Artificial Sequence
  dgRNA
  Mapk10
ttcagcgtgcggggg

SEQ ID NO: 19314 - DNA, 15 bp, Artificial Sequence
  dgRNA
  Fam195b
ggggaaatgcgtgtc

SEQ ID NO: 19315 - DNA, 15 bp, Artificial Sequence
  dgRNA
  Fam195b
gggaaatgcgtgtcc

SEQ ID NO: 19316 - DNA, 15 bp, Artificial Sequence
  dgRNA
  Fam195b
ggaaatgcgtgtccg

SEQ ID NO: 19317 - DNA, 15 bp, Artificial Sequence
  dgRNA
  Fam195b
atgcgtgtccggggc

SEQ ID NO: 19318 - DNA, 15 bp, Artificial Sequence
  dgRNA
  Srsf1
cccgccaggacgcga

SEQ ID NO: 19319 - DNA, 15 bp, Artificial Sequence
  dgRNA
  Srsf1
tcccctccgtgcgga

SEQ ID NO: 19320 - DNA, 15 bp, Artificial Sequence
  dgRNA
  Srsf1
ctcagcacccgttag

SEQ ID NO: 19321 - DNA, 15 bp, Artificial Sequence
  dgRNA
  Srsf1
cgcctgcgcactggg

SEQ ID NO: 19322 - DNA, 15 bp, Artificial Sequence
  dgRNA
  Cnp
aacaaagaggtggcg

SEQ ID NO: 19323 - DNA, 15 bp, Artificial Sequence
  dgRNA
  Cnp
tggcggactctttct

SEQ ID NO: 19324 - DNA, 15 bp, Artificial Sequence
  dgRNA
  Cnp
tggcattgagagtcc

SEQ ID NO: 19325 - DNA, 15 bp, Artificial Sequence
  dgRNA
  Cnp
cagaccgctgcttcc

SEQ ID NO: 19326 - DNA, 15 bp, Artificial Sequence
  dgRNA
  Cd82
ctccacacggagacc

SEQ ID NO: 19327 - DNA, 15 bp, Artificial Sequence
  dgRNA
  Cd82
acggagacctggtct

SEQ ID NO: 19328 - DNA, 15 bp, Artificial Sequence
  dgRNA
  Cd82
ctcccacgccattcc

SEQ ID NO: 19329 - DNA, 15 bp, Artificial Sequence
  dgRNA
  Cd82
tcccacgccattccc

SEQ ID NO: 19330 - DNA, 15 bp, Artificial Sequence
  dgRNA
  Vmn1r12
ctataatgtacactc

SEQ ID NO: 19331 - DNA, 15 bp, Artificial Sequence
  dgRNA
  D630023F18Rik
atgggcacaaggttc

SEQ ID NO: 19332 - DNA, 15 bp, Artificial Sequence
  dgRNA
  D630023F18Rik
aattctggatggtct

SEQ ID NO: 19333 - DNA, 15 bp, Artificial Sequence
  dgRNA
  D630023F18Rik
ctcaaactccatgac

SEQ ID NO: 19334 - DNA, 15 bp, Artificial Sequence
  dgRNA
  Nmu
tcagagccaactgcg

SEQ ID NO: 19335 - DNA, 15 bp, Artificial Sequence
  dgRNA
  Nmu
gtcagacactcggcc

SEQ ID NO: 19336 - DNA, 15 bp, Artificial Sequence
  dgRNA
  Nmu
ggagcgcgtgtcctg

SEQ ID NO: 19337 - DNA, 15 bp, Artificial Sequence
  dgRNA
  Nmu
gagcgcgtgtcctgc

SEQ ID NO: 19338 - DNA, 15 bp, Artificial Sequence
  dgRNA
  Adgrf4
ttgacagacccactg

SEQ ID NO: 19339 - DNA, 15 bp, Artificial Sequence
  dgRNA
  Adgrf4
caatcctcgaagctg

SEQ ID NO: 19340 - DNA, 15 bp, Artificial Sequence
  dgRNA
  Adgrf4
aatcctcgaagctgt

SEQ ID NO: 19341 - DNA, 15 bp, Artificial Sequence
  dgRNA
  Adgrf4
ggtgtaattagaaca

SEQ ID NO: 19342 - DNA, 15 bp, Artificial Sequence
  dgRNA
  Synj2bp
cttgagaacagtgcg

SEQ ID NO: 19343 - DNA, 15 bp, Artificial Sequence
  dgRNA
  Synj2bp
aacagtgcgaggtac

SEQ ID NO: 19344 - DNA, 15 bp, Artificial Sequence
  dgRNA
  Synj2bp
ggtaccggaaaacgc

SEQ ID NO: 19345 - DNA, 15 bp, Artificial Sequence
  dgRNA
  Synj2bp
accggaaaacgctgg

SEQ ID NO: 19346 - DNA, 15 bp, Artificial Sequence
  dgRNA
  Kidins220
cccctccaggaggcg

SEQ ID NO: 19347 - DNA, 15 bp, Artificial Sequence
  dgRNA
  Kidins220
cacgcctcctggagg

SEQ ID NO: 19348 - DNA, 15 bp, Artificial Sequence
  dgRNA
  Kidins220
ccacgcctcctggag

SEQ ID NO: 19349 - DNA, 15 bp, Artificial Sequence
  dgRNA
  Kidins220
gccacgcctcctgga

SEQ ID NO: 19350 - DNA, 15 bp, Artificial Sequence
  dgRNA
  Isx
tcacttggccatcta

SEQ ID NO: 19351 - DNA, 15 bp, Artificial Sequence
  dgRNA
  Isx
ccatctagggcccat

SEQ ID NO: 19352 - DNA, 15 bp, Artificial Sequence
  dgRNA
  Isx
tctagggcccatagg

SEQ ID NO: 19353 - DNA, 15 bp, Artificial Sequence
  dgRNA
  Isx
gctggctccctgcgg

SEQ ID NO: 19354 - DNA, 15 bp, Artificial Sequence
  dgRNA
  Sufu
gtctctgttctaaac

SEQ ID NO: 19355 - DNA, 15 bp, Artificial Sequence
  dgRNA
  Sufu
gttcctcctaacact

SEQ ID NO: 19356 - DNA, 15 bp, Artificial Sequence
  dgRNA
  Sufu
tcctcctaacactag

SEQ ID NO: 19357 - DNA, 15 bp, Artificial Sequence
  dgRNA
  Sufu
ggacgctcccaaccc

SEQ ID NO: 19358 - DNA, 15 bp, Artificial Sequence
  dgRNA
  Grsf1
gtccctccgccgccg

SEQ ID NO: 19359 - DNA, 15 bp, Artificial Sequence
  dgRNA
  Grsf1
ccgccgcgtcctact

SEQ ID NO: 19360 - DNA, 15 bp, Artificial Sequence
  dgRNA
  Grsf1
tgtttccgcgatcgc

SEQ ID NO: 19361 - DNA, 15 bp, Artificial Sequence
  dgRNA
  Grsf1
cgctggcagccgccg

SEQ ID NO: 19362 - DNA, 15 bp, Artificial Sequence
  dgRNA
  Scn3a
ataaagaggcgtgaa

SEQ ID NO: 19363 - DNA, 15 bp, Artificial Sequence
  dgRNA
  Scn3a
actcgtgtggtagct

SEQ ID NO: 19364 - DNA, 15 bp, Artificial Sequence
  dgRNA
  Scn3a
tctgctgtcaccgtg

SEQ ID NO: 19365 - DNA, 15 bp, Artificial Sequence
  dgRNA
  Scn3a
tgccttccgaagaga

SEQ ID NO: 19366 - DNA, 15 bp, Artificial Sequence
  dgRNA
  Pcbp1
ccgccatcgaatcct

SEQ ID NO: 19367 - DNA, 15 bp, Artificial Sequence
  dgRNA
  Pcbp1
cgccatcgaatcctt

SEQ ID NO: 19368 - DNA, 15 bp, Artificial Sequence
  dgRNA
  Pcbp1
catcgaatccttggg

SEQ ID NO: 19369 - DNA, 15 bp, Artificial Sequence
  dgRNA
  Pcbp1
aatccttgggcggac

SEQ ID NO: 19370 - DNA, 15 bp, Artificial Sequence
  dgRNA
  Prl8a2
gatggttcatgaatg

SEQ ID NO: 19371 - DNA, 15 bp, Artificial Sequence
  dgRNA
  Prl8a2
gttgtgcatgccctc

SEQ ID NO: 19372 - DNA, 15 bp, Artificial Sequence
  dgRNA
  Prl8a2
gtaaaactatatagg

SEQ ID NO: 19373 - DNA, 15 bp, Artificial Sequence
  dgRNA
  Prl8a2
aactagcctaatgta

SEQ ID NO: 19374 - DNA, 15 bp, Artificial Sequence
  dgRNA
  Rasl11b
ttgccaccctcgcgc

SEQ ID NO: 19375 - DNA, 15 bp, Artificial Sequence
  dgRNA
  Rasl11b
ccgccctgttttcct

SEQ ID NO: 19376 - DNA, 15 bp, Artificial Sequence
  dgRNA
  Rasl11b
tttcctcggatctca

SEQ ID NO: 19377 - DNA, 15 bp, Artificial Sequence
  dgRNA
  Rasl11b
ttcctcggatctcac

SEQ ID NO: 19378 - DNA, 15 bp, Artificial Sequence
  dgRNA
  St14
gatggccagtatcaa

SEQ ID NO: 19379 - DNA, 15 bp, Artificial Sequence
  dgRNA
  St14
ccagtatcaaaggac

SEQ ID NO: 19380 - DNA, 15 bp, Artificial Sequence
  dgRNA
  St14
aaaggaccggactga

SEQ ID NO: 19381 - DNA, 15 bp, Artificial Sequence
  dgRNA
  St14
aaggaccggactgaa

SEQ ID NO: 19382 - DNA, 15 bp, Artificial Sequence
  dgRNA
  Olfr1219
gtaatctttttgatg

SEQ ID NO: 19383 - DNA, 15 bp, Artificial Sequence
  dgRNA
  Cdc7
gcggcccggctcagt

SEQ ID NO: 19384 - DNA, 15 bp, Artificial Sequence
  dgRNA
  Cdc7
gtgggacgctcctga

SEQ ID NO: 19385 - DNA, 15 bp, Artificial Sequence
  dgRNA
  Cdc7
tgagggaagcgaccg

SEQ ID NO: 19386 - DNA, 15 bp, Artificial Sequence
  dgRNA
  Cdc7
ttttcccccctgccg

SEQ ID NO: 19387 - DNA, 15 bp, Artificial Sequence
  dgRNA
  Cyhr1
ctcccggctcagacc

SEQ ID NO: 19388 - DNA, 15 bp, Artificial Sequence
  dgRNA
  Cyhr1
tcccggctcagaccc

SEQ ID NO: 19389 - DNA, 15 bp, Artificial Sequence
  dgRNA
  Cyhr1
cccggctcagacccg

SEQ ID NO: 19390 - DNA, 15 bp, Artificial Sequence
  dgRNA
  Cyhr1
ccccgggtctgagcc

SEQ ID NO: 19391 - DNA, 15 bp, Artificial Sequence
  dgRNA
  Rps27
ctaactctctcacca

SEQ ID NO: 19392 - DNA, 15 bp, Artificial Sequence
  dgRNA
  Rps27
cgcgcccgcgacgcg

SEQ ID NO: 19393 - DNA, 15 bp, Artificial Sequence
  dgRNA
  Rps27
cgcgaggagccttta

SEQ ID NO: 19394 - DNA, 15 bp, Artificial Sequence
  dgRNA
  Rps27
cggaccttctacaaa

SEQ ID NO: 19395 - DNA, 15 bp, Artificial Sequence
  dgRNA
  Fcrla
ttaatctacaccctg

SEQ ID NO: 19396 - DNA, 15 bp, Artificial Sequence
  dgRNA
  Fcrla
taatctacaccctga

SEQ ID NO: 19397 - DNA, 15 bp, Artificial Sequence
  dgRNA
  Fcrla
gtgacaagagccaat

SEQ ID NO: 19398 - DNA, 15 bp, Artificial Sequence
  dgRNA
  Fcrla
ggaggcgagacagtt

SEQ ID NO: 19399 - DNA, 15 bp, Artificial Sequence
  dgRNA
  Olfr832
ctaagaaagtacatt

SEQ ID NO: 19400 - DNA, 15 bp, Artificial Sequence
  dgRNA
  Fbxo40
tgccgcagtccccac

SEQ ID NO: 19401 - DNA, 15 bp, Artificial Sequence
  dgRNA
  Fbxo40
tgagtggcgtaactt

SEQ ID NO: 19402 - DNA, 15 bp, Artificial Sequence
  dgRNA
  Fbxo40
gagtggcgtaactta

SEQ ID NO: 19403 - DNA, 15 bp, Artificial Sequence
  dgRNA
  Fbxo40
atgctcaggtcaagc

SEQ ID NO: 19404 - DNA, 15 bp, Artificial Sequence
  dgRNA
  Nr0b2
ccttcccgcccatca

SEQ ID NO: 19405 - DNA, 15 bp, Artificial Sequence
  dgRNA
  Nr0b2
actggaagctccacg

SEQ ID NO: 19406 - DNA, 15 bp, Artificial Sequence
  dgRNA
  Nr0b2
cacgctgaccctggc

SEQ ID NO: 19407 - DNA, 15 bp, Artificial Sequence
  dgRNA
  Nr0b2
catacacgctgaccc

SEQ ID NO: 19408 - DNA, 15 bp, Artificial Sequence
  dgRNA
  Rpn1
aatcaggggtgaata

SEQ ID NO: 19409 - DNA, 15 bp, Artificial Sequence
  dgRNA
  Rpn1
cgccccacgatcgcc

SEQ ID NO: 19410 - DNA, 15 bp, Artificial Sequence
  dgRNA
  Rpn1
atcgcccggttgccc

SEQ ID NO: 19411 - DNA, 15 bp, Artificial Sequence
  dgRNA
  Rpn1
ggggtcctttctgac

SEQ ID NO: 19412 - DNA, 15 bp, Artificial Sequence
  dgRNA
  Lrrc19
gtcaatcttttgcta

SEQ ID NO: 19413 - DNA, 15 bp, Artificial Sequence
  dgRNA
  Lrrc19
tgtttacgagttcaa

SEQ ID NO: 19414 - DNA, 15 bp, Artificial Sequence
  dgRNA
  Pik3r3
ggacagtcgagctac

SEQ ID NO: 19415 - DNA, 15 bp, Artificial Sequence
  dgRNA
  Pik3r3
tcctgcccggttggt

SEQ ID NO: 19416 - DNA, 15 bp, Artificial Sequence
  dgRNA
  Pik3r3
tggttggcgcctcag

SEQ ID NO: 19417 - DNA, 15 bp, Artificial Sequence
  dgRNA
  Pik3r3
gttggcgcctcagcg

SEQ ID NO: 19418 - DNA, 15 bp, Artificial Sequence
  dgRNA
  Akr1b3
gcaaacactgccacg

SEQ ID NO: 19419 - DNA, 15 bp, Artificial Sequence
  dgRNA
  Akr1b3
caaacactgccacgt

SEQ ID NO: 19420 - DNA, 15 bp, Artificial Sequence
  dgRNA
  Akr1b3
aaacactgccacgtg

SEQ ID NO: 19421 - DNA, 15 bp, Artificial Sequence
  dgRNA
  Akr1b3
cgcaagcagagcagc

SEQ ID NO: 19422 - DNA, 15 bp, Artificial Sequence
  dgRNA
  Etl4
gggtggcggacgctc

SEQ ID NO: 19423 - DNA, 15 bp, Artificial Sequence
  dgRNA
  Etl4
ggtggcggacgctcc

SEQ ID NO: 19424 - DNA, 15 bp, Artificial Sequence
  dgRNA
  Etl4
ggacgctccgggacc

SEQ ID NO: 19425 - DNA, 15 bp, Artificial Sequence
  dgRNA
  Etl4
gacgctccgggacct

SEQ ID NO: 19426 - DNA, 15 bp, Artificial Sequence
  dgRNA
  Krt33a
gtaaagccttttatg

SEQ ID NO: 19427 - DNA, 15 bp, Artificial Sequence
  dgRNA
  Krt33a
gccttttatgaggta

SEQ ID NO: 19428 - DNA, 15 bp, Artificial Sequence
  dgRNA
  Krt33a
ccttttatgaggtaa

SEQ ID NO: 19429 - DNA, 15 bp, Artificial Sequence
  dgRNA
  Krt33a
cgtccccacccaatt

SEQ ID NO: 19430 - DNA, 15 bp, Artificial Sequence
  dgRNA
  Sulf1
atcttttatctcccg

SEQ ID NO: 19431 - DNA, 15 bp, Artificial Sequence
  dgRNA
  Sulf1
tcttttatctcccgt

SEQ ID NO: 19432 - DNA, 15 bp, Artificial Sequence
  dgRNA
  Sulf1
cttttatctcccgtg

SEQ ID NO: 19433 - DNA, 15 bp, Artificial Sequence
  dgRNA
  Sulf1
tctcccgtggggtga

SEQ ID NO: 19434 - DNA, 15 bp, Artificial Sequence
  dgRNA
  Sh2b2
gcgccactggggctc

SEQ ID NO: 19435 - DNA, 15 bp, Artificial Sequence
  dgRNA
  Sh2b2
tccggagagagagcc

SEQ ID NO: 19436 - DNA, 15 bp, Artificial Sequence
  dgRNA
  Sh2b2
ccggagagagagccg

SEQ ID NO: 19437 - DNA, 15 bp, Artificial Sequence
  dgRNA
  Sh2b2
tgggagcgtggctag

SEQ ID NO: 19438 - DNA, 15 bp, Artificial Sequence
  dgRNA
  H2-M11
ctctataactacctt

SEQ ID NO: 19439 - DNA, 15 bp, Artificial Sequence
  dgRNA
  H2-M11
taagacaaaccaatc

SEQ ID NO: 19440 - DNA, 15 bp, Artificial Sequence
  dgRNA
  H2-M11
caaaggtagttatag

SEQ ID NO: 19441 - DNA, 15 bp, Artificial Sequence
  dgRNA
  Deptor
gtttgactttaaccc

SEQ ID NO: 19442 - DNA, 15 bp, Artificial Sequence
  dgRNA
  Deptor
tatagctaaatcaac

SEQ ID NO: 19443 - DNA, 15 bp, Artificial Sequence
  dgRNA
  Deptor
aacaggagcggcacc

SEQ ID NO: 19444 - DNA, 15 bp, Artificial Sequence
  dgRNA
  Deptor
ctaacaagtacgtcc

SEQ ID NO: 19445 - DNA, 15 bp, Artificial Sequence
  dgRNA
  Adra1b
aaactagatcagccc

SEQ ID NO: 19446 - DNA, 15 bp, Artificial Sequence
  dgRNA
  Adra1b
gtccaatcattaacc

SEQ ID NO: 19447 - DNA, 15 bp, Artificial Sequence
  dgRNA
  Adra1b
gcaaagttcacttag

SEQ ID NO: 19448 - DNA, 15 bp, Artificial Sequence
  dgRNA
  Adra1b
ctgatctagtttgaa

SEQ ID NO: 19449 - DNA, 15 bp, Artificial Sequence
  dgRNA
  Mtx1
gaacactggataccg

SEQ ID NO: 19450 - DNA, 15 bp, Artificial Sequence
  dgRNA
  Mtx1
aacactggataccgc

SEQ ID NO: 19451 - DNA, 15 bp, Artificial Sequence
  dgRNA
  Mtx1
ctggataccgcggga

SEQ ID NO: 19452 - DNA, 15 bp, Artificial Sequence
  dgRNA
  Mtx1
cgggatggccctgtc

SEQ ID NO: 19453 - DNA, 15 bp, Artificial Sequence
  dgRNA
  Olfr698
ttgtgcaaaaagtat

SEQ ID NO: 19454 - DNA, 15 bp, Artificial Sequence
  dgRNA
  Olfr698
ttgggattcccaaca

SEQ ID NO: 19455 - DNA, 15 bp, Artificial Sequence
  dgRNA
  Olfr698
gaacttgtgctaaaa

SEQ ID NO: 19456 - DNA, 15 bp, Artificial Sequence
  dgRNA
  Elof1
atctatagtcactct

SEQ ID NO: 19457 - DNA, 15 bp, Artificial Sequence
  dgRNA
  Elof1
tatagatgacgtcaa

SEQ ID NO: 19458 - DNA, 15 bp, Artificial Sequence
  dgRNA
  Elof1
ctatagatgacgtca

SEQ ID NO: 19459 - DNA, 15 bp, Artificial Sequence
  dgRNA
  Elof1
gatctcaggatggta

SEQ ID NO: 19460 - DNA, 15 bp, Artificial Sequence
  dgRNA
  Mapk15
ggacgtgcacaaccc

SEQ ID NO: 19461 - DNA, 15 bp, Artificial Sequence
  dgRNA
  Mapk15
gacgtgcacaaccca

SEQ ID NO: 19462 - DNA, 15 bp, Artificial Sequence
  dgRNA
  Mapk15
acgtgcacaacccag

SEQ ID NO: 19463 - DNA, 15 bp, Artificial Sequence
  dgRNA
  Mapk15
cgtgcagcactgact

SEQ ID NO: 19464 - DNA, 15 bp, Artificial Sequence
  dgRNA
  Hspa4
ggggcttctccgcgc

SEQ ID NO: 19465 - DNA, 15 bp, Artificial Sequence
  dgRNA
  Hspa4
tccgcgcaggctcag

SEQ ID NO: 19466 - DNA, 15 bp, Artificial Sequence
  dgRNA
  Hspa4
tggcccacttcgcgt

SEQ ID NO: 19467 - DNA, 15 bp, Artificial Sequence
  dgRNA
  Hspa4
cacggttcctgtgcc

SEQ ID NO: 19468 - DNA, 15 bp, Artificial Sequence
  dgRNA
  S100a8
agtctgtttagatgc

SEQ ID NO: 19469 - DNA, 15 bp, Artificial Sequence
  dgRNA
  S100a8
attgccacatggact

SEQ ID NO: 19470 - DNA, 15 bp, Artificial Sequence
  dgRNA
  S100a8
ccatgtctaggcccc

SEQ ID NO: 19471 - DNA, 15 bp, Artificial Sequence
  dgRNA
  S100a8
acaggagtacccagc

SEQ ID NO: 19472 - DNA, 15 bp, Artificial Sequence
  dgRNA
  Hipk1
gccctgaaatcgaca

SEQ ID NO: 19473 - DNA, 15 bp, Artificial Sequence
  dgRNA
  Hipk1
gcgctgcccaatcgc

SEQ ID NO: 19474 - DNA, 15 bp, Artificial Sequence
  dgRNA
  Hipk1
cgctgcccaatcgct

SEQ ID NO: 19475 - DNA, 15 bp, Artificial Sequence
  dgRNA
  Hipk1
tcgctgggatgtgat

SEQ ID NO: 19476 - DNA, 15 bp, Artificial Sequence
  dgRNA
  Dcstamp
aacttcgtcactttg

SEQ ID NO: 19477 - DNA, 15 bp, Artificial Sequence
  dgRNA
  Dcstamp
ttcgtcactttgtgg

SEQ ID NO: 19478 - DNA, 15 bp, Artificial Sequence
  dgRNA
  Dcstamp
ttagacattaaccct

SEQ ID NO: 19479 - DNA, 15 bp, Artificial Sequence
  dgRNA
  Dcstamp
gcttaatataggtca

SEQ ID NO: 19480 - DNA, 15 bp, Artificial Sequence
  dgRNA
  Gatad2a
gcactaagctggcca

SEQ ID NO: 19481 - DNA, 15 bp, Artificial Sequence
  dgRNA
  Gatad2a
gcttagcagcccaag

SEQ ID NO: 19482 - DNA, 15 bp, Artificial Sequence
  dgRNA
  Gatad2a
cttagcagcccaagt

SEQ ID NO: 19483 - DNA, 15 bp, Artificial Sequence
  dgRNA
  Gatad2a
agcgtcgccagtctt

SEQ ID NO: 19484 - DNA, 15 bp, Artificial Sequence
  dgRNA
  Lsm2
tacgagctaatcacg

SEQ ID NO: 19485 - DNA, 15 bp, Artificial Sequence
  dgRNA
  Lsm2
aacgcgcagctgcca

SEQ ID NO: 19486 - DNA, 15 bp, Artificial Sequence
  dgRNA
  Lsm2
gcgcttgtgagaaag

SEQ ID NO: 19487 - DNA, 15 bp, Artificial Sequence
  dgRNA
  Lsm2
agaaagcggctgctc

SEQ ID NO: 19488 - DNA, 15 bp, Artificial Sequence
  dgRNA
  Reg1
agggtgtatcagaaa

SEQ ID NO: 19489 - DNA, 15 bp, Artificial Sequence
  dgRNA
  Reg1
gttggcagatttccc

SEQ ID NO: 19490 - DNA, 15 bp, Artificial Sequence
  dgRNA
  Irak1bp1
cactctacattcagc

SEQ ID NO: 19491 - DNA, 15 bp, Artificial Sequence
  dgRNA
  Irak1bp1
aaaaaaacgcactcg

SEQ ID NO: 19492 - DNA, 15 bp, Artificial Sequence
  dgRNA
  Irak1bp1
agtgcgtttttttcc

SEQ ID NO: 19493 - DNA, 15 bp, Artificial Sequence
  dgRNA
  Sh3yl1
cgcatgcgcactgcc

SEQ ID NO: 19494 - DNA, 15 bp, Artificial Sequence
  dgRNA
  Sh3yl1
gcatgcgcactgcca

SEQ ID NO: 19495 - DNA, 15 bp, Artificial Sequence
  dgRNA
  Sh3yl1
ccagggttctgaccg

SEQ ID NO: 19496 - DNA, 15 bp, Artificial Sequence
  dgRNA
  Sh3yl1
ccccacgttcgtacg

SEQ ID NO: 19497 - DNA, 15 bp, Artificial Sequence
  dgRNA
  Pdzrn3
gcgctcgagccaata

SEQ ID NO: 19498 - DNA, 15 bp, Artificial Sequence
  dgRNA
  Pdzrn3
tcgagccaatacggc

SEQ ID NO: 19499 - DNA, 15 bp, Artificial Sequence
  dgRNA
  Pdzrn3
agccaatacggccgg

SEQ ID NO: 19500 - DNA, 15 bp, Artificial Sequence
  dgRNA
  Pdzrn3
ctcgggcattttccg

SEQ ID NO: 19501 - DNA, 15 bp, Artificial Sequence
  dgRNA
  Zfp750
tacgtggagctcagt

SEQ ID NO: 19502 - DNA, 15 bp, Artificial Sequence
  dgRNA
  Zfp750
tgtagctgcaggcgg

SEQ ID NO: 19503 - DNA, 15 bp, Artificial Sequence
  dgRNA
  Zfp750
aggcggaggaatatc

SEQ ID NO: 19504 - DNA, 15 bp, Artificial Sequence
  dgRNA
  Zfp750
catctctacgccccg

SEQ ID NO: 19505 - DNA, 15 bp, Artificial Sequence
  dgRNA
  Klrb1f
attatttaatcggtg

SEQ ID NO: 19506 - DNA, 15 bp, Artificial Sequence
  dgRNA
  Klrb1f
ttatttaatcggtgt

SEQ ID NO: 19507 - DNA, 15 bp, Artificial Sequence
  dgRNA
  Klrb1f
tcggtgtgggcataa

SEQ ID NO: 19508 - DNA, 15 bp, Artificial Sequence
  dgRNA
  Klrb1f
agttgcaagtgtggg

SEQ ID NO: 19509 - DNA, 15 bp, Artificial Sequence
  dgRNA
  Ift74
aagtgtgcaatgagt

SEQ ID NO: 19510 - DNA, 15 bp, Artificial Sequence
  dgRNA
  Ift74
ccccactttaagtac

SEQ ID NO: 19511 - DNA, 15 bp, Artificial Sequence
  dgRNA
  Ift74
aagtaccggaatctg

SEQ ID NO: 19512 - DNA, 15 bp, Artificial Sequence
  dgRNA
  Ift74
tctgaggcgcagcgc

SEQ ID NO: 19513 - DNA, 15 bp, Artificial Sequence
  dgRNA
  Mr1
acattaaccccttgt

SEQ ID NO: 19514 - DNA, 15 bp, Artificial Sequence
  dgRNA
  Mr1
aacattaaccccttg

SEQ ID NO: 19515 - DNA, 15 bp, Artificial Sequence
  dgRNA
  Mr1
gtgtcattagttgct

SEQ ID NO: 19516 - DNA, 15 bp, Artificial Sequence
  dgRNA
  Mr1
actggtaaatatatc

SEQ ID NO: 19517 - DNA, 15 bp, Artificial Sequence
  dgRNA
  Arf5
ttccgcaaacgcgcc

SEQ ID NO: 19518 - DNA, 15 bp, Artificial Sequence
  dgRNA
  Arf5
tccgcaaacgcgcct

SEQ ID NO: 19519 - DNA, 15 bp, Artificial Sequence
  dgRNA
  Arf5
ccgcaaacgcgcctg

SEQ ID NO: 19520 - DNA, 15 bp, Artificial Sequence
  dgRNA
  Arf5
cgcaaacgcgcctgg

SEQ ID NO: 19521 - DNA, 15 bp, Artificial Sequence
  dgRNA
  Ctag2
cgagatcctgttttc

SEQ ID NO: 19522 - DNA, 15 bp, Artificial Sequence
  dgRNA
  Ctag2
gtgaccctcacaatg

SEQ ID NO: 19523 - DNA, 15 bp, Artificial Sequence
  dgRNA
  Ctag2
ttagcaacagttgag

SEQ ID NO: 19524 - DNA, 15 bp, Artificial Sequence
  dgRNA
  Ctag2
tagcaacagttgagt

SEQ ID NO: 19525 - DNA, 15 bp, Artificial Sequence
  dgRNA
  Sct
taatctcccccccca

SEQ ID NO: 19526 - DNA, 15 bp, Artificial Sequence
  dgRNA
  Sct
cccccaaggcagttg

SEQ ID NO: 19527 - DNA, 15 bp, Artificial Sequence
  dgRNA
  Sct
ccccaaggcagttga

SEQ ID NO: 19528 - DNA, 15 bp, Artificial Sequence
  dgRNA
  Sct
tgaggggcgccaaca

SEQ ID NO: 19529 - DNA, 15 bp, Artificial Sequence
  dgRNA
  2810006K23Rik
ggctgctcggaagag

SEQ ID NO: 19530 - DNA, 15 bp, Artificial Sequence
  dgRNA
  2810006K23Rik
aagagagggccgagc

SEQ ID NO: 19531 - DNA, 15 bp, Artificial Sequence
  dgRNA
  2810006K23Rik
cagctcgctccagag

SEQ ID NO: 19532 - DNA, 15 bp, Artificial Sequence
  dgRNA
  2810006K23Rik
cgctccagagagggc

SEQ ID NO: 19533 - DNA, 15 bp, Artificial Sequence
  dgRNA
  Liph
aaccgcccacgaaga

SEQ ID NO: 19534 - DNA, 15 bp, Artificial Sequence
  dgRNA
  Liph
ccttttattgcaaag

SEQ ID NO: 19535 - DNA, 15 bp, Artificial Sequence
  dgRNA
  Liph
ccggatgacaaatcc

SEQ ID NO: 19536 - DNA, 15 bp, Artificial Sequence
  dgRNA
  Liph
cccggatgacaaatc

SEQ ID NO: 19537 - DNA, 15 bp, Artificial Sequence
  dgRNA
  Rbm6
ccttgcacacttgcg

SEQ ID NO: 19538 - DNA, 15 bp, Artificial Sequence
  dgRNA
  Rbm6
accataactcccggc

SEQ ID NO: 19539 - DNA, 15 bp, Artificial Sequence
  dgRNA
  Rbm6
agcgtgccttctaat

SEQ ID NO: 19540 - DNA, 15 bp, Artificial Sequence
  dgRNA
  Rbm6
gcgtgccttctaatt

SEQ ID NO: 19541 - DNA, 15 bp, Artificial Sequence
  dgRNA
  Hdhd2
caagtaacgaaattg

SEQ ID NO: 19542 - DNA, 15 bp, Artificial Sequence
  dgRNA
  Hdhd2
acgaaattgaggcat

SEQ ID NO: 19543 - DNA, 15 bp, Artificial Sequence
  dgRNA
  Hdhd2
cgaaattgaggcata

SEQ ID NO: 19544 - DNA, 15 bp, Artificial Sequence
  dgRNA
  Hdhd2
ggcatagggtgttga

SEQ ID NO: 19545 - DNA, 15 bp, Artificial Sequence
  dgRNA
  9130204L05Rik
tcccaattgtagact

SEQ ID NO: 19546 - DNA, 15 bp, Artificial Sequence
  dgRNA
  9130204L05Rik
aattgtagacttggc

SEQ ID NO: 19547 - DNA, 15 bp, Artificial Sequence
  dgRNA
  9130204L05Rik
attgtagacttggca

SEQ ID NO: 19548 - DNA, 15 bp, Artificial Sequence
  dgRNA
  9130204L05Rik
gccaagtctacaatt

SEQ ID NO: 19549 - DNA, 15 bp, Artificial Sequence
  dgRNA
  Znrf1
ccattgtctccacgg

SEQ ID NO: 19550 - DNA, 15 bp, Artificial Sequence
  dgRNA
  Znrf1
gtctccacggcggcg

SEQ ID NO: 19551 - DNA, 15 bp, Artificial Sequence
  dgRNA
  Znrf1
ggcggcgaggagcgc

SEQ ID NO: 19552 - DNA, 15 bp, Artificial Sequence
  dgRNA
  Znrf1
cagcccgggacggag

SEQ ID NO: 19553 - DNA, 15 bp, Artificial Sequence
  dgRNA
  P4hb
cggaagtggcgtccc

SEQ ID NO: 19554 - DNA, 15 bp, Artificial Sequence
  dgRNA
  P4hb
ggggcggtgccagta

SEQ ID NO: 19555 - DNA, 15 bp, Artificial Sequence
  dgRNA
  P4hb
gccagtacggaaacg

SEQ ID NO: 19556 - DNA, 15 bp, Artificial Sequence
  dgRNA
  P4hb
tcagaatgcaacacg

SEQ ID NO: 19557 - DNA, 15 bp, Artificial Sequence
  dgRNA
  Olfr1156
gtagtaaggtcgtct

SEQ ID NO: 19558 - DNA, 15 bp, Artificial Sequence
  dgRNA
  Ccm2
gggaatcgcccttct

SEQ ID NO: 19559 - DNA, 15 bp, Artificial Sequence
  dgRNA
  Ccm2
tggtatcgccctcct

SEQ ID NO: 19560 - DNA, 15 bp, Artificial Sequence
  dgRNA
  Ccm2
ggtatcgccctcctt

SEQ ID NO: 19561 - DNA, 15 bp, Artificial Sequence
  dgRNA
  Ccm2
ccagcgagtgcctct

SEQ ID NO: 19562 - DNA, 15 bp, Artificial Sequence
  dgRNA
  B4gat1
gcgctaggactgggg

SEQ ID NO: 19563 - DNA, 15 bp, Artificial Sequence
  dgRNA
  B4gat1
cgctaggactggggg

SEQ ID NO: 19564 - DNA, 15 bp, Artificial Sequence
  dgRNA
  B4gat1
tgcgtccagttcccc

SEQ ID NO: 19565 - DNA, 15 bp, Artificial Sequence
  dgRNA
  B4gat1
gcgtccagttccccg

SEQ ID NO: 19566 - DNA, 15 bp, Artificial Sequence
  dgRNA
  Snap29
cgcacgccccggcgc

SEQ ID NO: 19567 - DNA, 15 bp, Artificial Sequence
  dgRNA
  Snap29
acgccccggcgcagg

SEQ ID NO: 19568 - DNA, 15 bp, Artificial Sequence
  dgRNA
  Snap29
cccggcgcaggcggc

SEQ ID NO: 19569 - DNA, 15 bp, Artificial Sequence
  dgRNA
  Snap29
ccggcgcaggcggct

SEQ ID NO: 19570 - DNA, 15 bp, Artificial Sequence
  dgRNA
  Olfr450
tgatcatcttcaatg

SEQ ID NO: 19571 - DNA, 15 bp, Artificial Sequence
  dgRNA
  Olfr450
atttcacaactggac

SEQ ID NO: 19572 - DNA, 15 bp, Artificial Sequence
  dgRNA
  Hoxc9
gagttttccggttct

SEQ ID NO: 19573 - DNA, 15 bp, Artificial Sequence
  dgRNA
  Hoxc9
ccggttctaggttcg

SEQ ID NO: 19574 - DNA, 15 bp, Artificial Sequence
  dgRNA
  Hoxc9
cggttctaggttcgc

SEQ ID NO: 19575 - DNA, 15 bp, Artificial Sequence
  dgRNA
  Hoxc9
ctagacagctccagt

SEQ ID NO: 19576 - DNA, 15 bp, Artificial Sequence
  dgRNA
  Nkx2-6
agcgatcttatcacc

SEQ ID NO: 19577 - DNA, 15 bp, Artificial Sequence
  dgRNA
  Nkx2-6
cttatcacccggtcc

SEQ ID NO: 19578 - DNA, 15 bp, Artificial Sequence
  dgRNA
  Nkx2-6
gggaaggcgcggtcc

SEQ ID NO: 19579 - DNA, 15 bp, Artificial Sequence
  dgRNA
  Nkx2-6
atcccagaatcgatt

SEQ ID NO: 19580 - DNA, 15 bp, Artificial Sequence
  dgRNA
  Arhgef1
cgaaggggagccggg

SEQ ID NO: 19581 - DNA, 15 bp, Artificial Sequence
  dgRNA
  Arhgef1
gtggggacgcgcccg

SEQ ID NO: 19582 - DNA, 15 bp, Artificial Sequence
  dgRNA
  Arhgef1
tggggacgcgcccgc

SEQ ID NO: 19583 - DNA, 15 bp, Artificial Sequence
  dgRNA
  Arhgef1
ggggacgcgcccgcg

SEQ ID NO: 19584 - DNA, 15 bp, Artificial Sequence
  dgRNA
  Rnf111
taagccagtgcaaag

SEQ ID NO: 19585 - DNA, 15 bp, Artificial Sequence
  dgRNA
  Rnf111
gaaggactgggacgc

SEQ ID NO: 19586 - DNA, 15 bp, Artificial Sequence
  dgRNA
  Rnf111
caggggggcggtccc

SEQ ID NO: 19587 - DNA, 15 bp, Artificial Sequence
  dgRNA
  Rnf111
tgtgagagggcgtga

SEQ ID NO: 19588 - DNA, 15 bp, Artificial Sequence
  dgRNA
  Vpreb2
gggacctgaccagct

SEQ ID NO: 19589 - DNA, 15 bp, Artificial Sequence
  dgRNA
  Tnik
ttaaccctcaaaagc

SEQ ID NO: 19590 - DNA, 15 bp, Artificial Sequence
  dgRNA
  Tnik
cctggctagtggcgg

SEQ ID NO: 19591 - DNA, 15 bp, Artificial Sequence
  dgRNA
  Tnik
ctggctagtggcgga

SEQ ID NO: 19592 - DNA, 15 bp, Artificial Sequence
  dgRNA
  Tnik
agtggcggagggacc

SEQ ID NO: 19593 - DNA, 15 bp, Artificial Sequence
  dgRNA
  Htr3a
accaagccacctatt

SEQ ID NO: 19594 - DNA, 15 bp, Artificial Sequence
  dgRNA
  Htr3a
gccacctatttggat

SEQ ID NO: 19595 - DNA, 15 bp, Artificial Sequence
  dgRNA
  Htr3a
acctatttggatggg

SEQ ID NO: 19596 - DNA, 15 bp, Artificial Sequence
  dgRNA
  Htr3a
cctatttggatgggt

SEQ ID NO: 19597 - DNA, 15 bp, Artificial Sequence
  dgRNA
  Hhipl2
cttcacttttaggta

SEQ ID NO: 19598 - DNA, 15 bp, Artificial Sequence
  dgRNA
  Hhipl2
accacctcattgaac

SEQ ID NO: 19599 - DNA, 15 bp, Artificial Sequence
  dgRNA
  Hhipl2
ccacctcattgaact

SEQ ID NO: 19600 - DNA, 15 bp, Artificial Sequence
  dgRNA
  Hhipl2
acctaaaagtgaagc

SEQ ID NO: 19601 - DNA, 15 bp, Artificial Sequence
  dgRNA
  Usf2
caggagtagcggcgg

SEQ ID NO: 19602 - DNA, 15 bp, Artificial Sequence
  dgRNA
  Usf2
cgtgatcagcgcaag

SEQ ID NO: 19603 - DNA, 15 bp, Artificial Sequence
  dgRNA
  Usf2
gcgcggcgtgagcgc

SEQ ID NO: 19604 - DNA, 15 bp, Artificial Sequence
  dgRNA
  Usf2
cgcggcgtgagcgcc

SEQ ID NO: 19605 - DNA, 15 bp, Artificial Sequence
  dgRNA
  Vmn2r52
caattgcagaacccc

SEQ ID NO: 19606 - DNA, 15 bp, Artificial Sequence
  dgRNA
  Vmn2r52
ctggggttctgcaat

SEQ ID NO: 19607 - DNA, 15 bp, Artificial Sequence
  dgRNA
  Gprin1
gcaaatcgggaagac

SEQ ID NO: 19608 - DNA, 15 bp, Artificial Sequence
  dgRNA
  Gprin1
caaatcgggaagacc

SEQ ID NO: 19609 - DNA, 15 bp, Artificial Sequence
  dgRNA
  Gprin1
aaatcgggaagaccg

SEQ ID NO: 19610 - DNA, 15 bp, Artificial Sequence
  dgRNA
  Gprin1
ggaagaccggggttt

SEQ ID NO: 19611 - DNA, 15 bp, Artificial Sequence
  dgRNA
  Kcnk13
attctgtttagaccg

SEQ ID NO: 19612 - DNA, 15 bp, Artificial Sequence
  dgRNA
  Kcnk13
ttctgtttagaccgt

SEQ ID NO: 19613 - DNA, 15 bp, Artificial Sequence
  dgRNA
  Kcnk13
tgtttagaccgtggg

SEQ ID NO: 19614 - DNA, 15 bp, Artificial Sequence
  dgRNA
  Kcnk13
atattcgatcccctg

SEQ ID NO: 19615 - DNA, 15 bp, Artificial Sequence
  dgRNA
  Ttll12
ccctcgcggcagtcc

SEQ ID NO: 19616 - DNA, 15 bp, Artificial Sequence
  dgRNA
  Ttll12
gcgcgtgcgcactct

SEQ ID NO: 19617 - DNA, 15 bp, Artificial Sequence
  dgRNA
  Ttll12
ggaacctcgcaaccc

SEQ ID NO: 19618 - DNA, 15 bp, Artificial Sequence
  dgRNA
  Ttll12
cgcaacccaggacgc

SEQ ID NO: 19619 - DNA, 15 bp, Artificial Sequence
  dgRNA
  Lnx2
gagggagaatccggc

SEQ ID NO: 19620 - DNA, 15 bp, Artificial Sequence
  dgRNA
  Lnx2
agggagaatccggcc

SEQ ID NO: 19621 - DNA, 15 bp, Artificial Sequence
  dgRNA
  Lnx2
tccggccgggagcga

SEQ ID NO: 19622 - DNA, 15 bp, Artificial Sequence
  dgRNA
  Lnx2
ggccgggagcgatgg

SEQ ID NO: 19623 - DNA, 15 bp, Artificial Sequence
  dgRNA
  Ncor2
ttgctccgccttctt

SEQ ID NO: 19624 - DNA, 15 bp, Artificial Sequence
  dgRNA
  Ncor2
tgctccgccttcttc

SEQ ID NO: 19625 - DNA, 15 bp, Artificial Sequence
  dgRNA
  Ncor2
aaaaaacgcagctcg

SEQ ID NO: 19626 - DNA, 15 bp, Artificial Sequence
  dgRNA
  Ncor2
ctcggggtgcgcgca

SEQ ID NO: 19627 - DNA, 15 bp, Artificial Sequence
  dgRNA
  Ntng1
atattctatgcggtc

SEQ ID NO: 19628 - DNA, 15 bp, Artificial Sequence
  dgRNA
  Sgms1
cggccagctgtcctg

SEQ ID NO: 19629 - DNA, 15 bp, Artificial Sequence
  dgRNA
  Sgms1
ctgcgggactcagct

SEQ ID NO: 19630 - DNA, 15 bp, Artificial Sequence
  dgRNA
  Sgms1
ctggtcgagcgtccg

SEQ ID NO: 19631 - DNA, 15 bp, Artificial Sequence
  dgRNA
  Sgms1
gccgccgggaacacc

SEQ ID NO: 19632 - DNA, 15 bp, Artificial Sequence
  dgRNA
  Vma21
ccccatctatttgac

SEQ ID NO: 19633 - DNA, 15 bp, Artificial Sequence
  dgRNA
  Vma21
cattaggttcaccta

SEQ ID NO: 19634 - DNA, 15 bp, Artificial Sequence
  dgRNA
  Vma21
ccagtcaaatagatg

SEQ ID NO: 19635 - DNA, 15 bp, Artificial Sequence
  dgRNA
  Vma21
gccagtcaaatagat

SEQ ID NO: 19636 - DNA, 15 bp, Artificial Sequence
  dgRNA
  Fam110a
ggataagagcccggc

SEQ ID NO: 19637 - DNA, 15 bp, Artificial Sequence
  dgRNA
  Fam110a
gataagagcccggct

SEQ ID NO: 19638 - DNA, 15 bp, Artificial Sequence
  dgRNA
  Fam110a
cggctgggtgagcct

SEQ ID NO: 19639 - DNA, 15 bp, Artificial Sequence
  dgRNA
  Fam110a
ctgggggcgctgttc

SEQ ID NO: 19640 - DNA, 15 bp, Artificial Sequence
  dgRNA
  Shisa5
tgtctcaaattttcg

SEQ ID NO: 19641 - DNA, 15 bp, Artificial Sequence
  dgRNA
  Shisa5
caaattttcgtggac

SEQ ID NO: 19642 - DNA, 15 bp, Artificial Sequence
  dgRNA
  Shisa5
ttcgtggaccggtgc

SEQ ID NO: 19643 - DNA, 15 bp, Artificial Sequence
  dgRNA
  Shisa5
gtggaccggtgctgg

SEQ ID NO: 19644 - DNA, 15 bp, Artificial Sequence
  dgRNA
  0610009O20Rik
tcgcagctcctgcaa

SEQ ID NO: 19645 - DNA, 15 bp, Artificial Sequence
  dgRNA
  0610009O20Rik
ctgcaatggcgacag

SEQ ID NO: 19646 - DNA, 15 bp, Artificial Sequence
  dgRNA
  0610009O20Rik
cgacagaggacacct

SEQ ID NO: 19647 - DNA, 15 bp, Artificial Sequence
  dgRNA
  0610009O20Rik
aggacaccttggccg

SEQ ID NO: 19648 - DNA, 15 bp, Artificial Sequence
  dgRNA
  Brsk2
agagcggcattcccg

SEQ ID NO: 19649 - DNA, 15 bp, Artificial Sequence
  dgRNA
  Brsk2
ggcattcccgcggcc

SEQ ID NO: 19650 - DNA, 15 bp, Artificial Sequence
  dgRNA
  Brsk2
cggcccggcctcgta

SEQ ID NO: 19651 - DNA, 15 bp, Artificial Sequence
  dgRNA
  Brsk2
ggcccggcctcgtac

SEQ ID NO: 19652 - DNA, 15 bp, Artificial Sequence
  dgRNA
  Ndufb9
ggccatgccgcgaaa

SEQ ID NO: 19653 - DNA, 15 bp, Artificial Sequence
  dgRNA
  Ndufb9
gccatgccgcgaaaa

SEQ ID NO: 19654 - DNA, 15 bp, Artificial Sequence
  dgRNA
  Ndufb9
ccatgccgcgaaaag

SEQ ID NO: 19655 - DNA, 15 bp, Artificial Sequence
  dgRNA
  Ndufb9
cgcgaaaaggggacc

SEQ ID NO: 19656 - DNA, 15 bp, Artificial Sequence
  dgRNA
  Gfra3
tagcagcaatcttgc

SEQ ID NO: 19657 - DNA, 15 bp, Artificial Sequence
  dgRNA
  Gfra3
agcagcaatcttgcc

SEQ ID NO: 19658 - DNA, 15 bp, Artificial Sequence
  dgRNA
  Gfra3
gcagcaatcttgccg

SEQ ID NO: 19659 - DNA, 15 bp, Artificial Sequence
  dgRNA
  Gfra3
cttgccggggttaat

SEQ ID NO: 19660 - DNA, 15 bp, Artificial Sequence
  dgRNA
  Snrnp25
actcgcacatttcat

SEQ ID NO: 19661 - DNA, 15 bp, Artificial Sequence
  dgRNA
  Snrnp25
cacgcagtataccat

SEQ ID NO: 19662 - DNA, 15 bp, Artificial Sequence
  dgRNA
  Snrnp25
gctaagctatctcgt

SEQ ID NO: 19663 - DNA, 15 bp, Artificial Sequence
  dgRNA
  Snrnp25
ctaagctatctcgtc

SEQ ID NO: 19664 - DNA, 15 bp, Artificial Sequence
  dgRNA
  Olfr299
taactcacatagtgg

SEQ ID NO: 19665 - DNA, 15 bp, Artificial Sequence
  dgRNA
  Olfr299
ttaactcacatagtg

SEQ ID NO: 19666 - DNA, 15 bp, Artificial Sequence
  dgRNA
  Olfr299
gttaactcacatagt

SEQ ID NO: 19667 - DNA, 15 bp, Artificial Sequence
  dgRNA
  Olfr299
tgttaactcacatag

SEQ ID NO: 19668 - DNA, 15 bp, Artificial Sequence
  dgRNA
  Poteg
tattgcaggcctgat

SEQ ID NO: 19669 - DNA, 15 bp, Artificial Sequence
  dgRNA
  Poteg
caggcctgattggct

SEQ ID NO: 19670 - DNA, 15 bp, Artificial Sequence
  dgRNA
  Poteg
gtgtccgttctcatt

SEQ ID NO: 19671 - DNA, 15 bp, Artificial Sequence
  dgRNA
  Poteg
tgtccgttctcattt

SEQ ID NO: 19672 - DNA, 15 bp, Artificial Sequence
  dgRNA
  Ppbp
ggtagctaactctgc

SEQ ID NO: 19673 - DNA, 15 bp, Artificial Sequence
  dgRNA
  Ppbp
gatttttaacctgtc

SEQ ID NO: 19674 - DNA, 15 bp, Artificial Sequence
  dgRNA
  Ppbp
cctgtctggttgata

SEQ ID NO: 19675 - DNA, 15 bp, Artificial Sequence
  dgRNA
  Ppbp
cggcagtataaaaag

SEQ ID NO: 19676 - DNA, 15 bp, Artificial Sequence
  dgRNA
  Aamdc
ccctctacgacttca

SEQ ID NO: 19677 - DNA, 15 bp, Artificial Sequence
  dgRNA
  Aamdc
ttccctcccacttcg

SEQ ID NO: 19678 - DNA, 15 bp, Artificial Sequence
  dgRNA
  Aamdc
actgcctcgtgtgac

SEQ ID NO: 19679 - DNA, 15 bp, Artificial Sequence
  dgRNA
  Aamdc
ctgcctcgtgtgaca

SEQ ID NO: 19680 - DNA, 15 bp, Artificial Sequence
  dgRNA
  Cpne4
aatcacgtgcctctc

SEQ ID NO: 19681 - DNA, 15 bp, Artificial Sequence
  dgRNA
  Mettl2
acggaaccgtactcg

SEQ ID NO: 19682 - DNA, 15 bp, Artificial Sequence
  dgRNA
  Mettl2
cggaaccgtactcga

SEQ ID NO: 19683 - DNA, 15 bp, Artificial Sequence
  dgRNA
  Mettl2
cccaagattcccccc

SEQ ID NO: 19684 - DNA, 15 bp, Artificial Sequence
  dgRNA
  Mettl2
agtacggttccgtgc

SEQ ID NO: 19685 - DNA, 15 bp, Artificial Sequence
  dgRNA
  Vmn1r73
taaacaagtttagta

SEQ ID NO: 19686 - DNA, 15 bp, Artificial Sequence
  dgRNA
  Rab9b
gttctttggtacatg

SEQ ID NO: 19687 - DNA, 15 bp, Artificial Sequence
  dgRNA
  Rab9b
ttctaatcaattggg

SEQ ID NO: 19688 - DNA, 15 bp, Artificial Sequence
  dgRNA
  Rab9b
tctaatcaattggga

SEQ ID NO: 19689 - DNA, 15 bp, Artificial Sequence
  dgRNA
  Rab9b
agggcctaaaggctc

SEQ ID NO: 19690 - DNA, 15 bp, Artificial Sequence
  dgRNA
  Mier1
gaaattcccacgggg

SEQ ID NO: 19691 - DNA, 15 bp, Artificial Sequence
  dgRNA
  Mier1
acggggcggttgacc

SEQ ID NO: 19692 - DNA, 15 bp, Artificial Sequence
  dgRNA
  Mier1
cggttgacctggttc

SEQ ID NO: 19693 - DNA, 15 bp, Artificial Sequence
  dgRNA
  Mier1
ttaatccagatggtg

SEQ ID NO: 19694 - DNA, 15 bp, Artificial Sequence
  dgRNA
  Tars2
cactttccggtcaac

SEQ ID NO: 19695 - DNA, 15 bp, Artificial Sequence
  dgRNA
  Tars2
cctcagcggagttcc

SEQ ID NO: 19696 - DNA, 15 bp, Artificial Sequence
  dgRNA
  Tars2
ctcagcggagttcct

SEQ ID NO: 19697 - DNA, 15 bp, Artificial Sequence
  dgRNA
  Tars2
cagcggagttcctgg

SEQ ID NO: 19698 - DNA, 15 bp, Artificial Sequence
  dgRNA
  Pcdhb15
gttaagtataaacac

SEQ ID NO: 19699 - DNA, 15 bp, Artificial Sequence
  dgRNA
  Pcdhb15
gtataaacactggtg

SEQ ID NO: 19700 - DNA, 15 bp, Artificial Sequence
  dgRNA
  Pcdhb15
cactcacaaaacgca

SEQ ID NO: 19701 - DNA, 15 bp, Artificial Sequence
  dgRNA
  Pcdhb15
ctgcaggctaaaaag

SEQ ID NO: 19702 - DNA, 15 bp, Artificial Sequence
  dgRNA
  Cdan1
attgctccaggggcc

SEQ ID NO: 19703 - DNA, 15 bp, Artificial Sequence
  dgRNA
  Cdan1
gcctcgccgccctgc

SEQ ID NO: 19704 - DNA, 15 bp, Artificial Sequence
  dgRNA
  Cdan1
cgccccgtcgtccaa

SEQ ID NO: 19705 - DNA, 15 bp, Artificial Sequence
  dgRNA
  Cdan1
tccaacggtcgatcc

SEQ ID NO: 19706 - DNA, 15 bp, Artificial Sequence
  dgRNA
  Thsd4
gctgagttccccgcc

SEQ ID NO: 19707 - DNA, 15 bp, Artificial Sequence
  dgRNA
  Thsd4
ctgagttccccgccc

SEQ ID NO: 19708 - DNA, 15 bp, Artificial Sequence
  dgRNA
  Thsd4
gcagactgctggttg

SEQ ID NO: 19709 - DNA, 15 bp, Artificial Sequence
  dgRNA
  Thsd4
ggctcagcgtgtttt

SEQ ID NO: 19710 - DNA, 15 bp, Artificial Sequence
  dgRNA
  Gtf3c2
caatgcttttccaca

SEQ ID NO: 19711 - DNA, 15 bp, Artificial Sequence
  dgRNA
  Gtf3c2
gctgcggtgccgcgc

SEQ ID NO: 19712 - DNA, 15 bp, Artificial Sequence
  dgRNA
  Gtf3c2
gccgacctccccttc

SEQ ID NO: 19713 - DNA, 15 bp, Artificial Sequence
  dgRNA
  Gtf3c2
gagcttcgacggact

SEQ ID NO: 19714 - DNA, 15 bp, Artificial Sequence
  dgRNA
  Pik3cg
catgtataatcaact

SEQ ID NO: 19715 - DNA, 15 bp, Artificial Sequence
  dgRNA
  Pik3cg
ttgcagttaccagga

SEQ ID NO: 19716 - DNA, 15 bp, Artificial Sequence
  dgRNA
  Bbs4
taaattcgtccagcc

SEQ ID NO: 19717 - DNA, 15 bp, Artificial Sequence
  dgRNA
  Bbs4
taagccatccatctg

SEQ ID NO: 19718 - DNA, 15 bp, Artificial Sequence
  dgRNA
  Bbs4
cactcacaactcctt

SEQ ID NO: 19719 - DNA, 15 bp, Artificial Sequence
  dgRNA
  Bbs4
actcacaactcctta

SEQ ID NO: 19720 - DNA, 15 bp, Artificial Sequence
  dgRNA
  Sult5a1
ccaaatgggtctggt

SEQ ID NO: 19721 - DNA, 15 bp, Artificial Sequence
  dgRNA
  Sult5a1
gggccctgcaacgct

SEQ ID NO: 19722 - DNA, 15 bp, Artificial Sequence
  dgRNA
  Sult5a1
ggccctgcaacgcta

SEQ ID NO: 19723 - DNA, 15 bp, Artificial Sequence
  dgRNA
  Sult5a1
cctgcaacgctaggg

SEQ ID NO: 19724 - DNA, 15 bp, Artificial Sequence
  dgRNA
  8-Mar
cagcgccagtctacc

SEQ ID NO: 19725 - DNA, 15 bp, Artificial Sequence
  dgRNA
  8-Mar
cgccagtctaccagg

SEQ ID NO: 19726 - DNA, 15 bp, Artificial Sequence
  dgRNA
  8-Mar
aacgcttttagcctg

SEQ ID NO: 19727 - DNA, 15 bp, Artificial Sequence
  dgRNA
  8-Mar
ttttagcctgaggcg

SEQ ID NO: 19728 - DNA, 15 bp, Artificial Sequence
  dgRNA
  Tigd5
tggatccgtccgacg

SEQ ID NO: 19729 - DNA, 15 bp, Artificial Sequence
  dgRNA
  Tigd5
ggatccgtccgacga

SEQ ID NO: 19730 - DNA, 15 bp, Artificial Sequence
  dgRNA
  Tigd5
tccgtccgacgaggg

SEQ ID NO: 19731 - DNA, 15 bp, Artificial Sequence
  dgRNA
  Tigd5
ccgtccgacgagggc

SEQ ID NO: 19732 - DNA, 15 bp, Artificial Sequence
  dgRNA
  Med16
gcctctatagttact

SEQ ID NO: 19733 - DNA, 15 bp, Artificial Sequence
  dgRNA
  Med16
tatgcaaattaaccg

SEQ ID NO: 19734 - DNA, 15 bp, Artificial Sequence
  dgRNA
  Med16
aaattaaccggggca

SEQ ID NO: 19735 - DNA, 15 bp, Artificial Sequence
  dgRNA
  Med16
aattaaccggggcag

SEQ ID NO: 19736 - DNA, 15 bp, Artificial Sequence
  dgRNA
  Ahcyl2
ccctcattgtttcgg

SEQ ID NO: 19737 - DNA, 15 bp, Artificial Sequence
  dgRNA
  Ahcyl2
ccaccgaaacaatga

SEQ ID NO: 19738 - DNA, 15 bp, Artificial Sequence
  dgRNA
  Ahcyl2
gccaccgaaacaatg

SEQ ID NO: 19739 - DNA, 15 bp, Artificial Sequence
  dgRNA
  Polr3g
tcggggttctactgc

SEQ ID NO: 19740 - DNA, 15 bp, Artificial Sequence
  dgRNA
  Polr3g
cggggttctactgca

SEQ ID NO: 19741 - DNA, 15 bp, Artificial Sequence
  dgRNA
  Polr3g
ttctactgcaggggc

SEQ ID NO: 19742 - DNA, 15 bp, Artificial Sequence
  dgRNA
  Polr3g
gccgggagagatgcg

SEQ ID NO: 19743 - DNA, 15 bp, Artificial Sequence
  dgRNA
  Fas
tttctcgcaaccctt

SEQ ID NO: 19744 - DNA, 15 bp, Artificial Sequence
  dgRNA
  Fas
ttctcgcaacccttg

SEQ ID NO: 19745 - DNA, 15 bp, Artificial Sequence
  dgRNA
  Fas
tacgaagattgtgtt

SEQ ID NO: 19746 - DNA, 15 bp, Artificial Sequence
  dgRNA
  Fas
gttcaaagcgatttc

SEQ ID NO: 19747 - DNA, 15 bp, Artificial Sequence
  dgRNA
  St6gal1
tgaacttgcgattat

SEQ ID NO: 19748 - DNA, 15 bp, Artificial Sequence
  dgRNA
  St6gal1
cttgcgattattggt

SEQ ID NO: 19749 - DNA, 15 bp, Artificial Sequence
  dgRNA
  St6gal1
agtagtcctgacaag

SEQ ID NO: 19750 - DNA, 15 bp, Artificial Sequence
  dgRNA
  St6gal1
acgcaataattatgc

SEQ ID NO: 19751 - DNA, 15 bp, Artificial Sequence
  dgRNA
  Insl5
atcataaaacgcaca

SEQ ID NO: 19752 - DNA, 15 bp, Artificial Sequence
  dgRNA
  Insl5
taaaacgcacatggc

SEQ ID NO: 19753 - DNA, 15 bp, Artificial Sequence
  dgRNA
  Insl5
tataaatggtccaag

SEQ ID NO: 19754 - DNA, 15 bp, Artificial Sequence
  dgRNA
  Insl5
gttatctcaccctct

SEQ ID NO: 19755 - DNA, 15 bp, Artificial Sequence
  dgRNA
  Rab43
gactggccagggacg

SEQ ID NO: 19756 - DNA, 15 bp, Artificial Sequence
  dgRNA
  Rab43
tagtgcagccctgga

SEQ ID NO: 19757 - DNA, 15 bp, Artificial Sequence
  dgRNA
  Rab43
ttatgcaatacacta

SEQ ID NO: 19758 - DNA, 15 bp, Artificial Sequence
  dgRNA
  Rab43
atactgccccgtccc

SEQ ID NO: 19759 - DNA, 15 bp, Artificial Sequence
  dgRNA
  Dhx38
tacgccaagcgcgat

SEQ ID NO: 19760 - DNA, 15 bp, Artificial Sequence
  dgRNA
  Dhx38
gcgcgattggtcgca

SEQ ID NO: 19761 - DNA, 15 bp, Artificial Sequence
  dgRNA
  Dhx38
cggaaggcctgttcg

SEQ ID NO: 19762 - DNA, 15 bp, Artificial Sequence
  dgRNA
  Dhx38
ggaaggcctgttcgc

SEQ ID NO: 19763 - DNA, 15 bp, Artificial Sequence
  dgRNA
  Adamts6
tatctaagcgttttt

SEQ ID NO: 19764 - DNA, 15 bp, Artificial Sequence
  dgRNA
  Rxfp1
gtcttagcagctata

SEQ ID NO: 19765 - DNA, 15 bp, Artificial Sequence
  dgRNA
  Rxfp1
gataaaacgtggtct

SEQ ID NO: 19766 - DNA, 15 bp, Artificial Sequence
  dgRNA
  Cyp3a25
cgagcattgtgcaag

SEQ ID NO: 19767 - DNA, 15 bp, Artificial Sequence
  dgRNA
  Cyp3a25
cttgtaggtctggtg

SEQ ID NO: 19768 - DNA, 15 bp, Artificial Sequence
  dgRNA
  Cyp3a25
tcgaacttgtaggtc

SEQ ID NO: 19769 - DNA, 15 bp, Artificial Sequence
  dgRNA
  Cyp3a25
aatgctcgaacttgt

SEQ ID NO: 19770 - DNA, 15 bp, Artificial Sequence
  dgRNA
  Cisd1
agtcaaaggatcggc

SEQ ID NO: 19771 - DNA, 15 bp, Artificial Sequence
  dgRNA
  Cisd1
ggatcggcaggccat

SEQ ID NO: 19772 - DNA, 15 bp, Artificial Sequence
  dgRNA
  Cisd1
ggccgacagtcctgc

SEQ ID NO: 19773 - DNA, 15 bp, Artificial Sequence
  dgRNA
  Cisd1
tgaaacgctctcaac

SEQ ID NO: 19774 - DNA, 15 bp, Artificial Sequence
  dgRNA
  Lmo1
aacctcatacattga

SEQ ID NO: 19775 - DNA, 15 bp, Artificial Sequence
  dgRNA
  Lmo1
ctccctcaatgtatg

SEQ ID NO: 19776 - DNA, 15 bp, Artificial Sequence
  dgRNA
  Oxt
tgcctctaaacagcg

SEQ ID NO: 19777 - DNA, 15 bp, Artificial Sequence
  dgRNA
  Oxt
ataaaaaggtcggtc

SEQ ID NO: 19778 - DNA, 15 bp, Artificial Sequence
  dgRNA
  Oxt
taaaaaggtcggtct

SEQ ID NO: 19779 - DNA, 15 bp, Artificial Sequence
  dgRNA
  Oxt
aaggtcggtctgggc

SEQ ID NO: 19780 - DNA, 15 bp, Artificial Sequence
  dgRNA
  Eif4g3
ggcgttcccgaacag

SEQ ID NO: 19781 - DNA, 15 bp, Artificial Sequence
  dgRNA
  Eif4g3
ccgaacagcggccga

SEQ ID NO: 19782 - DNA, 15 bp, Artificial Sequence
  dgRNA
  Eif4g3
gctcccgaagaagcc

SEQ ID NO: 19783 - DNA, 15 bp, Artificial Sequence
  dgRNA
  Eif4g3
aagcccggccgctcg

SEQ ID NO: 19784 - DNA, 15 bp, Artificial Sequence
  dgRNA
  Igsf11
tcaacctgtccttgc

SEQ ID NO: 19785 - DNA, 15 bp, Artificial Sequence
  dgRNA
  Igsf11
tgtgcattctgcggc

SEQ ID NO: 19786 - DNA, 15 bp, Artificial Sequence
  dgRNA
  Igsf11
cactaggcgtcgcac

SEQ ID NO: 19787 - DNA, 15 bp, Artificial Sequence
  dgRNA
  Igsf11
gtcgcactggagtcg

SEQ ID NO: 19788 - DNA, 15 bp, Artificial Sequence
  dgRNA
  Igf1
ctaagccgctgtcac

SEQ ID NO: 19789 - DNA, 15 bp, Artificial Sequence
  dgRNA
  Igf1
gaggcagttgccgga

SEQ ID NO: 19790 - DNA, 15 bp, Artificial Sequence
  dgRNA
  Igf1
gtcaaagagtgcagc

SEQ ID NO: 19791 - DNA, 15 bp, Artificial Sequence
  dgRNA
  Igf1
cggcaactgcctcca

SEQ ID NO: 19792 - DNA, 15 bp, Artificial Sequence
  dgRNA
  Bloc1s2
aacgcattgccaacc

SEQ ID NO: 19793 - DNA, 15 bp, Artificial Sequence
  dgRNA
  Bloc1s2
ctgtgagcaagcggc

SEQ ID NO: 19794 - DNA, 15 bp, Artificial Sequence
  dgRNA
  Bloc1s2
tgtgagcaagcggcg

SEQ ID NO: 19795 - DNA, 15 bp, Artificial Sequence
  dgRNA
  Bloc1s2
gcaagcggcggggcg

SEQ ID NO: 19796 - DNA, 15 bp, Artificial Sequence
  dgRNA
  Ctu2
gcccgcgggcccagc

SEQ ID NO: 19797 - DNA, 15 bp, Artificial Sequence
  dgRNA
  Ctu2
cgcgggcccagccgg

SEQ ID NO: 19798 - DNA, 15 bp, Artificial Sequence
  dgRNA
  Ctu2
gccgctgctgcgccg

SEQ ID NO: 19799 - DNA, 15 bp, Artificial Sequence
  dgRNA
  Ctu2
tgcgccgaggccacc

SEQ ID NO: 19800 - DNA, 15 bp, Artificial Sequence
  dgRNA
  Sec24a
cagccggcctgactc

SEQ ID NO: 19801 - DNA, 15 bp, Artificial Sequence
  dgRNA
  Sec24a
agcctctccgcgccc

SEQ ID NO: 19802 - DNA, 15 bp, Artificial Sequence
  dgRNA
  Sec24a
ctccgcgccctggcc

SEQ ID NO: 19803 - DNA, 15 bp, Artificial Sequence
  dgRNA
  Sec24a
gccctggccaggtcg

SEQ ID NO: 19804 - DNA, 15 bp, Artificial Sequence
  dgRNA
  Pramef8
agtgaattaacgcat

SEQ ID NO: 19805 - DNA, 15 bp, Artificial Sequence
  dgRNA
  Pramef8
agctctacgtagagc

SEQ ID NO: 19806 - DNA, 15 bp, Artificial Sequence
  dgRNA
  Pramef8
tgctccggacgtcac

SEQ ID NO: 19807 - DNA, 15 bp, Artificial Sequence
  dgRNA
  Pramef8
gctccggacgtcaca

SEQ ID NO: 19808 - DNA, 15 bp, Artificial Sequence
  dgRNA
  9430007A20Rik
caaactattctgccc

SEQ ID NO: 19809 - DNA, 15 bp, Artificial Sequence
  dgRNA
  9430007A20Rik
aactattctgccctg

SEQ ID NO: 19810 - DNA, 15 bp, Artificial Sequence
  dgRNA
  9430007A20Rik
tggggatattgtacc

SEQ ID NO: 19811 - DNA, 15 bp, Artificial Sequence
  dgRNA
  9430007A20Rik
ggggatattgtacca

SEQ ID NO: 19812 - DNA, 15 bp, Artificial Sequence
  dgRNA
  Hcar2
ggttcccgtctgccc

SEQ ID NO: 19813 - DNA, 15 bp, Artificial Sequence
  dgRNA
  Hcar2
gttcccgtctgccca

SEQ ID NO: 19814 - DNA, 15 bp, Artificial Sequence
  dgRNA
  Hcar2
ttcccgtctgcccag

SEQ ID NO: 19815 - DNA, 15 bp, Artificial Sequence
  dgRNA
  Hcar2
gatttcgtagtttcc

SEQ ID NO: 19816 - DNA, 15 bp, Artificial Sequence
  dgRNA
  Akip1
tagcgcaacgagtca

SEQ ID NO: 19817 - DNA, 15 bp, Artificial Sequence
  dgRNA
  Akip1
agcgcaacgagtcac

SEQ ID NO: 19818 - DNA, 15 bp, Artificial Sequence
  dgRNA
  Akip1
cacactgacctgtcg

SEQ ID NO: 19819 - DNA, 15 bp, Artificial Sequence
  dgRNA
  Akip1
aagctgattaaggct

SEQ ID NO: 19820 - DNA, 15 bp, Artificial Sequence
  dgRNA
  Catsper1
gaggggatcccgaga

SEQ ID NO: 19821 - DNA, 15 bp, Artificial Sequence
  dgRNA
  Catsper1
cccgagaagggactt

SEQ ID NO: 19822 - DNA, 15 bp, Artificial Sequence
  dgRNA
  Catsper1
ccgagaagggacttt

SEQ ID NO: 19823 - DNA, 15 bp, Artificial Sequence
  dgRNA
  Nmrk1
cgcgcaacccgatgc

SEQ ID NO: 19824 - DNA, 15 bp, Artificial Sequence
  dgRNA
  Nmrk1
tcgccggctgctgat

SEQ ID NO: 19825 - DNA, 15 bp, Artificial Sequence
  dgRNA
  Nmrk1
tgattggctgcggcg

SEQ ID NO: 19826 - DNA, 15 bp, Artificial Sequence
  dgRNA
  Nmrk1
ctgcggcggggagcc

SEQ ID NO: 19827 - DNA, 15 bp, Artificial Sequence
  dgRNA
  Marveld2
gcgcactgtctgcct

SEQ ID NO: 19828 - DNA, 15 bp, Artificial Sequence
  dgRNA
  Marveld2
cgcactgtctgcctt

SEQ ID NO: 19829 - DNA, 15 bp, Artificial Sequence
  dgRNA
  Marveld2
cggggcactgcggct

SEQ ID NO: 19830 - DNA, 15 bp, Artificial Sequence
  dgRNA
  Marveld2
ggctcggccacgccc

SEQ ID NO: 19831 - DNA, 15 bp, Artificial Sequence
  dgRNA
  Olfm2
acagccttcaagtgg

SEQ ID NO: 19832 - DNA, 15 bp, Artificial Sequence
  dgRNA
  Olfm2
tctgtctccataacg

SEQ ID NO: 19833 - DNA, 15 bp, Artificial Sequence
  dgRNA
  Olfm2
aagaacaccgcgtta

SEQ ID NO: 19834 - DNA, 15 bp, Artificial Sequence
  dgRNA
  Abcb9
aatccgcctaccccg

SEQ ID NO: 19835 - DNA, 15 bp, Artificial Sequence
  dgRNA
  Abcb9
ctccgcccacccagg

SEQ ID NO: 19836 - DNA, 15 bp, Artificial Sequence
  dgRNA
  Abcb9
ccggctccttctcgg

SEQ ID NO: 19837 - DNA, 15 bp, Artificial Sequence
  dgRNA
  Abcb9
gtgaaactccgcccc

SEQ ID NO: 19838 - DNA, 15 bp, Artificial Sequence
  dgRNA
  Lars2
tctaattgtaagacc

SEQ ID NO: 19839 - DNA, 15 bp, Artificial Sequence
  dgRNA
  Lars2
aagaccgggacaatc

SEQ ID NO: 19840 - DNA, 15 bp, Artificial Sequence
  dgRNA
  Lars2
cgatagcaggcgtag

SEQ ID NO: 19841 - DNA, 15 bp, Artificial Sequence
  dgRNA
  Lars2
gatagcaggcgtaga

SEQ ID NO: 19842 - DNA, 15 bp, Artificial Sequence
  dgRNA
  Rtca
tgcttacacatgatt

SEQ ID NO: 19843 - DNA, 15 bp, Artificial Sequence
  dgRNA
  Rtca
agttccctgctagtt

SEQ ID NO: 19844 - DNA, 15 bp, Artificial Sequence
  dgRNA
  Rtca
gcacaacgccccgcg

SEQ ID NO: 19845 - DNA, 15 bp, Artificial Sequence
  dgRNA
  Rtca
agttatcccccaggc

SEQ ID NO: 19846 - DNA, 15 bp, Artificial Sequence
  dgRNA
  Sec16b
atgattagtgtcttc

SEQ ID NO: 19847 - DNA, 15 bp, Artificial Sequence
  dgRNA
  Sec16b
tcaggacttttgatc

SEQ ID NO: 19848 - DNA, 15 bp, Artificial Sequence
  dgRNA
  Sec16b
tagtgccccttttag

SEQ ID NO: 19849 - DNA, 15 bp, Artificial Sequence
  dgRNA
  Sec16b
agtgccccttttagt

SEQ ID NO: 19850 - DNA, 15 bp, Artificial Sequence
  dgRNA
  Tmeff2
ccgcctagacccact

SEQ ID NO: 19851 - DNA, 15 bp, Artificial Sequence
  dgRNA
  Tmeff2
cgcctagacccactc

SEQ ID NO: 19852 - DNA, 15 bp, Artificial Sequence
  dgRNA
  Tmeff2
gaactagcccatctg

SEQ ID NO: 19853 - DNA, 15 bp, Artificial Sequence
  dgRNA
  Tmeff2
ttcccacgtgacccc

SEQ ID NO: 19854 - DNA, 15 bp, Artificial Sequence
  dgRNA
  Kansl2
cagccactcccgttg

SEQ ID NO: 19855 - DNA, 15 bp, Artificial Sequence
  dgRNA
  Kansl2
ttagttctgaccaat

SEQ ID NO: 19856 - DNA, 15 bp, Artificial Sequence
  dgRNA
  Kansl2
aaccaatcagcgtct

SEQ ID NO: 19857 - DNA, 15 bp, Artificial Sequence
  dgRNA
  Kansl2
accaatcagcgtcta

SEQ ID NO: 19858 - DNA, 15 bp, Artificial Sequence
  dgRNA
  Pa2g4
tggcggacgggcgcg

SEQ ID NO: 19859 - DNA, 15 bp, Artificial Sequence
  dgRNA
  Pa2g4
acgggcgcgaggagc

SEQ ID NO: 19860 - DNA, 15 bp, Artificial Sequence
  dgRNA
  Pa2g4
gcgcgaggagcaggc

SEQ ID NO: 19861 - DNA, 15 bp, Artificial Sequence
  dgRNA
  Pa2g4
cgcgaggagcaggct

SEQ ID NO: 19862 - DNA, 15 bp, Artificial Sequence
  dgRNA
  Rapgefl1
tcctaattttcctcg

SEQ ID NO: 19863 - DNA, 15 bp, Artificial Sequence
  dgRNA
  Rapgefl1
agttcaagcctcgcg

SEQ ID NO: 19864 - DNA, 15 bp, Artificial Sequence
  dgRNA
  Rapgefl1
caagcctcgcgcggc

SEQ ID NO: 19865 - DNA, 15 bp, Artificial Sequence
  dgRNA
  Rapgefl1
aagcctcgcgcggcc

SEQ ID NO: 19866 - DNA, 15 bp, Artificial Sequence
  dgRNA
  Phrf1
gacagtacttgtgat

SEQ ID NO: 19867 - DNA, 15 bp, Artificial Sequence
  dgRNA
  Phrf1
ttgtgatgggctagt

SEQ ID NO: 19868 - DNA, 15 bp, Artificial Sequence
  dgRNA
  Phrf1
agtcggtgttctgag

SEQ ID NO: 19869 - DNA, 15 bp, Artificial Sequence
  dgRNA
  Phrf1
agtagtttccaccaa

SEQ ID NO: 19870 - DNA, 15 bp, Artificial Sequence
  dgRNA
  Gpatch2l
cttcctagtttcccg

SEQ ID NO: 19871 - DNA, 15 bp, Artificial Sequence
  dgRNA
  Gpatch2l
ttcctagtttcccgg

SEQ ID NO: 19872 - DNA, 15 bp, Artificial Sequence
  dgRNA
  Gpatch2l
gggccccgcctaccg

SEQ ID NO: 19873 - DNA, 15 bp, Artificial Sequence
  dgRNA
  Gpatch2l
ccgcctaccgtggag

SEQ ID NO: 19874 - DNA, 15 bp, Artificial Sequence
  dgRNA
  Cwf19l2
gatcaactctccagc

SEQ ID NO: 19875 - DNA, 15 bp, Artificial Sequence
  dgRNA
  Cwf19l2
cgctgaacctttcac

SEQ ID NO: 19876 - DNA, 15 bp, Artificial Sequence
  dgRNA
  Cwf19l2
cacaggcgaaacatt

SEQ ID NO: 19877 - DNA, 15 bp, Artificial Sequence
  dgRNA
  Cwf19l2
gacagtcgtaaaccg

SEQ ID NO: 19878 - DNA, 15 bp, Artificial Sequence
  dgRNA
  Plpp5
aggtgatctgttagg

SEQ ID NO: 19879 - DNA, 15 bp, Artificial Sequence
  dgRNA
  Plpp5
tttcctgtagcccgg

SEQ ID NO: 19880 - DNA, 15 bp, Artificial Sequence
  dgRNA
  Plpp5
gcccggaggccccgc

SEQ ID NO: 19881 - DNA, 15 bp, Artificial Sequence
  dgRNA
  Plpp5
ggtagtcagtccccg

SEQ ID NO: 19882 - DNA, 15 bp, Artificial Sequence
  dgRNA
  Gjb6
ctgttccccgtactc

SEQ ID NO: 19883 - DNA, 15 bp, Artificial Sequence
  dgRNA
  Gjb6
gccctcacttcatta

SEQ ID NO: 19884 - DNA, 15 bp, Artificial Sequence
  dgRNA
  Gjb6
ccctcacttcattaa

SEQ ID NO: 19885 - DNA, 15 bp, Artificial Sequence
  dgRNA
  Gjb6
gtccttgatgggatc

SEQ ID NO: 19886 - DNA, 15 bp, Artificial Sequence
  dgRNA
  Pnoc
ggccaggacattagg

SEQ ID NO: 19887 - DNA, 15 bp, Artificial Sequence
  dgRNA
  Pnoc
ccaggacattaggag

SEQ ID NO: 19888 - DNA, 15 bp, Artificial Sequence
  dgRNA
  Pnoc
actcctcaggcggag

SEQ ID NO: 19889 - DNA, 15 bp, Artificial Sequence
  dgRNA
  Pnoc
aggcggagaggttat

SEQ ID NO: 19890 - DNA, 15 bp, Artificial Sequence
  dgRNA
  Adgrg7
ttaagaccaaagtac

SEQ ID NO: 19891 - DNA, 15 bp, Artificial Sequence
  dgRNA
  Adgrg7
aacaccctcttggat

SEQ ID NO: 19892 - DNA, 15 bp, Artificial Sequence
  dgRNA
  Adgrg7
agtcaaacaccctct

SEQ ID NO: 19893 - DNA, 15 bp, Artificial Sequence
  dgRNA
  Adgrg7
gtactttggtcttaa

SEQ ID NO: 19894 - DNA, 15 bp, Artificial Sequence
  dgRNA
  Itch
gtccacttcacctgg

SEQ ID NO: 19895 - DNA, 15 bp, Artificial Sequence
  dgRNA
  Itch
ggaggctggcgcgca

SEQ ID NO: 19896 - DNA, 15 bp, Artificial Sequence
  dgRNA
  Itch
gcgcgcaaggcctgc

SEQ ID NO: 19897 - DNA, 15 bp, Artificial Sequence
  dgRNA
  Itch
cgcgcaaggcctgct

SEQ ID NO: 19898 - DNA, 15 bp, Artificial Sequence
  dgRNA
  Ltbp2
gcccgcagctcctca

SEQ ID NO: 19899 - DNA, 15 bp, Artificial Sequence
  dgRNA
  Ltbp2
cgcccgctcgcttct

SEQ ID NO: 19900 - DNA, 15 bp, Artificial Sequence
  dgRNA
  Ltbp2
ttctcggtgccaaag

SEQ ID NO: 19901 - DNA, 15 bp, Artificial Sequence
  dgRNA
  Ltbp2
tctcggtgccaaaga

SEQ ID NO: 19902 - DNA, 15 bp, Artificial Sequence
  dgRNA
  Cyb5b
cacccggccacgttt

SEQ ID NO: 19903 - DNA, 15 bp, Artificial Sequence
  dgRNA
  Cyb5b
gccacgtttaggcgc

SEQ ID NO: 19904 - DNA, 15 bp, Artificial Sequence
  dgRNA
  Cyb5b
atcacgatatctgat

SEQ ID NO: 19905 - DNA, 15 bp, Artificial Sequence
  dgRNA
  Cyb5b
gatatctgattggca

SEQ ID NO: 19906 - DNA, 15 bp, Artificial Sequence
  dgRNA
  Tmcc2
ctccgctccccaggt

SEQ ID NO: 19907 - DNA, 15 bp, Artificial Sequence
  dgRNA
  Tmcc2
gaatgaactatccta

SEQ ID NO: 19908 - DNA, 15 bp, Artificial Sequence
  dgRNA
  Tmcc2
cactggcgcgggagg

SEQ ID NO: 19909 - DNA, 15 bp, Artificial Sequence
  dgRNA
  Tmcc2
tcactggcgcgggag

SEQ ID NO: 19910 - DNA, 15 bp, Artificial Sequence
  dgRNA
  Ppfia4
gcatgtgcattccgt

SEQ ID NO: 19911 - DNA, 15 bp, Artificial Sequence
  dgRNA
  Ppfia4
gtgggcaacctaaca

SEQ ID NO: 19912 - DNA, 15 bp, Artificial Sequence
  dgRNA
  Ppfia4
ttgttaggttgccca

SEQ ID NO: 19913 - DNA, 15 bp, Artificial Sequence
  dgRNA
  Ppfia4
tggtggcaccttgtt

SEQ ID NO: 19914 - DNA, 15 bp, Artificial Sequence
  dgRNA
  Arl13b
tttccgccctttgac

SEQ ID NO: 19915 - DNA, 15 bp, Artificial Sequence
  dgRNA
  Arl13b
ttccgccctttgaca

SEQ ID NO: 19916 - DNA, 15 bp, Artificial Sequence
  dgRNA
  Arl13b
tccgccctttgacag

SEQ ID NO: 19917 - DNA, 15 bp, Artificial Sequence
  dgRNA
  Arl13b
ccgccctttgacagg

SEQ ID NO: 19918 - DNA, 15 bp, Artificial Sequence
  dgRNA
  11-Sep
tcttatcagctgacc

SEQ ID NO: 19919 - DNA, 15 bp, Artificial Sequence
  dgRNA
  11-Sep
ctgcgttcgtctgct

SEQ ID NO: 19920 - DNA, 15 bp, Artificial Sequence
  dgRNA
  11-Sep
gttcgtctgctcggc

SEQ ID NO: 19921 - DNA, 15 bp, Artificial Sequence
  dgRNA
  11-Sep
ttcgtctgctcggct

SEQ ID NO: 19922 - DNA, 15 bp, Artificial Sequence
  dgRNA
  Cmtm5
cccctaggaggcatg

SEQ ID NO: 19923 - DNA, 15 bp, Artificial Sequence
  dgRNA
  Cmtm5
gcccctaggaggcat

SEQ ID NO: 19924 - DNA, 15 bp, Artificial Sequence
  dgRNA
  Cmtm5
tgcagggcccctagg

SEQ ID NO: 19925 - DNA, 15 bp, Artificial Sequence
  dgRNA
  Fer1l5
gacggaggagctcca

SEQ ID NO: 19926 - DNA, 15 bp, Artificial Sequence
  dgRNA
  Fer1l5
gagcttagcaacaag

SEQ ID NO: 19927 - DNA, 15 bp, Artificial Sequence
  dgRNA
  Fer1l5
cgtcccaggttcaca

SEQ ID NO: 19928 - DNA, 15 bp, Artificial Sequence
  dgRNA
  Fer1l5
ccgtcccaggttcac

SEQ ID NO: 19929 - DNA, 15 bp, Artificial Sequence
  dgRNA
  Slc35b3
cccggctcacgatcg

SEQ ID NO: 19930 - DNA, 15 bp, Artificial Sequence
  dgRNA
  Slc35b3
ggatgtgaagtcaac

SEQ ID NO: 19931 - DNA, 15 bp, Artificial Sequence
  dgRNA
  Slc35b3
gatgtgaagtcaact

SEQ ID NO: 19932 - DNA, 15 bp, Artificial Sequence
  dgRNA
  Slc35b3
agccacgagatggac

SEQ ID NO: 19933 - DNA, 15 bp, Artificial Sequence
  dgRNA
  Sgol2b
aaccttctccggcag

SEQ ID NO: 19934 - DNA, 15 bp, Artificial Sequence
  dgRNA
  Sgol2b
cagcgggtagcatcc

SEQ ID NO: 19935 - DNA, 15 bp, Artificial Sequence
  dgRNA
  Sgol2b
ggtagcatcccggct

SEQ ID NO: 19936 - DNA, 15 bp, Artificial Sequence
  dgRNA
  Sgol2b
atcccggctcggctc

SEQ ID NO: 19937 - DNA, 15 bp, Artificial Sequence
  dgRNA
  Borcs6
cctcaactttccgaa

SEQ ID NO: 19938 - DNA, 15 bp, Artificial Sequence
  dgRNA
  Borcs6
ctcaactttccgaag

SEQ ID NO: 19939 - DNA, 15 bp, Artificial Sequence
  dgRNA
  Borcs6
actttccgaaggggc

SEQ ID NO: 19940 - DNA, 15 bp, Artificial Sequence
  dgRNA
  Borcs6
ctttccgaaggggcg

SEQ ID NO: 19941 - DNA, 15 bp, Artificial Sequence
  dgRNA
  Zfp64
cgaccacagagtccc

SEQ ID NO: 19942 - DNA, 15 bp, Artificial Sequence
  dgRNA
  Zfp64
gggatcggtgtactc

SEQ ID NO: 19943 - DNA, 15 bp, Artificial Sequence
  dgRNA
  Zfp64
ctccacgacctttcc

SEQ ID NO: 19944 - DNA, 15 bp, Artificial Sequence
  dgRNA
  Zfp64
cctttcccggttcct

SEQ ID NO: 19945 - DNA, 15 bp, Artificial Sequence
  dgRNA
  Magi2
ccactcgcagcacgc

SEQ ID NO: 19946 - DNA, 15 bp, Artificial Sequence
  dgRNA
  Magi2
cgcagcacgcaggag

SEQ ID NO: 19947 - DNA, 15 bp, Artificial Sequence
  dgRNA
  Magi2
cgcaggagtggcccc

SEQ ID NO: 19948 - DNA, 15 bp, Artificial Sequence
  dgRNA
  Magi2
acccgctcaccagct

SEQ ID NO: 19949 - DNA, 15 bp, Artificial Sequence
  dgRNA
  Hist1h4k
tcagaaagctcggac

SEQ ID NO: 19950 - DNA, 15 bp, Artificial Sequence
  dgRNA
  Hist1h4k
cagaaagctcggaca

SEQ ID NO: 19951 - DNA, 15 bp, Artificial Sequence
  dgRNA
  Hist1h4k
cgccgcagtataaaa

SEQ ID NO: 19952 - DNA, 15 bp, Artificial Sequence
  dgRNA
  Hist1h4k
cgcagtataaaaagg

SEQ ID NO: 19953 - DNA, 15 bp, Artificial Sequence
  dgRNA
  Zfp563
gggccatgagagctt

SEQ ID NO: 19954 - DNA, 15 bp, Artificial Sequence
  dgRNA
  Zfp563
gctttggctgcaata

SEQ ID NO: 19955 - DNA, 15 bp, Artificial Sequence
  dgRNA
  Zfp563
atccaattagtacca

SEQ ID NO: 19956 - DNA, 15 bp, Artificial Sequence
  dgRNA
  Zfp563
cacattagagcttgg

SEQ ID NO: 19957 - DNA, 15 bp, Artificial Sequence
  dgRNA
  Kcnk9
gtgatgatgcccaag

SEQ ID NO: 19958 - DNA, 15 bp, Artificial Sequence
  dgRNA
  Kcnk9
tcgactccatcgtag

SEQ ID NO: 19959 - DNA, 15 bp, Artificial Sequence
  dgRNA
  Kcnk9
actccatcgtagagg

SEQ ID NO: 19960 - DNA, 15 bp, Artificial Sequence
  dgRNA
  Kcnk9
atcgtagaggaggct

SEQ ID NO: 19961 - DNA, 15 bp, Artificial Sequence
  dgRNA
  Ldlrad2
acctacttccgctgt

SEQ ID NO: 19962 - DNA, 15 bp, Artificial Sequence
  dgRNA
  Ldlrad2
cttccgctgtcggaa

SEQ ID NO: 19963 - DNA, 15 bp, Artificial Sequence
  dgRNA
  Ldlrad2
ctcctatgtgatgac

SEQ ID NO: 19964 - DNA, 15 bp, Artificial Sequence
  dgRNA
  Ldlrad2
tgccgcaagaccctg

SEQ ID NO: 19965 - DNA, 15 bp, Artificial Sequence
  dgRNA
  Nfatc2
ccgccacccgctccc

SEQ ID NO: 19966 - DNA, 15 bp, Artificial Sequence
  dgRNA
  Nfatc2
tccccggacgcgtcc

SEQ ID NO: 19967 - DNA, 15 bp, Artificial Sequence
  dgRNA
  Nfatc2
gccgtgagccatcct

SEQ ID NO: 19968 - DNA, 15 bp, Artificial Sequence
  dgRNA
  Nfatc2
cgtgcgccacagata

SEQ ID NO: 19969 - DNA, 15 bp, Artificial Sequence
  dgRNA
  Pcdhb16
gcacagcaataaggg

SEQ ID NO: 19970 - DNA, 15 bp, Artificial Sequence
  dgRNA
  Pcdhb16
acaaggcggcgctgt

SEQ ID NO: 19971 - DNA, 15 bp, Artificial Sequence
  dgRNA
  Pcdhb16
cggcgctgtaggata

SEQ ID NO: 19972 - DNA, 15 bp, Artificial Sequence
  dgRNA
  Pcdhb16
tgtggttccattaat

SEQ ID NO: 19973 - DNA, 15 bp, Artificial Sequence
  dgRNA
  Jsrp1
cggcctgggatggac

SEQ ID NO: 19974 - DNA, 15 bp, Artificial Sequence
  dgRNA
  Jsrp1
acggaggggcggcct

SEQ ID NO: 19975 - DNA, 15 bp, Artificial Sequence
  dgRNA
  Jsrp1
gacggaggggcggcc

SEQ ID NO: 19976 - DNA, 15 bp, Artificial Sequence
  dgRNA
  Jsrp1
tagtggacggagggg

SEQ ID NO: 19977 - DNA, 15 bp, Artificial Sequence
  dgRNA
  C1qtnf6
acaggtccccagcgc

SEQ ID NO: 19978 - DNA, 15 bp, Artificial Sequence
  dgRNA
  C1qtnf6
ctcccagtacctccg

SEQ ID NO: 19979 - DNA, 15 bp, Artificial Sequence
  dgRNA
  C1qtnf6
ttgagtcaaatgccc

SEQ ID NO: 19980 - DNA, 15 bp, Artificial Sequence
  dgRNA
  C1qtnf6
tgcctcggaggtact

SEQ ID NO: 19981 - DNA, 15 bp, Artificial Sequence
  dgRNA
  Phc1
ccctcgcggcggggc

SEQ ID NO: 19982 - DNA, 15 bp, Artificial Sequence
  dgRNA
  Phc1
gcccgcgcgagcccc

SEQ ID NO: 19983 - DNA, 15 bp, Artificial Sequence
  dgRNA
  Phc1
cgcgagcccccggcc

SEQ ID NO: 19984 - DNA, 15 bp, Artificial Sequence
  dgRNA
  Phc1
ggcctggcggagccg

SEQ ID NO: 19985 - DNA, 15 bp, Artificial Sequence
  dgRNA
  Kif18a
actaaatatcccagg

SEQ ID NO: 19986 - DNA, 15 bp, Artificial Sequence
  dgRNA
  Kif18a
cgcccacctccgtca

SEQ ID NO: 19987 - DNA, 15 bp, Artificial Sequence
  dgRNA
  Kif18a
ctccgtcacggctgc

SEQ ID NO: 19988 - DNA, 15 bp, Artificial Sequence
  dgRNA
  Kif18a
ccgcgcgcgttgcca

SEQ ID NO: 19989 - DNA, 15 bp, Artificial Sequence
  dgRNA
  Fhl1
tttatatgtagcgtt

SEQ ID NO: 19990 - DNA, 15 bp, Artificial Sequence
  dgRNA
  Fhl1
ttggatcacctaaaa

SEQ ID NO: 19991 - DNA, 15 bp, Artificial Sequence
  dgRNA
  Fhl1
taaggttgtgatctc

SEQ ID NO: 19992 - DNA, 15 bp, Artificial Sequence
  dgRNA
  Fhl1
attttaggtgatcca

SEQ ID NO: 19993 - DNA, 15 bp, Artificial Sequence
  dgRNA
  Zcchc7
ttcttttcgaaagga

SEQ ID NO: 19994 - DNA, 15 bp, Artificial Sequence
  dgRNA
  Zcchc7
cacaaagtttatagg

SEQ ID NO: 19995 - DNA, 15 bp, Artificial Sequence
  dgRNA
  Zcchc7
cgttacgcatgcgct

SEQ ID NO: 19996 - DNA, 15 bp, Artificial Sequence
  dgRNA
  Zcchc7
tacgcatgcgctcgg

SEQ ID NO: 19997 - DNA, 15 bp, Artificial Sequence
  dgRNA
  Pear1
ggaaagaggggcgtc

SEQ ID NO: 19998 - DNA, 15 bp, Artificial Sequence
  dgRNA
  Pear1
aagaggggcgtcggg

SEQ ID NO: 19999 - DNA, 15 bp, Artificial Sequence
  dgRNA
  Pear1
ggtggaccgcgacgc

SEQ ID NO: 20000 - DNA, 15 bp, Artificial Sequence
  dgRNA
  Pear1
gtggaccgcgacgcc

SEQ ID NO: 20001 - DNA, 15 bp, Artificial Sequence
  dgRNA
  Oip5
ggttgaactgcctcg

SEQ ID NO: 20002 - DNA, 15 bp, Artificial Sequence
  dgRNA
  Oip5
gttgaactgcctcga

SEQ ID NO: 20003 - DNA, 15 bp, Artificial Sequence
  dgRNA
  Oip5
gaactgcctcgaggg

SEQ ID NO: 20004 - DNA, 15 bp, Artificial Sequence
  dgRNA
  Oip5
aactgcctcgagggt

SEQ ID NO: 20005 - DNA, 15 bp, Artificial Sequence
  dgRNA
  Cxcl10
atgccctcggtttac

SEQ ID NO: 20006 - DNA, 15 bp, Artificial Sequence
  dgRNA
  Cxcl10
tgccctcggtttaca

SEQ ID NO: 20007 - DNA, 15 bp, Artificial Sequence
  dgRNA
  Cxcl10
gccctcggtttacag

SEQ ID NO: 20008 - DNA, 15 bp, Artificial Sequence
  dgRNA
  Cxcl10
acttccctcgggttg

SEQ ID NO: 20009 - DNA, 15 bp, Artificial Sequence
  dgRNA
  Slc25a32
tacttccgccttccg

SEQ ID NO: 20010 - DNA, 15 bp, Artificial Sequence
  dgRNA
  Slc25a32
acttccgccttccgc

SEQ ID NO: 20011 - DNA, 15 bp, Artificial Sequence
  dgRNA
  Slc25a32
gggcttcctgtcacg

SEQ ID NO: 20012 - DNA, 15 bp, Artificial Sequence
  dgRNA
  Slc25a32
cgtggctccgcagag

SEQ ID NO: 20013 - DNA, 15 bp, Artificial Sequence
  dgRNA
  5830411N06Rik
atgacggctctcata

SEQ ID NO: 20014 - DNA, 15 bp, Artificial Sequence
  dgRNA
  5830411N06Rik
tgacggctctcatat

SEQ ID NO: 20015 - DNA, 15 bp, Artificial Sequence
  dgRNA
  5830411N06Rik
gacggctctcatatg

SEQ ID NO: 20016 - DNA, 15 bp, Artificial Sequence
  dgRNA
  5830411N06Rik
acggctctcatatgg

SEQ ID NO: 20017 - DNA, 15 bp, Artificial Sequence
  dgRNA
  Foxj1
cacagagtcggatct

SEQ ID NO: 20018 - DNA, 15 bp, Artificial Sequence
  dgRNA
  Foxj1
agagtcggatctcgg

SEQ ID NO: 20019 - DNA, 15 bp, Artificial Sequence
  dgRNA
  Foxj1
gtcggatctcggtgg

SEQ ID NO: 20020 - DNA, 15 bp, Artificial Sequence
  dgRNA
  Foxj1
tcggatctcggtggc

SEQ ID NO: 20021 - DNA, 15 bp, Artificial Sequence
  dgRNA
  Rtbdn
tcatgatcaggatta

SEQ ID NO: 20022 - DNA, 15 bp, Artificial Sequence
  dgRNA
  Rtbdn
ataagagcgattagc

SEQ ID NO: 20023 - DNA, 15 bp, Artificial Sequence
  dgRNA
  Rtbdn
cgattagctggtagc

SEQ ID NO: 20024 - DNA, 15 bp, Artificial Sequence
  dgRNA
  Rtbdn
gattagctggtagct

SEQ ID NO: 20025 - DNA, 15 bp, Artificial Sequence
  dgRNA
  Olfr569
taactgtgttactac

SEQ ID NO: 20026 - DNA, 15 bp, Artificial Sequence
  dgRNA
  Olfr569
tgttctcagcagcga

SEQ ID NO: 20027 - DNA, 15 bp, Artificial Sequence
  dgRNA
  Popdc2
aacatggtatccctc

SEQ ID NO: 20028 - DNA, 15 bp, Artificial Sequence
  dgRNA
  Popdc2
ggtcaccctttcttc

SEQ ID NO: 20029 - DNA, 15 bp, Artificial Sequence
  dgRNA
  Popdc2
ctccgcgttctgcct

SEQ ID NO: 20030 - DNA, 15 bp, Artificial Sequence
  dgRNA
  Popdc2
taccatgtttggaat

SEQ ID NO: 20031 - DNA, 15 bp, Artificial Sequence
  dgRNA
  Best2
ctgtaactcaactaa

SEQ ID NO: 20032 - DNA, 15 bp, Artificial Sequence
  dgRNA
  Best2
tgtaactcaactaaa

SEQ ID NO: 20033 - DNA, 15 bp, Artificial Sequence
  dgRNA
  Best2
gtaactcaactaaag

SEQ ID NO: 20034 - DNA, 15 bp, Artificial Sequence
  dgRNA
  Best2
ctcaactaaagggga

SEQ ID NO: 20035 - DNA, 15 bp, Artificial Sequence
  dgRNA
  Tsc2
gcgatcctagtcgcg

SEQ ID NO: 20036 - DNA, 15 bp, Artificial Sequence
  dgRNA
  Tsc2
gcaaagcctcgcccc

SEQ ID NO: 20037 - DNA, 15 bp, Artificial Sequence
  dgRNA
  Tsc2
agctcgccccgcgag

SEQ ID NO: 20038 - DNA, 15 bp, Artificial Sequence
  dgRNA
  Tsc2
cggaagggtgtaggg

SEQ ID NO: 20039 - DNA, 15 bp, Artificial Sequence
  dgRNA
  Vav2
ctccacgtgcaccta

SEQ ID NO: 20040 - DNA, 15 bp, Artificial Sequence
  dgRNA
  Vav2
acctagggaaagtcg

SEQ ID NO: 20041 - DNA, 15 bp, Artificial Sequence
  dgRNA
  Vav2
cctagggaaagtcgt

SEQ ID NO: 20042 - DNA, 15 bp, Artificial Sequence
  dgRNA
  Vav2
gggaaagtcgtgggc

SEQ ID NO: 20043 - DNA, 15 bp, Artificial Sequence
  dgRNA
  Ccer1
tcctgcgaatgttca

SEQ ID NO: 20044 - DNA, 15 bp, Artificial Sequence
  dgRNA
  Ccer1
cctgcgaatgttcat

SEQ ID NO: 20045 - DNA, 15 bp, Artificial Sequence
  dgRNA
  Ccer1
tgggatatctagttc

SEQ ID NO: 20046 - DNA, 15 bp, Artificial Sequence
  dgRNA
  Ccer1
cacgtccactccaat

SEQ ID NO: 20047 - DNA, 15 bp, Artificial Sequence
  dgRNA
  Tmem82
gagacagagcgctgc

SEQ ID NO: 20048 - DNA, 15 bp, Artificial Sequence
  dgRNA
  Tmem82
agacagagcgctgcg

SEQ ID NO: 20049 - DNA, 15 bp, Artificial Sequence
  dgRNA
  Tmem82
cgggccacacctgag

SEQ ID NO: 20050 - DNA, 15 bp, Artificial Sequence
  dgRNA
  Tmem82
gtgagctggccgaag

SEQ ID NO: 20051 - DNA, 15 bp, Artificial Sequence
  dgRNA
  Gimap8
cacggaaggggctta

SEQ ID NO: 20052 - DNA, 15 bp, Artificial Sequence
  dgRNA
  Gimap8
ggatgaacacggaag

SEQ ID NO: 20053 - DNA, 15 bp, Artificial Sequence
  dgRNA
  Gimap8
taggatgaacacgga

SEQ ID NO: 20054 - DNA, 15 bp, Artificial Sequence
  dgRNA
  Vmn1r84
gttgggtcatcaaat

SEQ ID NO: 20055 - DNA, 15 bp, Artificial Sequence
  dgRNA
  Lrrc36
ttgacgcccttctca

SEQ ID NO: 20056 - DNA, 15 bp, Artificial Sequence
  dgRNA
  Lrrc36
tagtcctaaattccg

SEQ ID NO: 20057 - DNA, 15 bp, Artificial Sequence
  dgRNA
  Lrrc36
cgacagactcgtgac

SEQ ID NO: 20058 - DNA, 15 bp, Artificial Sequence
  dgRNA
  Lrrc36
gaccggtccctctaa

SEQ ID NO: 20059 - DNA, 15 bp, Artificial Sequence
  dgRNA
  Pwwp2b
tttgagagccggctg

SEQ ID NO: 20060 - DNA, 15 bp, Artificial Sequence
  dgRNA
  Pwwp2b
ttgagagccggctgt

SEQ ID NO: 20061 - DNA, 15 bp, Artificial Sequence
  dgRNA
  Pwwp2b
tgtgggcgcacgctg

SEQ ID NO: 20062 - DNA, 15 bp, Artificial Sequence
  dgRNA
  Pwwp2b
gtgggcgcacgctgc

SEQ ID NO: 20063 - DNA, 15 bp, Artificial Sequence
  dgRNA
  Vmn2r120
atatgtgttgtaggc

SEQ ID NO: 20064 - DNA, 15 bp, Artificial Sequence
  dgRNA
  Vmn2r120
gcaaaatgctgtgcc

SEQ ID NO: 20065 - DNA, 15 bp, Artificial Sequence
  dgRNA
  Stag2
tcgtttgtgtctatt

SEQ ID NO: 20066 - DNA, 15 bp, Artificial Sequence
  dgRNA
  Stag2
cgtttgtgtctattt

SEQ ID NO: 20067 - DNA, 15 bp, Artificial Sequence
  dgRNA
  Stag2
ttgggcctcggaccg

SEQ ID NO: 20068 - DNA, 15 bp, Artificial Sequence
  dgRNA
  Stag2
tgggcctcggaccga

SEQ ID NO: 20069 - DNA, 15 bp, Artificial Sequence
  dgRNA
  Ldlrad4
gagttgagacagacc

SEQ ID NO: 20070 - DNA, 15 bp, Artificial Sequence
  dgRNA
  Ldlrad4
gacccggcctctgcg

SEQ ID NO: 20071 - DNA, 15 bp, Artificial Sequence
  dgRNA
  Ldlrad4
ccggcctctgcgcgg

SEQ ID NO: 20072 - DNA, 15 bp, Artificial Sequence
  dgRNA
  Ldlrad4
gcctctgcgcggtgg

SEQ ID NO: 20073 - DNA, 15 bp, Artificial Sequence
  dgRNA
  Pet117
agcactgcgacttcc

SEQ ID NO: 20074 - DNA, 15 bp, Artificial Sequence
  dgRNA
  Pet117
gcgacttcctggtga

SEQ ID NO: 20075 - DNA, 15 bp, Artificial Sequence
  dgRNA
  Pet117
aggcggtccccaaat

SEQ ID NO: 20076 - DNA, 15 bp, Artificial Sequence
  dgRNA
  Pet117
caagaagcagcgaag

SEQ ID NO: 20077 - DNA, 15 bp, Artificial Sequence
  dgRNA
  Accs
tacaaatagatggcg

SEQ ID NO: 20078 - DNA, 15 bp, Artificial Sequence
  dgRNA
  Accs
gcttaggtaatgccc

SEQ ID NO: 20079 - DNA, 15 bp, Artificial Sequence
  dgRNA
  Accs
tgtccgaaaagctag

SEQ ID NO: 20080 - DNA, 15 bp, Artificial Sequence
  dgRNA
  Accs
aacaccaatcttcct

SEQ ID NO: 20081 - DNA, 15 bp, Artificial Sequence
  dgRNA
  Pld2
gtctctaacgcaggg

SEQ ID NO: 20082 - DNA, 15 bp, Artificial Sequence
  dgRNA
  Pld2
tctctaacgcagggc

SEQ ID NO: 20083 - DNA, 15 bp, Artificial Sequence
  dgRNA
  Pld2
acgcagggcgggcag

SEQ ID NO: 20084 - DNA, 15 bp, Artificial Sequence
  dgRNA
  Pld2
cgggcagaggacggc

SEQ ID NO: 20085 - DNA, 15 bp, Artificial Sequence
  dgRNA
  Myeov2
acaactcgtgctgtg

SEQ ID NO: 20086 - DNA, 15 bp, Artificial Sequence
  dgRNA
  Myeov2
gctgtgcggtgttgc

SEQ ID NO: 20087 - DNA, 15 bp, Artificial Sequence
  dgRNA
  Myeov2
cagcgagtgccaccg

SEQ ID NO: 20088 - DNA, 15 bp, Artificial Sequence
  dgRNA
  Myeov2
agtgccaccgaggcg

SEQ ID NO: 20089 - DNA, 15 bp, Artificial Sequence
  dgRNA
  Gpr139
aggggaacggcgtcc

SEQ ID NO: 20090 - DNA, 15 bp, Artificial Sequence
  dgRNA
  Gpr139
aacggcgtcccggcc

SEQ ID NO: 20091 - DNA, 15 bp, Artificial Sequence
  dgRNA
  Gpr139
acggcgtcccggccc

SEQ ID NO: 20092 - DNA, 15 bp, Artificial Sequence
  dgRNA
  Gpr139
gcccgggttctgagg

SEQ ID NO: 20093 - DNA, 15 bp, Artificial Sequence
  dgRNA
  Naa35
gctccgcctctctct

SEQ ID NO: 20094 - DNA, 15 bp, Artificial Sequence
  dgRNA
  Naa35
tctgggttccgccca

SEQ ID NO: 20095 - DNA, 15 bp, Artificial Sequence
  dgRNA
  Naa35
ggttccgcccacggc

SEQ ID NO: 20096 - DNA, 15 bp, Artificial Sequence
  dgRNA
  Naa35
gttccgcccacggcc

SEQ ID NO: 20097 - DNA, 15 bp, Artificial Sequence
  dgRNA
  Kcna7
gtggacaactggtta

SEQ ID NO: 20098 - DNA, 15 bp, Artificial Sequence
  dgRNA
  Kcna7
tggacaactggttaa

SEQ ID NO: 20099 - DNA, 15 bp, Artificial Sequence
  dgRNA
  Tbx3
ccgcggcgagctctc

SEQ ID NO: 20100 - DNA, 15 bp, Artificial Sequence
  dgRNA
  Tbx3
ggatcagccacctag

SEQ ID NO: 20101 - DNA, 15 bp, Artificial Sequence
  dgRNA
  Tbx3
acctagaggcgactt

SEQ ID NO: 20102 - DNA, 15 bp, Artificial Sequence
  dgRNA
  Tbx3
actttggtgagcgcg

SEQ ID NO: 20103 - DNA, 15 bp, Artificial Sequence
  dgRNA
  Pcdhb13
attgatttgaacgca

SEQ ID NO: 20104 - DNA, 15 bp, Artificial Sequence
  dgRNA
  Pcdhb13
gatttgaacgcatgg

SEQ ID NO: 20105 - DNA, 15 bp, Artificial Sequence
  dgRNA
  Pcdhb13
gcatggtggcggtgt

SEQ ID NO: 20106 - DNA, 15 bp, Artificial Sequence
  dgRNA
  Pcdhb13
agcgtcctcagactc

SEQ ID NO: 20107 - DNA, 15 bp, Artificial Sequence
  dgRNA
  A830018L16Rik
cggtgctgcggaaag

SEQ ID NO: 20108 - DNA, 15 bp, Artificial Sequence
  dgRNA
  A830018L16Rik
cggaaagcggagagc

SEQ ID NO: 20109 - DNA, 15 bp, Artificial Sequence
  dgRNA
  A830018L16Rik
aaagcggagagcggg

SEQ ID NO: 20110 - DNA, 15 bp, Artificial Sequence
  dgRNA
  A830018L16Rik
aagcggagagcgggt

SEQ ID NO: 20111 - DNA, 15 bp, Artificial Sequence
  dgRNA
  Lrch3
tgtagtggcctttta

SEQ ID NO: 20112 - DNA, 15 bp, Artificial Sequence
  dgRNA
  Lrch3
ccttttagggagccc

SEQ ID NO: 20113 - DNA, 15 bp, Artificial Sequence
  dgRNA
  Lrch3
tctgcgaagtcggtt

SEQ ID NO: 20114 - DNA, 15 bp, Artificial Sequence
  dgRNA
  Lrch3
tcggttcggtttccc

SEQ ID NO: 20115 - DNA, 15 bp, Artificial Sequence
  dgRNA
  Tjap1
ttaccaggtctgcaa

SEQ ID NO: 20116 - DNA, 15 bp, Artificial Sequence
  dgRNA
  Tjap1
taacgctttaccccg

SEQ ID NO: 20117 - DNA, 15 bp, Artificial Sequence
  dgRNA
  Tjap1
ccctccgatgacgca

SEQ ID NO: 20118 - DNA, 15 bp, Artificial Sequence
  dgRNA
  Tjap1
atgacgcacggcgcc

SEQ ID NO: 20119 - DNA, 15 bp, Artificial Sequence
  dgRNA
  Alad
agacgggcgggctct

SEQ ID NO: 20120 - DNA, 15 bp, Artificial Sequence
  dgRNA
  Alad
gacgggcgggctctc

SEQ ID NO: 20121 - DNA, 15 bp, Artificial Sequence
  dgRNA
  Alad
gctctcgggcaactc

SEQ ID NO: 20122 - DNA, 15 bp, Artificial Sequence
  dgRNA
  Alad
cgggcaactctggat

SEQ ID NO: 20123 - DNA, 15 bp, Artificial Sequence
  dgRNA
  Extl2
gtgacgcttcaaacg

SEQ ID NO: 20124 - DNA, 15 bp, Artificial Sequence
  dgRNA
  Extl2
agcgcttgaccgccg

SEQ ID NO: 20125 - DNA, 15 bp, Artificial Sequence
  dgRNA
  Extl2
acacccgggaattcg

SEQ ID NO: 20126 - DNA, 15 bp, Artificial Sequence
  dgRNA
  Extl2
gaattcgaggacttc

SEQ ID NO: 20127 - DNA, 15 bp, Artificial Sequence
  dgRNA
  Itpr2
gaggagcgaaggtgt

SEQ ID NO: 20128 - DNA, 15 bp, Artificial Sequence
  dgRNA
  Itpr2
ggacagaacttcgcc

SEQ ID NO: 20129 - DNA, 15 bp, Artificial Sequence
  dgRNA
  Itpr2
aacttcgccaggaac

SEQ ID NO: 20130 - DNA, 15 bp, Artificial Sequence
  dgRNA
  Itpr2
aacctactgctgggc

SEQ ID NO: 20131 - DNA, 15 bp, Artificial Sequence
  dgRNA
  Bcl9l
ctctcgctgcccgcc

SEQ ID NO: 20132 - DNA, 15 bp, Artificial Sequence
  dgRNA
  Bcl9l
tctcgctgcccgccc

SEQ ID NO: 20133 - DNA, 15 bp, Artificial Sequence
  dgRNA
  Bcl9l
cgggcctgccgggat

SEQ ID NO: 20134 - DNA, 15 bp, Artificial Sequence
  dgRNA
  Bcl9l
ctgccgggatgggca

SEQ ID NO: 20135 - DNA, 15 bp, Artificial Sequence
  dgRNA
  Cd2bp2
aagtcccgtgaggca

SEQ ID NO: 20136 - DNA, 15 bp, Artificial Sequence
  dgRNA
  Cd2bp2
cacgcgagtctttgc

SEQ ID NO: 20137 - DNA, 15 bp, Artificial Sequence
  dgRNA
  Cd2bp2
cttcctgccgcgagt

SEQ ID NO: 20138 - DNA, 15 bp, Artificial Sequence
  dgRNA
  Cd2bp2
gccgcgagtcggcct

SEQ ID NO: 20139 - DNA, 15 bp, Artificial Sequence
  dgRNA
  Fhod3
gcgttgattgctgcc

SEQ ID NO: 20140 - DNA, 15 bp, Artificial Sequence
  dgRNA
  Fhod3
ctgcagcggtcgcga

SEQ ID NO: 20141 - DNA, 15 bp, Artificial Sequence
  dgRNA
  Fhod3
agcggtcgcgaaggt

SEQ ID NO: 20142 - DNA, 15 bp, Artificial Sequence
  dgRNA
  Fhod3
gcggtcgcgaaggtc

SEQ ID NO: 20143 - DNA, 15 bp, Artificial Sequence
  dgRNA
  Rbm19
aagcctgtcatcccg

SEQ ID NO: 20144 - DNA, 15 bp, Artificial Sequence
  dgRNA
  Rbm19
agcctgtcatcccga

SEQ ID NO: 20145 - DNA, 15 bp, Artificial Sequence
  dgRNA
  Rbm19
gcctgtcatcccgag

SEQ ID NO: 20146 - DNA, 15 bp, Artificial Sequence
  dgRNA
  Rbm19
cctgtcatcccgagg

SEQ ID NO: 20147 - DNA, 15 bp, Artificial Sequence
  dgRNA
  Alpk3
ctgggtcggcattca

SEQ ID NO: 20148 - DNA, 15 bp, Artificial Sequence
  dgRNA
  Alpk3
acggagtttctctgc

SEQ ID NO: 20149 - DNA, 15 bp, Artificial Sequence
  dgRNA
  Alpk3
gtagctgcctaaacc

SEQ ID NO: 20150 - DNA, 15 bp, Artificial Sequence
  dgRNA
  Alpk3
tagctgcctaaaccg

SEQ ID NO: 20151 - DNA, 15 bp, Artificial Sequence
  dgRNA
  Tgfbr1
cgggggcgtggttag

SEQ ID NO: 20152 - DNA, 15 bp, Artificial Sequence
  dgRNA
  Tgfbr1
cccacggccgctcat

SEQ ID NO: 20153 - DNA, 15 bp, Artificial Sequence
  dgRNA
  Tgfbr1
gctcattggtagccc

SEQ ID NO: 20154 - DNA, 15 bp, Artificial Sequence
  dgRNA
  Tgfbr1
tagcccagggccccg

SEQ ID NO: 20155 - DNA, 15 bp, Artificial Sequence
  dgRNA
  Pglyrp4
tctgtactaggatgt

SEQ ID NO: 20156 - DNA, 15 bp, Artificial Sequence
  dgRNA
  Pglyrp4
ctgtactaggatgtt

SEQ ID NO: 20157 - DNA, 15 bp, Artificial Sequence
  dgRNA
  Pglyrp4
gtgccgggccttaga

SEQ ID NO: 20158 - DNA, 15 bp, Artificial Sequence
  dgRNA
  Pglyrp4
gggttacacacagtc

SEQ ID NO: 20159 - DNA, 15 bp, Artificial Sequence
  dgRNA
  H2-M10.1
tgtagaactggtgca

SEQ ID NO: 20160 - DNA, 15 bp, Artificial Sequence
  dgRNA
  H2-M10.1
gaactggtgcaaggt

SEQ ID NO: 20161 - DNA, 15 bp, Artificial Sequence
  dgRNA
  H2-M10.1
aactggtgcaaggtg

SEQ ID NO: 20162 - DNA, 15 bp, Artificial Sequence
  dgRNA
  H2-M10.1
ctacgtcactacctt

SEQ ID NO: 20163 - DNA, 15 bp, Artificial Sequence
  dgRNA
  Asgr1
gtcaggttagggctg

SEQ ID NO: 20164 - DNA, 15 bp, Artificial Sequence
  dgRNA
  Asgr1
gcaattataacactg

SEQ ID NO: 20165 - DNA, 15 bp, Artificial Sequence
  dgRNA
  Asgr1
ggattgggcaagagc

SEQ ID NO: 20166 - DNA, 15 bp, Artificial Sequence
  dgRNA
  Asgr1
gattgggcaagagcg

SEQ ID NO: 20167 - DNA, 15 bp, Artificial Sequence
  dgRNA
  Hrasls
tgtcccataaggaat

SEQ ID NO: 20168 - DNA, 15 bp, Artificial Sequence
  dgRNA
  Hrasls
aatcggtgtccagcg

SEQ ID NO: 20169 - DNA, 15 bp, Artificial Sequence
  dgRNA
  Hrasls
atccctaaacatttc

SEQ ID NO: 20170 - DNA, 15 bp, Artificial Sequence
  dgRNA
  Hrasls
acaccgattccttat

SEQ ID NO: 20171 - DNA, 15 bp, Artificial Sequence
  dgRNA
  Stra8
gtccacgctccccat

SEQ ID NO: 20172 - DNA, 15 bp, Artificial Sequence
  dgRNA
  Stra8
accatgcatccccat

SEQ ID NO: 20173 - DNA, 15 bp, Artificial Sequence
  dgRNA
  Stra8
catccccattggtca

SEQ ID NO: 20174 - DNA, 15 bp, Artificial Sequence
  dgRNA
  Stra8
ccccattggtcatgg

SEQ ID NO: 20175 - DNA, 15 bp, Artificial Sequence
  dgRNA
  Olfr815
gaaagggctatgcta

SEQ ID NO: 20176 - DNA, 15 bp, Artificial Sequence
  dgRNA
  Gng12
ggtggtggcctcgcg

SEQ ID NO: 20177 - DNA, 15 bp, Artificial Sequence
  dgRNA
  Gng12
cctcgcgtggttgcc

SEQ ID NO: 20178 - DNA, 15 bp, Artificial Sequence
  dgRNA
  Gng12
ctcgcgtggttgccc

SEQ ID NO: 20179 - DNA, 15 bp, Artificial Sequence
  dgRNA
  Gng12
gcaccaacccagccg

SEQ ID NO: 20180 - DNA, 15 bp, Artificial Sequence
  dgRNA
  Tmc5
gatatgtatatctca

SEQ ID NO: 20181 - DNA, 15 bp, Artificial Sequence
  dgRNA
  Tmc5
tgatatgtatatctc

SEQ ID NO: 20182 - DNA, 15 bp, Artificial Sequence
  dgRNA
  Tmc5
atgacctgtaaccac

SEQ ID NO: 20183 - DNA, 15 bp, Artificial Sequence
  dgRNA
  Sertad4
aatagacaagacgtc

SEQ ID NO: 20184 - DNA, 15 bp, Artificial Sequence
  dgRNA
  Sertad4
atagacaagacgtct

SEQ ID NO: 20185 - DNA, 15 bp, Artificial Sequence
  dgRNA
  Sertad4
acaagacgtctgggc

SEQ ID NO: 20186 - DNA, 15 bp, Artificial Sequence
  dgRNA
  Sertad4
cgggctgcgcgcgtg

SEQ ID NO: 20187 - DNA, 15 bp, Artificial Sequence
  dgRNA
  Magt1
gatgtctttacacgt

SEQ ID NO: 20188 - DNA, 15 bp, Artificial Sequence
  dgRNA
  Magt1
tttacacgtaggaaa

SEQ ID NO: 20189 - DNA, 15 bp, Artificial Sequence
  dgRNA
  Magt1
ttacacgtaggaaaa

SEQ ID NO: 20190 - DNA, 15 bp, Artificial Sequence
  dgRNA
  Magt1
ttatccttttccgat

SEQ ID NO: 20191 - DNA, 15 bp, Artificial Sequence
  dgRNA
  Cndp2
atctaagcctccgat

SEQ ID NO: 20192 - DNA, 15 bp, Artificial Sequence
  dgRNA
  Cndp2
ttaggagccaatcgg

SEQ ID NO: 20193 - DNA, 15 bp, Artificial Sequence
  dgRNA
  Ifih1
acccgccgcttccac

SEQ ID NO: 20194 - DNA, 15 bp, Artificial Sequence
  dgRNA
  Ifih1
acgaaacttattctc

SEQ ID NO: 20195 - DNA, 15 bp, Artificial Sequence
  dgRNA
  Ifih1
ccggaagttgacgtt

SEQ ID NO: 20196 - DNA, 15 bp, Artificial Sequence
  dgRNA
  Ifih1
gacgttaggaaagtc

SEQ ID NO: 20197 - DNA, 15 bp, Artificial Sequence
  dgRNA
  Coa5
ctcgaggcctcgtcc

SEQ ID NO: 20198 - DNA, 15 bp, Artificial Sequence
  dgRNA
  Coa5
tcgaggcctcgtcct

SEQ ID NO: 20199 - DNA, 15 bp, Artificial Sequence
  dgRNA
  Coa5
cctcgtcctgggccc

SEQ ID NO: 20200 - DNA, 15 bp, Artificial Sequence
  dgRNA
  Coa5
taccgccaccttccc

SEQ ID NO: 20201 - DNA, 15 bp, Artificial Sequence
  dgRNA
  Gm7361
agcaaactccggctt

SEQ ID NO: 20202 - DNA, 15 bp, Artificial Sequence
  dgRNA
  Gm7361
aactccggctttgga

SEQ ID NO: 20203 - DNA, 15 bp, Artificial Sequence
  dgRNA
  Gm7361
gccggagtttgctct

SEQ ID NO: 20204 - DNA, 15 bp, Artificial Sequence
  dgRNA
  Tbkbp1
ctcatgacgtctatc

SEQ ID NO: 20205 - DNA, 15 bp, Artificial Sequence
  dgRNA
  Tbkbp1
cgtcatgagtggagt

SEQ ID NO: 20206 - DNA, 15 bp, Artificial Sequence
  dgRNA
  Tbkbp1
acgtcatgagtggag

SEQ ID NO: 20207 - DNA, 15 bp, Artificial Sequence
  dgRNA
  Tbkbp1
gatagacgtcatgag

SEQ ID NO: 20208 - DNA, 15 bp, Artificial Sequence
  dgRNA
  Myof
ccaccgccgtttcat

SEQ ID NO: 20209 - DNA, 15 bp, Artificial Sequence
  dgRNA
  Myof
aacttcttttcgtcg

SEQ ID NO: 20210 - DNA, 15 bp, Artificial Sequence
  dgRNA
  Myof
gaggtgtcctttttc

SEQ ID NO: 20211 - DNA, 15 bp, Artificial Sequence
  dgRNA
  Myof
ttttaccgagtctcg

SEQ ID NO: 20212 - DNA, 15 bp, Artificial Sequence
  dgRNA
  Txnl1
agcacagcggcgcca

SEQ ID NO: 20213 - DNA, 15 bp, Artificial Sequence
  dgRNA
  Txnl1
gcgcctgcgcccttc

SEQ ID NO: 20214 - DNA, 15 bp, Artificial Sequence
  dgRNA
  Txnl1
ggcagtgagcgcctc

SEQ ID NO: 20215 - DNA, 15 bp, Artificial Sequence
  dgRNA
  Txnl1
agtgagcgcctcagg

SEQ ID NO: 20216 - DNA, 15 bp, Artificial Sequence
  dgRNA
  Rimbp2
atccttagcattgcc

SEQ ID NO: 20217 - DNA, 15 bp, Artificial Sequence
  dgRNA
  Rimbp2
cttagcattgcctgg

SEQ ID NO: 20218 - DNA, 15 bp, Artificial Sequence
  dgRNA
  Rimbp2
tctggaccacctgcg

SEQ ID NO: 20219 - DNA, 15 bp, Artificial Sequence
  dgRNA
  Rimbp2
ctggaccacctgcgg

SEQ ID NO: 20220 - DNA, 15 bp, Artificial Sequence
  dgRNA
  Gm996
agccggaccagcacg

SEQ ID NO: 20221 - DNA, 15 bp, Artificial Sequence
  dgRNA
  Gm996
gccggaccagcacgt

SEQ ID NO: 20222 - DNA, 15 bp, Artificial Sequence
  dgRNA
  Gm996
ccggaccagcacgtg

SEQ ID NO: 20223 - DNA, 15 bp, Artificial Sequence
  dgRNA
  Gm996
gaccagcacgtgggg

SEQ ID NO: 20224 - DNA, 15 bp, Artificial Sequence
  dgRNA
  Tspan9
caccccgccccttac

SEQ ID NO: 20225 - DNA, 15 bp, Artificial Sequence
  dgRNA
  Tspan9
ccccgccgcccggtg

SEQ ID NO: 20226 - DNA, 15 bp, Artificial Sequence
  dgRNA
  Tspan9
accccctccgcctgc

SEQ ID NO: 20227 - DNA, 15 bp, Artificial Sequence
  dgRNA
  Tspan9
gccccccgtttccgc

SEQ ID NO: 20228 - DNA, 15 bp, Artificial Sequence
  dgRNA
  Smc1b
gcaagtctgtcccgg

SEQ ID NO: 20229 - DNA, 15 bp, Artificial Sequence
  dgRNA
  Smc1b
gtccgctttccgcag

SEQ ID NO: 20230 - DNA, 15 bp, Artificial Sequence
  dgRNA
  Smc1b
ttccgcagcggagca

SEQ ID NO: 20231 - DNA, 15 bp, Artificial Sequence
  dgRNA
  Smc1b
gggatccaattcccc

SEQ ID NO: 20232 - DNA, 15 bp, Artificial Sequence
  dgRNA
  Tnpo1
gaatcagatttcgac

SEQ ID NO: 20233 - DNA, 15 bp, Artificial Sequence
  dgRNA
  Tnpo1
aatcagatttcgacc

SEQ ID NO: 20234 - DNA, 15 bp, Artificial Sequence
  dgRNA
  Tnpo1
atcagatttcgaccg

SEQ ID NO: 20235 - DNA, 15 bp, Artificial Sequence
  dgRNA
  Tnpo1
cgaccggggctttgc

SEQ ID NO: 20236 - DNA, 15 bp, Artificial Sequence
  dgRNA
  Fuz
aacaacttgaacgct

SEQ ID NO: 20237 - DNA, 15 bp, Artificial Sequence
  dgRNA
  Fuz
ggtcatgatgacttc

SEQ ID NO: 20238 - DNA, 15 bp, Artificial Sequence
  dgRNA
  Fuz
atgatgacttccggc

SEQ ID NO: 20239 - DNA, 15 bp, Artificial Sequence
  dgRNA
  Fuz
tgatgacttccggcc

SEQ ID NO: 20240 - DNA, 15 bp, Artificial Sequence
  dgRNA
  Specc1l
ttgggcaacttttgt

SEQ ID NO: 20241 - DNA, 15 bp, Artificial Sequence
  dgRNA
  Specc1l
ctgcagtgaaatcgc

SEQ ID NO: 20242 - DNA, 15 bp, Artificial Sequence
  dgRNA
  Specc1l
atcagtaatacccac

SEQ ID NO: 20243 - DNA, 15 bp, Artificial Sequence
  dgRNA
  Mpv17l
tacttccgcctcccg

SEQ ID NO: 20244 - DNA, 15 bp, Artificial Sequence
  dgRNA
  Mpv17l
cagcggtttccacgc

SEQ ID NO: 20245 - DNA, 15 bp, Artificial Sequence
  dgRNA
  Mpv17l
cccgcccgcagccgg

SEQ ID NO: 20246 - DNA, 15 bp, Artificial Sequence
  dgRNA
  Mpv17l
ccgcccgcagccggc

SEQ ID NO: 20247 - DNA, 15 bp, Artificial Sequence
  dgRNA
  Gdf5
aaaactggagcgcac

SEQ ID NO: 20248 - DNA, 15 bp, Artificial Sequence
  dgRNA
  Gdf5
cttgtataaggctga

SEQ ID NO: 20249 - DNA, 15 bp, Artificial Sequence
  dgRNA
  Ltk
cgcagcatttcacct

SEQ ID NO: 20250 - DNA, 15 bp, Artificial Sequence
  dgRNA
  Ltk
accttggtgccaccc

SEQ ID NO: 20251 - DNA, 15 bp, Artificial Sequence
  dgRNA
  Ltk
gccaactcgtctgtc

SEQ ID NO: 20252 - DNA, 15 bp, Artificial Sequence
  dgRNA
  Ltk
ccaactcgtctgtct

SEQ ID NO: 20253 - DNA, 15 bp, Artificial Sequence
  dgRNA
  Cystm1
gacaccgccctcgct

SEQ ID NO: 20254 - DNA, 15 bp, Artificial Sequence
  dgRNA
  Cystm1
cctcgcgcgttgcca

SEQ ID NO: 20255 - DNA, 15 bp, Artificial Sequence
  dgRNA
  Cystm1
ccgggcttccagcgc

SEQ ID NO: 20256 - DNA, 15 bp, Artificial Sequence
  dgRNA
  Cystm1
ggcttccagcgcagg

SEQ ID NO: 20257 - DNA, 15 bp, Artificial Sequence
  dgRNA
  Pcsk7
gggggcggccaagcc

SEQ ID NO: 20258 - DNA, 15 bp, Artificial Sequence
  dgRNA
  Pcsk7
ggggcggccaagcct

SEQ ID NO: 20259 - DNA, 15 bp, Artificial Sequence
  dgRNA
  Pcsk7
gggcggccaagcctg

SEQ ID NO: 20260 - DNA, 15 bp, Artificial Sequence
  dgRNA
  Pcsk7
ggcggccaagcctgg

SEQ ID NO: 20261 - DNA, 15 bp, Artificial Sequence
  dgRNA
  Psmd11
ggtggggattaattt

SEQ ID NO: 20262 - DNA, 15 bp, Artificial Sequence
  dgRNA
  Psmd11
cagatggccgcgaga

SEQ ID NO: 20263 - DNA, 15 bp, Artificial Sequence
  dgRNA
  Psmd11
gccgcgagatggcga

SEQ ID NO: 20264 - DNA, 15 bp, Artificial Sequence
  dgRNA
  Psmd11
ccgcgagatggcgat

SEQ ID NO: 20265 - DNA, 15 bp, Artificial Sequence
  dgRNA
  Adam9
ctagtctccgctgag

SEQ ID NO: 20266 - DNA, 15 bp, Artificial Sequence
  dgRNA
  Adam9
tagtctccgctgagc

SEQ ID NO: 20267 - DNA, 15 bp, Artificial Sequence
  dgRNA
  Adam9
cgctgagcgggcgga

SEQ ID NO: 20268 - DNA, 15 bp, Artificial Sequence
  dgRNA
  Adam9
gctgagcgggcggag

SEQ ID NO: 20269 - DNA, 15 bp, Artificial Sequence
  dgRNA
  Spsb2
gcgcttgtccacgtc

SEQ ID NO: 20270 - DNA, 15 bp, Artificial Sequence
  dgRNA
  Spsb2
attctttgtagccgg

SEQ ID NO: 20271 - DNA, 15 bp, Artificial Sequence
  dgRNA
  Spsb2
ttctttgtagccggt

SEQ ID NO: 20272 - DNA, 15 bp, Artificial Sequence
  dgRNA
  Spsb2
gccggtgggttctca

SEQ ID NO: 20273 - DNA, 15 bp, Artificial Sequence
  dgRNA
  Wdr17
acgggttattctaag

SEQ ID NO: 20274 - DNA, 15 bp, Artificial Sequence
  dgRNA
  Wdr17
aagaacatcacggat

SEQ ID NO: 20275 - DNA, 15 bp, Artificial Sequence
  dgRNA
  Wdr17
ggatcagcaaaactc

SEQ ID NO: 20276 - DNA, 15 bp, Artificial Sequence
  dgRNA
  Wdr17
cgtgtaaatttcaat

SEQ ID NO: 20277 - DNA, 15 bp, Artificial Sequence
  dgRNA
  P2rx3
ggtggtccaccgccc

SEQ ID NO: 20278 - DNA, 15 bp, Artificial Sequence
  dgRNA
  P2rx3
ttctgttctcttacg

SEQ ID NO: 20279 - DNA, 15 bp, Artificial Sequence
  dgRNA
  P2rx3
tggctagggccctct

SEQ ID NO: 20280 - DNA, 15 bp, Artificial Sequence
  dgRNA
  P2rx3
ctggctagggccctc

SEQ ID NO: 20281 - DNA, 15 bp, Artificial Sequence
  dgRNA
  4931406C07Rik
aagaaccccgccctg

SEQ ID NO: 20282 - DNA, 15 bp, Artificial Sequence
  dgRNA
  4931406C07Rik
cgaaaagagcgctcc

SEQ ID NO: 20283 - DNA, 15 bp, Artificial Sequence
  dgRNA
  4931406C07Rik
cccagcagccggact

SEQ ID NO: 20284 - DNA, 15 bp, Artificial Sequence
  dgRNA
  4931406C07Rik
agccggactaggaca

SEQ ID NO: 20285 - DNA, 15 bp, Artificial Sequence
  dgRNA
  Kcnc4
aaccccccctcgtcc

SEQ ID NO: 20286 - DNA, 15 bp, Artificial Sequence
  dgRNA
  Kcnc4
cccctcgtcccggcg

SEQ ID NO: 20287 - DNA, 15 bp, Artificial Sequence
  dgRNA
  Kcnc4
gcgctgcatccagcc

SEQ ID NO: 20288 - DNA, 15 bp, Artificial Sequence
  dgRNA
  Kcnc4
gcccggcgcagctcc

SEQ ID NO: 20289 - DNA, 15 bp, Artificial Sequence
  dgRNA
  Ppp1r1c
gcactttcgagcagc

SEQ ID NO: 20290 - DNA, 15 bp, Artificial Sequence
  dgRNA
  Ppp1r1c
gtgtattagcaagca

SEQ ID NO: 20291 - DNA, 15 bp, Artificial Sequence
  dgRNA
  Ppp1r1c
ctgtacattactaac

SEQ ID NO: 20292 - DNA, 15 bp, Artificial Sequence
  dgRNA
  Ppp1r1c
gccaagctttcactc

SEQ ID NO: 20293 - DNA, 15 bp, Artificial Sequence
  dgRNA
  Nkap
gcggtgttgcttata

SEQ ID NO: 20294 - DNA, 15 bp, Artificial Sequence
  dgRNA
  Nkap
tcgcaatgttctttc

SEQ ID NO: 20295 - DNA, 15 bp, Artificial Sequence
  dgRNA
  Nkap
catccagtgcggttt

SEQ ID NO: 20296 - DNA, 15 bp, Artificial Sequence
  dgRNA
  Nkap
ccggcttctatatag

SEQ ID NO: 20297 - DNA, 15 bp, Artificial Sequence
  dgRNA
  Rapgef1
taccgagctgtggcg

SEQ ID NO: 20298 - DNA, 15 bp, Artificial Sequence
  dgRNA
  Rapgef1
cgagctgtggcgcgg

SEQ ID NO: 20299 - DNA, 15 bp, Artificial Sequence
  dgRNA
  Rapgef1
cggaggactccaagc

SEQ ID NO: 20300 - DNA, 15 bp, Artificial Sequence
  dgRNA
  Rapgef1
actccaagccggtag

SEQ ID NO: 20301 - DNA, 15 bp, Artificial Sequence
  dgRNA
  Sox14
ccatcagggacgctc

SEQ ID NO: 20302 - DNA, 15 bp, Artificial Sequence
  dgRNA
  Sox14
catcagggacgctcc

SEQ ID NO: 20303 - DNA, 15 bp, Artificial Sequence
  dgRNA
  Sox14
ccactactcgcgagt

SEQ ID NO: 20304 - DNA, 15 bp, Artificial Sequence
  dgRNA
  Sox14
tactcgcgagttggc

SEQ ID NO: 20305 - DNA, 15 bp, Artificial Sequence
  dgRNA
  Lrtm1
tattacactccctgc

SEQ ID NO: 20306 - DNA, 15 bp, Artificial Sequence
  dgRNA
  Lrtm1
caagaccctaggtta

SEQ ID NO: 20307 - DNA, 15 bp, Artificial Sequence
  dgRNA
  Lrtm1
acagccggattaaga

SEQ ID NO: 20308 - DNA, 15 bp, Artificial Sequence
  dgRNA
  Lrtm1
cgaatccctaaccta

SEQ ID NO: 20309 - DNA, 15 bp, Artificial Sequence
  dgRNA
  Olfr1390
atttccagtccgaag

SEQ ID NO: 20310 - DNA, 15 bp, Artificial Sequence
  dgRNA
  Olfr1390
gaaaaagcttgattc

SEQ ID NO: 20311 - DNA, 15 bp, Artificial Sequence
  dgRNA
  Olfr1390
attggtgcacacgaa

SEQ ID NO: 20312 - DNA, 15 bp, Artificial Sequence
  dgRNA
  Olfr1390
cggactggaaatcat

SEQ ID NO: 20313 - DNA, 15 bp, Artificial Sequence
  dgRNA
  Dhrs9
cactgacgattcctt

SEQ ID NO: 20314 - DNA, 15 bp, Artificial Sequence
  dgRNA
  Dhrs9
cccgccctccatcca

SEQ ID NO: 20315 - DNA, 15 bp, Artificial Sequence
  dgRNA
  Dhrs9
gccctccatccacgg

SEQ ID NO: 20316 - DNA, 15 bp, Artificial Sequence
  dgRNA
  Dhrs9
gacttagtcaccact

SEQ ID NO: 20317 - DNA, 15 bp, Artificial Sequence
  dgRNA
  Cox4i1
acgctctcgcacctc

SEQ ID NO: 20318 - DNA, 15 bp, Artificial Sequence
  dgRNA
  Cox4i1
tcgcacctccggccg

SEQ ID NO: 20319 - DNA, 15 bp, Artificial Sequence
  dgRNA
  Cox4i1
cccgcctcagccggt

SEQ ID NO: 20320 - DNA, 15 bp, Artificial Sequence
  dgRNA
  Cox4i1
cctcagccggtcggc

SEQ ID NO: 20321 - DNA, 15 bp, Artificial Sequence
  dgRNA
  Snrpc
tactagtcatacgag

SEQ ID NO: 20322 - DNA, 15 bp, Artificial Sequence
  dgRNA
  Snrpc
aatgattcgcagcgt

SEQ ID NO: 20323 - DNA, 15 bp, Artificial Sequence
  dgRNA
  Amotl2
gatcttgggacgagt

SEQ ID NO: 20324 - DNA, 15 bp, Artificial Sequence
  dgRNA
  Amotl2
ggaatgaatgccgca

SEQ ID NO: 20325 - DNA, 15 bp, Artificial Sequence
  dgRNA
  Amotl2
gcagcgccgcctccc

SEQ ID NO: 20326 - DNA, 15 bp, Artificial Sequence
  dgRNA
  Amotl2
cgcctcccgggagga

SEQ ID NO: 20327 - DNA, 15 bp, Artificial Sequence
  dgRNA
  Fam166b
gagcggcacccactc

SEQ ID NO: 20328 - DNA, 15 bp, Artificial Sequence
  dgRNA
  Fam166b
agcggcacccactcc

SEQ ID NO: 20329 - DNA, 15 bp, Artificial Sequence
  dgRNA
  Fam166b
cactccgggaagacc

SEQ ID NO: 20330 - DNA, 15 bp, Artificial Sequence
  dgRNA
  Fam166b
tcattcgccaactct

SEQ ID NO: 20331 - DNA, 15 bp, Artificial Sequence
  dgRNA
  Fmnl3
aacaaacacagcgat

SEQ ID NO: 20332 - DNA, 15 bp, Artificial Sequence
  dgRNA
  Fmnl3
ggcgcgctcgcagcc

SEQ ID NO: 20333 - DNA, 15 bp, Artificial Sequence
  dgRNA
  Fmnl3
tcgcagccaggcgcg

SEQ ID NO: 20334 - DNA, 15 bp, Artificial Sequence
  dgRNA
  Fmnl3
gcgcgaggccgccga

SEQ ID NO: 20335 - DNA, 15 bp, Artificial Sequence
  dgRNA
  Gsc
gaaaaggaccaaatc

SEQ ID NO: 20336 - DNA, 15 bp, Artificial Sequence
  dgRNA
  Gsc
catctgcatattacc

SEQ ID NO: 20337 - DNA, 15 bp, Artificial Sequence
  dgRNA
  Gsc
agaggttgagccggt

SEQ ID NO: 20338 - DNA, 15 bp, Artificial Sequence
  dgRNA
  Gsc
gctgcgtcctacccg

SEQ ID NO: 20339 - DNA, 15 bp, Artificial Sequence
  dgRNA
  Clec3a
ggcctccttatgcca

SEQ ID NO: 20340 - DNA, 15 bp, Artificial Sequence
  dgRNA
  Clec3a
tccttatgccatggc

SEQ ID NO: 20341 - DNA, 15 bp, Artificial Sequence
  dgRNA
  Clec3a
ttatgccatggctgg

SEQ ID NO: 20342 - DNA, 15 bp, Artificial Sequence
  dgRNA
  Clec3a
cggccttccgtcagc

SEQ ID NO: 20343 - DNA, 15 bp, Artificial Sequence
  dgRNA
  Pqlc1
aaagaccgactggcg

SEQ ID NO: 20344 - DNA, 15 bp, Artificial Sequence
  dgRNA
  Pqlc1
ccgactggcgcggcg

SEQ ID NO: 20345 - DNA, 15 bp, Artificial Sequence
  dgRNA
  Pqlc1
ccacgccgcgccagt

SEQ ID NO: 20346 - DNA, 15 bp, Artificial Sequence
  dgRNA
  Sema3b
ggaggaatgtgcacg

SEQ ID NO: 20347 - DNA, 15 bp, Artificial Sequence
  dgRNA
  Sema3b
gaggaatgtgcacga

SEQ ID NO: 20348 - DNA, 15 bp, Artificial Sequence
  dgRNA
  Sema3b
aatgtgcacgaggga

SEQ ID NO: 20349 - DNA, 15 bp, Artificial Sequence
  dgRNA
  Sema3b
ggagggcgggaacgc

SEQ ID NO: 20350 - DNA, 15 bp, Artificial Sequence
  dgRNA
  Dtx4
gaagctctagatcgc

SEQ ID NO: 20351 - DNA, 15 bp, Artificial Sequence
  dgRNA
  Dtx4
gatcgctggtgctag

SEQ ID NO: 20352 - DNA, 15 bp, Artificial Sequence
  dgRNA
  Dtx4
ggaacggtgcagacg

SEQ ID NO: 20353 - DNA, 15 bp, Artificial Sequence
  dgRNA
  Dtx4
ataacggacagaaca

SEQ ID NO: 20354 - DNA, 15 bp, Artificial Sequence
  dgRNA
  Plg
cggagaggtgtaaca

SEQ ID NO: 20355 - DNA, 15 bp, Artificial Sequence
  dgRNA
  Plg
ggtgtaacagggtgt

SEQ ID NO: 20356 - DNA, 15 bp, Artificial Sequence
  dgRNA
  Plg
gtgtaacagggtgta

SEQ ID NO: 20357 - DNA, 15 bp, Artificial Sequence
  dgRNA
  Plg
gtgtaggggtccaat

SEQ ID NO: 20358 - DNA, 15 bp, Artificial Sequence
  dgRNA
  Dnaic1
cgggagctccttgcg

SEQ ID NO: 20359 - DNA, 15 bp, Artificial Sequence
  dgRNA
  Dnaic1
gagctccttgcgcgg

SEQ ID NO: 20360 - DNA, 15 bp, Artificial Sequence
  dgRNA
  Dnaic1
agctccttgcgcgga

SEQ ID NO: 20361 - DNA, 15 bp, Artificial Sequence
  dgRNA
  Dnaic1
tccttgcgcggaggg

SEQ ID NO: 20362 - DNA, 15 bp, Artificial Sequence
  dgRNA
  Elac2
ccggaaaacgtcaac

SEQ ID NO: 20363 - DNA, 15 bp, Artificial Sequence
  dgRNA
  Elac2
cggaaaacgtcaaca

SEQ ID NO: 20364 - DNA, 15 bp, Artificial Sequence
  dgRNA
  Elac2
agggaaagccggaac

SEQ ID NO: 20365 - DNA, 15 bp, Artificial Sequence
  dgRNA
  Elac2
aagccggaaccggtg

SEQ ID NO: 20366 - DNA, 15 bp, Artificial Sequence
  dgRNA
  Casz1
gccttggcggtgggt

SEQ ID NO: 20367 - DNA, 15 bp, Artificial Sequence
  dgRNA
  Casz1
ctagaggggaaggtc

SEQ ID NO: 20368 - DNA, 15 bp, Artificial Sequence
  dgRNA
  Casz1
cccagccccgcgatc

SEQ ID NO: 20369 - DNA, 15 bp, Artificial Sequence
  dgRNA
  Casz1
ccccgcgatccggcc

SEQ ID NO: 20370 - DNA, 15 bp, Artificial Sequence
  dgRNA
  Clasp2
attgtaagtgcatag

SEQ ID NO: 20371 - DNA, 15 bp, Artificial Sequence
  dgRNA
  Clasp2
gattttttagatgca

SEQ ID NO: 20372 - DNA, 15 bp, Artificial Sequence
  dgRNA
  Clasp2
tacctttcatgaggc

SEQ ID NO: 20373 - DNA, 15 bp, Artificial Sequence
  dgRNA
  Clasp2
gctgttgcagcacct

SEQ ID NO: 20374 - DNA, 15 bp, Artificial Sequence
  dgRNA
  Smc6
ctagcactaagctcc

SEQ ID NO: 20375 - DNA, 15 bp, Artificial Sequence
  dgRNA
  Smc6
tagtcccgccccttc

SEQ ID NO: 20376 - DNA, 15 bp, Artificial Sequence
  dgRNA
  Smc6
tcgccctgccctcgc

SEQ ID NO: 20377 - DNA, 15 bp, Artificial Sequence
  dgRNA
  Smc6
ggaattcgggaactt

SEQ ID NO: 20378 - DNA, 15 bp, Artificial Sequence
  dgRNA
  Smad5
ccgcccgtcactctc

SEQ ID NO: 20379 - DNA, 15 bp, Artificial Sequence
  dgRNA
  Smad5
ctccggacgtcgcag

SEQ ID NO: 20380 - DNA, 15 bp, Artificial Sequence
  dgRNA
  Smad5
tctctgccccggtcc

SEQ ID NO: 20381 - DNA, 15 bp, Artificial Sequence
  dgRNA
  Smad5
ctgccccggtcccgg

SEQ ID NO: 20382 - DNA, 15 bp, Artificial Sequence
  dgRNA
  Rnd1
aagagggcgctgact

SEQ ID NO: 20383 - DNA, 15 bp, Artificial Sequence
  dgRNA
  Rnd1
ggagtctcctactat

SEQ ID NO: 20384 - DNA, 15 bp, Artificial Sequence
  dgRNA
  Rnd1
actattggctgcagc

SEQ ID NO: 20385 - DNA, 15 bp, Artificial Sequence
  dgRNA
  Rnd1
aggggatcccacctt

SEQ ID NO: 20386 - DNA, 15 bp, Artificial Sequence
  dgRNA
  Baz1b
tgcaactcaacttcg

SEQ ID NO: 20387 - DNA, 15 bp, Artificial Sequence
  dgRNA
  Baz1b
actcaacttcgcggc

SEQ ID NO: 20388 - DNA, 15 bp, Artificial Sequence
  dgRNA
  Baz1b
tcgcggctggagccc

SEQ ID NO: 20389 - DNA, 15 bp, Artificial Sequence
  dgRNA
  Baz1b
cgcggctggagccca

SEQ ID NO: 20390 - DNA, 15 bp, Artificial Sequence
  dgRNA
  Taar7a
gtttatctaggatga

SEQ ID NO: 20391 - DNA, 15 bp, Artificial Sequence
  dgRNA
  Taar7a
ctagattcctaagca

SEQ ID NO: 20392 - DNA, 15 bp, Artificial Sequence
  dgRNA
  Gltpd2
acaagctagccccac

SEQ ID NO: 20393 - DNA, 15 bp, Artificial Sequence
  dgRNA
  Gltpd2
ctggacaccacggga

SEQ ID NO: 20394 - DNA, 15 bp, Artificial Sequence
  dgRNA
  Gltpd2
tggacaccacgggaa

SEQ ID NO: 20395 - DNA, 15 bp, Artificial Sequence
  dgRNA
  Gltpd2
gaggcagcgtcttgt

SEQ ID NO: 20396 - DNA, 15 bp, Artificial Sequence
  dgRNA
  Rab11fip4
gctcaggtctaggag

SEQ ID NO: 20397 - DNA, 15 bp, Artificial Sequence
  dgRNA
  Rab11fip4
ccccacgcgggcccg

SEQ ID NO: 20398 - DNA, 15 bp, Artificial Sequence
  dgRNA
  Rab11fip4
cgcggcagacacgag

SEQ ID NO: 20399 - DNA, 15 bp, Artificial Sequence
  dgRNA
  Rab11fip4
agcggctgacacgag

SEQ ID NO: 20400 - DNA, 15 bp, Artificial Sequence
  dgRNA
  Dnmbp
gtgtaactctagaac

SEQ ID NO: 20401 - DNA, 15 bp, Artificial Sequence
  dgRNA
  Dnmbp
agagagcggcgctgc

SEQ ID NO: 20402 - DNA, 15 bp, Artificial Sequence
  dgRNA
  Adck3
ttaacagtcaagaac

SEQ ID NO: 20403 - DNA, 15 bp, Artificial Sequence
  dgRNA
  Adck3
aaggaggtagtggcg

SEQ ID NO: 20404 - DNA, 15 bp, Artificial Sequence
  dgRNA
  Adck3
tagttggttgtatga

SEQ ID NO: 20405 - DNA, 15 bp, Artificial Sequence
  dgRNA
  Adck3
agttggttgtatgat

SEQ ID NO: 20406 - DNA, 15 bp, Artificial Sequence
  dgRNA
  Rela
gtcactggcctccgc

SEQ ID NO: 20407 - DNA, 15 bp, Artificial Sequence
  dgRNA
  Rela
ctccgcgggagcagc

SEQ ID NO: 20408 - DNA, 15 bp, Artificial Sequence
  dgRNA
  Rela
gcctctccctgcgca

SEQ ID NO: 20409 - DNA, 15 bp, Artificial Sequence
  dgRNA
  Rela
cctgcgcagggcgaa

SEQ ID NO: 20410 - DNA, 15 bp, Artificial Sequence
  dgRNA
  Fkbpl
gatctttgtcaacct

SEQ ID NO: 20411 - DNA, 15 bp, Artificial Sequence
  dgRNA
  Fkbpl
aacctcggttcgatt

SEQ ID NO: 20412 - DNA, 15 bp, Artificial Sequence
  dgRNA
  Fkbpl
tgcttaggtctagtc

SEQ ID NO: 20413 - DNA, 15 bp, Artificial Sequence
  dgRNA
  Fkbpl
ctagtccggttgcta

SEQ ID NO: 20414 - DNA, 15 bp, Artificial Sequence
  dgRNA
  1700037H04Rik
ccaagctcgtgccgc

SEQ ID NO: 20415 - DNA, 15 bp, Artificial Sequence
  dgRNA
  1700037H04Rik
caagctcgtgccgct

SEQ ID NO: 20416 - DNA, 15 bp, Artificial Sequence
  dgRNA
  1700037H04Rik
aagctcgtgccgctg

SEQ ID NO: 20417 - DNA, 15 bp, Artificial Sequence
  dgRNA
  1700037H04Rik
ggtgacgtcgactcg

SEQ ID NO: 20418 - DNA, 15 bp, Artificial Sequence
  dgRNA
  Gja6
tcccccagaccagtc

SEQ ID NO: 20419 - DNA, 15 bp, Artificial Sequence
  dgRNA
  Gja6
atagatgcaatgttg

SEQ ID NO: 20420 - DNA, 15 bp, Artificial Sequence
  dgRNA
  Gja6
cttccttgctaggcg

SEQ ID NO: 20421 - DNA, 15 bp, Artificial Sequence
  dgRNA
  Gja6
tcccctttgtaggag

SEQ ID NO: 20422 - DNA, 15 bp, Artificial Sequence
  dgRNA
  Gpx4
aaagcggagcctgat

SEQ ID NO: 20423 - DNA, 15 bp, Artificial Sequence
  dgRNA
  Gpx4
cctgataggcatctc

SEQ ID NO: 20424 - DNA, 15 bp, Artificial Sequence
  dgRNA
  Gpx4
ctgataggcatctcc

SEQ ID NO: 20425 - DNA, 15 bp, Artificial Sequence
  dgRNA
  Gpx4
tgataggcatctccg

SEQ ID NO: 20426 - DNA, 15 bp, Artificial Sequence
  dgRNA
  Samd4
ctatggcccgggctt

SEQ ID NO: 20427 - DNA, 15 bp, Artificial Sequence
  dgRNA
  Samd4
caacccgccgcccgc

SEQ ID NO: 20428 - DNA, 15 bp, Artificial Sequence
  dgRNA
  Samd4
tcctctccccccgct

SEQ ID NO: 20429 - DNA, 15 bp, Artificial Sequence
  dgRNA
  Samd4
aagcccatgatgtaa

SEQ ID NO: 20430 - DNA, 15 bp, Artificial Sequence
  dgRNA
  Als2
gatctcgcgtacccg

SEQ ID NO: 20431 - DNA, 15 bp, Artificial Sequence
  dgRNA
  Als2
tacccgcggtgcagt

SEQ ID NO: 20432 - DNA, 15 bp, Artificial Sequence
  dgRNA
  Als2
acccgcggtgcagtc

SEQ ID NO: 20433 - DNA, 15 bp, Artificial Sequence
  dgRNA
  Als2
cagtcgggctcgcgc

SEQ ID NO: 20434 - DNA, 15 bp, Artificial Sequence
  dgRNA
  Spag16
atgagtccctggttc

SEQ ID NO: 20435 - DNA, 15 bp, Artificial Sequence
  dgRNA
  Spag16
gcgtctggggtaact

SEQ ID NO: 20436 - DNA, 15 bp, Artificial Sequence
  dgRNA
  Spag16
actgcggacgcgcag

SEQ ID NO: 20437 - DNA, 15 bp, Artificial Sequence
  dgRNA
  Spag16
ctgcggacgcgcaga

SEQ ID NO: 20438 - DNA, 15 bp, Artificial Sequence
  dgRNA
  Asic3
tcatccagtcctatc

SEQ ID NO: 20439 - DNA, 15 bp, Artificial Sequence
  dgRNA
  Asic3
ggatgagttgaactt

SEQ ID NO: 20440 - DNA, 15 bp, Artificial Sequence
  dgRNA
  Asic3
gacaggtgaaagtac

SEQ ID NO: 20441 - DNA, 15 bp, Artificial Sequence
  dgRNA
  Asic3
tagcaggatagtggt

SEQ ID NO: 20442 - DNA, 15 bp, Artificial Sequence
  dgRNA
  Sec61a2
ggaaaacccttgtcc

SEQ ID NO: 20443 - DNA, 15 bp, Artificial Sequence
  dgRNA
  Sec61a2
aagaaccgcccacca

SEQ ID NO: 20444 - DNA, 15 bp, Artificial Sequence
  dgRNA
  Sec61a2
accgcccaccacggc

SEQ ID NO: 20445 - DNA, 15 bp, Artificial Sequence
  dgRNA
  Sec61a2
ccgccgccgcgccaa

SEQ ID NO: 20446 - DNA, 15 bp, Artificial Sequence
  dgRNA
  Cd164
tccttgccagggcgg

SEQ ID NO: 20447 - DNA, 15 bp, Artificial Sequence
  dgRNA
  Cd164
ccttgccagggcggg

SEQ ID NO: 20448 - DNA, 15 bp, Artificial Sequence
  dgRNA
  Cd164
gggggagatcatccg

SEQ ID NO: 20449 - DNA, 15 bp, Artificial Sequence
  dgRNA
  Cd164
cgtggtgcagatgtg

SEQ ID NO: 20450 - DNA, 15 bp, Artificial Sequence
  dgRNA
  Pdcd2
agagcttccggcctt

SEQ ID NO: 20451 - DNA, 15 bp, Artificial Sequence
  dgRNA
  Pdcd2
acagtgacagttcga

SEQ ID NO: 20452 - DNA, 15 bp, Artificial Sequence
  dgRNA
  Pdcd2
gtgacagttcgatgg

SEQ ID NO: 20453 - DNA, 15 bp, Artificial Sequence
  dgRNA
  Pdcd2
gggttacctccagtc

SEQ ID NO: 20454 - DNA, 15 bp, Artificial Sequence
  dgRNA
  Cel
ggcagtaacccacac

SEQ ID NO: 20455 - DNA, 15 bp, Artificial Sequence
  dgRNA
  Cel
ccactccggatgctc

SEQ ID NO: 20456 - DNA, 15 bp, Artificial Sequence
  dgRNA
  Cel
cactccggatgctca

SEQ ID NO: 20457 - DNA, 15 bp, Artificial Sequence
  dgRNA
  Cel
cagctccataaatac

SEQ ID NO: 20458 - DNA, 15 bp, Artificial Sequence
  dgRNA
  Hras
cttccccgcggctcc

SEQ ID NO: 20459 - DNA, 15 bp, Artificial Sequence
  dgRNA
  Hras
agccccgcccagctt

SEQ ID NO: 20460 - DNA, 15 bp, Artificial Sequence
  dgRNA
  Hras
agcttcggcttctga

SEQ ID NO: 20461 - DNA, 15 bp, Artificial Sequence
  dgRNA
  Hras
tcggcttctgacgga

SEQ ID NO: 20462 - DNA, 15 bp, Artificial Sequence
  dgRNA
  Mgat1
ctcccgcgttgatga

SEQ ID NO: 20463 - DNA, 15 bp, Artificial Sequence
  dgRNA
  Mgat1
cgcgttgatgatgga

SEQ ID NO: 20464 - DNA, 15 bp, Artificial Sequence
  dgRNA
  Mgat1
gcgttgatgatggag

SEQ ID NO: 20465 - DNA, 15 bp, Artificial Sequence
  dgRNA
  Mgat1
cgttgatgatggagg

SEQ ID NO: 20466 - DNA, 15 bp, Artificial Sequence
  dgRNA
  Diras1
cacccgcgttcccta

SEQ ID NO: 20467 - DNA, 15 bp, Artificial Sequence
  dgRNA
  Diras1
cgttccctaaggtac

SEQ ID NO: 20468 - DNA, 15 bp, Artificial Sequence
  dgRNA
  Diras1
gtacaggtagccacg

SEQ ID NO: 20469 - DNA, 15 bp, Artificial Sequence
  dgRNA
  Diras1
gccacgtggtatgcg

SEQ ID NO: 20470 - DNA, 15 bp, Artificial Sequence
  dgRNA
  Pvrl1
agcggaggaggcgaa

SEQ ID NO: 20471 - DNA, 15 bp, Artificial Sequence
  dgRNA
  Pvrl1
tcgtgcaacttactg

SEQ ID NO: 20472 - DNA, 15 bp, Artificial Sequence
  dgRNA
  Pvrl1
cgtgcaacttactgc

SEQ ID NO: 20473 - DNA, 15 bp, Artificial Sequence
  dgRNA
  Pvrl1
tgcgggcatctgccg

SEQ ID NO: 20474 - DNA, 15 bp, Artificial Sequence
  dgRNA
  Zfp69
ggctgccggcttcgc

SEQ ID NO: 20475 - DNA, 15 bp, Artificial Sequence
  dgRNA
  Zfp69
gctggacaccgcccc

SEQ ID NO: 20476 - DNA, 15 bp, Artificial Sequence
  dgRNA
  Zfp69
ctggacaccgcccct

SEQ ID NO: 20477 - DNA, 15 bp, Artificial Sequence
  dgRNA
  Zfp69
ctgggtctgcccggg

SEQ ID NO: 20478 - DNA, 15 bp, Artificial Sequence
  dgRNA
  Esp38
ggataataaaactac

SEQ ID NO: 20479 - DNA, 15 bp, Artificial Sequence
  dgRNA
  Camkk2
cgcccctgcgcgagt

SEQ ID NO: 20480 - DNA, 15 bp, Artificial Sequence
  dgRNA
  Camkk2
gcccctgcgcgagtc

SEQ ID NO: 20481 - DNA, 15 bp, Artificial Sequence
  dgRNA
  Camkk2
ctacttaagtctccg

SEQ ID NO: 20482 - DNA, 15 bp, Artificial Sequence
  dgRNA
  Camkk2
tacttaagtctccgc

SEQ ID NO: 20483 - DNA, 15 bp, Artificial Sequence
  dgRNA
  4833439L19Rik
tagagttcaacctac

SEQ ID NO: 20484 - DNA, 15 bp, Artificial Sequence
  dgRNA
  4833439L19Rik
gttcaacctacaggg

SEQ ID NO: 20485 - DNA, 15 bp, Artificial Sequence
  dgRNA
  4833439L19Rik
tacagggaggtgttc

SEQ ID NO: 20486 - DNA, 15 bp, Artificial Sequence
  dgRNA
  4833439L19Rik
gaggtgttccggtgg

SEQ ID NO: 20487 - DNA, 15 bp, Artificial Sequence
  dgRNA
  mt-Cytb
taaacctccataaat

SEQ ID NO: 20488 - DNA, 15 bp, Artificial Sequence
  dgRNA
  mt-Cytb
tccataaataggtga

SEQ ID NO: 20489 - DNA, 15 bp, Artificial Sequence
  dgRNA
  mt-Cytb
ttcacctatttatgg

SEQ ID NO: 20490 - DNA, 15 bp, Artificial Sequence
  dgRNA
  mt-Cytb
gccttcacctattta

SEQ ID NO: 20491 - DNA, 15 bp, Artificial Sequence
  dgRNA
  Taf9
cctgctcaccggtta

SEQ ID NO: 20492 - DNA, 15 bp, Artificial Sequence
  dgRNA
  Taf9
ggttagggcgcgcaa

SEQ ID NO: 20493 - DNA, 15 bp, Artificial Sequence
  dgRNA
  Taf9
gttagggcgcgcaac

SEQ ID NO: 20494 - DNA, 15 bp, Artificial Sequence
  dgRNA
  Taf9
ttagggcgcgcaacg

SEQ ID NO: 20495 - DNA, 15 bp, Artificial Sequence
  dgRNA
  Lyg2
cctccagtgcaacct

SEQ ID NO: 20496 - DNA, 15 bp, Artificial Sequence
  dgRNA
  Lyg2
agtagcactataatc

SEQ ID NO: 20497 - DNA, 15 bp, Artificial Sequence
  dgRNA
  Lyg2
caatgctttaaagag

SEQ ID NO: 20498 - DNA, 15 bp, Artificial Sequence
  dgRNA
  Lyg2
tctaacgaacccccc

SEQ ID NO: 20499 - DNA, 15 bp, Artificial Sequence
  dgRNA
  Dock6
ggctccgccctatct

SEQ ID NO: 20500 - DNA, 15 bp, Artificial Sequence
  dgRNA
  Dock6
gctccgccctatcta

SEQ ID NO: 20501 - DNA, 15 bp, Artificial Sequence
  dgRNA
  Dock6
cgccccctccagaga

SEQ ID NO: 20502 - DNA, 15 bp, Artificial Sequence
  dgRNA
  Dock6
atcctagagttggcc

SEQ ID NO: 20503 - DNA, 15 bp, Artificial Sequence
  dgRNA
  Naalad2
atcccctgatgtgag

SEQ ID NO: 20504 - DNA, 15 bp, Artificial Sequence
  dgRNA
  Naalad2
tcccctgatgtgagc

SEQ ID NO: 20505 - DNA, 15 bp, Artificial Sequence
  dgRNA
  Naalad2
tgagcgggtatctat

SEQ ID NO: 20506 - DNA, 15 bp, Artificial Sequence
  dgRNA
  Naalad2
gatgcagttgacaaa

SEQ ID NO: 20507 - DNA, 15 bp, Artificial Sequence
  dgRNA
  Zfp120
aaatttctacagacc

SEQ ID NO: 20508 - DNA, 15 bp, Artificial Sequence
  dgRNA
  Zfp120
ctacagacccggaaa

SEQ ID NO: 20509 - DNA, 15 bp, Artificial Sequence
  dgRNA
  Zfp120
acactctaatcctat

SEQ ID NO: 20510 - DNA, 15 bp, Artificial Sequence
  dgRNA
  Zfp120
ctctaatcctatggg

SEQ ID NO: 20511 - DNA, 15 bp, Artificial Sequence
  dgRNA
  Ssbp3
ccccgctcccccggc

SEQ ID NO: 20512 - DNA, 15 bp, Artificial Sequence
  dgRNA
  Ssbp3
ccgctcccccggccg

SEQ ID NO: 20513 - DNA, 15 bp, Artificial Sequence
  dgRNA
  Ssbp3
cggccggggcacgag

SEQ ID NO: 20514 - DNA, 15 bp, Artificial Sequence
  dgRNA
  Ssbp3
ggccggggcacgagc

SEQ ID NO: 20515 - DNA, 15 bp, Artificial Sequence
  dgRNA
  Vmn1r184
ctcctgtcaaaattt

SEQ ID NO: 20516 - DNA, 15 bp, Artificial Sequence
  dgRNA
  Vmn1r184
atctaactcgagaaa

SEQ ID NO: 20517 - DNA, 15 bp, Artificial Sequence
  dgRNA
  Vmn1r184
taactcgagaaatgg

SEQ ID NO: 20518 - DNA, 15 bp, Artificial Sequence
  dgRNA
  Vmn1r184
aactcgagaaatggt

SEQ ID NO: 20519 - DNA, 15 bp, Artificial Sequence
  dgRNA
  A630076J17Rik
tgtgatgccttcata

SEQ ID NO: 20520 - DNA, 15 bp, Artificial Sequence
  dgRNA
  A630076J17Rik
ccgtgacacttccac

SEQ ID NO: 20521 - DNA, 15 bp, Artificial Sequence
  dgRNA
  A630076J17Rik
cgtgacacttccaca

SEQ ID NO: 20522 - DNA, 15 bp, Artificial Sequence
  dgRNA
  A630076J17Rik
tggtgccattaataa

SEQ ID NO: 20523 - DNA, 15 bp, Artificial Sequence
  dgRNA
  Acot7
tgccaccgaaccttc

SEQ ID NO: 20524 - DNA, 15 bp, Artificial Sequence
  dgRNA
  Acot7
gagcgtctgccgccg

SEQ ID NO: 20525 - DNA, 15 bp, Artificial Sequence
  dgRNA
  Acot7
cgtctgccgccgtgg

SEQ ID NO: 20526 - DNA, 15 bp, Artificial Sequence
  dgRNA
  Acot7
cgccgtggaggcctc

SEQ ID NO: 20527 - DNA, 15 bp, Artificial Sequence
  dgRNA
  Serpina11
accctcagacagaat

SEQ ID NO: 20528 - DNA, 15 bp, Artificial Sequence
  dgRNA
  Serpina11
cttcccgtcagttcc

SEQ ID NO: 20529 - DNA, 15 bp, Artificial Sequence
  dgRNA
  Serpina11
accagtctgctgcta

SEQ ID NO: 20530 - DNA, 15 bp, Artificial Sequence
  dgRNA
  Serpina11
gccattggtggtgat

SEQ ID NO: 20531 - DNA, 15 bp, Artificial Sequence
  dgRNA
  Zfp37
gacacgtcgcagctc

SEQ ID NO: 20532 - DNA, 15 bp, Artificial Sequence
  dgRNA
  Zfp37
acacgtcgcagctcc

SEQ ID NO: 20533 - DNA, 15 bp, Artificial Sequence
  dgRNA
  Zfp37
gcagctccgggaacc

SEQ ID NO: 20534 - DNA, 15 bp, Artificial Sequence
  dgRNA
  Zfp37
aatcgccagccctgc

SEQ ID NO: 20535 - DNA, 15 bp, Artificial Sequence
  dgRNA
  Rplp1
attcgcaagccccaa

SEQ ID NO: 20536 - DNA, 15 bp, Artificial Sequence
  dgRNA
  Rplp1
aaaggccaatcgcac

SEQ ID NO: 20537 - DNA, 15 bp, Artificial Sequence
  dgRNA
  Rplp1
tcgaacgcgcaaatc

SEQ ID NO: 20538 - DNA, 15 bp, Artificial Sequence
  dgRNA
  Rplp1
agacgcgcctcctct

SEQ ID NO: 20539 - DNA, 15 bp, Artificial Sequence
  dgRNA
  Rmdn3
gcagcgtgagatttg

SEQ ID NO: 20540 - DNA, 15 bp, Artificial Sequence
  dgRNA
  Rmdn3
ttgcggagcacattc

SEQ ID NO: 20541 - DNA, 15 bp, Artificial Sequence
  dgRNA
  Rmdn3
ttctggccgtagcac

SEQ ID NO: 20542 - DNA, 15 bp, Artificial Sequence
  dgRNA
  Rmdn3
tctggccgtagcacc

SEQ ID NO: 20543 - DNA, 15 bp, Artificial Sequence
  dgRNA
  Aagab
cggagcgctcctaga

SEQ ID NO: 20544 - DNA, 15 bp, Artificial Sequence
  dgRNA
  Aagab
cgctcctagatggtg

SEQ ID NO: 20545 - DNA, 15 bp, Artificial Sequence
  dgRNA
  Aagab
gctcctagatggtgc

SEQ ID NO: 20546 - DNA, 15 bp, Artificial Sequence
  dgRNA
  Aagab
cgcggcgcgcgcgac

SEQ ID NO: 20547 - DNA, 15 bp, Artificial Sequence
  dgRNA
  Rps15
ccctccggagggtag

SEQ ID NO: 20548 - DNA, 15 bp, Artificial Sequence
  dgRNA
  Rps15
gcggcgcttttgctc

SEQ ID NO: 20549 - DNA, 15 bp, Artificial Sequence
  dgRNA
  Rps15
ctggcctccggacag

SEQ ID NO: 20550 - DNA, 15 bp, Artificial Sequence
  dgRNA
  Rps15
tggcctccggacagc

SEQ ID NO: 20551 - DNA, 15 bp, Artificial Sequence
  dgRNA
  Ankrd33b
gattacggtcctcag

SEQ ID NO: 20552 - DNA, 15 bp, Artificial Sequence
  dgRNA
  Ankrd33b
attacggtcctcagt

SEQ ID NO: 20553 - DNA, 15 bp, Artificial Sequence
  dgRNA
  Ankrd33b
ttacggtcctcagtg

SEQ ID NO: 20554 - DNA, 15 bp, Artificial Sequence
  dgRNA
  Ankrd33b
cgagcctcctggtgc

SEQ ID NO: 20555 - DNA, 15 bp, Artificial Sequence
  dgRNA
  Man2c1
aggtgagaaccgcga

SEQ ID NO: 20556 - DNA, 15 bp, Artificial Sequence
  dgRNA
  Man2c1
cgaaggctcagcttc

SEQ ID NO: 20557 - DNA, 15 bp, Artificial Sequence
  dgRNA
  Man2c1
gcttccgggtttcac

SEQ ID NO: 20558 - DNA, 15 bp, Artificial Sequence
  dgRNA
  Man2c1
cttccgggtttcact

SEQ ID NO: 20559 - DNA, 15 bp, Artificial Sequence
  dgRNA
  Slc25a27
ctgaggccgccggac

SEQ ID NO: 20560 - DNA, 15 bp, Artificial Sequence
  dgRNA
  Slc25a27
accggtccagctacc

SEQ ID NO: 20561 - DNA, 15 bp, Artificial Sequence
  dgRNA
  Slc25a27
ggtccagctaccagg

SEQ ID NO: 20562 - DNA, 15 bp, Artificial Sequence
  dgRNA
  Slc25a27
gtccagctaccaggc

SEQ ID NO: 20563 - DNA, 15 bp, Artificial Sequence
  dgRNA
  Txnrd3
ccgcacctttgaaaa

SEQ ID NO: 20564 - DNA, 15 bp, Artificial Sequence
  dgRNA
  Txnrd3
gacagagtagtttgc

SEQ ID NO: 20565 - DNA, 15 bp, Artificial Sequence
  dgRNA
  Txnrd3
gtttgcaggctcacc

SEQ ID NO: 20566 - DNA, 15 bp, Artificial Sequence
  dgRNA
  Txnrd3
cgtagcttagccctg

SEQ ID NO: 20567 - DNA, 15 bp, Artificial Sequence
  dgRNA
  Olfr324
gtttgacataatgtg

SEQ ID NO: 20568 - DNA, 15 bp, Artificial Sequence
  dgRNA
  Olfr324
tgaatctatgagacc

SEQ ID NO: 20569 - DNA, 15 bp, Artificial Sequence
  dgRNA
  Olfr324
tagtcactcagagtt

SEQ ID NO: 20570 - DNA, 15 bp, Artificial Sequence
  dgRNA
  Olfr324
tgtcaaacagactag

SEQ ID NO: 20571 - DNA, 15 bp, Artificial Sequence
  dgRNA
  Defb43
gcttaaagcgaatga

SEQ ID NO: 20572 - DNA, 15 bp, Artificial Sequence
  dgRNA
  Defb43
ttgcatgctacctcc

SEQ ID NO: 20573 - DNA, 15 bp, Artificial Sequence
  dgRNA
  Defb43
ggttcaaagcctcat

SEQ ID NO: 20574 - DNA, 15 bp, Artificial Sequence
  dgRNA
  Defb43
acaactcctgggcca

SEQ ID NO: 20575 - DNA, 15 bp, Artificial Sequence
  dgRNA
  Ccdc129
tagaacaaatgggcg

SEQ ID NO: 20576 - DNA, 15 bp, Artificial Sequence
  dgRNA
  Ccdc129
cgcccatttgttcta

SEQ ID NO: 20577 - DNA, 15 bp, Artificial Sequence
  dgRNA
  Mospd2
cccctacagctcagc

SEQ ID NO: 20578 - DNA, 15 bp, Artificial Sequence
  dgRNA
  Olfr175-ps1
tatcttgtgagtcaa

SEQ ID NO: 20579 - DNA, 15 bp, Artificial Sequence
  dgRNA
  Calr3
tattggtggctatcc

SEQ ID NO: 20580 - DNA, 15 bp, Artificial Sequence
  dgRNA
  Calr3
gaagactgtcaaccc

SEQ ID NO: 20581 - DNA, 15 bp, Artificial Sequence
  dgRNA
  Ppil3
gaagttgggcggaat

SEQ ID NO: 20582 - DNA, 15 bp, Artificial Sequence
  dgRNA
  Map4k4
gcggcgggcgacgcc

SEQ ID NO: 20583 - DNA, 15 bp, Artificial Sequence
  dgRNA
  Map4k4
ggcgggcgacgcccg

SEQ ID NO: 20584 - DNA, 15 bp, Artificial Sequence
  dgRNA
  Map4k4
gcgggcgacgcccgg

SEQ ID NO: 20585 - DNA, 15 bp, Artificial Sequence
  dgRNA
  Map4k4
cgggcgacgcccggg

SEQ ID NO: 20586 - DNA, 15 bp, Artificial Sequence
  dgRNA
  Atad3a
ctatttgcctggtcc

SEQ ID NO: 20587 - DNA, 15 bp, Artificial Sequence
  dgRNA
  Atad3a
gcctccttagaaagc

SEQ ID NO: 20588 - DNA, 15 bp, Artificial Sequence
  dgRNA
  Atad3a
tgccaccgacgccac

SEQ ID NO: 20589 - DNA, 15 bp, Artificial Sequence
  dgRNA
  Atad3a
gcgtccctatgtcag

SEQ ID NO: 20590 - DNA, 15 bp, Artificial Sequence
  dgRNA
  Myo7a
acccccttgttcccg

SEQ ID NO: 20591 - DNA, 15 bp, Artificial Sequence
  dgRNA
  Myo7a
accacgggaacaagg

SEQ ID NO: 20592 - DNA, 15 bp, Artificial Sequence
  dgRNA
  Myo7a
gaccacgggaacaag

SEQ ID NO: 20593 - DNA, 15 bp, Artificial Sequence
  dgRNA
  Myo7a
ggaccacgggaacaa

SEQ ID NO: 20594 - DNA, 15 bp, Artificial Sequence
  dgRNA
  Cars2
cccaagttacccata

SEQ ID NO: 20595 - DNA, 15 bp, Artificial Sequence
  dgRNA
  Cars2
gttacccataaggaa

SEQ ID NO: 20596 - DNA, 15 bp, Artificial Sequence
  dgRNA
  Cars2
agatctgcgctaaaa

SEQ ID NO: 20597 - DNA, 15 bp, Artificial Sequence
  dgRNA
  Cars2
gatctgcgctaaaat

SEQ ID NO: 20598 - DNA, 15 bp, Artificial Sequence
  dgRNA
  Myh11
acagactctgtatac

SEQ ID NO: 20599 - DNA, 15 bp, Artificial Sequence
  dgRNA
  Myh11
gatctgggtggctac

SEQ ID NO: 20600 - DNA, 15 bp, Artificial Sequence
  dgRNA
  Myh11
atctgggtggctaca

SEQ ID NO: 20601 - DNA, 15 bp, Artificial Sequence
  dgRNA
  Myh11
cagggggcgccgcga

SEQ ID NO: 20602 - DNA, 15 bp, Artificial Sequence
  dgRNA
  Svs1
cgctgctgtgactca

SEQ ID NO: 20603 - DNA, 15 bp, Artificial Sequence
  dgRNA
  Svs1
gactcatggcgttcc

SEQ ID NO: 20604 - DNA, 15 bp, Artificial Sequence
  dgRNA
  Svs1
gagcatttatcagcc

SEQ ID NO: 20605 - DNA, 15 bp, Artificial Sequence
  dgRNA
  Olfr1513
gacgtgcaagctggg

SEQ ID NO: 20606 - DNA, 15 bp, Artificial Sequence
  dgRNA
  Olfr1513
tgacgtgcaagctgg

SEQ ID NO: 20607 - DNA, 15 bp, Artificial Sequence
  dgRNA
  Olfr1513
atgacgtgcaagctg

SEQ ID NO: 20608 - DNA, 15 bp, Artificial Sequence
  dgRNA
  Olfr1513
aatgacgtgcaagct

SEQ ID NO: 20609 - DNA, 15 bp, Artificial Sequence
  dgRNA
  Slmap
accgaaggggacaag

SEQ ID NO: 20610 - DNA, 15 bp, Artificial Sequence
  dgRNA
  Slmap
aaggggacaagcggc

SEQ ID NO: 20611 - DNA, 15 bp, Artificial Sequence
  dgRNA
  Slmap
aggggacaagcggcc

SEQ ID NO: 20612 - DNA, 15 bp, Artificial Sequence
  dgRNA
  Slmap
cttcggtagcggaaa

SEQ ID NO: 20613 - DNA, 15 bp, Artificial Sequence
  dgRNA
  Tmem55b
cacgtctctctccaa

SEQ ID NO: 20614 - DNA, 15 bp, Artificial Sequence
  dgRNA
  Tmem55b
cgctcccttacaaac

SEQ ID NO: 20615 - DNA, 15 bp, Artificial Sequence
  dgRNA
  Tmem55b
gctcccttacaaacc

SEQ ID NO: 20616 - DNA, 15 bp, Artificial Sequence
  dgRNA
  Tmem55b
accgggaactgtttc

SEQ ID NO: 20617 - DNA, 15 bp, Artificial Sequence
  dgRNA
  Pdap1
tgacggcttccgctc

SEQ ID NO: 20618 - DNA, 15 bp, Artificial Sequence
  dgRNA
  Pdap1
agaataaggccctcg

SEQ ID NO: 20619 - DNA, 15 bp, Artificial Sequence
  dgRNA
  Pdap1
gaataaggccctcgc

SEQ ID NO: 20620 - DNA, 15 bp, Artificial Sequence
  dgRNA
  Pdap1
aataaggccctcgcg

SEQ ID NO: 20621 - DNA, 15 bp, Artificial Sequence
  dgRNA
  Try4
ataatccaaggcact

SEQ ID NO: 20622 - DNA, 15 bp, Artificial Sequence
  dgRNA
  Try4
tgaactggggtataa

SEQ ID NO: 20623 - DNA, 15 bp, Artificial Sequence
  dgRNA
  Try4
ctccgggtgcagaca

SEQ ID NO: 20624 - DNA, 15 bp, Artificial Sequence
  dgRNA
  Try4
gaggtacaagtgata

SEQ ID NO: 20625 - DNA, 15 bp, Artificial Sequence
  dgRNA
  Me1
ggaattgcatccacc

SEQ ID NO: 20626 - DNA, 15 bp, Artificial Sequence
  dgRNA
  Me1
gctagggcacgtctg

SEQ ID NO: 20627 - DNA, 15 bp, Artificial Sequence
  dgRNA
  Me1
ctagggcacgtctgt

SEQ ID NO: 20628 - DNA, 15 bp, Artificial Sequence
  dgRNA
  Me1
tagggcacgtctgtg

SEQ ID NO: 20629 - DNA, 15 bp, Artificial Sequence
  dgRNA
  Abi1
ccttagacgcatgcg

SEQ ID NO: 20630 - DNA, 15 bp, Artificial Sequence
  dgRNA
  Abi1
atgcgcggcctagcc

SEQ ID NO: 20631 - DNA, 15 bp, Artificial Sequence
  dgRNA
  Abi1
ccgcgcatgcgtcta

SEQ ID NO: 20632 - DNA, 15 bp, Artificial Sequence
  dgRNA
  Inpp4a
ggctactgccatcgt

SEQ ID NO: 20633 - DNA, 15 bp, Artificial Sequence
  dgRNA
  Inpp4a
ccatcgtaggagtcc

SEQ ID NO: 20634 - DNA, 15 bp, Artificial Sequence
  dgRNA
  Inpp4a
catcgtaggagtcca

SEQ ID NO: 20635 - DNA, 15 bp, Artificial Sequence
  dgRNA
  Inpp4a
gacggctctgctttg

SEQ ID NO: 20636 - DNA, 15 bp, Artificial Sequence
  dgRNA
  Slc25a54
ccgagaatgcttcta

SEQ ID NO: 20637 - DNA, 15 bp, Artificial Sequence
  dgRNA
  Slc25a54
gcttctaaggtctag

SEQ ID NO: 20638 - DNA, 15 bp, Artificial Sequence
  dgRNA
  Slc25a54
cttctaaggtctaga

SEQ ID NO: 20639 - DNA, 15 bp, Artificial Sequence
  dgRNA
  Slc25a54
gagggtcatagtctc

SEQ ID NO: 20640 - DNA, 15 bp, Artificial Sequence
  dgRNA
  Ddx50
ggcgagcgtccttcc

SEQ ID NO: 20641 - DNA, 15 bp, Artificial Sequence
  dgRNA
  Ddx50
gattggcccgtgctc

SEQ ID NO: 20642 - DNA, 15 bp, Artificial Sequence
  dgRNA
  Ddx50
tgtcacttcagaccg

SEQ ID NO: 20643 - DNA, 15 bp, Artificial Sequence
  dgRNA
  Ddx50
gtcacttcagaccgt

SEQ ID NO: 20644 - DNA, 15 bp, Artificial Sequence
  dgRNA
  Dnajc12
gcagccccgcatggc

SEQ ID NO: 20645 - DNA, 15 bp, Artificial Sequence
  dgRNA
  Dnajc12
tggcaggctcgatcc

SEQ ID NO: 20646 - DNA, 15 bp, Artificial Sequence
  dgRNA
  Dnajc12
ggcaggctcgatcct

SEQ ID NO: 20647 - DNA, 15 bp, Artificial Sequence
  dgRNA
  Dnajc12
ccatgcggggctgct

SEQ ID NO: 20648 - DNA, 15 bp, Artificial Sequence
  dgRNA
  Wdr95
cccattaagctccac

SEQ ID NO: 20649 - DNA, 15 bp, Artificial Sequence
  dgRNA
  Wdr95
ccattaagctccaca

SEQ ID NO: 20650 - DNA, 15 bp, Artificial Sequence
  dgRNA
  Wdr95
catagggccctggcg

SEQ ID NO: 20651 - DNA, 15 bp, Artificial Sequence
  dgRNA
  Wdr95
atagggccctggcgc

SEQ ID NO: 20652 - DNA, 15 bp, Artificial Sequence
  dgRNA
  Pxt1
ctttagaagaacggg

SEQ ID NO: 20653 - DNA, 15 bp, Artificial Sequence
  dgRNA
  Pxt1
accgagggagggtgc

SEQ ID NO: 20654 - DNA, 15 bp, Artificial Sequence
  dgRNA
  Pxt1
gagctgcctctattc

SEQ ID NO: 20655 - DNA, 15 bp, Artificial Sequence
  dgRNA
  Pxt1
tcaggagctccgcct

SEQ ID NO: 20656 - DNA, 15 bp, Artificial Sequence
  dgRNA
  Zfp12
caagctgctgaaacg

SEQ ID NO: 20657 - DNA, 15 bp, Artificial Sequence
  dgRNA
  Zfp12
gctgctgaaacgagg

SEQ ID NO: 20658 - DNA, 15 bp, Artificial Sequence
  dgRNA
  Zfp12
ttgtgcgacgatccc

SEQ ID NO: 20659 - DNA, 15 bp, Artificial Sequence
  dgRNA
  Zfp12
gaagcctaagagttc

SEQ ID NO: 20660 - DNA, 15 bp, Artificial Sequence
  dgRNA
  Znrd1as
cattaggtccgacgt

SEQ ID NO: 20661 - DNA, 15 bp, Artificial Sequence
  dgRNA
  Znrd1as
taggtccgacgtagg

SEQ ID NO: 20662 - DNA, 15 bp, Artificial Sequence
  dgRNA
  Znrd1as
tcccgatcccagacg

SEQ ID NO: 20663 - DNA, 15 bp, Artificial Sequence
  dgRNA
  Znrd1as
cccgatcccagacgc

SEQ ID NO: 20664 - DNA, 15 bp, Artificial Sequence
  dgRNA
  Scgb2b3
gttcgtcagagtggg

SEQ ID NO: 20665 - DNA, 15 bp, Artificial Sequence
  dgRNA
  Scgb2b3
cctcccctgttcaag

SEQ ID NO: 20666 - DNA, 15 bp, Artificial Sequence
  dgRNA
  Scgb2b3
ctcccctgttcaagt

SEQ ID NO: 20667 - DNA, 15 bp, Artificial Sequence
  dgRNA
  Scgb2b3
cctgttcaagtggga

SEQ ID NO: 20668 - DNA, 15 bp, Artificial Sequence
  dgRNA
  Inpp4a
gaatcgcttgttctc

SEQ ID NO: 20669 - DNA, 15 bp, Artificial Sequence
  dgRNA
  Inpp4a
aatcgcttgttctct

SEQ ID NO: 20670 - DNA, 15 bp, Artificial Sequence
  dgRNA
  Inpp4a
aaaaactcccactcc

SEQ ID NO: 20671 - DNA, 15 bp, Artificial Sequence
  dgRNA
  Inpp4a
gtgacgtcacataag

SEQ ID NO: 20672 - DNA, 15 bp, Artificial Sequence
  dgRNA
  Olfr1256
tatcataatgctctg

SEQ ID NO: 20673 - DNA, 15 bp, Artificial Sequence
  dgRNA
  Lhx9
ttgattaatcgagtg

SEQ ID NO: 20674 - DNA, 15 bp, Artificial Sequence
  dgRNA
  Lhx9
tcgagtgaggagacg

SEQ ID NO: 20675 - DNA, 15 bp, Artificial Sequence
  dgRNA
  Lhx9
cgagtgaggagacgt

SEQ ID NO: 20676 - DNA, 15 bp, Artificial Sequence
  dgRNA
  Ythdf2
gccaaaaaactccag

SEQ ID NO: 20677 - DNA, 15 bp, Artificial Sequence
  dgRNA
  Ythdf2
cccccggtgccaccc

SEQ ID NO: 20678 - DNA, 15 bp, Artificial Sequence
  dgRNA
  Ythdf2
ccccggtgccaccca

SEQ ID NO: 20679 - DNA, 15 bp, Artificial Sequence
  dgRNA
  Ythdf2
ctcctaggcccaaag

SEQ ID NO: 20680 - DNA, 15 bp, Artificial Sequence
  dgRNA
  Chrna3
atgcctgatcccgac

SEQ ID NO: 20681 - DNA, 15 bp, Artificial Sequence
  dgRNA
  Chrna3
tggtctgtagcctag

SEQ ID NO: 20682 - DNA, 15 bp, Artificial Sequence
  dgRNA
  Chrna3
ctgggcgaggcatcg

SEQ ID NO: 20683 - DNA, 15 bp, Artificial Sequence
  dgRNA
  Chrna3
cgacgcagaagaccg

SEQ ID NO: 20684 - DNA, 15 bp, Artificial Sequence
  dgRNA
  Ptprz1
ccaggcgcttggtcc

SEQ ID NO: 20685 - DNA, 15 bp, Artificial Sequence
  dgRNA
  Ptprz1
cgcttggtccaggct

SEQ ID NO: 20686 - DNA, 15 bp, Artificial Sequence
  dgRNA
  Ptprz1
cgttcacctagaccc

SEQ ID NO: 20687 - DNA, 15 bp, Artificial Sequence
  dgRNA
  Ptprz1
cggcgtcccctgcct

SEQ ID NO: 20688 - DNA, 15 bp, Artificial Sequence
  dgRNA
  Mipep
tcctccagacacacg

SEQ ID NO: 20689 - DNA, 15 bp, Artificial Sequence
  dgRNA
  Mipep
cctccagacacacga

SEQ ID NO: 20690 - DNA, 15 bp, Artificial Sequence
  dgRNA
  Mipep
agggcgctacgaaac

SEQ ID NO: 20691 - DNA, 15 bp, Artificial Sequence
  dgRNA
  Mipep
gctgctcagaaggcg

SEQ ID NO: 20692 - DNA, 15 bp, Artificial Sequence
  dgRNA
  C1s2
cctcactaccaaagc

SEQ ID NO: 20693 - DNA, 15 bp, Artificial Sequence
  dgRNA
  C1s2
cctgctttggtagtg

SEQ ID NO: 20694 - DNA, 15 bp, Artificial Sequence
  dgRNA
  C1s2
ttatctgacaagtac

SEQ ID NO: 20695 - DNA, 15 bp, Artificial Sequence
  dgRNA
  Cd101
tcctctttaggcagg

SEQ ID NO: 20696 - DNA, 15 bp, Artificial Sequence
  dgRNA
  Cd101
aacccatacagatga

SEQ ID NO: 20697 - DNA, 15 bp, Artificial Sequence
  dgRNA
  Cd101
ttatcttcacggtga

SEQ ID NO: 20698 - DNA, 15 bp, Artificial Sequence
  dgRNA
  Cd101
cagtcacttagactt

SEQ ID NO: 20699 - DNA, 15 bp, Artificial Sequence
  dgRNA
  3-Mar
tcagccgcaagcgat

SEQ ID NO: 20700 - DNA, 15 bp, Artificial Sequence
  dgRNA
  3-Mar
attggacattgagtg

SEQ ID NO: 20701 - DNA, 15 bp, Artificial Sequence
  dgRNA
  3-Mar
ttggacattgagtga

SEQ ID NO: 20702 - DNA, 15 bp, Artificial Sequence
  dgRNA
  3-Mar
gcgggactacgctct

SEQ ID NO: 20703 - DNA, 15 bp, Artificial Sequence
  dgRNA
  Prss34
agataaatgggaccc

SEQ ID NO: 20704 - DNA, 15 bp, Artificial Sequence
  dgRNA
  Prss34
gataaatgggaccct

SEQ ID NO: 20705 - DNA, 15 bp, Artificial Sequence
  dgRNA
  Prss34
taaatgggaccctgg

SEQ ID NO: 20706 - DNA, 15 bp, Artificial Sequence
  dgRNA
  Prss34
tgccctgcggtagat

SEQ ID NO: 20707 - DNA, 15 bp, Artificial Sequence
  dgRNA
  Sf3b5
acccgctacatatac

SEQ ID NO: 20708 - DNA, 15 bp, Artificial Sequence
  dgRNA
  Sf3b5
cccgctacatataca

SEQ ID NO: 20709 - DNA, 15 bp, Artificial Sequence
  dgRNA
  Sf3b5
gtatatgtagcgggt

SEQ ID NO: 20710 - DNA, 15 bp, Artificial Sequence
  dgRNA
  Sf3b5
ccctgtatatgtagc

SEQ ID NO: 20711 - DNA, 15 bp, Artificial Sequence
  dgRNA
  Hvcn1
cccctgaattcagct

SEQ ID NO: 20712 - DNA, 15 bp, Artificial Sequence
  dgRNA
  Hvcn1
ccctgaattcagcta

SEQ ID NO: 20713 - DNA, 15 bp, Artificial Sequence
  dgRNA
  Hvcn1
ggaggtccttggatg

SEQ ID NO: 20714 - DNA, 15 bp, Artificial Sequence
  dgRNA
  Hvcn1
gatgaggcgtttgag

SEQ ID NO: 20715 - DNA, 15 bp, Artificial Sequence
  dgRNA
  Olfr591
cctaaactcagattt

SEQ ID NO: 20716 - DNA, 15 bp, Artificial Sequence
  dgRNA
  Olfr591
ggatgttaccttgaa

SEQ ID NO: 20717 - DNA, 15 bp, Artificial Sequence
  dgRNA
  Nat2
atctcacgcaaagaa

SEQ ID NO: 20718 - DNA, 15 bp, Artificial Sequence
  dgRNA
  Nat2
actaagcataagggg

SEQ ID NO: 20719 - DNA, 15 bp, Artificial Sequence
  dgRNA
  Nat2
tgcatttctcgtgat

SEQ ID NO: 20720 - DNA, 15 bp, Artificial Sequence
  dgRNA
  Nat2
ggcttcacttaaccc

SEQ ID NO: 20721 - DNA, 15 bp, Artificial Sequence
  dgRNA
  Tmprss11e
tctctacactcgcca

SEQ ID NO: 20722 - DNA, 15 bp, Artificial Sequence
  dgRNA
  Tmprss11e
caaggcttgtcagac

SEQ ID NO: 20723 - DNA, 15 bp, Artificial Sequence
  dgRNA
  Tmprss11e
cagactggttctcta

SEQ ID NO: 20724 - DNA, 15 bp, Artificial Sequence
  dgRNA
  Tmprss11e
tgagacactttttat

SEQ ID NO: 20725 - DNA, 15 bp, Artificial Sequence
  dgRNA
  Macf1
gtcaggtctcctaca

SEQ ID NO: 20726 - DNA, 15 bp, Artificial Sequence
  dgRNA
  Macf1
gtatactatccttgt

SEQ ID NO: 20727 - DNA, 15 bp, Artificial Sequence
  dgRNA
  Macf1
caagactaatttatg

SEQ ID NO: 20728 - DNA, 15 bp, Artificial Sequence
  dgRNA
  Cnpy1
gacagcctcatttgt

SEQ ID NO: 20729 - DNA, 15 bp, Artificial Sequence
  dgRNA
  Cnpy1
cccactaaaaatgtc

SEQ ID NO: 20730 - DNA, 15 bp, Artificial Sequence
  dgRNA
  Cnpy1
atgtcaggccctgtt

SEQ ID NO: 20731 - DNA, 15 bp, Artificial Sequence
  dgRNA
  Cnpy1
gtgggccaacaaatg

SEQ ID NO: 20732 - DNA, 15 bp, Artificial Sequence
  dgRNA
  Mgat1
actgcctttcgaagt

SEQ ID NO: 20733 - DNA, 15 bp, Artificial Sequence
  dgRNA
  Mgat1
ctgcctttcgaagtt

SEQ ID NO: 20734 - DNA, 15 bp, Artificial Sequence
  dgRNA
  Mgat1
tgcctttcgaagttg

SEQ ID NO: 20735 - DNA, 15 bp, Artificial Sequence
  dgRNA
  Mgat1
gcctttcgaagttgg

SEQ ID NO: 20736 - DNA, 15 bp, Artificial Sequence
  dgRNA
  Gm5148
ctgccccctcccatt

SEQ ID NO: 20737 - DNA, 15 bp, Artificial Sequence
  dgRNA
  Gm5148
ccattcggaagatga

SEQ ID NO: 20738 - DNA, 15 bp, Artificial Sequence
  dgRNA
  Gm5148
gaaggatgctcgttt

SEQ ID NO: 20739 - DNA, 15 bp, Artificial Sequence
  dgRNA
  Gm5148
aaggatgctcgtttt

SEQ ID NO: 20740 - DNA, 15 bp, Artificial Sequence
  dgRNA
  Acss1
agatcgcagaaaccc

SEQ ID NO: 20741 - DNA, 15 bp, Artificial Sequence
  dgRNA
  Acss1
ctgaagccgagagcg

SEQ ID NO: 20742 - DNA, 15 bp, Artificial Sequence
  dgRNA
  Acss1
tgaagccgagagcgc

SEQ ID NO: 20743 - DNA, 15 bp, Artificial Sequence
  dgRNA
  Acss1
agcgcgggctagccc

SEQ ID NO: 20744 - DNA, 15 bp, Artificial Sequence
  dgRNA
  Cep97
caccagatcaacttt

SEQ ID NO: 20745 - DNA, 15 bp, Artificial Sequence
  dgRNA
  Cep97
ctttaggtgtcaacc

SEQ ID NO: 20746 - DNA, 15 bp, Artificial Sequence
  dgRNA
  Cep97
tttaggtgtcaaccc

SEQ ID NO: 20747 - DNA, 15 bp, Artificial Sequence
  dgRNA
  Cep97
catcagggagccaat

SEQ ID NO: 20748 - DNA, 15 bp, Artificial Sequence
  dgRNA
  Xylt1
cccgccctagaaccc

SEQ ID NO: 20749 - DNA, 15 bp, Artificial Sequence
  dgRNA
  Xylt1
ccgccctagaaccct

SEQ ID NO: 20750 - DNA, 15 bp, Artificial Sequence
  dgRNA
  Xylt1
cgccctagaaccctg

SEQ ID NO: 20751 - DNA, 15 bp, Artificial Sequence
  dgRNA
  Xylt1
ggggaccctgaccca

SEQ ID NO: 20752 - DNA, 15 bp, Artificial Sequence
  dgRNA
  Prr22
aggtgacttgcgtga

SEQ ID NO: 20753 - DNA, 15 bp, Artificial Sequence
  dgRNA
  Prr22
gcagcgacctggctc

SEQ ID NO: 20754 - DNA, 15 bp, Artificial Sequence
  dgRNA
  Prr22
cagcgacctggctca

SEQ ID NO: 20755 - DNA, 15 bp, Artificial Sequence
  dgRNA
  Prr22
ctccacctagcaacg

SEQ ID NO: 20756 - DNA, 15 bp, Artificial Sequence
  dgRNA
  Ear14
gagttatagatcctg

SEQ ID NO: 20757 - DNA, 15 bp, Artificial Sequence
  dgRNA
  Ear14
tgtgggtccatggtc

SEQ ID NO: 20758 - DNA, 15 bp, Artificial Sequence
  dgRNA
  Smo
aaggagcccggtagt

SEQ ID NO: 20759 - DNA, 15 bp, Artificial Sequence
  dgRNA
  Smo
agcccggtagtcggc

SEQ ID NO: 20760 - DNA, 15 bp, Artificial Sequence
  dgRNA
  Smo
gcccggtagtcggca

SEQ ID NO: 20761 - DNA, 15 bp, Artificial Sequence
  dgRNA
  Smo
tgcggcgcgctcgcg

SEQ ID NO: 20762 - DNA, 15 bp, Artificial Sequence
  dgRNA
  Slc6a3
ccccaagtggtgcag

SEQ ID NO: 20763 - DNA, 15 bp, Artificial Sequence
  dgRNA
  Slc6a3
ccctgggcggaacag

SEQ ID NO: 20764 - DNA, 15 bp, Artificial Sequence
  dgRNA
  Slc6a3
cggagccagtgccag

SEQ ID NO: 20765 - DNA, 15 bp, Artificial Sequence
  dgRNA
  Slc6a3
agtgggcgcccccga

SEQ ID NO: 20766 - DNA, 15 bp, Artificial Sequence
  dgRNA
  Ecm1
gagcaagttgtcatc

SEQ ID NO: 20767 - DNA, 15 bp, Artificial Sequence
  dgRNA
  Acads
aaagttgcccaagct

SEQ ID NO: 20768 - DNA, 15 bp, Artificial Sequence
  dgRNA
  Acads
tttactccgtaatac

SEQ ID NO: 20769 - DNA, 15 bp, Artificial Sequence
  dgRNA
  Acads
ttactccgtaataca

SEQ ID NO: 20770 - DNA, 15 bp, Artificial Sequence
  dgRNA
  Acads
attaagttgacttcc

SEQ ID NO: 20771 - DNA, 15 bp, Artificial Sequence
  dgRNA
  Ypel4
atcacccctctagcc

SEQ ID NO: 20772 - DNA, 15 bp, Artificial Sequence
  dgRNA
  Ypel4
gccctgctctgacgt

SEQ ID NO: 20773 - DNA, 15 bp, Artificial Sequence
  dgRNA
  Ypel4
ctgctctgacgtggg

SEQ ID NO: 20774 - DNA, 15 bp, Artificial Sequence
  dgRNA
  Ypel4
ggttgttaaggagca

SEQ ID NO: 20775 - DNA, 15 bp, Artificial Sequence
  dgRNA
  Olfr166
gtcaattcaaagttg

SEQ ID NO: 20776 - DNA, 15 bp, Artificial Sequence
  dgRNA
  1700017D01Rik
aattgtgggatcagc

SEQ ID NO: 20777 - DNA, 15 bp, Artificial Sequence
  dgRNA
  1700017D01Rik
attgtgggatcagca

SEQ ID NO: 20778 - DNA, 15 bp, Artificial Sequence
  dgRNA
  1700017D01Rik
agtgagagaccacgt

SEQ ID NO: 20779 - DNA, 15 bp, Artificial Sequence
  dgRNA
  1700017D01Rik
gagtgagagaccacg

SEQ ID NO: 20780 - DNA, 15 bp, Artificial Sequence
  dgRNA
  Ctla4
taacagctaaaccca

SEQ ID NO: 20781 - DNA, 15 bp, Artificial Sequence
  dgRNA
  Ctla4
ttcgagtcacctctg

SEQ ID NO: 20782 - DNA, 15 bp, Artificial Sequence
  dgRNA
  Ctla4
cgagaaaggaagccg

SEQ ID NO: 20783 - DNA, 15 bp, Artificial Sequence
  dgRNA
  Msantd1
tcactgcaatattga

SEQ ID NO: 20784 - DNA, 15 bp, Artificial Sequence
  dgRNA
  Msantd1
gatggcccgttagtg

SEQ ID NO: 20785 - DNA, 15 bp, Artificial Sequence
  dgRNA
  Msantd1
caatattgcagtgag

SEQ ID NO: 20786 - DNA, 15 bp, Artificial Sequence
  dgRNA
  Msantd1
cagggccgcactaac

SEQ ID NO: 20787 - DNA, 15 bp, Artificial Sequence
  dgRNA
  Wfdc13
gttgggttttcagcc

SEQ ID NO: 20788 - DNA, 15 bp, Artificial Sequence
  dgRNA
  Wfdc13
ctagccctgccctac

SEQ ID NO: 20789 - DNA, 15 bp, Artificial Sequence
  dgRNA
  Clec2h
atgaatcaccagtct

SEQ ID NO: 20790 - DNA, 15 bp, Artificial Sequence
  dgRNA
  Clec2h
atcaccagtctgggc

SEQ ID NO: 20791 - DNA, 15 bp, Artificial Sequence
  dgRNA
  Anapc15
gcaaacaccgccgag

SEQ ID NO: 20792 - DNA, 15 bp, Artificial Sequence
  dgRNA
  Anapc15
acaccgccgagtggc

SEQ ID NO: 20793 - DNA, 15 bp, Artificial Sequence
  dgRNA
  Anapc15
ccgccgagtggcagg

SEQ ID NO: 20794 - DNA, 15 bp, Artificial Sequence
  dgRNA
  Anapc15
cgccgagtggcagga

SEQ ID NO: 20795 - DNA, 15 bp, Artificial Sequence
  dgRNA
  Ube2w
ctccgccagcactga

SEQ ID NO: 20796 - DNA, 15 bp, Artificial Sequence
  dgRNA
  Ube2w
cgccagcactgaggg

SEQ ID NO: 20797 - DNA, 15 bp, Artificial Sequence
  dgRNA
  Ube2w
ggcccgcgtataaat

SEQ ID NO: 20798 - DNA, 15 bp, Artificial Sequence
  dgRNA
  Ube2w
cgcgtataaattggc

SEQ ID NO: 20799 - DNA, 15 bp, Artificial Sequence
  dgRNA
  Wdr19
tagcattcaacttcc

SEQ ID NO: 20800 - DNA, 15 bp, Artificial Sequence
  dgRNA
  Wdr19
caaaggagggctccg

SEQ ID NO: 20801 - DNA, 15 bp, Artificial Sequence
  dgRNA
  Wdr19
aaaggagggctccgg

SEQ ID NO: 20802 - DNA, 15 bp, Artificial Sequence
  dgRNA
  Wdr19
cccacgctcgctgat

SEQ ID NO: 20803 - DNA, 15 bp, Artificial Sequence
  dgRNA
  Dcaf5
gttcggcgcggtcag

SEQ ID NO: 20804 - DNA, 15 bp, Artificial Sequence
  dgRNA
  Dcaf5
gccgcccgccatctc

SEQ ID NO: 20805 - DNA, 15 bp, Artificial Sequence
  dgRNA
  Dcaf5
ccgcccgccatctcc

SEQ ID NO: 20806 - DNA, 15 bp, Artificial Sequence
  dgRNA
  Dcaf5
ccgggcagccgtccg

SEQ ID NO: 20807 - DNA, 15 bp, Artificial Sequence
  dgRNA
  Dact1
agcaggcggggtgtc

SEQ ID NO: 20808 - DNA, 15 bp, Artificial Sequence
  dgRNA
  Dact1
gcaggcggggtgtcg

SEQ ID NO: 20809 - DNA, 15 bp, Artificial Sequence
  dgRNA
  Dact1
gcggggtgtcggggc

SEQ ID NO: 20810 - DNA, 15 bp, Artificial Sequence
  dgRNA
  Dact1
cggggtgtcggggcc

SEQ ID NO: 20811 - DNA, 15 bp, Artificial Sequence
  dgRNA
  Akt1s1
tgtagaacgcaaagt

SEQ ID NO: 20812 - DNA, 15 bp, Artificial Sequence
  dgRNA
  Akt1s1
aacgcaaagttggca

SEQ ID NO: 20813 - DNA, 15 bp, Artificial Sequence
  dgRNA
  Akt1s1
acgcaaagttggcaa

SEQ ID NO: 20814 - DNA, 15 bp, Artificial Sequence
  dgRNA
  Akt1s1
caagggtcagcggga

SEQ ID NO: 20815 - DNA, 15 bp, Artificial Sequence
  dgRNA
  Gtf2ird2
tgcctgagtaacacg

SEQ ID NO: 20816 - DNA, 15 bp, Artificial Sequence
  dgRNA
  Gtf2ird2
gcctgagtaacacgt

SEQ ID NO: 20817 - DNA, 15 bp, Artificial Sequence
  dgRNA
  Gtf2ird2
cctgagtaacacgtg

SEQ ID NO: 20818 - DNA, 15 bp, Artificial Sequence
  dgRNA
  Gtf2ird2
cggccatgcacatcc

SEQ ID NO: 20819 - DNA, 15 bp, Artificial Sequence
  dgRNA
  Apoa1
gaagacatacacctc

SEQ ID NO: 20820 - DNA, 15 bp, Artificial Sequence
  dgRNA
  Apoa1
acatacacctcggga

SEQ ID NO: 20821 - DNA, 15 bp, Artificial Sequence
  dgRNA
  Apoa1
caactgccttacccc

SEQ ID NO: 20822 - DNA, 15 bp, Artificial Sequence
  dgRNA
  Apoa1
aactgccttacccct

SEQ ID NO: 20823 - DNA, 15 bp, Artificial Sequence
  dgRNA
  Pacs2
gcgcctcacttccgg

SEQ ID NO: 20824 - DNA, 15 bp, Artificial Sequence
  dgRNA
  Pacs2
ctcacttccggtggg

SEQ ID NO: 20825 - DNA, 15 bp, Artificial Sequence
  dgRNA
  Pacs2
ccggtgggcggtgat

SEQ ID NO: 20826 - DNA, 15 bp, Artificial Sequence
  dgRNA
  Pacs2
cggtgggcggtgatt

SEQ ID NO: 20827 - DNA, 15 bp, Artificial Sequence
  dgRNA
  Hnrnpf
cgtcttgcatccttc

SEQ ID NO: 20828 - DNA, 15 bp, Artificial Sequence
  dgRNA
  Hnrnpf
cttccggctccgtcg

SEQ ID NO: 20829 - DNA, 15 bp, Artificial Sequence
  dgRNA
  Hnrnpf
cggctccgtcgtgga

SEQ ID NO: 20830 - DNA, 15 bp, Artificial Sequence
  dgRNA
  Hnrnpf
cggaaggatgcaaga

SEQ ID NO: 20831 - DNA, 15 bp, Artificial Sequence
  dgRNA
  Adam4
tcgggcttctgccat

SEQ ID NO: 20832 - DNA, 15 bp, Artificial Sequence
  dgRNA
  Adam4
gatctggagaaccta

SEQ ID NO: 20833 - DNA, 15 bp, Artificial Sequence
  dgRNA
  Olfr1087
aattcgatcacatgt

SEQ ID NO: 20834 - DNA, 15 bp, Artificial Sequence
  dgRNA
  Olfr1087
caaagttatatgcag

SEQ ID NO: 20835 - DNA, 15 bp, Artificial Sequence
  dgRNA
  Clic5
tgagctcgtacactg

SEQ ID NO: 20836 - DNA, 15 bp, Artificial Sequence
  dgRNA
  Clic5
agctcgtacactgag

SEQ ID NO: 20837 - DNA, 15 bp, Artificial Sequence
  dgRNA
  Clic5
ggtctcctatgtgac

SEQ ID NO: 20838 - DNA, 15 bp, Artificial Sequence
  dgRNA
  Clic5
cctccagtccccgcc

SEQ ID NO: 20839 - DNA, 15 bp, Artificial Sequence
  dgRNA
  Fam135a
agtctcccgttctcg

SEQ ID NO: 20840 - DNA, 15 bp, Artificial Sequence
  dgRNA
  Fam135a
gtctcccgttctcgc

SEQ ID NO: 20841 - DNA, 15 bp, Artificial Sequence
  dgRNA
  Fam135a
gttctcgcgggaact

SEQ ID NO: 20842 - DNA, 15 bp, Artificial Sequence
  dgRNA
  Fam135a
ttctcgcgggaactc

SEQ ID NO: 20843 - DNA, 15 bp, Artificial Sequence
  dgRNA
  Hace1
ggtgtgttagaaccg

SEQ ID NO: 20844 - DNA, 15 bp, Artificial Sequence
  dgRNA
  Hace1
gtgtgttagaaccga

SEQ ID NO: 20845 - DNA, 15 bp, Artificial Sequence
  dgRNA
  Hace1
tgttagaaccgaggg

SEQ ID NO: 20846 - DNA, 15 bp, Artificial Sequence
  dgRNA
  Hace1
gctcttatacaactt

SEQ ID NO: 20847 - DNA, 15 bp, Artificial Sequence
  dgRNA
  Mcf2l
ctccccttaaattct

SEQ ID NO: 20848 - DNA, 15 bp, Artificial Sequence
  dgRNA
  Mcf2l
agcttggtgaggcta

SEQ ID NO: 20849 - DNA, 15 bp, Artificial Sequence
  dgRNA
  Mcf2l
ttggggtttgtgcgt

SEQ ID NO: 20850 - DNA, 15 bp, Artificial Sequence
  dgRNA
  Mcf2l
tgtgcgttggcttcc

SEQ ID NO: 20851 - DNA, 15 bp, Artificial Sequence
  dgRNA
  Tmprss6
ccattcaccctgtta

SEQ ID NO: 20852 - DNA, 15 bp, Artificial Sequence
  dgRNA
  Tmprss6
cattcaccctgttag

SEQ ID NO: 20853 - DNA, 15 bp, Artificial Sequence
  dgRNA
  Tmprss6
cctgttaggggacca

SEQ ID NO: 20854 - DNA, 15 bp, Artificial Sequence
  dgRNA
  Tmprss6
ctgttaggggaccag

SEQ ID NO: 20855 - DNA, 15 bp, Artificial Sequence
  dgRNA
  D930015E06Rik
atccccttctatctg

SEQ ID NO: 20856 - DNA, 15 bp, Artificial Sequence
  dgRNA
  D930015E06Rik
cggagcacacgcgct

SEQ ID NO: 20857 - DNA, 15 bp, Artificial Sequence
  dgRNA
  D930015E06Rik
ggagcacacgcgctc

SEQ ID NO: 20858 - DNA, 15 bp, Artificial Sequence
  dgRNA
  D930015E06Rik
gcgctcgggagcaag

SEQ ID NO: 20859 - DNA, 15 bp, Artificial Sequence
  dgRNA
  Rrm2
cgcgctcaatcccca

SEQ ID NO: 20860 - DNA, 15 bp, Artificial Sequence
  dgRNA
  Rrm2
tctcgcaatcctaac

SEQ ID NO: 20861 - DNA, 15 bp, Artificial Sequence
  dgRNA
  Rrm2
aatcctaaccggttc

SEQ ID NO: 20862 - DNA, 15 bp, Artificial Sequence
  dgRNA
  Rrm2
gagcgcccgcgcacc

SEQ ID NO: 20863 - DNA, 15 bp, Artificial Sequence
  dgRNA
  Ctdspl
ctcccacctaccccg

SEQ ID NO: 20864 - DNA, 15 bp, Artificial Sequence
  dgRNA
  Ctdspl
ctgtgccccccgact

SEQ ID NO: 20865 - DNA, 15 bp, Artificial Sequence
  dgRNA
  Ctdspl
cacccctctccccgg

SEQ ID NO: 20866 - DNA, 15 bp, Artificial Sequence
  dgRNA
  Ctdspl
acccctctccccggc

SEQ ID NO: 20867 - DNA, 15 bp, Artificial Sequence
  dgRNA
  Snx27
caccccctcgcagcg

SEQ ID NO: 20868 - DNA, 15 bp, Artificial Sequence
  dgRNA
  Snx27
cccctcgcagcgcgg

SEQ ID NO: 20869 - DNA, 15 bp, Artificial Sequence
  dgRNA
  Snx27
actagctccagcggt

SEQ ID NO: 20870 - DNA, 15 bp, Artificial Sequence
  dgRNA
  Snx27
agctccagcggtcgg

SEQ ID NO: 20871 - DNA, 15 bp, Artificial Sequence
  dgRNA
  Itfg2
gttgacaactccatt

SEQ ID NO: 20872 - DNA, 15 bp, Artificial Sequence
  dgRNA
  Itfg2
ttgacaactccatta

SEQ ID NO: 20873 - DNA, 15 bp, Artificial Sequence
  dgRNA
  Itfg2
tattactatgacccg

SEQ ID NO: 20874 - DNA, 15 bp, Artificial Sequence
  dgRNA
  Itfg2
attactatgacccga

SEQ ID NO: 20875 - DNA, 15 bp, Artificial Sequence
  dgRNA
  Zbtb20
gtcttcagtcgcccc

SEQ ID NO: 20876 - DNA, 15 bp, Artificial Sequence
  dgRNA
  Zbtb20
aggatgaacgacaca

SEQ ID NO: 20877 - DNA, 15 bp, Artificial Sequence
  dgRNA
  Zbtb20
tgatcagactgcccg

SEQ ID NO: 20878 - DNA, 15 bp, Artificial Sequence
  dgRNA
  Zbtb20
tcgttcatcctgatt

SEQ ID NO: 20879 - DNA, 15 bp, Artificial Sequence
  dgRNA
  Macc1
gctaacacacatgtc

SEQ ID NO: 20880 - DNA, 15 bp, Artificial Sequence
  dgRNA
  Macc1
taagtaagttgacag

SEQ ID NO: 20881 - DNA, 15 bp, Artificial Sequence
  dgRNA
  Ppp1r9b
gagagaccaggcgac

SEQ ID NO: 20882 - DNA, 15 bp, Artificial Sequence
  dgRNA
  Ppp1r9b
gaccaggcgacaggg

SEQ ID NO: 20883 - DNA, 15 bp, Artificial Sequence
  dgRNA
  Ppp1r9b
aaatccgatcccttt

SEQ ID NO: 20884 - DNA, 15 bp, Artificial Sequence
  dgRNA
  Ppp1r9b
ccctttaggacccag

SEQ ID NO: 20885 - DNA, 15 bp, Artificial Sequence
  dgRNA
  Olfr1301
tgtccatctaattga

SEQ ID NO: 20886 - DNA, 15 bp, Artificial Sequence
  dgRNA
  Olfr1301
atctacacctgagat

SEQ ID NO: 20887 - DNA, 15 bp, Artificial Sequence
  dgRNA
  Rax
ggaccctaggctgag

SEQ ID NO: 20888 - DNA, 15 bp, Artificial Sequence
  dgRNA
  Rax
agaccggccctctat

SEQ ID NO: 20889 - DNA, 15 bp, Artificial Sequence
  dgRNA
  Rax
gaccggccctctata

SEQ ID NO: 20890 - DNA, 15 bp, Artificial Sequence
  dgRNA
  Rax
accggccctctatag

SEQ ID NO: 20891 - DNA, 15 bp, Artificial Sequence
  dgRNA
  Asxl3
cgtgtgcattccgtg

SEQ ID NO: 20892 - DNA, 15 bp, Artificial Sequence
  dgRNA
  Asxl3
atgttttgtgtggac

SEQ ID NO: 20893 - DNA, 15 bp, Artificial Sequence
  dgRNA
  Asxl3
gttcgcgctgtttgt

SEQ ID NO: 20894 - DNA, 15 bp, Artificial Sequence
  dgRNA
  Asxl3
ggaatgcacacgaca

SEQ ID NO: 20895 - DNA, 15 bp, Artificial Sequence
  dgRNA
  Flcn
agtggcgacagcccc

SEQ ID NO: 20896 - DNA, 15 bp, Artificial Sequence
  dgRNA
  Flcn
caggacagttgcgag

SEQ ID NO: 20897 - DNA, 15 bp, Artificial Sequence
  dgRNA
  Flcn
aggacagttgcgagc

SEQ ID NO: 20898 - DNA, 15 bp, Artificial Sequence
  dgRNA
  Flcn
gttgcgagcgggttc

SEQ ID NO: 20899 - DNA, 15 bp, Artificial Sequence
  dgRNA
  Mmp16
taccgatgaacattc

SEQ ID NO: 20900 - DNA, 15 bp, Artificial Sequence
  dgRNA
  Mmp16
cgatgaacattctgg

SEQ ID NO: 20901 - DNA, 15 bp, Artificial Sequence
  dgRNA
  Mmp16
ccttcccgcagaaac

SEQ ID NO: 20902 - DNA, 15 bp, Artificial Sequence
  dgRNA
  Mmp16
cttcccgcagaaact

SEQ ID NO: 20903 - DNA, 15 bp, Artificial Sequence
  dgRNA
  Zdhhc1
ccgcacacaagagaa

SEQ ID NO: 20904 - DNA, 15 bp, Artificial Sequence
  dgRNA
  Zdhhc1
cccgcacacaagaga

SEQ ID NO: 20905 - DNA, 15 bp, Artificial Sequence
  dgRNA
  Morn3
ctgatacacctggag

SEQ ID NO: 20906 - DNA, 15 bp, Artificial Sequence
  dgRNA
  Morn3
ctcttctaccaaagt

SEQ ID NO: 20907 - DNA, 15 bp, Artificial Sequence
  dgRNA
  Morn3
aagtcggttcctgat

SEQ ID NO: 20908 - DNA, 15 bp, Artificial Sequence
  dgRNA
  Morn3
gtcatcacaatccct

SEQ ID NO: 20909 - DNA, 15 bp, Artificial Sequence
  dgRNA
  Timm10b
gccgctcttcccctc

SEQ ID NO: 20910 - DNA, 15 bp, Artificial Sequence
  dgRNA
  Timm10b
ccgctcttcccctca

SEQ ID NO: 20911 - DNA, 15 bp, Artificial Sequence
  dgRNA
  Timm10b
tcagggcgcgaggcc

SEQ ID NO: 20912 - DNA, 15 bp, Artificial Sequence
  dgRNA
  Timm10b
gaggcccggaccgcg

SEQ ID NO: 20913 - DNA, 15 bp, Artificial Sequence
  dgRNA
  Net1
gagctcctaaaagtt

SEQ ID NO: 20914 - DNA, 15 bp, Artificial Sequence
  dgRNA
  Net1
gaagtcttctgatta

SEQ ID NO: 20915 - DNA, 15 bp, Artificial Sequence
  dgRNA
  Net1
gtcttctgattaggg

SEQ ID NO: 20916 - DNA, 15 bp, Artificial Sequence
  dgRNA
  Net1
caccttactcctgaa

SEQ ID NO: 20917 - DNA, 15 bp, Artificial Sequence
  dgRNA
  Nsmf
gggctaggatgctcc

SEQ ID NO: 20918 - DNA, 15 bp, Artificial Sequence
  dgRNA
  Nsmf
atgctccgggtctga

SEQ ID NO: 20919 - DNA, 15 bp, Artificial Sequence
  dgRNA
  Nsmf
tctttgggcatacac

SEQ ID NO: 20920 - DNA, 15 bp, Artificial Sequence
  dgRNA
  Nsmf
aagaaagcctccggg

SEQ ID NO: 20921 - DNA, 15 bp, Artificial Sequence
  dgRNA
  Rab4a
ctccccctgctccgc

SEQ ID NO: 20922 - DNA, 15 bp, Artificial Sequence
  dgRNA
  Rab4a
tccccctgctccgcc

SEQ ID NO: 20923 - DNA, 15 bp, Artificial Sequence
  dgRNA
  Rab4a
gcgggactagggagg

SEQ ID NO: 20924 - DNA, 15 bp, Artificial Sequence
  dgRNA
  Rab4a
ggcgggactagggag

SEQ ID NO: 20925 - DNA, 15 bp, Artificial Sequence
  dgRNA
  Rbbp6
gccgctcgtggcctc

SEQ ID NO: 20926 - DNA, 15 bp, Artificial Sequence
  dgRNA
  Rbbp6
cgctcgtggcctccg

SEQ ID NO: 20927 - DNA, 15 bp, Artificial Sequence
  dgRNA
  Rbbp6
cggggagcaggcgcc

SEQ ID NO: 20928 - DNA, 15 bp, Artificial Sequence
  dgRNA
  Rbbp6
gtgcggtgggggcct

SEQ ID NO: 20929 - DNA, 15 bp, Artificial Sequence
  dgRNA
  Nfkb2
ctgggtgacaccccg

SEQ ID NO: 20930 - DNA, 15 bp, Artificial Sequence
  dgRNA
  Nfkb2
ccccgcggccagtcc

SEQ ID NO: 20931 - DNA, 15 bp, Artificial Sequence
  dgRNA
  Nfkb2
cccgcggccagtcct

SEQ ID NO: 20932 - DNA, 15 bp, Artificial Sequence
  dgRNA
  Nfkb2
cgagccttccccgaa

SEQ ID NO: 20933 - DNA, 15 bp, Artificial Sequence
  dgRNA
  Mtmr7
cccgcaggtgcgagc

SEQ ID NO: 20934 - DNA, 15 bp, Artificial Sequence
  dgRNA
  Mtmr7
cagagccgcgatctc

SEQ ID NO: 20935 - DNA, 15 bp, Artificial Sequence
  dgRNA
  Mtmr7
atctcaggcccgcgc

SEQ ID NO: 20936 - DNA, 15 bp, Artificial Sequence
  dgRNA
  Mtmr7
ggcgcccagcaccac

SEQ ID NO: 20937 - DNA, 15 bp, Artificial Sequence
  dgRNA
  Anxa3
caagccctaaaagga

SEQ ID NO: 20938 - DNA, 15 bp, Artificial Sequence
  dgRNA
  Anxa3
aagccctaaaaggag

SEQ ID NO: 20939 - DNA, 15 bp, Artificial Sequence
  dgRNA
  Anxa3
aggggagggcttgcg

SEQ ID NO: 20940 - DNA, 15 bp, Artificial Sequence
  dgRNA
  Anxa3
gagggcttgcgaggg

SEQ ID NO: 20941 - DNA, 15 bp, Artificial Sequence
  dgRNA
  Tpx2
tctctgaaggcgctc

SEQ ID NO: 20942 - DNA, 15 bp, Artificial Sequence
  dgRNA
  Tpx2
tcgctgaattttctg

SEQ ID NO: 20943 - DNA, 15 bp, Artificial Sequence
  dgRNA
  Tpx2
attgatagggttgtg

SEQ ID NO: 20944 - DNA, 15 bp, Artificial Sequence
  dgRNA
  Tpx2
gtatagggattgata

SEQ ID NO: 20945 - DNA, 15 bp, Artificial Sequence
  dgRNA
  Prpf31
ggtcgccgtcccgcg

SEQ ID NO: 20946 - DNA, 15 bp, Artificial Sequence
  dgRNA
  Prpf31
cgccgtcccgcgagg

SEQ ID NO: 20947 - DNA, 15 bp, Artificial Sequence
  dgRNA
  Prpf31
ttgtccaaacgctgc

SEQ ID NO: 20948 - DNA, 15 bp, Artificial Sequence
  dgRNA
  Prpf31
cggaaatgtcgtaaa

SEQ ID NO: 20949 - DNA, 15 bp, Artificial Sequence
  dgRNA
  Pgap1
agccccctcctccgt

SEQ ID NO: 20950 - DNA, 15 bp, Artificial Sequence
  dgRNA
  Pgap1
cccctcctccgtggg

SEQ ID NO: 20951 - DNA, 15 bp, Artificial Sequence
  dgRNA
  Pgap1
ccgtgggcggcaccg

SEQ ID NO: 20952 - DNA, 15 bp, Artificial Sequence
  dgRNA
  Pgap1
cgtgggcggcaccgc

SEQ ID NO: 20953 - DNA, 15 bp, Artificial Sequence
  dgRNA
  Tubg2
tttagcatatccggc

SEQ ID NO: 20954 - DNA, 15 bp, Artificial Sequence
  dgRNA
  Tubg2
atatccggcaggtgt

SEQ ID NO: 20955 - DNA, 15 bp, Artificial Sequence
  dgRNA
  Tubg2
ccggcaggtgtaggc

SEQ ID NO: 20956 - DNA, 15 bp, Artificial Sequence
  dgRNA
  Tubg2
cttggtgcatccacc

SEQ ID NO: 20957 - DNA, 15 bp, Artificial Sequence
  dgRNA
  Cd209b
aagtcttgatatatc

SEQ ID NO: 20958 - DNA, 15 bp, Artificial Sequence
  dgRNA
  Cd209b
tatctggcaaaagat

SEQ ID NO: 20959 - DNA, 15 bp, Artificial Sequence
  dgRNA
  Cd209b
ctcttccgcaataca

SEQ ID NO: 20960 - DNA, 15 bp, Artificial Sequence
  dgRNA
  Cd209b
tcttccgcaatacat

SEQ ID NO: 20961 - DNA, 15 bp, Artificial Sequence
  dgRNA
  Psma2
gctcagagcatgcgc

SEQ ID NO: 20962 - DNA, 15 bp, Artificial Sequence
  dgRNA
  Psma2
tcttgcgcatgcgca

SEQ ID NO: 20963 - DNA, 15 bp, Artificial Sequence
  dgRNA
  Psma2
cttgcgcatgcgcaa

SEQ ID NO: 20964 - DNA, 15 bp, Artificial Sequence
  dgRNA
  Psma2
ctgagcgaggaggcg

SEQ ID NO: 20965 - DNA, 15 bp, Artificial Sequence
  dgRNA
  Olfr152
ctgacattggatcgt

SEQ ID NO: 20966 - DNA, 15 bp, Artificial Sequence
  dgRNA
  Insrr
cctccctcagttgac

SEQ ID NO: 20967 - DNA, 15 bp, Artificial Sequence
  dgRNA
  Insrr
aacagagaagtcggc

SEQ ID NO: 20968 - DNA, 15 bp, Artificial Sequence
  dgRNA
  Insrr
gaagtcggcgggcgg

SEQ ID NO: 20969 - DNA, 15 bp, Artificial Sequence
  dgRNA
  Insrr
aaaccaatccgtttc

SEQ ID NO: 20970 - DNA, 15 bp, Artificial Sequence
  dgRNA
  Stard3nl
ttatgagccatctac

SEQ ID NO: 20971 - DNA, 15 bp, Artificial Sequence
  dgRNA
  Stard3nl
agcgcgttgacgtca

SEQ ID NO: 20972 - DNA, 15 bp, Artificial Sequence
  dgRNA
  Stard3nl
gttgacgtcacggac

SEQ ID NO: 20973 - DNA, 15 bp, Artificial Sequence
  dgRNA
  Stard3nl
cggacgaccagtaga

SEQ ID NO: 20974 - DNA, 15 bp, Artificial Sequence
  dgRNA
  Adam29
atggggaactatgtt

SEQ ID NO: 20975 - DNA, 15 bp, Artificial Sequence
  dgRNA
  Adam29
aaggtgtcagggtat

SEQ ID NO: 20976 - DNA, 15 bp, Artificial Sequence
  dgRNA
  Adam29
tggctaaaggtgtca

SEQ ID NO: 20977 - DNA, 15 bp, Artificial Sequence
  dgRNA
  Adam29
ttggctaaaggtgtc

SEQ ID NO: 20978 - DNA, 15 bp, Artificial Sequence
  dgRNA
  Safb
cggccaagcgcgagc

SEQ ID NO: 20979 - DNA, 15 bp, Artificial Sequence
  dgRNA
  Safb
aagcgcgagccggcg

SEQ ID NO: 20980 - DNA, 15 bp, Artificial Sequence
  dgRNA
  Safb
cgcgcacactgcgct

SEQ ID NO: 20981 - DNA, 15 bp, Artificial Sequence
  dgRNA
  Safb
gcgcacactgcgctt

SEQ ID NO: 20982 - DNA, 15 bp, Artificial Sequence
  dgRNA
  Flt4
tcgtcattgtcattt

SEQ ID NO: 20983 - DNA, 15 bp, Artificial Sequence
  dgRNA
  Jph1
cgcgcgccaagcagc

SEQ ID NO: 20984 - DNA, 15 bp, Artificial Sequence
  dgRNA
  Jph1
gcgccaagcagccgg

SEQ ID NO: 20985 - DNA, 15 bp, Artificial Sequence
  dgRNA
  Jph1
agaagctcggctccg

SEQ ID NO: 20986 - DNA, 15 bp, Artificial Sequence
  dgRNA
  Jph1
ctcggctccgcgggc

SEQ ID NO: 20987 - DNA, 15 bp, Artificial Sequence
  dgRNA
  Rreb1
ctcatcccgggatag

SEQ ID NO: 20988 - DNA, 15 bp, Artificial Sequence
  dgRNA
  Rreb1
ttgcctagctaaaac

SEQ ID NO: 20989 - DNA, 15 bp, Artificial Sequence
  dgRNA
  Rreb1
gctaaaactggggcg

SEQ ID NO: 20990 - DNA, 15 bp, Artificial Sequence
  dgRNA
  Rreb1
ctaaaactggggcgg

SEQ ID NO: 20991 - DNA, 15 bp, Artificial Sequence
  dgRNA
  Methig1
agtcagggcattacc

SEQ ID NO: 20992 - DNA, 15 bp, Artificial Sequence
  dgRNA
  Methig1
catgggacacaccgg

SEQ ID NO: 20993 - DNA, 15 bp, Artificial Sequence
  dgRNA
  Methig1
actgatgaccctcat

SEQ ID NO: 20994 - DNA, 15 bp, Artificial Sequence
  dgRNA
  Methig1
agaaatcgcagagcc

SEQ ID NO: 20995 - DNA, 15 bp, Artificial Sequence
  dgRNA
  Lmx1a
gtaccatagttctag

SEQ ID NO: 20996 - DNA, 15 bp, Artificial Sequence
  dgRNA
  Lmx1a
ccatagttctagtgg

SEQ ID NO: 20997 - DNA, 15 bp, Artificial Sequence
  dgRNA
  Lmx1a
catagttctagtggt

SEQ ID NO: 20998 - DNA, 15 bp, Artificial Sequence
  dgRNA
  Lmx1a
gtggtgggatcccta

SEQ ID NO: 20999 - DNA, 15 bp, Artificial Sequence
  dgRNA
  Tsc22d4
tatttatggacagtc

SEQ ID NO: 21000 - DNA, 15 bp, Artificial Sequence
  dgRNA
  Tsc22d4
tacccagaacatgtc

SEQ ID NO: 21001 - DNA, 15 bp, Artificial Sequence
  dgRNA
  Tsc22d4
atgcccctccctccg

SEQ ID NO: 21002 - DNA, 15 bp, Artificial Sequence
  dgRNA
  Tsc22d4
ttgtcacagcgtctc

SEQ ID NO: 21003 - DNA, 15 bp, Artificial Sequence
  dgRNA
  Itga5
tttacgttgtacatc

SEQ ID NO: 21004 - DNA, 15 bp, Artificial Sequence
  dgRNA
  Itga5
cgcccagtctgagcc

SEQ ID NO: 21005 - DNA, 15 bp, Artificial Sequence
  dgRNA
  Itga5
ggaatcacctctggg

SEQ ID NO: 21006 - DNA, 15 bp, Artificial Sequence
  dgRNA
  Itga5
aggaatcacctctgg

SEQ ID NO: 21007 - DNA, 15 bp, Artificial Sequence
  dgRNA
  Slc7a11
gagtatgctttgttc

SEQ ID NO: 21008 - DNA, 15 bp, Artificial Sequence
  dgRNA
  Slc7a11
cattgagcaacccac

SEQ ID NO: 21009 - DNA, 15 bp, Artificial Sequence
  dgRNA
  Slc7a11
tggctgatgcaaacc

SEQ ID NO: 21010 - DNA, 15 bp, Artificial Sequence
  dgRNA
  Slc7a11
tgcagcccagtaagt

SEQ ID NO: 21011 - DNA, 15 bp, Artificial Sequence
  dgRNA
  Rab11fip2
ccttgtcggcctctg

SEQ ID NO: 21012 - DNA, 15 bp, Artificial Sequence
  dgRNA
  Rab11fip2
cttgtcggcctctgc

SEQ ID NO: 21013 - DNA, 15 bp, Artificial Sequence
  dgRNA
  Rab11fip2
cccgctgcaaccgac

SEQ ID NO: 21014 - DNA, 15 bp, Artificial Sequence
  dgRNA
  Rab11fip2
ctgcaaccgacaggt

SEQ ID NO: 21015 - DNA, 15 bp, Artificial Sequence
  dgRNA
  Ptn
cggtcttataaccca

SEQ ID NO: 21016 - DNA, 15 bp, Artificial Sequence
  dgRNA
  Ptn
ctacacagatccgtt

SEQ ID NO: 21017 - DNA, 15 bp, Artificial Sequence
  dgRNA
  Ptn
tacacagatccgttt

SEQ ID NO: 21018 - DNA, 15 bp, Artificial Sequence
  dgRNA
  Ptn
acacagatccgtttg

SEQ ID NO: 21019 - DNA, 15 bp, Artificial Sequence
  dgRNA
  Arl14
tcaggtccaacagtt

SEQ ID NO: 21020 - DNA, 15 bp, Artificial Sequence
  dgRNA
  Arl14
tgagtgagtaggatt

SEQ ID NO: 21021 - DNA, 15 bp, Artificial Sequence
  dgRNA
  Hist1h3h
gactgcgaaaacaaa

SEQ ID NO: 21022 - DNA, 15 bp, Artificial Sequence
  dgRNA
  Hist1h3h
ccaattaagttgatc

SEQ ID NO: 21023 - DNA, 15 bp, Artificial Sequence
  dgRNA
  Hist1h3h
cgtctgtataaattt

SEQ ID NO: 21024 - DNA, 15 bp, Artificial Sequence
  dgRNA
  Hist1h3h
agaaaatcccgccgc

SEQ ID NO: 21025 - DNA, 15 bp, Artificial Sequence
  dgRNA
  Lrrc43
caagattattctaag

SEQ ID NO: 21026 - DNA, 15 bp, Artificial Sequence
  dgRNA
  Lrrc43
taggagcttagctgg

SEQ ID NO: 21027 - DNA, 15 bp, Artificial Sequence
  dgRNA
  Lrrc43
gcttccacgcaccca

SEQ ID NO: 21028 - DNA, 15 bp, Artificial Sequence
  dgRNA
  Lrrc43
ccagggtaacgcgtc

SEQ ID NO: 21029 - DNA, 15 bp, Artificial Sequence
  dgRNA
  F11
cttatttgaacaaac

SEQ ID NO: 21030 - DNA, 15 bp, Artificial Sequence
  dgRNA
  F11
agttagtcgatcttc

SEQ ID NO: 21031 - DNA, 15 bp, Artificial Sequence
  dgRNA
  F11
gttagtcgatcttct

SEQ ID NO: 21032 - DNA, 15 bp, Artificial Sequence
  dgRNA
  F11
ttagtcgatcttctg

SEQ ID NO: 21033 - DNA, 15 bp, Artificial Sequence
  dgRNA
  Uox
taaccactattctga

SEQ ID NO: 21034 - DNA, 15 bp, Artificial Sequence
  dgRNA
  Uox
tctgaccactcagcg

SEQ ID NO: 21035 - DNA, 15 bp, Artificial Sequence
  dgRNA
  Uox
actcagcgaggcatt

SEQ ID NO: 21036 - DNA, 15 bp, Artificial Sequence
  dgRNA
  Uox
tacataggctactat

SEQ ID NO: 21037 - DNA, 15 bp, Artificial Sequence
  dgRNA
  Gsdma3
ctcttagcaggccag

SEQ ID NO: 21038 - DNA, 15 bp, Artificial Sequence
  dgRNA
  Gsdma3
tgaggcacttctaac

SEQ ID NO: 21039 - DNA, 15 bp, Artificial Sequence
  dgRNA
  Gsdma3
ctaacaggttgatgc

SEQ ID NO: 21040 - DNA, 15 bp, Artificial Sequence
  dgRNA
  Gsdma3
gaagtgcctcacctc

SEQ ID NO: 21041 - DNA, 15 bp, Artificial Sequence
  dgRNA
  Vmn2r116
gtgttaatagtgcat

SEQ ID NO: 21042 - DNA, 15 bp, Artificial Sequence
  dgRNA
  Vmn2r116
tgttaatagtgcatg

SEQ ID NO: 21043 - DNA, 15 bp, Artificial Sequence
  dgRNA
  Vmn2r116
tgcatggggatatat

SEQ ID NO: 21044 - DNA, 15 bp, Artificial Sequence
  dgRNA
  Micu3
taacgtgcataaaag

SEQ ID NO: 21045 - DNA, 15 bp, Artificial Sequence
  dgRNA
  Micu3
aacgtgcataaaaga

SEQ ID NO: 21046 - DNA, 15 bp, Artificial Sequence
  dgRNA
  P2rx6
catagggtccaaccc

SEQ ID NO: 21047 - DNA, 15 bp, Artificial Sequence
  dgRNA
  P2rx6
tgggcagtcaacacg

SEQ ID NO: 21048 - DNA, 15 bp, Artificial Sequence
  dgRNA
  P2rx6
ggtgggcagtcaaca

SEQ ID NO: 21049 - DNA, 15 bp, Artificial Sequence
  dgRNA
  Kpna2
gggtgccttgcagaa

SEQ ID NO: 21050 - DNA, 15 bp, Artificial Sequence
  dgRNA
  Kpna2
ggccgggcaatccca

SEQ ID NO: 21051 - DNA, 15 bp, Artificial Sequence
  dgRNA
  Kpna2
cggccgggcaatccc

SEQ ID NO: 21052 - DNA, 15 bp, Artificial Sequence
  dgRNA
  Kpna2
gatgagggagcggcc

SEQ ID NO: 21053 - DNA, 15 bp, Artificial Sequence
  dgRNA
  Prune
gtgaatccagtattc

SEQ ID NO: 21054 - DNA, 15 bp, Artificial Sequence
  dgRNA
  Prune
atagcttccctggtt

SEQ ID NO: 21055 - DNA, 15 bp, Artificial Sequence
  dgRNA
  Prune
ctagcccaacctgtc

SEQ ID NO: 21056 - DNA, 15 bp, Artificial Sequence
  dgRNA
  Gtpbp1
gagagctgcgacgat

SEQ ID NO: 21057 - DNA, 15 bp, Artificial Sequence
  dgRNA
  Gtpbp1
gatacgtgacagtct

SEQ ID NO: 21058 - DNA, 15 bp, Artificial Sequence
  dgRNA
  Gtpbp1
atacgtgacagtctc

SEQ ID NO: 21059 - DNA, 15 bp, Artificial Sequence
  dgRNA
  Gtpbp1
cgtgacagtctcggg

SEQ ID NO: 21060 - DNA, 15 bp, Artificial Sequence
  dgRNA
  Tas2r144
taactctcaatgaag

SEQ ID NO: 21061 - DNA, 15 bp, Artificial Sequence
  dgRNA
  Tas2r144
cagcatcactgacgg

SEQ ID NO: 21062 - DNA, 15 bp, Artificial Sequence
  dgRNA
  Tas2r144
agcatcactgacggt

SEQ ID NO: 21063 - DNA, 15 bp, Artificial Sequence
  dgRNA
  Tas2r144
cggtgggaagattac

SEQ ID NO: 21064 - DNA, 15 bp, Artificial Sequence
  dgRNA
  Ubl7
ccctacctcaggtgg

SEQ ID NO: 21065 - DNA, 15 bp, Artificial Sequence
  dgRNA
  Ubl7
aaagctacaacctac

SEQ ID NO: 21066 - DNA, 15 bp, Artificial Sequence
  dgRNA
  Ubl7
gcactcacgcctcct

SEQ ID NO: 21067 - DNA, 15 bp, Artificial Sequence
  dgRNA
  Ubl7
acgcctcctaggacc

SEQ ID NO: 21068 - DNA, 15 bp, Artificial Sequence
  dgRNA
  Igsf1
ttgggcaacctcagc

SEQ ID NO: 21069 - DNA, 15 bp, Artificial Sequence
  dgRNA
  Igsf1
ggggcgttccattcc

SEQ ID NO: 21070 - DNA, 15 bp, Artificial Sequence
  dgRNA
  Igsf1
attcctggtcgtcag

SEQ ID NO: 21071 - DNA, 15 bp, Artificial Sequence
  dgRNA
  Igsf1
tcgtcagaggactgc

SEQ ID NO: 21072 - DNA, 15 bp, Artificial Sequence
  dgRNA
  Rgs6
caggtgcgggcgccc

SEQ ID NO: 21073 - DNA, 15 bp, Artificial Sequence
  dgRNA
  Rgs6
gggcgcccaggtgcg

SEQ ID NO: 21074 - DNA, 15 bp, Artificial Sequence
  dgRNA
  Rgs6
caggtgcgcggcgcg

SEQ ID NO: 21075 - DNA, 15 bp, Artificial Sequence
  dgRNA
  Rgs6
ctgggtccccgacag

SEQ ID NO: 21076 - DNA, 15 bp, Artificial Sequence
  dgRNA
  Lrrc49
atgggctgtattact

SEQ ID NO: 21077 - DNA, 15 bp, Artificial Sequence
  dgRNA
  Lrrc49
tgtattactgggatc

SEQ ID NO: 21078 - DNA, 15 bp, Artificial Sequence
  dgRNA
  Lrrc49
gtattactgggatcg

SEQ ID NO: 21079 - DNA, 15 bp, Artificial Sequence
  dgRNA
  Lrrc49
gctattgtctcattg

SEQ ID NO: 21080 - DNA, 15 bp, Artificial Sequence
  dgRNA
  Ces1e
agtcaccttacttaa

SEQ ID NO: 21081 - DNA, 15 bp, Artificial Sequence
  dgRNA
  Ces1e
caatttagataaacc

SEQ ID NO: 21082 - DNA, 15 bp, Artificial Sequence
  dgRNA
  Ces1e
gtcttcacatcaagc

SEQ ID NO: 21083 - DNA, 15 bp, Artificial Sequence
  dgRNA
  Ces1e
agactcctttaagta

SEQ ID NO: 21084 - DNA, 15 bp, Artificial Sequence
  dgRNA
  Zfp35
aagctttgagtcaag

SEQ ID NO: 21085 - DNA, 15 bp, Artificial Sequence
  dgRNA
  Zfp35
agctttgagtcaagc

SEQ ID NO: 21086 - DNA, 15 bp, Artificial Sequence
  dgRNA
  Zfp35
cccctatgctaaagc

SEQ ID NO: 21087 - DNA, 15 bp, Artificial Sequence
  dgRNA
  Zfp35
ccctatgctaaagct

SEQ ID NO: 21088 - DNA, 15 bp, Artificial Sequence
  dgRNA
  Olfr1249
ttgaatgcctattat

SEQ ID NO: 21089 - DNA, 15 bp, Artificial Sequence
  dgRNA
  Olfr1249
cctgttaagagatca

SEQ ID NO: 21090 - DNA, 15 bp, Artificial Sequence
  dgRNA
  Olfr1249
ccatgatctcttaac

SEQ ID NO: 21091 - DNA, 15 bp, Artificial Sequence
  dgRNA
  Tmem59
cgacgtgagacccac

SEQ ID NO: 21092 - DNA, 15 bp, Artificial Sequence
  dgRNA
  Tmem59
gacgtgagacccacc

SEQ ID NO: 21093 - DNA, 15 bp, Artificial Sequence
  dgRNA
  Tmem59
cctgcctacgctgtt

SEQ ID NO: 21094 - DNA, 15 bp, Artificial Sequence
  dgRNA
  Tmem59
ctcgggacctccacc

SEQ ID NO: 21095 - DNA, 15 bp, Artificial Sequence
  dgRNA
  A230046K03Rik
gagaacagtcgtgaa

SEQ ID NO: 21096 - DNA, 15 bp, Artificial Sequence
  dgRNA
  A230046K03Rik
aacggcagcgagacc

SEQ ID NO: 21097 - DNA, 15 bp, Artificial Sequence
  dgRNA
  A230046K03Rik
cggcagccatcacta

SEQ ID NO: 21098 - DNA, 15 bp, Artificial Sequence
  dgRNA
  A230046K03Rik
cagccatcactatgg

SEQ ID NO: 21099 - DNA, 15 bp, Artificial Sequence
  dgRNA
  Commd10
agcctcggtttcaca

SEQ ID NO: 21100 - DNA, 15 bp, Artificial Sequence
  dgRNA
  Commd10
ttcacacggtcagaa

SEQ ID NO: 21101 - DNA, 15 bp, Artificial Sequence
  dgRNA
  Commd10
ccacgcacaagcctt

SEQ ID NO: 21102 - DNA, 15 bp, Artificial Sequence
  dgRNA
  Commd10
acgcacagcatctcg

SEQ ID NO: 21103 - DNA, 15 bp, Artificial Sequence
  dgRNA
  Kif13b
ggcacaattgtaaaa

SEQ ID NO: 21104 - DNA, 15 bp, Artificial Sequence
  dgRNA
  Kif13b
ttcccgccagcgcct

SEQ ID NO: 21105 - DNA, 15 bp, Artificial Sequence
  dgRNA
  Kif13b
cctcggcctgacttg

SEQ ID NO: 21106 - DNA, 15 bp, Artificial Sequence
  dgRNA
  Kif13b
ctcggcctgacttgt

SEQ ID NO: 21107 - DNA, 15 bp, Artificial Sequence
  dgRNA
  St6galnac5
gtttgatcctgaaca

SEQ ID NO: 21108 - DNA, 15 bp, Artificial Sequence
  dgRNA
  St6galnac5
ggctgtcaagttaaa

SEQ ID NO: 21109 - DNA, 15 bp, Artificial Sequence
  dgRNA
  St6galnac5
ctgccgccgcctgct

SEQ ID NO: 21110 - DNA, 15 bp, Artificial Sequence
  dgRNA
  St6galnac5
cctgccgccgcctgc

SEQ ID NO: 21111 - DNA, 15 bp, Artificial Sequence
  dgRNA
  Glt1d1
cccgctagtctcctc

SEQ ID NO: 21112 - DNA, 15 bp, Artificial Sequence
  dgRNA
  Glt1d1
cctcaggtcccctcg

SEQ ID NO: 21113 - DNA, 15 bp, Artificial Sequence
  dgRNA
  Glt1d1
tacccctgaacctgc

SEQ ID NO: 21114 - DNA, 15 bp, Artificial Sequence
  dgRNA
  Glt1d1
ctgcgggctccgcct

SEQ ID NO: 21115 - DNA, 15 bp, Artificial Sequence
  dgRNA
  Serac1
tttctaggcgcgcag

SEQ ID NO: 21116 - DNA, 15 bp, Artificial Sequence
  dgRNA
  Serac1
ctgcgacaccctagt

SEQ ID NO: 21117 - DNA, 15 bp, Artificial Sequence
  dgRNA
  Serac1
cgacaccctagtagg

SEQ ID NO: 21118 - DNA, 15 bp, Artificial Sequence
  dgRNA
  Serac1
gacaccctagtaggt

SEQ ID NO: 21119 - DNA, 15 bp, Artificial Sequence
  dgRNA
  Olfr235
gatcacttatttctt

SEQ ID NO: 21120 - DNA, 15 bp, Artificial Sequence
  dgRNA
  Foxr1
ctgatgagcgcgagc

SEQ ID NO: 21121 - DNA, 15 bp, Artificial Sequence
  dgRNA
  Foxr1
acctgcgattgcccg

SEQ ID NO: 21122 - DNA, 15 bp, Artificial Sequence
  dgRNA
  Foxr1
attgcccgcggtttg

SEQ ID NO: 21123 - DNA, 15 bp, Artificial Sequence
  dgRNA
  Foxr1
aagcaccttccacgc

SEQ ID NO: 21124 - DNA, 15 bp, Artificial Sequence
  dgRNA
  Ttc30a1
gtggatacgtcccat

SEQ ID NO: 21125 - DNA, 15 bp, Artificial Sequence
  dgRNA
  Ttc30a1
tggatacgtcccatt

SEQ ID NO: 21126 - DNA, 15 bp, Artificial Sequence
  dgRNA
  Ttc30a1
aacaatgttgcatgc

SEQ ID NO: 21127 - DNA, 15 bp, Artificial Sequence
  dgRNA
  Ttc30a1
atgccgggagaaacc

SEQ ID NO: 21128 - DNA, 15 bp, Artificial Sequence
  dgRNA
  Neurl1a
gggctcccagcgttg

SEQ ID NO: 21129 - DNA, 15 bp, Artificial Sequence
  dgRNA
  Neurl1a
ctcccagcgttgtgg

SEQ ID NO: 21130 - DNA, 15 bp, Artificial Sequence
  dgRNA
  Neurl1a
tctattcctgacgtc

SEQ ID NO: 21131 - DNA, 15 bp, Artificial Sequence
  dgRNA
  Neurl1a
tgccgcccccaaccc

SEQ ID NO: 21132 - DNA, 15 bp, Artificial Sequence
  dgRNA
  Ndufs3
gcttagctcaagagc

SEQ ID NO: 21133 - DNA, 15 bp, Artificial Sequence
  dgRNA
  Ndufs3
gctcaagagccggcg

SEQ ID NO: 21134 - DNA, 15 bp, Artificial Sequence
  dgRNA
  Ndufs3
tttctctcaccggtg

SEQ ID NO: 21135 - DNA, 15 bp, Artificial Sequence
  dgRNA
  Ndufs3
gcgtcttcttctctt

SEQ ID NO: 21136 - DNA, 15 bp, Artificial Sequence
  dgRNA
  Rnaset2b
gagcgtggggacttc

SEQ ID NO: 21137 - DNA, 15 bp, Artificial Sequence
  dgRNA
  Dmrtc1b
gaccttgaattcggc

SEQ ID NO: 21138 - DNA, 15 bp, Artificial Sequence
  dgRNA
  Dmrtc1b
gcagctgggtacatc

SEQ ID NO: 21139 - DNA, 15 bp, Artificial Sequence
  dgRNA
  Dmrtc1b
gtctactgttgtatg

SEQ ID NO: 21140 - DNA, 15 bp, Artificial Sequence
  dgRNA
  Dmrtc1b
attcaaggtccccca

SEQ ID NO: 21141 - DNA, 15 bp, Artificial Sequence
  dgRNA
  Ctdp1
gcgatccgcgtgaca

SEQ ID NO: 21142 - DNA, 15 bp, Artificial Sequence
  dgRNA
  Ctdp1
cgcgtgacatggctg

SEQ ID NO: 21143 - DNA, 15 bp, Artificial Sequence
  dgRNA
  Ctdp1
gtggtctcaacacca

SEQ ID NO: 21144 - DNA, 15 bp, Artificial Sequence
  dgRNA
  Ctdp1
ctcaacaccacggac

SEQ ID NO: 21145 - DNA, 15 bp, Artificial Sequence
  dgRNA
  N4bp2l1
ctgcggaaggcggcg

SEQ ID NO: 21146 - DNA, 15 bp, Artificial Sequence
  dgRNA
  N4bp2l1
cggcggggggctgga

SEQ ID NO: 21147 - DNA, 15 bp, Artificial Sequence
  dgRNA
  N4bp2l1
tcacccacgcttccc

SEQ ID NO: 21148 - DNA, 15 bp, Artificial Sequence
  dgRNA
  N4bp2l1
cacccacgcttcccc

SEQ ID NO: 21149 - DNA, 15 bp, Artificial Sequence
  dgRNA
  Guk1
aggagggtacggaaa

SEQ ID NO: 21150 - DNA, 15 bp, Artificial Sequence
  dgRNA
  Guk1
gaaaagggcggagtt

SEQ ID NO: 21151 - DNA, 15 bp, Artificial Sequence
  dgRNA
  Guk1
acaacgaagagaagt

SEQ ID NO: 21152 - DNA, 15 bp, Artificial Sequence
  dgRNA
  Guk1
agtgggcgtggtcgt

SEQ ID NO: 21153 - DNA, 15 bp, Artificial Sequence
  dgRNA
  Kcnj6
cccagagtggttatc

SEQ ID NO: 21154 - DNA, 15 bp, Artificial Sequence
  dgRNA
  Kcnj6
ccagagtggttatca

SEQ ID NO: 21155 - DNA, 15 bp, Artificial Sequence
  dgRNA
  Kcnj6
gtatctgctataatc

SEQ ID NO: 21156 - DNA, 15 bp, Artificial Sequence
  dgRNA
  Kcnj6
tatctgctataatct

SEQ ID NO: 21157 - DNA, 15 bp, Artificial Sequence
  dgRNA
  Rbm12
agctactaaaatacc

SEQ ID NO: 21158 - DNA, 15 bp, Artificial Sequence
  dgRNA
  Rbm12
cctgcgtctcccatc

SEQ ID NO: 21159 - DNA, 15 bp, Artificial Sequence
  dgRNA
  Rbm12
cccatcaggtgacgt

SEQ ID NO: 21160 - DNA, 15 bp, Artificial Sequence
  dgRNA
  Rbm12
aggtgacgtcggcag

SEQ ID NO: 21161 - DNA, 15 bp, Artificial Sequence
  dgRNA
  Dact2
ccccgatgagctcat

SEQ ID NO: 21162 - DNA, 15 bp, Artificial Sequence
  dgRNA
  Dact2
aggtcccaggggcgc

SEQ ID NO: 21163 - DNA, 15 bp, Artificial Sequence
  dgRNA
  Dact2
cgcaggggttgggcg

SEQ ID NO: 21164 - DNA, 15 bp, Artificial Sequence
  dgRNA
  Dact2
ggcgcggccggtcga

SEQ ID NO: 21165 - DNA, 15 bp, Artificial Sequence
  dgRNA
  Adgrb2
ggcaccggcgatcag

SEQ ID NO: 21166 - DNA, 15 bp, Artificial Sequence
  dgRNA
  Adgrb2
ccggcgatcagaggc

SEQ ID NO: 21167 - DNA, 15 bp, Artificial Sequence
  dgRNA
  Adgrb2
cggcgatcagaggct

SEQ ID NO: 21168 - DNA, 15 bp, Artificial Sequence
  dgRNA
  Adgrb2
ggcgatcagaggctg

SEQ ID NO: 21169 - DNA, 15 bp, Artificial Sequence
  dgRNA
  Dlc1
gggaatctaatttcg

SEQ ID NO: 21170 - DNA, 15 bp, Artificial Sequence
  dgRNA
  Dlc1
tttcgaggtgaagcc

SEQ ID NO: 21171 - DNA, 15 bp, Artificial Sequence
  dgRNA
  Dlc1
ttcgaggtgaagcct

SEQ ID NO: 21172 - DNA, 15 bp, Artificial Sequence
  dgRNA
  Dlc1
agcagccatgagcgt

SEQ ID NO: 21173 - DNA, 15 bp, Artificial Sequence
  dgRNA
  Dnmt1
gcttgcctccccggc

SEQ ID NO: 21174 - DNA, 15 bp, Artificial Sequence
  dgRNA
  Dnmt1
ccggaccatgtccgc

SEQ ID NO: 21175 - DNA, 15 bp, Artificial Sequence
  dgRNA
  Dnmt1
gaccatgtccgcagg

SEQ ID NO: 21176 - DNA, 15 bp, Artificial Sequence
  dgRNA
  Dnmt1
atgtccgcaggcggt

SEQ ID NO: 21177 - DNA, 15 bp, Artificial Sequence
  dgRNA
  Dgcr6
tcgggcacatgacag

SEQ ID NO: 21178 - DNA, 15 bp, Artificial Sequence
  dgRNA
  Dgcr6
ctagaaatgtccgcc

SEQ ID NO: 21179 - DNA, 15 bp, Artificial Sequence
  dgRNA
  Dgcr6
tagaaatgtccgcca

SEQ ID NO: 21180 - DNA, 15 bp, Artificial Sequence
  dgRNA
  Dgcr6
gaaatgtccgccagg

SEQ ID NO: 21181 - DNA, 15 bp, Artificial Sequence
  dgRNA
  Stk26
tcaactaatagccta

SEQ ID NO: 21182 - DNA, 15 bp, Artificial Sequence
  dgRNA
  Stk26
taatagcctaaggta

SEQ ID NO: 21183 - DNA, 15 bp, Artificial Sequence
  dgRNA
  Stk26
ggttaaagtgacttg

SEQ ID NO: 21184 - DNA, 15 bp, Artificial Sequence
  dgRNA
  Stk26
ttgaggcatatctaa

SEQ ID NO: 21185 - DNA, 15 bp, Artificial Sequence
  dgRNA
  Irs2
gcaccgagcatcctt

SEQ ID NO: 21186 - DNA, 15 bp, Artificial Sequence
  dgRNA
  Irs2
gagcatccttcggag

SEQ ID NO: 21187 - DNA, 15 bp, Artificial Sequence
  dgRNA
  Irs2
catccttcggagcgg

SEQ ID NO: 21188 - DNA, 15 bp, Artificial Sequence
  dgRNA
  Irs2
ccttcggagcggcgg

SEQ ID NO: 21189 - DNA, 15 bp, Artificial Sequence
  dgRNA
  Olfr317
gcggagaagctggac

SEQ ID NO: 21190 - DNA, 15 bp, Artificial Sequence
  dgRNA
  Olfr317
aagtcagctgtaatg

SEQ ID NO: 21191 - DNA, 15 bp, Artificial Sequence
  dgRNA
  Yars
caccccgaggcagcg

SEQ ID NO: 21192 - DNA, 15 bp, Artificial Sequence
  dgRNA
  Yars
agcggggccaacacc

SEQ ID NO: 21193 - DNA, 15 bp, Artificial Sequence
  dgRNA
  Yars
gcggggccaacacca

SEQ ID NO: 21194 - DNA, 15 bp, Artificial Sequence
  dgRNA
  Yars
cggggccaacaccag

SEQ ID NO: 21195 - DNA, 15 bp, Artificial Sequence
  dgRNA
  Pld3
gcccgcacccccacg

SEQ ID NO: 21196 - DNA, 15 bp, Artificial Sequence
  dgRNA
  Pld3
actcctccctcggcc

SEQ ID NO: 21197 - DNA, 15 bp, Artificial Sequence
  dgRNA
  Pld3
tcctgcccttgatac

SEQ ID NO: 21198 - DNA, 15 bp, Artificial Sequence
  dgRNA
  Pld3
atacggggtggccgg

SEQ ID NO: 21199 - DNA, 15 bp, Artificial Sequence
  dgRNA
  Zmym3
cactccgcaatttcc

SEQ ID NO: 21200 - DNA, 15 bp, Artificial Sequence
  dgRNA
  Zmym3
tccgcaatttccagg

SEQ ID NO: 21201 - DNA, 15 bp, Artificial Sequence
  dgRNA
  Zmym3
tttccaggcggccac

SEQ ID NO: 21202 - DNA, 15 bp, Artificial Sequence
  dgRNA
  Zmym3
ttccaggcggccact

SEQ ID NO: 21203 - DNA, 15 bp, Artificial Sequence
  dgRNA
  Zbtb32
aagtgaattagactg

SEQ ID NO: 21204 - DNA, 15 bp, Artificial Sequence
  dgRNA
  Zbtb32
tgaattagactgagg

SEQ ID NO: 21205 - DNA, 15 bp, Artificial Sequence
  dgRNA
  Zbtb32
gccacacccctctag

SEQ ID NO: 21206 - DNA, 15 bp, Artificial Sequence
  dgRNA
  Zbtb32
ccctctaggggactg

SEQ ID NO: 21207 - DNA, 15 bp, Artificial Sequence
  dgRNA
  Trpv3
gtaagttccctgtaa

SEQ ID NO: 21208 - DNA, 15 bp, Artificial Sequence
  dgRNA
  Trpv3
taagttccctgtaat

SEQ ID NO: 21209 - DNA, 15 bp, Artificial Sequence
  dgRNA
  Trpv3
aaccaaaggctatcc

SEQ ID NO: 21210 - DNA, 15 bp, Artificial Sequence
  dgRNA
  Trpv3
ggaacttactgatca

SEQ ID NO: 21211 - DNA, 15 bp, Artificial Sequence
  dgRNA
  Itga9
acatcaatcaagcct

SEQ ID NO: 21212 - DNA, 15 bp, Artificial Sequence
  dgRNA
  Itga9
tcaagcctcgggaca

SEQ ID NO: 21213 - DNA, 15 bp, Artificial Sequence
  dgRNA
  Itga9
agcctcgggacaagg

SEQ ID NO: 21214 - DNA, 15 bp, Artificial Sequence
  dgRNA
  Itga9
cgtccccctctgcac

SEQ ID NO: 21215 - DNA, 15 bp, Artificial Sequence
  dgRNA
  Slc9a3
ttcacgtgtgcgcag

SEQ ID NO: 21216 - DNA, 15 bp, Artificial Sequence
  dgRNA
  Slc9a3
tcacgtgtgcgcagc

SEQ ID NO: 21217 - DNA, 15 bp, Artificial Sequence
  dgRNA
  Slc9a3
cacgtgtgcgcagcg

SEQ ID NO: 21218 - DNA, 15 bp, Artificial Sequence
  dgRNA
  Slc9a3
acgtgtgcgcagcgg

SEQ ID NO: 21219 - DNA, 15 bp, Artificial Sequence
  dgRNA
  Ngfr
taaccggaggtgccc

SEQ ID NO: 21220 - DNA, 15 bp, Artificial Sequence
  dgRNA
  Ngfr
aaccggaggtgccct

SEQ ID NO: 21221 - DNA, 15 bp, Artificial Sequence
  dgRNA
  Ngfr
ggtgccctgggtacg

SEQ ID NO: 21222 - DNA, 15 bp, Artificial Sequence
  dgRNA
  Ngfr
gtgccctgggtacgt

SEQ ID NO: 21223 - DNA, 15 bp, Artificial Sequence
  dgRNA
  Adam2
agcacaaacgcttcc

SEQ ID NO: 21224 - DNA, 15 bp, Artificial Sequence
  dgRNA
  Adam2
ccaactgccctgtag

SEQ ID NO: 21225 - DNA, 15 bp, Artificial Sequence
  dgRNA
  Adam2
caactgccctgtaga

SEQ ID NO: 21226 - DNA, 15 bp, Artificial Sequence
  dgRNA
  Adam2
aactgccattccccg

SEQ ID NO: 21227 - DNA, 15 bp, Artificial Sequence
  dgRNA
  Thnsl1
gcgcgcagtcagcgc

SEQ ID NO: 21228 - DNA, 15 bp, Artificial Sequence
  dgRNA
  4933428G20Rik
gtgtccgtctccacg

SEQ ID NO: 21229 - DNA, 15 bp, Artificial Sequence
  dgRNA
  4933428G20Rik
cccgagcacacgcta

SEQ ID NO: 21230 - DNA, 15 bp, Artificial Sequence
  dgRNA
  4933428G20Rik
acacgctacggtcca

SEQ ID NO: 21231 - DNA, 15 bp, Artificial Sequence
  dgRNA
  4933428G20Rik
cgctacggtccatgg

SEQ ID NO: 21232 - DNA, 15 bp, Artificial Sequence
  dgRNA
  Eps8
cgggtctcccctgcg

SEQ ID NO: 21233 - DNA, 15 bp, Artificial Sequence
  dgRNA
  Eps8
gccgtgctcgccttg

SEQ ID NO: 21234 - DNA, 15 bp, Artificial Sequence
  dgRNA
  Eps8
ccgtgctcgccttgt

SEQ ID NO: 21235 - DNA, 15 bp, Artificial Sequence
  dgRNA
  Eps8
ctatccagagcccta

SEQ ID NO: 21236 - DNA, 15 bp, Artificial Sequence
  dgRNA
  Slc22a19
atagtaagttaactc

SEQ ID NO: 21237 - DNA, 15 bp, Artificial Sequence
  dgRNA
  Slc22a19
cagatcaatgtccac

SEQ ID NO: 21238 - DNA, 15 bp, Artificial Sequence
  dgRNA
  Slc22a19
atcaatgtccacagg

SEQ ID NO: 21239 - DNA, 15 bp, Artificial Sequence
  dgRNA
  Slc22a19
gagtagcctgatgat

SEQ ID NO: 21240 - DNA, 15 bp, Artificial Sequence
  dgRNA
  Scaf11
tccgtccgtccgtcg

SEQ ID NO: 21241 - DNA, 15 bp, Artificial Sequence
  dgRNA
  Scaf11
gtccgtcgcggctcg

SEQ ID NO: 21242 - DNA, 15 bp, Artificial Sequence
  dgRNA
  Scaf11
tccgtcgcggctcgc

SEQ ID NO: 21243 - DNA, 15 bp, Artificial Sequence
  dgRNA
  Scaf11
ctcgcgggcgccccc

SEQ ID NO: 21244 - DNA, 15 bp, Artificial Sequence
  dgRNA
  Ryk
gcgcgccccagaacc

SEQ ID NO: 21245 - DNA, 15 bp, Artificial Sequence
  dgRNA
  Ryk
agaaccaggcgctct

SEQ ID NO: 21246 - DNA, 15 bp, Artificial Sequence
  dgRNA
  Ryk
ccaggcgctctcggt

SEQ ID NO: 21247 - DNA, 15 bp, Artificial Sequence
  dgRNA
  Ryk
caggcgctctcggtc

SEQ ID NO: 21248 - DNA, 15 bp, Artificial Sequence
  dgRNA
  Ptk2b
gatgttttatcaaac

SEQ ID NO: 21249 - DNA, 15 bp, Artificial Sequence
  dgRNA
  Ptk2b
cccagtcgaagcagc

SEQ ID NO: 21250 - DNA, 15 bp, Artificial Sequence
  dgRNA
  Ptk2b
agtcgaagcagctgg

SEQ ID NO: 21251 - DNA, 15 bp, Artificial Sequence
  dgRNA
  Ptk2b
ctgttgtatccatcc

SEQ ID NO: 21252 - DNA, 15 bp, Artificial Sequence
  dgRNA
  Alg13
atctcagacttatca

SEQ ID NO: 21253 - DNA, 15 bp, Artificial Sequence
  dgRNA
  Alg13
ctgcgctacctgcaa

SEQ ID NO: 21254 - DNA, 15 bp, Artificial Sequence
  dgRNA
  Alg13
tgcgctacctgcaaa

SEQ ID NO: 21255 - DNA, 15 bp, Artificial Sequence
  dgRNA
  Alg13
ggtataaagcattgc

SEQ ID NO: 21256 - DNA, 15 bp, Artificial Sequence
  dgRNA
  Plpp2
ctgcccctgcgcgcc

SEQ ID NO: 21257 - DNA, 15 bp, Artificial Sequence
  dgRNA
  Plpp2
tgcccctgcgcgccc

SEQ ID NO: 21258 - DNA, 15 bp, Artificial Sequence
  dgRNA
  Plpp2
tgcgcgcccgggtca

SEQ ID NO: 21259 - DNA, 15 bp, Artificial Sequence
  dgRNA
  Plpp2
gcgcccgggtcaagg

SEQ ID NO: 21260 - DNA, 15 bp, Artificial Sequence
  dgRNA
  Nrl
gcacctgtctttcac

SEQ ID NO: 21261 - DNA, 15 bp, Artificial Sequence
  dgRNA
  Nrl
attggatgaggctcg

SEQ ID NO: 21262 - DNA, 15 bp, Artificial Sequence
  dgRNA
  Nrl
accacagatgatctc

SEQ ID NO: 21263 - DNA, 15 bp, Artificial Sequence
  dgRNA
  Nrl
ccttgttctgaatac

SEQ ID NO: 21264 - DNA, 15 bp, Artificial Sequence
  dgRNA
  Prkch
cacgcccccggggtc

SEQ ID NO: 21265 - DNA, 15 bp, Artificial Sequence
  dgRNA
  Prkch
cccccggggtccgga

SEQ ID NO: 21266 - DNA, 15 bp, Artificial Sequence
  dgRNA
  Prkch
ggggtccggaaggcg

SEQ ID NO: 21267 - DNA, 15 bp, Artificial Sequence
  dgRNA
  Prkch
cgtggcagcccgcac

SEQ ID NO: 21268 - DNA, 15 bp, Artificial Sequence
  dgRNA
  Wdr53
accgcccgcctcgcc

SEQ ID NO: 21269 - DNA, 15 bp, Artificial Sequence
  dgRNA
  Wdr53
gcccgcgacgcgccc

SEQ ID NO: 21270 - DNA, 15 bp, Artificial Sequence
  dgRNA
  Wdr53
cccgcgacgcgcccc

SEQ ID NO: 21271 - DNA, 15 bp, Artificial Sequence
  dgRNA
  Wdr53
ccgccatgcgagttg

SEQ ID NO: 21272 - DNA, 15 bp, Artificial Sequence
  dgRNA
  Acox3
gcgtccgcgtttccc

SEQ ID NO: 21273 - DNA, 15 bp, Artificial Sequence
  dgRNA
  Acox3
gcgtttccctggcga

SEQ ID NO: 21274 - DNA, 15 bp, Artificial Sequence
  dgRNA
  Acox3
cgtttccctggcgac

SEQ ID NO: 21275 - DNA, 15 bp, Artificial Sequence
  dgRNA
  Acox3
gtttccctggcgacg

SEQ ID NO: 21276 - DNA, 15 bp, Artificial Sequence
  dgRNA
  Rasl10a
acaaggcgacccgcc

SEQ ID NO: 21277 - DNA, 15 bp, Artificial Sequence
  dgRNA
  Rasl10a
ccgcctggcagtcac

SEQ ID NO: 21278 - DNA, 15 bp, Artificial Sequence
  dgRNA
  Rasl10a
cgcctggcagtcact

SEQ ID NO: 21279 - DNA, 15 bp, Artificial Sequence
  dgRNA
  Rasl10a
ggccgcgaccctccc

SEQ ID NO: 21280 - DNA, 15 bp, Artificial Sequence
  dgRNA
  Olfr148
gtattgtgtaatgat

SEQ ID NO: 21281 - DNA, 15 bp, Artificial Sequence
  dgRNA
  Olfr148
ttcataaccatgaac

SEQ ID NO: 21282 - DNA, 15 bp, Artificial Sequence
  dgRNA
  Olfr148
ctagatacatcatgc

SEQ ID NO: 21283 - DNA, 15 bp, Artificial Sequence
  dgRNA
  Olfr148
ctcttggcctgttca

SEQ ID NO: 21284 - DNA, 15 bp, Artificial Sequence
  dgRNA
  Madcam1
tgcctcctacaaagt

SEQ ID NO: 21285 - DNA, 15 bp, Artificial Sequence
  dgRNA
  Madcam1
gcctcctacaaagtg

SEQ ID NO: 21286 - DNA, 15 bp, Artificial Sequence
  dgRNA
  Madcam1
cctcctacaaagtgg

SEQ ID NO: 21287 - DNA, 15 bp, Artificial Sequence
  dgRNA
  Madcam1
cccccactttgtagg

SEQ ID NO: 21288 - DNA, 15 bp, Artificial Sequence
  dgRNA
  5330417C22Rik
ccgcgctgagcgaag

SEQ ID NO: 21289 - DNA, 15 bp, Artificial Sequence
  dgRNA
  5330417C22Rik
gttgtcaaggcgaca

SEQ ID NO: 21290 - DNA, 15 bp, Artificial Sequence
  dgRNA
  5330417C22Rik
caaggcgacatggat

SEQ ID NO: 21291 - DNA, 15 bp, Artificial Sequence
  dgRNA
  5330417C22Rik
ggcgacatggatagg

SEQ ID NO: 21292 - DNA, 15 bp, Artificial Sequence
  dgRNA
  Shisa8
tccgacaacagtttg

SEQ ID NO: 21293 - DNA, 15 bp, Artificial Sequence
  dgRNA
  Shisa8
ccgacaacagtttga

SEQ ID NO: 21294 - DNA, 15 bp, Artificial Sequence
  dgRNA
  Shisa8
acaacagtttgaggg

SEQ ID NO: 21295 - DNA, 15 bp, Artificial Sequence
  dgRNA
  Shisa8
tccctcccggcgcag

SEQ ID NO: 21296 - DNA, 15 bp, Artificial Sequence
  dgRNA
  Spire2
ctcgcccctccctac

SEQ ID NO: 21297 - DNA, 15 bp, Artificial Sequence
  dgRNA
  Spire2
ctgcatctgcccgcg

SEQ ID NO: 21298 - DNA, 15 bp, Artificial Sequence
  dgRNA
  Spire2
tgcatctgcccgcga

SEQ ID NO: 21299 - DNA, 15 bp, Artificial Sequence
  dgRNA
  Spire2
gcatctgcccgcgag

SEQ ID NO: 21300 - DNA, 15 bp, Artificial Sequence
  dgRNA
  Tmem87a
tgctagttcacctcc

SEQ ID NO: 21301 - DNA, 15 bp, Artificial Sequence
  dgRNA
  Tmem87a
ccaggccacgatcgc

SEQ ID NO: 21302 - DNA, 15 bp, Artificial Sequence
  dgRNA
  Tmem87a
caggccacgatcgca

SEQ ID NO: 21303 - DNA, 15 bp, Artificial Sequence
  dgRNA
  Tmem87a
cgatcgcagggaaac

SEQ ID NO: 21304 - DNA, 15 bp, Artificial Sequence
  dgRNA
  Bahcc1
ccggcgccagcctat

SEQ ID NO: 21305 - DNA, 15 bp, Artificial Sequence
  dgRNA
  Bahcc1
cggcgccagcctatt

SEQ ID NO: 21306 - DNA, 15 bp, Artificial Sequence
  dgRNA
  Bahcc1
cgccagcctattggg

SEQ ID NO: 21307 - DNA, 15 bp, Artificial Sequence
  dgRNA
  Bahcc1
tttacgccgaatgag

SEQ ID NO: 21308 - DNA, 15 bp, Artificial Sequence
  dgRNA
  Set
tcccgcctctcgtcc

SEQ ID NO: 21309 - DNA, 15 bp, Artificial Sequence
  dgRNA
  Set
cgccgccacccgcca

SEQ ID NO: 21310 - DNA, 15 bp, Artificial Sequence
  dgRNA
  Set
cctgccccgcggccg

SEQ ID NO: 21311 - DNA, 15 bp, Artificial Sequence
  dgRNA
  Set
cggccaatcgctgta

SEQ ID NO: 21312 - DNA, 15 bp, Artificial Sequence
  dgRNA
  Picalm
cgagtcacgtgacct

SEQ ID NO: 21313 - DNA, 15 bp, Artificial Sequence
  dgRNA
  Picalm
gagtcacgtgaccta

SEQ ID NO: 21314 - DNA, 15 bp, Artificial Sequence
  dgRNA
  Picalm
agtcacgtgacctag

SEQ ID NO: 21315 - DNA, 15 bp, Artificial Sequence
  dgRNA
  Picalm
gacctaggggcagcc

SEQ ID NO: 21316 - DNA, 15 bp, Artificial Sequence
  dgRNA
  Sdr16c5
ctatgaaactttgat

SEQ ID NO: 21317 - DNA, 15 bp, Artificial Sequence
  dgRNA
  Sdr16c5
ctgcccttttcaaac

SEQ ID NO: 21318 - DNA, 15 bp, Artificial Sequence
  dgRNA
  Sdr16c5
tcctacatccagcct

SEQ ID NO: 21319 - DNA, 15 bp, Artificial Sequence
  dgRNA
  Sdr16c5
tttcatagggtttag

SEQ ID NO: 21320 - DNA, 15 bp, Artificial Sequence
  dgRNA
  Rpa3
ctgcccgccgggttt

SEQ ID NO: 21321 - DNA, 15 bp, Artificial Sequence
  dgRNA
  Rpa3
acgccgcgcgtcact

SEQ ID NO: 21322 - DNA, 15 bp, Artificial Sequence
  dgRNA
  Rpa3
aaccagatgctcccg

SEQ ID NO: 21323 - DNA, 15 bp, Artificial Sequence
  dgRNA
  Rpa3
tcccgtggatttgat

SEQ ID NO: 21324 - DNA, 15 bp, Artificial Sequence
  dgRNA
  Lep
ccaaacttgcactcg

SEQ ID NO: 21325 - DNA, 15 bp, Artificial Sequence
  dgRNA
  Lep
caaacttgcactcga

SEQ ID NO: 21326 - DNA, 15 bp, Artificial Sequence
  dgRNA
  Lep
ttgcactcgagggcg

SEQ ID NO: 21327 - DNA, 15 bp, Artificial Sequence
  dgRNA
  Lep
tgaagttctccctcg

SEQ ID NO: 21328 - DNA, 15 bp, Artificial Sequence
  dgRNA
  Khdc1b
aagttcttttcgaat

SEQ ID NO: 21329 - DNA, 15 bp, Artificial Sequence
  dgRNA
  Khdc1b
agttcttttcgaatg

SEQ ID NO: 21330 - DNA, 15 bp, Artificial Sequence
  dgRNA
  Khdc1b
ggggaaagtactgat

SEQ ID NO: 21331 - DNA, 15 bp, Artificial Sequence
  dgRNA
  Olfr827
ctgtgtaaacttatt

SEQ ID NO: 21332 - DNA, 15 bp, Artificial Sequence
  dgRNA
  Olfr827
atagctgattattta

SEQ ID NO: 21333 - DNA, 15 bp, Artificial Sequence
  dgRNA
  Olfr827
tagctgattatttat

SEQ ID NO: 21334 - DNA, 15 bp, Artificial Sequence
  dgRNA
  Ttc22
gcccttgccacttac

SEQ ID NO: 21335 - DNA, 15 bp, Artificial Sequence
  dgRNA
  Ttc22
tgtgagcctcccgtt

SEQ ID NO: 21336 - DNA, 15 bp, Artificial Sequence
  dgRNA
  Ttc22
gtctagcagcgaaag

SEQ ID NO: 21337 - DNA, 15 bp, Artificial Sequence
  dgRNA
  Ttc22
agcggaaacacctac

SEQ ID NO: 21338 - DNA, 15 bp, Artificial Sequence
  dgRNA
  Izumo3
cctagatgttaagta

SEQ ID NO: 21339 - DNA, 15 bp, Artificial Sequence
  dgRNA
  Izumo3
ctagatgttaagtat

SEQ ID NO: 21340 - DNA, 15 bp, Artificial Sequence
  dgRNA
  Izumo3
tacttaacatctagg

SEQ ID NO: 21341 - DNA, 15 bp, Artificial Sequence
  dgRNA
  Fmnl1
cccgctccctcggac

SEQ ID NO: 21342 - DNA, 15 bp, Artificial Sequence
  dgRNA
  Fmnl1
ccgctccctcggacg

SEQ ID NO: 21343 - DNA, 15 bp, Artificial Sequence
  dgRNA
  Fmnl1
acggggccgccgcga

SEQ ID NO: 21344 - DNA, 15 bp, Artificial Sequence
  dgRNA
  Fmnl1
cggggccgccgcgat

SEQ ID NO: 21345 - DNA, 15 bp, Artificial Sequence
  dgRNA
  Slc5a4a
gctcatcctcaaccc

SEQ ID NO: 21346 - DNA, 15 bp, Artificial Sequence
  dgRNA
  Slc5a4a
caattccactcaggc

SEQ ID NO: 21347 - DNA, 15 bp, Artificial Sequence
  dgRNA
  Slc5a4a
agagcctgaacgcac

SEQ ID NO: 21348 - DNA, 15 bp, Artificial Sequence
  dgRNA
  Slc5a4a
tagtgccagcctgag

SEQ ID NO: 21349 - DNA, 15 bp, Artificial Sequence
  dgRNA
  Asic2
ccccatgcttaacac

SEQ ID NO: 21350 - DNA, 15 bp, Artificial Sequence
  dgRNA
  Asic2
cccatgcttaacacg

SEQ ID NO: 21351 - DNA, 15 bp, Artificial Sequence
  dgRNA
  Asic2
cggggcattatgcgc

SEQ ID NO: 21352 - DNA, 15 bp, Artificial Sequence
  dgRNA
  Asic2
tatgcgctggttaac

SEQ ID NO: 21353 - DNA, 15 bp, Artificial Sequence
  dgRNA
  Nrip2
tgcgcccccacacaa

SEQ ID NO: 21354 - DNA, 15 bp, Artificial Sequence
  dgRNA
  Gstt2
ttctggtgcccgata

SEQ ID NO: 21355 - DNA, 15 bp, Artificial Sequence
  dgRNA
  Gstt2
gcccgatatggccca

SEQ ID NO: 21356 - DNA, 15 bp, Artificial Sequence
  dgRNA
  Gstt2
cccgatatggcccac

SEQ ID NO: 21357 - DNA, 15 bp, Artificial Sequence
  dgRNA
  Gstt2
aaagccagtgataat

SEQ ID NO: 21358 - DNA, 15 bp, Artificial Sequence
  dgRNA
  Crygd
ccacaatgaatcccg

SEQ ID NO: 21359 - DNA, 15 bp, Artificial Sequence
  dgRNA
  Crygd
cacaatgaatcccgt

SEQ ID NO: 21360 - DNA, 15 bp, Artificial Sequence
  dgRNA
  Crygd
cactctggagtattc

SEQ ID NO: 21361 - DNA, 15 bp, Artificial Sequence
  dgRNA
  Crygd
attcattgtgggctt

SEQ ID NO: 21362 - DNA, 15 bp, Artificial Sequence
  dgRNA
  Cdc42se1
ctagcacagacagtt

SEQ ID NO: 21363 - DNA, 15 bp, Artificial Sequence
  dgRNA
  Cdc42se1
acagttggggtgccg

SEQ ID NO: 21364 - DNA, 15 bp, Artificial Sequence
  dgRNA
  Cdc42se1
ggttgtccccgagcg

SEQ ID NO: 21365 - DNA, 15 bp, Artificial Sequence
  dgRNA
  Cdc42se1
ttgccgctgtccccg

SEQ ID NO: 21366 - DNA, 15 bp, Artificial Sequence
  dgRNA
  BC052040
gacgcaaaaagaatt

SEQ ID NO: 21367 - DNA, 15 bp, Artificial Sequence
  dgRNA
  BC052040
gcagccgccacttcc

SEQ ID NO: 21368 - DNA, 15 bp, Artificial Sequence
  dgRNA
  BC052040
gcggctagttgcctt

SEQ ID NO: 21369 - DNA, 15 bp, Artificial Sequence
  dgRNA
  BC052040
tagttgccttcggcc

SEQ ID NO: 21370 - DNA, 15 bp, Artificial Sequence
  dgRNA
  Slc14a1
tttctcagtaatagt

SEQ ID NO: 21371 - DNA, 15 bp, Artificial Sequence
  dgRNA
  Slc14a1
tctcagtaatagttg

SEQ ID NO: 21372 - DNA, 15 bp, Artificial Sequence
  dgRNA
  Slc14a1
tgagccggatgtttc

SEQ ID NO: 21373 - DNA, 15 bp, Artificial Sequence
  dgRNA
  Sin3a
atccttcacacaatc

SEQ ID NO: 21374 - DNA, 15 bp, Artificial Sequence
  dgRNA
  Sin3a
gactgttcaagggga

SEQ ID NO: 21375 - DNA, 15 bp, Artificial Sequence
  dgRNA
  Sin3a
ttccagattgtgtga

SEQ ID NO: 21376 - DNA, 15 bp, Artificial Sequence
  dgRNA
  Sin3a
acttacgttcacaga

SEQ ID NO: 21377 - DNA, 15 bp, Artificial Sequence
  dgRNA
  Lztfl1
gccattggcaacggc

SEQ ID NO: 21378 - DNA, 15 bp, Artificial Sequence
  dgRNA
  Lztfl1
ggcaggcaccgcccc

SEQ ID NO: 21379 - DNA, 15 bp, Artificial Sequence
  dgRNA
  Lztfl1
cgccccaggttagcg

SEQ ID NO: 21380 - DNA, 15 bp, Artificial Sequence
  dgRNA
  Lztfl1
tagcgtggcaagaaa

SEQ ID NO: 21381 - DNA, 15 bp, Artificial Sequence
  dgRNA
  Psg20
gacagacccatatcg

SEQ ID NO: 21382 - DNA, 15 bp, Artificial Sequence
  dgRNA
  Psg20
tatcgaggagtcagc

SEQ ID NO: 21383 - DNA, 15 bp, Artificial Sequence
  dgRNA
  Psg20
ctgactcctcgatat

SEQ ID NO: 21384 - DNA, 15 bp, Artificial Sequence
  dgRNA
  Psg20
gctgactcctcgata

SEQ ID NO: 21385 - DNA, 15 bp, Artificial Sequence
  dgRNA
  Tmcc3
atctgtgcaatgatc

SEQ ID NO: 21386 - DNA, 15 bp, Artificial Sequence
  dgRNA
  Tmcc3
gtagcagagatttgc

SEQ ID NO: 21387 - DNA, 15 bp, Artificial Sequence
  dgRNA
  Tmcc3
cctgagctttaagct

SEQ ID NO: 21388 - DNA, 15 bp, Artificial Sequence
  dgRNA
  Tmcc3
ctggggtgcacattt

SEQ ID NO: 21389 - DNA, 15 bp, Artificial Sequence
  dgRNA
  Adora2a
gcttagctccgataa

SEQ ID NO: 21390 - DNA, 15 bp, Artificial Sequence
  dgRNA
  Adora2a
cttagctccgataaa

SEQ ID NO: 21391 - DNA, 15 bp, Artificial Sequence
  dgRNA
  Adora2a
cagcctaatgccttg

SEQ ID NO: 21392 - DNA, 15 bp, Artificial Sequence
  dgRNA
  Adora2a
gaggagccaccggag

SEQ ID NO: 21393 - DNA, 15 bp, Artificial Sequence
  dgRNA
  Dll3
ttcctgagcccaaat

SEQ ID NO: 21394 - DNA, 15 bp, Artificial Sequence
  dgRNA
  Dll3
ccagctgcggcccaa

SEQ ID NO: 21395 - DNA, 15 bp, Artificial Sequence
  dgRNA
  Dll3
agctgcggcccaagg

SEQ ID NO: 21396 - DNA, 15 bp, Artificial Sequence
  dgRNA
  Dll3
tgcggcccaaggggg

SEQ ID NO: 21397 - DNA, 15 bp, Artificial Sequence
  dgRNA
  Dync1i2
aaagcggaaacgctt

SEQ ID NO: 21398 - DNA, 15 bp, Artificial Sequence
  dgRNA
  Dync1i2
aagcggaaacgcttc

SEQ ID NO: 21399 - DNA, 15 bp, Artificial Sequence
  dgRNA
  Dync1i2
aaacgcttcgggccc

SEQ ID NO: 21400 - DNA, 15 bp, Artificial Sequence
  dgRNA
  Dync1i2
aacgcttcgggcccc

SEQ ID NO: 21401 - DNA, 15 bp, Artificial Sequence
  dgRNA
  Tpr
gagagaactcgagtt

SEQ ID NO: 21402 - DNA, 15 bp, Artificial Sequence
  dgRNA
  Tpr
agagaactcgagtta

SEQ ID NO: 21403 - DNA, 15 bp, Artificial Sequence
  dgRNA
  Tpr
agtagctaccttcaa

SEQ ID NO: 21404 - DNA, 15 bp, Artificial Sequence
  dgRNA
  Tpr
ttcctactccaaacg

SEQ ID NO: 21405 - DNA, 15 bp, Artificial Sequence
  dgRNA
  Irf5
aaaggagcccggcga

SEQ ID NO: 21406 - DNA, 15 bp, Artificial Sequence
  dgRNA
  Irf5
aaggagcccggcgag

SEQ ID NO: 21407 - DNA, 15 bp, Artificial Sequence
  dgRNA
  Irf5
gcgccgagctgtctg

SEQ ID NO: 21408 - DNA, 15 bp, Artificial Sequence
  dgRNA
  Irf5
ctgtctgcggtctcg

SEQ ID NO: 21409 - DNA, 15 bp, Artificial Sequence
  dgRNA
  Tdrd12
atactgctaaagact

SEQ ID NO: 21410 - DNA, 15 bp, Artificial Sequence
  dgRNA
  Tdrd12
atgcagtcactccat

SEQ ID NO: 21411 - DNA, 15 bp, Artificial Sequence
  dgRNA
  Tdrd12
tgcagtcactccatg

SEQ ID NO: 21412 - DNA, 15 bp, Artificial Sequence
  dgRNA
  Tdrd12
cagtcactccatggg

SEQ ID NO: 21413 - DNA, 15 bp, Artificial Sequence
  dgRNA
  Tnnt2
ccacatgagcttata

SEQ ID NO: 21414 - DNA, 15 bp, Artificial Sequence
  dgRNA
  Tnnt2
tgagcttatatggcg

SEQ ID NO: 21415 - DNA, 15 bp, Artificial Sequence
  dgRNA
  Tnnt2
gagcttatatggcgt

SEQ ID NO: 21416 - DNA, 15 bp, Artificial Sequence
  dgRNA
  Tnnt2
agcttatatggcgtg

SEQ ID NO: 21417 - DNA, 15 bp, Artificial Sequence
  dgRNA
  Usp50
aacacgttagaacct

SEQ ID NO: 21418 - DNA, 15 bp, Artificial Sequence
  dgRNA
  Usp50
agaaccttggtatga

SEQ ID NO: 21419 - DNA, 15 bp, Artificial Sequence
  dgRNA
  Usp50
gaaccttggtatgaa

SEQ ID NO: 21420 - DNA, 15 bp, Artificial Sequence
  dgRNA
  Usp50
tgacaattgtgatgc

SEQ ID NO: 21421 - DNA, 15 bp, Artificial Sequence
  dgRNA
  Mgat1
gagcagtccaccagg

SEQ ID NO: 21422 - DNA, 15 bp, Artificial Sequence
  dgRNA
  Mgat1
ggagcagtccaccag

SEQ ID NO: 21423 - DNA, 15 bp, Artificial Sequence
  dgRNA
  Mgat1
cgggagcagtccacc

SEQ ID NO: 21424 - DNA, 15 bp, Artificial Sequence
  dgRNA
  Ckap2
acaagcccgctccaa

SEQ ID NO: 21425 - DNA, 15 bp, Artificial Sequence
  dgRNA
  Ckap2
cgtcatccatccagt

SEQ ID NO: 21426 - DNA, 15 bp, Artificial Sequence
  dgRNA
  Ckap2
gtcatccatccagtt

SEQ ID NO: 21427 - DNA, 15 bp, Artificial Sequence
  dgRNA
  Ckap2
tttgaaatttctcgc

SEQ ID NO: 21428 - DNA, 15 bp, Artificial Sequence
  dgRNA
  Nek1
tccgttcgcttcgcc

SEQ ID NO: 21429 - DNA, 15 bp, Artificial Sequence
  dgRNA
  Nek1
gccccccgcagatcc

SEQ ID NO: 21430 - DNA, 15 bp, Artificial Sequence
  dgRNA
  Nek1
tgcagcgccacaagt

SEQ ID NO: 21431 - DNA, 15 bp, Artificial Sequence
  dgRNA
  Nek1
tagcggggagcgtga

SEQ ID NO: 21432 - DNA, 15 bp, Artificial Sequence
  dgRNA
  Ankrd49
gacatagaatttatc

SEQ ID NO: 21433 - DNA, 15 bp, Artificial Sequence
  dgRNA
  Psma3
ggaacaagccgcaag

SEQ ID NO: 21434 - DNA, 15 bp, Artificial Sequence
  dgRNA
  Psma3
gagagcgcagccaat

SEQ ID NO: 21435 - DNA, 15 bp, Artificial Sequence
  dgRNA
  Psma3
tgcggcttgttccgt

SEQ ID NO: 21436 - DNA, 15 bp, Artificial Sequence
  dgRNA
  Psma3
ttgcggcttgttccg

SEQ ID NO: 21437 - DNA, 15 bp, Artificial Sequence
  dgRNA
  Rwdd1
acatcgagcgcagaa

SEQ ID NO: 21438 - DNA, 15 bp, Artificial Sequence
  dgRNA
  Rwdd1
gtccttcccgaacgc

SEQ ID NO: 21439 - DNA, 15 bp, Artificial Sequence
  dgRNA
  Rwdd1
ttcccgaacgccggg

SEQ ID NO: 21440 - DNA, 15 bp, Artificial Sequence
  dgRNA
  Rwdd1
tcccgaacgccgggc

SEQ ID NO: 21441 - DNA, 15 bp, Artificial Sequence
  dgRNA
  Cacna2d2
ccttaagcctgttga

SEQ ID NO: 21442 - DNA, 15 bp, Artificial Sequence
  dgRNA
  Cacna2d2
aggtcgagtcccaga

SEQ ID NO: 21443 - DNA, 15 bp, Artificial Sequence
  dgRNA
  Cacna2d2
ggtcgagtcccagaa

SEQ ID NO: 21444 - DNA, 15 bp, Artificial Sequence
  dgRNA
  Cacna2d2
atgtgcaactgccta

SEQ ID NO: 21445 - DNA, 15 bp, Artificial Sequence
  dgRNA
  Armc12
ctgattctagtaccc

SEQ ID NO: 21446 - DNA, 15 bp, Artificial Sequence
  dgRNA
  Armc12
ctagtaccctggttc

SEQ ID NO: 21447 - DNA, 15 bp, Artificial Sequence
  dgRNA
  Armc12
tagtaccctggttct

SEQ ID NO: 21448 - DNA, 15 bp, Artificial Sequence
  dgRNA
  Armc12
actctaggggtagaa

SEQ ID NO: 21449 - DNA, 15 bp, Artificial Sequence
  dgRNA
  Aplp2
ggcggggccacgagg

SEQ ID NO: 21450 - DNA, 15 bp, Artificial Sequence
  dgRNA
  Aplp2
cgagggggcacgcgc

SEQ ID NO: 21451 - DNA, 15 bp, Artificial Sequence
  dgRNA
  Aplp2
gagggggcacgcgct

SEQ ID NO: 21452 - DNA, 15 bp, Artificial Sequence
  dgRNA
  Aplp2
ggggcacgcgctggg

SEQ ID NO: 21453 - DNA, 15 bp, Artificial Sequence
  dgRNA
  Mrpl41
gagcgaccgctccat

SEQ ID NO: 21454 - DNA, 15 bp, Artificial Sequence
  dgRNA
  Mrpl41
cgcccgatccacatc

SEQ ID NO: 21455 - DNA, 15 bp, Artificial Sequence
  dgRNA
  Mrpl41
cgcgactgcgcggat

SEQ ID NO: 21456 - DNA, 15 bp, Artificial Sequence
  dgRNA
  Mrpl41
cgcaccccctccgct

SEQ ID NO: 21457 - DNA, 15 bp, Artificial Sequence
  dgRNA
  Rsl1
cgtgcgtctttctta

SEQ ID NO: 21458 - DNA, 15 bp, Artificial Sequence
  dgRNA
  Rsl1
gtgaagtctactgtt

SEQ ID NO: 21459 - DNA, 15 bp, Artificial Sequence
  dgRNA
  1-Mar
tccagtttttgagca

SEQ ID NO: 21460 - DNA, 15 bp, Artificial Sequence
  dgRNA
  1-Mar
atggcagatttccac

SEQ ID NO: 21461 - DNA, 15 bp, Artificial Sequence
  dgRNA
  1-Mar
actggatgacatcat

SEQ ID NO: 21462 - DNA, 15 bp, Artificial Sequence
  dgRNA
  1-Mar
cccagtgagtgccgc

SEQ ID NO: 21463 - DNA, 15 bp, Artificial Sequence
  dgRNA
  Rasl2-9
agtgaaaatcagtcc

SEQ ID NO: 21464 - DNA, 15 bp, Artificial Sequence
  dgRNA
  Rasl2-9
gcagagcgcaacacg

SEQ ID NO: 21465 - DNA, 15 bp, Artificial Sequence
  dgRNA
  Rasl2-9
cagagcgcaacacga

SEQ ID NO: 21466 - DNA, 15 bp, Artificial Sequence
  dgRNA
  Rasl2-9
gcgcaacacgagggt

SEQ ID NO: 21467 - DNA, 15 bp, Artificial Sequence
  dgRNA
  Polr2b
ggccgtagcacgcag

SEQ ID NO: 21468 - DNA, 15 bp, Artificial Sequence
  dgRNA
  Polr2b
gtagcacgcagcggc

SEQ ID NO: 21469 - DNA, 15 bp, Artificial Sequence
  dgRNA
  Polr2b
acgcagcggccggcg

SEQ ID NO: 21470 - DNA, 15 bp, Artificial Sequence
  dgRNA
  Polr2b
gcagcggccggcgcg

SEQ ID NO: 21471 - DNA, 15 bp, Artificial Sequence
  dgRNA
  Vmn1r232
accatcgcgtttcac

SEQ ID NO: 21472 - DNA, 15 bp, Artificial Sequence
  dgRNA
  Vmn1r232
tcgcgtttcacagga

SEQ ID NO: 21473 - DNA, 15 bp, Artificial Sequence
  dgRNA
  Vmn1r232
tcctgtgaaacgcga

SEQ ID NO: 21474 - DNA, 15 bp, Artificial Sequence
  dgRNA
  Fam98a
gagctccgcgccccc

SEQ ID NO: 21475 - DNA, 15 bp, Artificial Sequence
  dgRNA
  Fam98a
tcactaccccatact

SEQ ID NO: 21476 - DNA, 15 bp, Artificial Sequence
  dgRNA
  Fam98a
gggcacgcgcacacc

SEQ ID NO: 21477 - DNA, 15 bp, Artificial Sequence
  dgRNA
  Fam98a
tttcctcggccggtg

SEQ ID NO: 21478 - DNA, 15 bp, Artificial Sequence
  dgRNA
  Gstk1
ttcctcatccgctct

SEQ ID NO: 21479 - DNA, 15 bp, Artificial Sequence
  dgRNA
  Gstk1
acccgtgtacacccc

SEQ ID NO: 21480 - DNA, 15 bp, Artificial Sequence
  dgRNA
  Gstk1
cccgtgtacacccct

SEQ ID NO: 21481 - DNA, 15 bp, Artificial Sequence
  dgRNA
  Gstk1
ctgggccagccctat

SEQ ID NO: 21482 - DNA, 15 bp, Artificial Sequence
  dgRNA
  Smim14
tattctatgctgcac

SEQ ID NO: 21483 - DNA, 15 bp, Artificial Sequence
  dgRNA
  Smim14
tatgctgcactggct

SEQ ID NO: 21484 - DNA, 15 bp, Artificial Sequence
  dgRNA
  Smim14
agcatagaatatgtc

SEQ ID NO: 21485 - DNA, 15 bp, Artificial Sequence
  dgRNA
  Zfp623
cccacgtgcgcaaac

SEQ ID NO: 21486 - DNA, 15 bp, Artificial Sequence
  dgRNA
  Zfp623
ccacgtgcgcaaaca

SEQ ID NO: 21487 - DNA, 15 bp, Artificial Sequence
  dgRNA
  Zfp623
accgcgtctgcgcac

SEQ ID NO: 21488 - DNA, 15 bp, Artificial Sequence
  dgRNA
  Zfp623
ccgcgtctgcgcact

SEQ ID NO: 21489 - DNA, 15 bp, Artificial Sequence
  dgRNA
  Tssc4
tcaaccctttgcgat

SEQ ID NO: 21490 - DNA, 15 bp, Artificial Sequence
  dgRNA
  Tssc4
attggcagttagccc

SEQ ID NO: 21491 - DNA, 15 bp, Artificial Sequence
  dgRNA
  Tssc4
gtattgtgggaaccg

SEQ ID NO: 21492 - DNA, 15 bp, Artificial Sequence
  dgRNA
  Tssc4
ctttttcgtcatttc

SEQ ID NO: 21493 - DNA, 15 bp, Artificial Sequence
  dgRNA
  Necab1
ctgtcatgtaaagtg

SEQ ID NO: 21494 - DNA, 15 bp, Artificial Sequence
  dgRNA
  Necab1
atgtaaagtgcggtg

SEQ ID NO: 21495 - DNA, 15 bp, Artificial Sequence
  dgRNA
  Necab1
taaagtgcggtgtgg

SEQ ID NO: 21496 - DNA, 15 bp, Artificial Sequence
  dgRNA
  Necab1
aaagtgcggtgtggt

SEQ ID NO: 21497 - DNA, 15 bp, Artificial Sequence
  dgRNA
  Ddx56
gcccacgtcactctg

SEQ ID NO: 21498 - DNA, 15 bp, Artificial Sequence
  dgRNA
  Ddx56
cccacgtcactctgt

SEQ ID NO: 21499 - DNA, 15 bp, Artificial Sequence
  dgRNA
  Ddx56
gcatccacaattcgg

SEQ ID NO: 21500 - DNA, 15 bp, Artificial Sequence
  dgRNA
  Ddx56
catccacaattcgga

SEQ ID NO: 21501 - DNA, 15 bp, Artificial Sequence
  dgRNA
  Pex19
aatggcggtcctgca

SEQ ID NO: 21502 - DNA, 15 bp, Artificial Sequence
  dgRNA
  Pex19
gtagaacgatattat

SEQ ID NO: 21503 - DNA, 15 bp, Artificial Sequence
  dgRNA
  Pex19
atgtggtggcgccag

SEQ ID NO: 21504 - DNA, 15 bp, Artificial Sequence
  dgRNA
  Pex19
caagcactcggctac

SEQ ID NO: 21505 - DNA, 15 bp, Artificial Sequence
  dgRNA
  Olfr1245
atataatccactgac

SEQ ID NO: 21506 - DNA, 15 bp, Artificial Sequence
  dgRNA
  Olfr1245
tttatttccctacga

SEQ ID NO: 21507 - DNA, 15 bp, Artificial Sequence
  dgRNA
  Olfr1245
tagtaaacacgtttt

SEQ ID NO: 21508 - DNA, 15 bp, Artificial Sequence
  dgRNA
  Nprl2
gccaccgctccgtta

SEQ ID NO: 21509 - DNA, 15 bp, Artificial Sequence
  dgRNA
  Nprl2
gagtagcttcacttc

SEQ ID NO: 21510 - DNA, 15 bp, Artificial Sequence
  dgRNA
  Nprl2
ccacccgagacttcc

SEQ ID NO: 21511 - DNA, 15 bp, Artificial Sequence
  dgRNA
  Nprl2
cacccgagacttcct

SEQ ID NO: 21512 - DNA, 15 bp, Artificial Sequence
  dgRNA
  Mak
ttgcacagcttcaag

SEQ ID NO: 21513 - DNA, 15 bp, Artificial Sequence
  dgRNA
  Mak
ccaaaaaagattgac

SEQ ID NO: 21514 - DNA, 15 bp, Artificial Sequence
  dgRNA
  Mak
tagaatagattagcc

SEQ ID NO: 21515 - DNA, 15 bp, Artificial Sequence
  dgRNA
  Mak
gactttgcgaaagcg

SEQ ID NO: 21516 - DNA, 15 bp, Artificial Sequence
  dgRNA
  Syt14
ttgtggatatttcgg

SEQ ID NO: 21517 - DNA, 15 bp, Artificial Sequence
  dgRNA
  Syt14
tggatatttcggggg

SEQ ID NO: 21518 - DNA, 15 bp, Artificial Sequence
  dgRNA
  Syt14
ggatatttcgggggc

SEQ ID NO: 21519 - DNA, 15 bp, Artificial Sequence
  dgRNA
  Syt14
gatatttcgggggcg

SEQ ID NO: 21520 - DNA, 15 bp, Artificial Sequence
  dgRNA
  Rpl23a
aaggtggcgcatgct

SEQ ID NO: 21521 - DNA, 15 bp, Artificial Sequence
  dgRNA
  Rpl23a
tggtctcccactcta

SEQ ID NO: 21522 - DNA, 15 bp, Artificial Sequence
  dgRNA
  Rpl23a
aaatgtggcgttttt

SEQ ID NO: 21523 - DNA, 15 bp, Artificial Sequence
  dgRNA
  Rpl23a
tttaattccctagag

SEQ ID NO: 21524 - DNA, 15 bp, Artificial Sequence
  dgRNA
  Arl8a
ccatcacgctcctcc

SEQ ID NO: 21525 - DNA, 15 bp, Artificial Sequence
  dgRNA
  Arl8a
tcctcccggccgccg

SEQ ID NO: 21526 - DNA, 15 bp, Artificial Sequence
  dgRNA
  Arl8a
cctcccggccgccgc

SEQ ID NO: 21527 - DNA, 15 bp, Artificial Sequence
  dgRNA
  Arl8a
cgcgggcgctggcct

SEQ ID NO: 21528 - DNA, 15 bp, Artificial Sequence
  dgRNA
  Car7
cgccatggccgcgcc

SEQ ID NO: 21529 - DNA, 15 bp, Artificial Sequence
  dgRNA
  Car7
cagcaaagccgccta

SEQ ID NO: 21530 - DNA, 15 bp, Artificial Sequence
  dgRNA
  Car7
caaagccgcctaagg

SEQ ID NO: 21531 - DNA, 15 bp, Artificial Sequence
  dgRNA
  Car7
aggccgccacccact

SEQ ID NO: 21532 - DNA, 15 bp, Artificial Sequence
  dgRNA
  Rnf19a
ccgcgggagggccgg

SEQ ID NO: 21533 - DNA, 15 bp, Artificial Sequence
  dgRNA
  Rnf19a
agagcgcgcagtgcg

SEQ ID NO: 21534 - DNA, 15 bp, Artificial Sequence
  dgRNA
  Rnf19a
gcgaggcgaacgtgc

SEQ ID NO: 21535 - DNA, 15 bp, Artificial Sequence
  dgRNA
  Rnf19a
aacgtgctggagcca

SEQ ID NO: 21536 - DNA, 15 bp, Artificial Sequence
  dgRNA
  Cep128
agtttcttccgggaa

SEQ ID NO: 21537 - DNA, 15 bp, Artificial Sequence
  dgRNA
  Cep128
cggtctttacagacc

SEQ ID NO: 21538 - DNA, 15 bp, Artificial Sequence
  dgRNA
  Cep128
tttcccggaagaaac

SEQ ID NO: 21539 - DNA, 15 bp, Artificial Sequence
  dgRNA
  Cep128
gccgcctggccctct

SEQ ID NO: 21540 - DNA, 15 bp, Artificial Sequence
  dgRNA
  Car1
aatcattctgatgcc

SEQ ID NO: 21541 - DNA, 15 bp, Artificial Sequence
  dgRNA
  Car1
ggcaactgacaactt

SEQ ID NO: 21542 - DNA, 15 bp, Artificial Sequence
  dgRNA
  Car1
ctttgggcagtcctt

SEQ ID NO: 21543 - DNA, 15 bp, Artificial Sequence
  dgRNA
  Car1
ttaatcagccaatct

SEQ ID NO: 21544 - DNA, 15 bp, Artificial Sequence
  dgRNA
  Serpind1
cgtgctgacacagat

SEQ ID NO: 21545 - DNA, 15 bp, Artificial Sequence
  dgRNA
  Serpind1
cactttgatcactta

SEQ ID NO: 21546 - DNA, 15 bp, Artificial Sequence
  dgRNA
  Klk5
gctgtccacacttac

SEQ ID NO: 21547 - DNA, 15 bp, Artificial Sequence
  dgRNA
  Klk5
tgagtgctaatggtg

SEQ ID NO: 21548 - DNA, 15 bp, Artificial Sequence
  dgRNA
  Klk5
ggaccggcagtggag

SEQ ID NO: 21549 - DNA, 15 bp, Artificial Sequence
  dgRNA
  Klk5
gggaccggcagtgga

SEQ ID NO: 21550 - DNA, 15 bp, Artificial Sequence
  dgRNA
  Nefh
tgcacttgtccgctc

SEQ ID NO: 21551 - DNA, 15 bp, Artificial Sequence
  dgRNA
  Nefh
tggtctgacctcggg

SEQ ID NO: 21552 - DNA, 15 bp, Artificial Sequence
  dgRNA
  Nefh
ccgcccctctcactg

SEQ ID NO: 21553 - DNA, 15 bp, Artificial Sequence
  dgRNA
  Nefh
tcactgcggagaagc

SEQ ID NO: 21554 - DNA, 15 bp, Artificial Sequence
  dgRNA
  Casr
aagtattatgatgag

SEQ ID NO: 21555 - DNA, 15 bp, Artificial Sequence
  dgRNA
  Casr
agcacaccctgatgc

SEQ ID NO: 21556 - DNA, 15 bp, Artificial Sequence
  dgRNA
  Casr
gcacaccctgatgct

SEQ ID NO: 21557 - DNA, 15 bp, Artificial Sequence
  dgRNA
  Casr
gggtgtgcttcttga

SEQ ID NO: 21558 - DNA, 15 bp, Artificial Sequence
  dgRNA
  Sorbs2
aattgatatactcat

SEQ ID NO: 21559 - DNA, 15 bp, Artificial Sequence
  dgRNA
  Sorbs2
attgatatactcata

SEQ ID NO: 21560 - DNA, 15 bp, Artificial Sequence
  dgRNA
  Sorbs2
atttgacaccacctt

SEQ ID NO: 21561 - DNA, 15 bp, Artificial Sequence
  dgRNA
  Sorbs2
gcaaccgcgggaggg

SEQ ID NO: 21562 - DNA, 15 bp, Artificial Sequence
  dgRNA
  Ankrd23
agggccagcataccc

SEQ ID NO: 21563 - DNA, 15 bp, Artificial Sequence
  dgRNA
  Ankrd23
cccctcgagcttaca

SEQ ID NO: 21564 - DNA, 15 bp, Artificial Sequence
  dgRNA
  Ankrd23
tctcaaaggtcacgc

SEQ ID NO: 21565 - DNA, 15 bp, Artificial Sequence
  dgRNA
  Ankrd23
gtcacgctggagttc

SEQ ID NO: 21566 - DNA, 15 bp, Artificial Sequence
  dgRNA
  Lepr
cctattggaggggta

SEQ ID NO: 21567 - DNA, 15 bp, Artificial Sequence
  dgRNA
  Lepr
ttcgcccaagctcct

SEQ ID NO: 21568 - DNA, 15 bp, Artificial Sequence
  dgRNA
  Lepr
gcgcagtcacctgag

SEQ ID NO: 21569 - DNA, 15 bp, Artificial Sequence
  dgRNA
  Lepr
tccaataggacagtc

SEQ ID NO: 21570 - DNA, 15 bp, Artificial Sequence
  dgRNA
  Dcbld1
gcgagcctgcgtgcc

SEQ ID NO: 21571 - DNA, 15 bp, Artificial Sequence
  dgRNA
  Dcbld1
ctagtgaatccgggc

SEQ ID NO: 21572 - DNA, 15 bp, Artificial Sequence
  dgRNA
  Dcbld1
gtgaatccgggcagg

SEQ ID NO: 21573 - DNA, 15 bp, Artificial Sequence
  dgRNA
  Dcbld1
tccgggcaggtggcg

SEQ ID NO: 21574 - DNA, 15 bp, Artificial Sequence
  dgRNA
  Mbtps2
tcacaagcacgctgc

SEQ ID NO: 21575 - DNA, 15 bp, Artificial Sequence
  dgRNA
  Mbtps2
aagcacgctgccgga

SEQ ID NO: 21576 - DNA, 15 bp, Artificial Sequence
  dgRNA
  Mbtps2
gagcttcgagcattc

SEQ ID NO: 21577 - DNA, 15 bp, Artificial Sequence
  dgRNA
  Mbtps2
gagcccgagcgtccc

SEQ ID NO: 21578 - DNA, 15 bp, Artificial Sequence
  dgRNA
  Hmces
tggccttacacattg

SEQ ID NO: 21579 - DNA, 15 bp, Artificial Sequence
  dgRNA
  Hmces
ttacacattgagggt

SEQ ID NO: 21580 - DNA, 15 bp, Artificial Sequence
  dgRNA
  Hmces
ttcagattccggcct

SEQ ID NO: 21581 - DNA, 15 bp, Artificial Sequence
  dgRNA
  Hmces
gattccggcctggga

SEQ ID NO: 21582 - DNA, 15 bp, Artificial Sequence
  dgRNA
  Olfr889
ctaccataaaatgta

SEQ ID NO: 21583 - DNA, 15 bp, Artificial Sequence
  dgRNA
  Olfr889
attttatggtagtta

SEQ ID NO: 21584 - DNA, 15 bp, Artificial Sequence
  dgRNA
  Krt81
gcacgccttacaaag

SEQ ID NO: 21585 - DNA, 15 bp, Artificial Sequence
  dgRNA
  Krt81
cgccttacaaagagg

SEQ ID NO: 21586 - DNA, 15 bp, Artificial Sequence
  dgRNA
  Krt81
cattctagagaggct

SEQ ID NO: 21587 - DNA, 15 bp, Artificial Sequence
  dgRNA
  Krt81
gaagctgccataaat

SEQ ID NO: 21588 - DNA, 15 bp, Artificial Sequence
  dgRNA
  Arglu1
ctcctaaggttttcg

SEQ ID NO: 21589 - DNA, 15 bp, Artificial Sequence
  dgRNA
  Arglu1
tcgtgggtcttgttg

SEQ ID NO: 21590 - DNA, 15 bp, Artificial Sequence
  dgRNA
  Arglu1
ttagttgccacgcag

SEQ ID NO: 21591 - DNA, 15 bp, Artificial Sequence
  dgRNA
  Arglu1
gttgccacgcagcgg

SEQ ID NO: 21592 - DNA, 15 bp, Artificial Sequence
  dgRNA
  Olfr608
ttaatgctgctgcac

SEQ ID NO: 21593 - DNA, 15 bp, Artificial Sequence
  dgRNA
  Olfr608
gataatcttctcagc

SEQ ID NO: 21594 - DNA, 15 bp, Artificial Sequence
  dgRNA
  Trmt13
gggttaaaccccagc

SEQ ID NO: 21595 - DNA, 15 bp, Artificial Sequence
  dgRNA
  Trmt13
ggttaaaccccagca

SEQ ID NO: 21596 - DNA, 15 bp, Artificial Sequence
  dgRNA
  Trmt13
gagaggggtgtaacc

SEQ ID NO: 21597 - DNA, 15 bp, Artificial Sequence
  dgRNA
  Cd74
cggagtgacctgctg

SEQ ID NO: 21598 - DNA, 15 bp, Artificial Sequence
  dgRNA
  Cd74
agtatcagctttaag

SEQ ID NO: 21599 - DNA, 15 bp, Artificial Sequence
  dgRNA
  Cd74
tttaagaggtgatct

SEQ ID NO: 21600 - DNA, 15 bp, Artificial Sequence
  dgRNA
  Cd74
taagaggtgatcttg

SEQ ID NO: 21601 - DNA, 15 bp, Artificial Sequence
  dgRNA
  Fndc3a
acacacttgcgggcc

SEQ ID NO: 21602 - DNA, 15 bp, Artificial Sequence
  dgRNA
  Fndc3a
cacacttgcgggccc

SEQ ID NO: 21603 - DNA, 15 bp, Artificial Sequence
  dgRNA
  Fndc3a
gggcccgggaagcct

SEQ ID NO: 21604 - DNA, 15 bp, Artificial Sequence
  dgRNA
  Fndc3a
gaagcctcggcttgc

SEQ ID NO: 21605 - DNA, 15 bp, Artificial Sequence
  dgRNA
  Fam174a
tcaggttacccactc

SEQ ID NO: 21606 - DNA, 15 bp, Artificial Sequence
  dgRNA
  Fam174a
agccttttcactatt

SEQ ID NO: 21607 - DNA, 15 bp, Artificial Sequence
  dgRNA
  Fam174a
catggaaaacctagt

SEQ ID NO: 21608 - DNA, 15 bp, Artificial Sequence
  dgRNA
  Fam174a
ctacgcgtgcgcaat

SEQ ID NO: 21609 - DNA, 15 bp, Artificial Sequence
  dgRNA
  Lrrc72
ggtgactgtttgctc

SEQ ID NO: 21610 - DNA, 15 bp, Artificial Sequence
  dgRNA
  Lrrc72
cgacccactcactcc

SEQ ID NO: 21611 - DNA, 15 bp, Artificial Sequence
  dgRNA
  Lrrc72
ccgcactgtgcgtca

SEQ ID NO: 21612 - DNA, 15 bp, Artificial Sequence
  dgRNA
  Lrrc72
cacgtcacagaagtc

SEQ ID NO: 21613 - DNA, 15 bp, Artificial Sequence
  dgRNA
  Psg16
gctcttttgtacaat

SEQ ID NO: 21614 - DNA, 15 bp, Artificial Sequence
  dgRNA
  Psg16
cttttgtacaatagg

SEQ ID NO: 21615 - DNA, 15 bp, Artificial Sequence
  dgRNA
  Psg16
gtcggccctggactg

SEQ ID NO: 21616 - DNA, 15 bp, Artificial Sequence
  dgRNA
  Psg16
ggcattggtcggccc

SEQ ID NO: 21617 - DNA, 15 bp, Artificial Sequence
  dgRNA
  Tdg
cataatacatcctaa

SEQ ID NO: 21618 - DNA, 15 bp, Artificial Sequence
  dgRNA
  Tdg
aaagctgacgtcagc

SEQ ID NO: 21619 - DNA, 15 bp, Artificial Sequence
  dgRNA
  Tdg
tccacgtttcccgaa

SEQ ID NO: 21620 - DNA, 15 bp, Artificial Sequence
  dgRNA
  Tdg
cgaaaggctaagcgg

SEQ ID NO: 21621 - DNA, 15 bp, Artificial Sequence
  dgRNA
  Smim19
cgccgacccgggccg

SEQ ID NO: 21622 - DNA, 15 bp, Artificial Sequence
  dgRNA
  Smim19
gcaccgcgctgcgct

SEQ ID NO: 21623 - DNA, 15 bp, Artificial Sequence
  dgRNA
  Smim19
ggctcccgccacacg

SEQ ID NO: 21624 - DNA, 15 bp, Artificial Sequence
  dgRNA
  Smim19
gccacacgcggcacg

SEQ ID NO: 21625 - DNA, 15 bp, Artificial Sequence
  dgRNA
  Gmpr
ttcgcagctcagccc

SEQ ID NO: 21626 - DNA, 15 bp, Artificial Sequence
  dgRNA
  Gmpr
ctctagggtgctgca

SEQ ID NO: 21627 - DNA, 15 bp, Artificial Sequence
  dgRNA
  Gmpr
ctagactcaagcaga

SEQ ID NO: 21628 - DNA, 15 bp, Artificial Sequence
  dgRNA
  Gmpr
aaggagggggcgctt

SEQ ID NO: 21629 - DNA, 15 bp, Artificial Sequence
  dgRNA
  Cacng4
cgccgccagcccgcc

SEQ ID NO: 21630 - DNA, 15 bp, Artificial Sequence
  dgRNA
  Cacng4
ctcgccgccgcgcct

SEQ ID NO: 21631 - DNA, 15 bp, Artificial Sequence
  dgRNA
  Cacng4
tgagccccgcgcagc

SEQ ID NO: 21632 - DNA, 15 bp, Artificial Sequence
  dgRNA
  Cacng4
gcgcagccggagcgc

SEQ ID NO: 21633 - DNA, 15 bp, Artificial Sequence
  dgRNA
  Scn4a
atacacagtagaccc

SEQ ID NO: 21634 - DNA, 15 bp, Artificial Sequence
  dgRNA
  Scn4a
gtgtcctggtcttgt

SEQ ID NO: 21635 - DNA, 15 bp, Artificial Sequence
  dgRNA
  Scn4a
ggtcactaacgccct

SEQ ID NO: 21636 - DNA, 15 bp, Artificial Sequence
  dgRNA
  Scn4a
tggtcactaacgccc

SEQ ID NO: 21637 - DNA, 15 bp, Artificial Sequence
  dgRNA
  Pard6a
attctgccttcggat

SEQ ID NO: 21638 - DNA, 15 bp, Artificial Sequence
  dgRNA
  Pard6a
tggtcgagtcctttt

SEQ ID NO: 21639 - DNA, 15 bp, Artificial Sequence
  dgRNA
  Pard6a
ggtcgagtccttttt

SEQ ID NO: 21640 - DNA, 15 bp, Artificial Sequence
  dgRNA
  Pard6a
ccgtctccgtttcct

SEQ ID NO: 21641 - DNA, 15 bp, Artificial Sequence
  dgRNA
  Vmn1r191
gtcatgttccatatt

SEQ ID NO: 21642 - DNA, 15 bp, Artificial Sequence
  dgRNA
  Six5
aagcgcggccagaga

SEQ ID NO: 21643 - DNA, 15 bp, Artificial Sequence
  dgRNA
  Six5
cgcggccagagacgg

SEQ ID NO: 21644 - DNA, 15 bp, Artificial Sequence
  dgRNA
  Six5
gcggccagagacgga

SEQ ID NO: 21645 - DNA, 15 bp, Artificial Sequence
  dgRNA
  Six5
ggggggcggacacac

SEQ ID NO: 21646 - DNA, 15 bp, Artificial Sequence
  dgRNA
  Gria3
agcgagagcaagttg

SEQ ID NO: 21647 - DNA, 15 bp, Artificial Sequence
  dgRNA
  Gria3
gcgagagcaagttga

SEQ ID NO: 21648 - DNA, 15 bp, Artificial Sequence
  dgRNA
  Gria3
cgagagcaagttgag

SEQ ID NO: 21649 - DNA, 15 bp, Artificial Sequence
  dgRNA
  Gria3
agggggtgtaagagc

SEQ ID NO: 21650 - DNA, 15 bp, Artificial Sequence
  dgRNA
  Selk
cccttcgagccacct

SEQ ID NO: 21651 - DNA, 15 bp, Artificial Sequence
  dgRNA
  Selk
caagcaacttccggt

SEQ ID NO: 21652 - DNA, 15 bp, Artificial Sequence
  dgRNA
  Selk
cggtcggcagtgctg

SEQ ID NO: 21653 - DNA, 15 bp, Artificial Sequence
  dgRNA
  Selk
gactctcggtcaaac

SEQ ID NO: 21654 - DNA, 15 bp, Artificial Sequence
  dgRNA
  Wdr93
gcgcccgctccctcg

SEQ ID NO: 21655 - DNA, 15 bp, Artificial Sequence
  dgRNA
  Wdr93
cgcccgctccctcgt

SEQ ID NO: 21656 - DNA, 15 bp, Artificial Sequence
  dgRNA
  Wdr93
cctcgtgggtcccct

SEQ ID NO: 21657 - DNA, 15 bp, Artificial Sequence
  dgRNA
  Wdr93
cccctgggacgtcgc

SEQ ID NO: 21658 - DNA, 15 bp, Artificial Sequence
  dgRNA
  Ing2
gcgcggcctgccgtt

SEQ ID NO: 21659 - DNA, 15 bp, Artificial Sequence
  dgRNA
  Ing2
ggcctgccgtttggc

SEQ ID NO: 21660 - DNA, 15 bp, Artificial Sequence
  dgRNA
  Ing2
gacagaccaatcgcc

SEQ ID NO: 21661 - DNA, 15 bp, Artificial Sequence
  dgRNA
  Ing2
acagaccaatcgccc

SEQ ID NO: 21662 - DNA, 15 bp, Artificial Sequence
  dgRNA
  Saal1
ccccatggatcctac

SEQ ID NO: 21663 - DNA, 15 bp, Artificial Sequence
  dgRNA
  Saal1
gatcctacaggttcc

SEQ ID NO: 21664 - DNA, 15 bp, Artificial Sequence
  dgRNA
  Saal1
ggttcccggacctcg

SEQ ID NO: 21665 - DNA, 15 bp, Artificial Sequence
  dgRNA
  Saal1
gttcccggacctcgc

SEQ ID NO: 21666 - DNA, 15 bp, Artificial Sequence
  dgRNA
  Sf1
ccgccatttcgtcgc

SEQ ID NO: 21667 - DNA, 15 bp, Artificial Sequence
  dgRNA
  Sf1
cgccatttcgtcgcc

SEQ ID NO: 21668 - DNA, 15 bp, Artificial Sequence
  dgRNA
  Sf1
cgtcgccgggcctaa

SEQ ID NO: 21669 - DNA, 15 bp, Artificial Sequence
  dgRNA
  Sf1
ccgggcctaacggtt

SEQ ID NO: 21670 - DNA, 15 bp, Artificial Sequence
  dgRNA
  Kif3c
agaaaccgagaatgg

SEQ ID NO: 21671 - DNA, 15 bp, Artificial Sequence
  dgRNA
  Kif3c
ccgagagaacacgcg

SEQ ID NO: 21672 - DNA, 15 bp, Artificial Sequence
  dgRNA
  Kif3c
cgagagaacacgcgt

SEQ ID NO: 21673 - DNA, 15 bp, Artificial Sequence
  dgRNA
  Kif3c
gggctcccagacttg

SEQ ID NO: 21674 - DNA, 15 bp, Artificial Sequence
  dgRNA
  Vmn2r58
gtctccgtctgtctt

SEQ ID NO: 21675 - DNA, 15 bp, Artificial Sequence
  dgRNA
  Rgs16
ccaagtctccgacct

SEQ ID NO: 21676 - DNA, 15 bp, Artificial Sequence
  dgRNA
  Rgs16
caagtctccgacctt

SEQ ID NO: 21677 - DNA, 15 bp, Artificial Sequence
  dgRNA
  Rgs16
aagtctccgaccttg

SEQ ID NO: 21678 - DNA, 15 bp, Artificial Sequence
  dgRNA
  Rgs16
agtctccgaccttgg

SEQ ID NO: 21679 - DNA, 15 bp, Artificial Sequence
  dgRNA
  Ncapg2
ctctgagtcacgccc

SEQ ID NO: 21680 - DNA, 15 bp, Artificial Sequence
  dgRNA
  Ncapg2
tgagtcacgcccagg

SEQ ID NO: 21681 - DNA, 15 bp, Artificial Sequence
  dgRNA
  Ncapg2
gtcacgcccaggagg

SEQ ID NO: 21682 - DNA, 15 bp, Artificial Sequence
  dgRNA
  Ncapg2
caggaggcggtgctt

SEQ ID NO: 21683 - DNA, 15 bp, Artificial Sequence
  dgRNA
  Fignl1
tttatcgccaccgcg

SEQ ID NO: 21684 - DNA, 15 bp, Artificial Sequence
  dgRNA
  Fignl1
ttatcgccaccgcgc

SEQ ID NO: 21685 - DNA, 15 bp, Artificial Sequence
  dgRNA
  Fignl1
ctccctcatagagcg

SEQ ID NO: 21686 - DNA, 15 bp, Artificial Sequence
  dgRNA
  Fignl1
tccctcatagagcgc

SEQ ID NO: 21687 - DNA, 15 bp, Artificial Sequence
  dgRNA
  Spink2
ggtcacagactttgc

SEQ ID NO: 21688 - DNA, 15 bp, Artificial Sequence
  dgRNA
  Spink2
atgctcaagtgggtc

SEQ ID NO: 21689 - DNA, 15 bp, Artificial Sequence
  dgRNA
  Spink2
gtcaagggaccagct

SEQ ID NO: 21690 - DNA, 15 bp, Artificial Sequence
  dgRNA
  Spink2
ggagctgagagcgct

SEQ ID NO: 21691 - DNA, 15 bp, Artificial Sequence
  dgRNA
  Acot1
ttcaattgcgaaacc

SEQ ID NO: 21692 - DNA, 15 bp, Artificial Sequence
  dgRNA
  Acot1
ctcacaactcttagg

SEQ ID NO: 21693 - DNA, 15 bp, Artificial Sequence
  dgRNA
  Acot1
ctgaggccaaccaat

SEQ ID NO: 21694 - DNA, 15 bp, Artificial Sequence
  dgRNA
  Acot1
tgggactgcagcgag

SEQ ID NO: 21695 - DNA, 15 bp, Artificial Sequence
  dgRNA
  Eqtn
gtcctattgagactt

SEQ ID NO: 21696 - DNA, 15 bp, Artificial Sequence
  dgRNA
  Eqtn
agacttaggacctgc

SEQ ID NO: 21697 - DNA, 15 bp, Artificial Sequence
  dgRNA
  Eqtn
gtcctaagtctcaat

SEQ ID NO: 21698 - DNA, 15 bp, Artificial Sequence
  dgRNA
  Eqtn
ttcttgtggcccagc

SEQ ID NO: 21699 - DNA, 15 bp, Artificial Sequence
  dgRNA
  Edrf1
gagcggccgcctgcg

SEQ ID NO: 21700 - DNA, 15 bp, Artificial Sequence
  dgRNA
  Edrf1
agcggccgcctgcga

SEQ ID NO: 21701 - DNA, 15 bp, Artificial Sequence
  dgRNA
  Edrf1
ttacgcgaataccca

SEQ ID NO: 21702 - DNA, 15 bp, Artificial Sequence
  dgRNA
  Edrf1
cgcgaatacccaagg

SEQ ID NO: 21703 - DNA, 15 bp, Artificial Sequence
  dgRNA
  Mfsd7c
tgggggctaaccggg

SEQ ID NO: 21704 - DNA, 15 bp, Artificial Sequence
  dgRNA
  Mfsd7c
cggtttccatgacac

SEQ ID NO: 21705 - DNA, 15 bp, Artificial Sequence
  dgRNA
  Mfsd7c
gtttccatgacaccg

SEQ ID NO: 21706 - DNA, 15 bp, Artificial Sequence
  dgRNA
  Mfsd7c
tgacaccggggacgt

SEQ ID NO: 21707 - DNA, 15 bp, Artificial Sequence
  dgRNA
  BC089597
ggactttataccaga

SEQ ID NO: 21708 - DNA, 15 bp, Artificial Sequence
  dgRNA
  BC089597
ggcctcaaatatgga

SEQ ID NO: 21709 - DNA, 15 bp, Artificial Sequence
  dgRNA
  BC089597
tctggacaacaagtg

SEQ ID NO: 21710 - DNA, 15 bp, Artificial Sequence
  dgRNA
  BC089597
aggactttagccttc

SEQ ID NO: 21711 - DNA, 15 bp, Artificial Sequence
  dgRNA
  Fermt2
cgagagcccggatgt

SEQ ID NO: 21712 - DNA, 15 bp, Artificial Sequence
  dgRNA
  Fermt2
ttccatccctgcgcc

SEQ ID NO: 21713 - DNA, 15 bp, Artificial Sequence
  dgRNA
  Fermt2
agggcagcgctccgc

SEQ ID NO: 21714 - DNA, 15 bp, Artificial Sequence
  dgRNA
  Fermt2
gggcagcgctccgca

SEQ ID NO: 21715 - DNA, 15 bp, Artificial Sequence
  dgRNA
  Calb1
caagaggcgggagct

SEQ ID NO: 21716 - DNA, 15 bp, Artificial Sequence
  dgRNA
  Calb1
aggcgtggcccggcc

SEQ ID NO: 21717 - DNA, 15 bp, Artificial Sequence
  dgRNA
  Calb1
ggcgtggcccggcct

SEQ ID NO: 21718 - DNA, 15 bp, Artificial Sequence
  dgRNA
  Calb1
gcgtggcccggcctg

SEQ ID NO: 21719 - DNA, 15 bp, Artificial Sequence
  dgRNA
  Plppr3
gtgggacggggacga

SEQ ID NO: 21720 - DNA, 15 bp, Artificial Sequence
  dgRNA
  Plppr3
ttgctcaggcgccca

SEQ ID NO: 21721 - DNA, 15 bp, Artificial Sequence
  dgRNA
  Plppr3
gactccagcgagccg

SEQ ID NO: 21722 - DNA, 15 bp, Artificial Sequence
  dgRNA
  Plppr3
actccagcgagccgc

SEQ ID NO: 21723 - DNA, 15 bp, Artificial Sequence
  dgRNA
  Epha2
cgaaggcccacgcac

SEQ ID NO: 21724 - DNA, 15 bp, Artificial Sequence
  dgRNA
  Epha2
ccccgccctctagtc

SEQ ID NO: 21725 - DNA, 15 bp, Artificial Sequence
  dgRNA
  Epha2
cccgccctctagtca

SEQ ID NO: 21726 - DNA, 15 bp, Artificial Sequence
  dgRNA
  Epha2
acattcctgagggcg

SEQ ID NO: 21727 - DNA, 15 bp, Artificial Sequence
  dgRNA
  Cbln2
cgtgagcgctgtaga

SEQ ID NO: 21728 - DNA, 15 bp, Artificial Sequence
  dgRNA
  Cbln2
gtgagcgctgtagac

SEQ ID NO: 21729 - DNA, 15 bp, Artificial Sequence
  dgRNA
  Cbln2
gagtgtgggcgatga

SEQ ID NO: 21730 - DNA, 15 bp, Artificial Sequence
  dgRNA
  Cbln2
agtgtgggcgatgag

SEQ ID NO: 21731 - DNA, 15 bp, Artificial Sequence
  dgRNA
  E2f1
cgcgtggctctttcg

SEQ ID NO: 21732 - DNA, 15 bp, Artificial Sequence
  dgRNA
  E2f1
tctttcgcggcaaaa

SEQ ID NO: 21733 - DNA, 15 bp, Artificial Sequence
  dgRNA
  E2f1
gcggcaaaaaggatt

SEQ ID NO: 21734 - DNA, 15 bp, Artificial Sequence
  dgRNA
  E2f1
tttggcgcgtaaaag

SEQ ID NO: 21735 - DNA, 15 bp, Artificial Sequence
  dgRNA
  Msl3l2
gagggccctagtctc

SEQ ID NO: 21736 - DNA, 15 bp, Artificial Sequence
  dgRNA
  Msl3l2
ggccctagtctctgg

SEQ ID NO: 21737 - DNA, 15 bp, Artificial Sequence
  dgRNA
  Msl3l2
gcagtgccacccgtt

SEQ ID NO: 21738 - DNA, 15 bp, Artificial Sequence
  dgRNA
  Msl3l2
gggcgctagagagtc

SEQ ID NO: 21739 - DNA, 15 bp, Artificial Sequence
  dgRNA
  Vmn1r176
tcaattgtaaaggtc

SEQ ID NO: 21740 - DNA, 15 bp, Artificial Sequence
  dgRNA
  Lgals8
ggcttccagcacgtg

SEQ ID NO: 21741 - DNA, 15 bp, Artificial Sequence
  dgRNA
  Lgals8
ctgcagtcgttctcg

SEQ ID NO: 21742 - DNA, 15 bp, Artificial Sequence
  dgRNA
  Lgals8
tcgttctcgcggaaa

SEQ ID NO: 21743 - DNA, 15 bp, Artificial Sequence
  dgRNA
  Lgals8
tcgcggaaacggccg

SEQ ID NO: 21744 - DNA, 15 bp, Artificial Sequence
  dgRNA
  AW209491
ttgacccgcccctgc

SEQ ID NO: 21745 - DNA, 15 bp, Artificial Sequence
  dgRNA
  AW209491
cccgcccctgctggc

SEQ ID NO: 21746 - DNA, 15 bp, Artificial Sequence
  dgRNA
  AW209491
ccgcccctgctggct

SEQ ID NO: 21747 - DNA, 15 bp, Artificial Sequence
  dgRNA
  AW209491
aggtttccgtcgctt

SEQ ID NO: 21748 - DNA, 15 bp, Artificial Sequence
  dgRNA
  Slc30a2
ccggctcagctcctt

SEQ ID NO: 21749 - DNA, 15 bp, Artificial Sequence
  dgRNA
  Slc30a2
cggctcagctccttc

SEQ ID NO: 21750 - DNA, 15 bp, Artificial Sequence
  dgRNA
  Slc30a2
agctccttcgggctc

SEQ ID NO: 21751 - DNA, 15 bp, Artificial Sequence
  dgRNA
  Slc30a2
ctccttcgggctccg

SEQ ID NO: 21752 - DNA, 15 bp, Artificial Sequence
  dgRNA
  Slc10a4
gaccgagcagcaggg

SEQ ID NO: 21753 - DNA, 15 bp, Artificial Sequence
  dgRNA
  Slc10a4
ccgagcagcagggcg

SEQ ID NO: 21754 - DNA, 15 bp, Artificial Sequence
  dgRNA
  Slc10a4
gcctgcggtgcgggc

SEQ ID NO: 21755 - DNA, 15 bp, Artificial Sequence
  dgRNA
  Slc10a4
ccgacaaagcccagg

SEQ ID NO: 21756 - DNA, 15 bp, Artificial Sequence
  dgRNA
  Tmem132a
tcatcggcttccacg

SEQ ID NO: 21757 - DNA, 15 bp, Artificial Sequence
  dgRNA
  Tmem132a
aggccagaccacctt

SEQ ID NO: 21758 - DNA, 15 bp, Artificial Sequence
  dgRNA
  Tmem132a
tcataccctccccac

SEQ ID NO: 21759 - DNA, 15 bp, Artificial Sequence
  dgRNA
  Tmem132a
ggaagccgatgatca

SEQ ID NO: 21760 - DNA, 15 bp, Artificial Sequence
  dgRNA
  Lmx1b
cggccccgaccccgc

SEQ ID NO: 21761 - DNA, 15 bp, Artificial Sequence
  dgRNA
  Lmx1b
ggcgccgcgcctccc

SEQ ID NO: 21762 - DNA, 15 bp, Artificial Sequence
  dgRNA
  Lmx1b
cggctgcagcggagc

SEQ ID NO: 21763 - DNA, 15 bp, Artificial Sequence
  dgRNA
  Lmx1b
ctgcagcggagcggg

SEQ ID NO: 21764 - DNA, 15 bp, Artificial Sequence
  dgRNA
  Chst8
gccgcagagcgcgcg

SEQ ID NO: 21765 - DNA, 15 bp, Artificial Sequence
  dgRNA
  Chst8
ccgcagagcgcgcgt

SEQ ID NO: 21766 - DNA, 15 bp, Artificial Sequence
  dgRNA
  Chst8
gagcgcgcgtgggcg

SEQ ID NO: 21767 - DNA, 15 bp, Artificial Sequence
  dgRNA
  Chst8
ccgtgagctcccgag

SEQ ID NO: 21768 - DNA, 15 bp, Artificial Sequence
  dgRNA
  Pom121l2
ccgcagatcccagag

SEQ ID NO: 21769 - DNA, 15 bp, Artificial Sequence
  dgRNA
  Pom121l2
cagagcgggctgacg

SEQ ID NO: 21770 - DNA, 15 bp, Artificial Sequence
  dgRNA
  Pom121l2
ctgacgtggttgccg

SEQ ID NO: 21771 - DNA, 15 bp, Artificial Sequence
  dgRNA
  Pom121l2
tccctcgcgcttttc

SEQ ID NO: 21772 - DNA, 15 bp, Artificial Sequence
  dgRNA
  Asgr2
gttagatggacattc

SEQ ID NO: 21773 - DNA, 15 bp, Artificial Sequence
  dgRNA
  Asgr2
ctcataaccagagaa

SEQ ID NO: 21774 - DNA, 15 bp, Artificial Sequence
  dgRNA
  Asgr2
acgcagttggaactc

SEQ ID NO: 21775 - DNA, 15 bp, Artificial Sequence
  dgRNA
  Ajuba
agctctccacctcgg

SEQ ID NO: 21776 - DNA, 15 bp, Artificial Sequence
  dgRNA
  Ajuba
gtatccatcaacgtt

SEQ ID NO: 21777 - DNA, 15 bp, Artificial Sequence
  dgRNA
  Ajuba
tgtatccatcaacgt

SEQ ID NO: 21778 - DNA, 15 bp, Artificial Sequence
  dgRNA
  Ajuba
cgcggaggggcactg

SEQ ID NO: 21779 - DNA, 15 bp, Artificial Sequence
  dgRNA
  Rwdd2b
acaatgagtccggga

SEQ ID NO: 21780 - DNA, 15 bp, Artificial Sequence
  dgRNA
  Rwdd2b
ccagaaagcaaccgg

SEQ ID NO: 21781 - DNA, 15 bp, Artificial Sequence
  dgRNA
  Rwdd2b
agaaagcaaccggcg

SEQ ID NO: 21782 - DNA, 15 bp, Artificial Sequence
  dgRNA
  Rwdd2b
gaaagcaaccggcgg

SEQ ID NO: 21783 - DNA, 15 bp, Artificial Sequence
  dgRNA
  Etv1
agcaagtctagaagg

SEQ ID NO: 21784 - DNA, 15 bp, Artificial Sequence
  dgRNA
  Etv1
tcatcacaaattacc

SEQ ID NO: 21785 - DNA, 15 bp, Artificial Sequence
  dgRNA
  Etv1
agagctcaattaatt

SEQ ID NO: 21786 - DNA, 15 bp, Artificial Sequence
  dgRNA
  Etv1
tagagctcaattaat

SEQ ID NO: 21787 - DNA, 15 bp, Artificial Sequence
  dgRNA
  Cap2
gttggaggatattcg

SEQ ID NO: 21788 - DNA, 15 bp, Artificial Sequence
  dgRNA
  Cap2
agtagaatccttggc

SEQ ID NO: 21789 - DNA, 15 bp, Artificial Sequence
  dgRNA
  Cap2
tagattgtagatctg

SEQ ID NO: 21790 - DNA, 15 bp, Artificial Sequence
  dgRNA
  Cap2
atagattgtagatct

SEQ ID NO: 21791 - DNA, 15 bp, Artificial Sequence
  dgRNA
  Tubgcp3
agtatccccgtttcc

SEQ ID NO: 21792 - DNA, 15 bp, Artificial Sequence
  dgRNA
  Tubgcp3
ctcctggtgacgtca

SEQ ID NO: 21793 - DNA, 15 bp, Artificial Sequence
  dgRNA
  Tubgcp3
tcctggtgacgtcaa

SEQ ID NO: 21794 - DNA, 15 bp, Artificial Sequence
  dgRNA
  Tubgcp3
cctggtgacgtcaag

SEQ ID NO: 21795 - DNA, 15 bp, Artificial Sequence
  dgRNA
  Adgre5
acaagtcctgctgat

SEQ ID NO: 21796 - DNA, 15 bp, Artificial Sequence
  dgRNA
  Adgre5
aggcgagggtcgccc

SEQ ID NO: 21797 - DNA, 15 bp, Artificial Sequence
  dgRNA
  Adgre5
gcccaggacatcgtt

SEQ ID NO: 21798 - DNA, 15 bp, Artificial Sequence
  dgRNA
  Adgre5
cccaggacatcgttc

SEQ ID NO: 21799 - DNA, 15 bp, Artificial Sequence
  dgRNA
  Tmem63c
cctgcttatctagcc

SEQ ID NO: 21800 - DNA, 15 bp, Artificial Sequence
  dgRNA
  Tmem63c
cccgggttcccccac

SEQ ID NO: 21801 - DNA, 15 bp, Artificial Sequence
  dgRNA
  Tmem63c
ggtcagagcagcgtt

SEQ ID NO: 21802 - DNA, 15 bp, Artificial Sequence
  dgRNA
  Tmem63c
cagagcagcgttggg

SEQ ID NO: 21803 - DNA, 15 bp, Artificial Sequence
  dgRNA
  Acat1
tagcgtgcaccacct

SEQ ID NO: 21804 - DNA, 15 bp, Artificial Sequence
  dgRNA
  Acat1
aggtgtcaagccacg

SEQ ID NO: 21805 - DNA, 15 bp, Artificial Sequence
  dgRNA
  Acat1
ccgccctctggctac

SEQ ID NO: 21806 - DNA, 15 bp, Artificial Sequence
  dgRNA
  Acat1
caagcgcagcgatct

SEQ ID NO: 21807 - DNA, 15 bp, Artificial Sequence
  dgRNA
  Adk
gctgaaggaacgggg

SEQ ID NO: 21808 - DNA, 15 bp, Artificial Sequence
  dgRNA
  Adk
gcactccctgagcgc

SEQ ID NO: 21809 - DNA, 15 bp, Artificial Sequence
  dgRNA
  Adk
cagcctaactccgtt

SEQ ID NO: 21810 - DNA, 15 bp, Artificial Sequence
  dgRNA
  Adk
agcctaactccgttt

SEQ ID NO: 21811 - DNA, 15 bp, Artificial Sequence
  dgRNA
  Ism1
aaacggtgacaacct

SEQ ID NO: 21812 - DNA, 15 bp, Artificial Sequence
  dgRNA
  Ism1
acaacctcggtgacc

SEQ ID NO: 21813 - DNA, 15 bp, Artificial Sequence
  dgRNA
  Ism1
cggagccagcccatc

SEQ ID NO: 21814 - DNA, 15 bp, Artificial Sequence
  dgRNA
  Ism1
gagccagcccatccg

SEQ ID NO: 21815 - DNA, 15 bp, Artificial Sequence
  dgRNA
  Ccbl2
agggcgcgccacgat

SEQ ID NO: 21816 - DNA, 15 bp, Artificial Sequence
  dgRNA
  Ccbl2
ccttagccctgatac

SEQ ID NO: 21817 - DNA, 15 bp, Artificial Sequence
  dgRNA
  Ccbl2
accggagccaatccc

SEQ ID NO: 21818 - DNA, 15 bp, Artificial Sequence
  dgRNA
  Ccbl2
gcctcctctacaatc

SEQ ID NO: 21819 - DNA, 15 bp, Artificial Sequence
  dgRNA
  Slf1
gcaggccgaaaacac

SEQ ID NO: 21820 - DNA, 15 bp, Artificial Sequence
  dgRNA
  Slf1
caggccgaaaacacc

SEQ ID NO: 21821 - DNA, 15 bp, Artificial Sequence
  dgRNA
  Slf1
accaatctccgtcta

SEQ ID NO: 21822 - DNA, 15 bp, Artificial Sequence
  dgRNA
  Slf1
ggcgctgatcctgca

SEQ ID NO: 21823 - DNA, 15 bp, Artificial Sequence
  dgRNA
  C1qb
tgagttggcgaaacc

SEQ ID NO: 21824 - DNA, 15 bp, Artificial Sequence
  dgRNA
  C1qb
ttggcgaaaccaggc

SEQ ID NO: 21825 - DNA, 15 bp, Artificial Sequence
  dgRNA
  C1qb
gagggtcagcctgtt

SEQ ID NO: 21826 - DNA, 15 bp, Artificial Sequence
  dgRNA
  C1qb
tacgacctgttctta

SEQ ID NO: 21827 - DNA, 15 bp, Artificial Sequence
  dgRNA
  Zmiz2
tcccctcaagtcgtc

SEQ ID NO: 21828 - DNA, 15 bp, Artificial Sequence
  dgRNA
  Zmiz2
tgccaccctcttgat

SEQ ID NO: 21829 - DNA, 15 bp, Artificial Sequence
  dgRNA
  Zmiz2
ctgtgtcagccgtgt

SEQ ID NO: 21830 - DNA, 15 bp, Artificial Sequence
  dgRNA
  Zmiz2
cgacttgaggggagc

SEQ ID NO: 21831 - DNA, 15 bp, Artificial Sequence
  dgRNA
  Ccni
tgcgtccataagaca

SEQ ID NO: 21832 - DNA, 15 bp, Artificial Sequence
  dgRNA
  Ccni
tctcctatgcgtccg

SEQ ID NO: 21833 - DNA, 15 bp, Artificial Sequence
  dgRNA
  Ccni
ctcctatgcgtccgt

SEQ ID NO: 21834 - DNA, 15 bp, Artificial Sequence
  dgRNA
  Ccni
gcgtccgtgggacac

SEQ ID NO: 21835 - DNA, 15 bp, Artificial Sequence
  dgRNA
  Pygb
ggtaaatcttaggta

SEQ ID NO: 21836 - DNA, 15 bp, Artificial Sequence
  dgRNA
  Pygb
gtaaatcttaggtat

SEQ ID NO: 21837 - DNA, 15 bp, Artificial Sequence
  dgRNA
  Pygb
aacagcctgattgac

SEQ ID NO: 21838 - DNA, 15 bp, Artificial Sequence
  dgRNA
  Pygb
cgggctctttctccg

SEQ ID NO: 21839 - DNA, 15 bp, Artificial Sequence
  dgRNA
  Acbd5
acactagcggtatcc

SEQ ID NO: 21840 - DNA, 15 bp, Artificial Sequence
  dgRNA
  Acbd5
cactagcggtatcca

SEQ ID NO: 21841 - DNA, 15 bp, Artificial Sequence
  dgRNA
  Acbd5
actagcggtatccag

SEQ ID NO: 21842 - DNA, 15 bp, Artificial Sequence
  dgRNA
  Acbd5
ccaggggccaccttt

SEQ ID NO: 21843 - DNA, 15 bp, Artificial Sequence
  dgRNA
  Trim12c
tttgcataagcctgc

SEQ ID NO: 21844 - DNA, 15 bp, Artificial Sequence
  dgRNA
  Gpr137b
gccaatcgcacacaa

SEQ ID NO: 21845 - DNA, 15 bp, Artificial Sequence
  dgRNA
  Gpr137b
gcctttgtgtgcgat

SEQ ID NO: 21846 - DNA, 15 bp, Artificial Sequence
  dgRNA
  Gmeb1
ctcccctaaatcgct

SEQ ID NO: 21847 - DNA, 15 bp, Artificial Sequence
  dgRNA
  Gmeb1
taaatcgctaggctg

SEQ ID NO: 21848 - DNA, 15 bp, Artificial Sequence
  dgRNA
  Gmeb1
aaatcgctaggctga

SEQ ID NO: 21849 - DNA, 15 bp, Artificial Sequence
  dgRNA
  Gmeb1
aatcgctaggctgag

SEQ ID NO: 21850 - DNA, 15 bp, Artificial Sequence
  dgRNA
  Nrg2
tctcccgcgcccctg

SEQ ID NO: 21851 - DNA, 15 bp, Artificial Sequence
  dgRNA
  Nrg2
gcccctgcgggctga

SEQ ID NO: 21852 - DNA, 15 bp, Artificial Sequence
  dgRNA
  Nrg2
cctgcgggctgaagg

SEQ ID NO: 21853 - DNA, 15 bp, Artificial Sequence
  dgRNA
  Nrg2
ctgcgggctgaaggc

SEQ ID NO: 21854 - DNA, 15 bp, Artificial Sequence
  dgRNA
  Vmn1r27
atactagttgattat

SEQ ID NO: 21855 - DNA, 15 bp, Artificial Sequence
  dgRNA
  Gcnt1
cgccctcacctcgag

SEQ ID NO: 21856 - DNA, 15 bp, Artificial Sequence
  dgRNA
  Gcnt1
cctcacctcgagcgg

SEQ ID NO: 21857 - DNA, 15 bp, Artificial Sequence
  dgRNA
  Gcnt1
tcgagcggtggccgc

SEQ ID NO: 21858 - DNA, 15 bp, Artificial Sequence
  dgRNA
  Gcnt1
tgggcgaagtggaac

SEQ ID NO: 21859 - DNA, 15 bp, Artificial Sequence
  dgRNA
  Fam150a
agagacccacaatta

SEQ ID NO: 21860 - DNA, 15 bp, Artificial Sequence
  dgRNA
  Fam150a
gaacttgtgactcgc

SEQ ID NO: 21861 - DNA, 15 bp, Artificial Sequence
  dgRNA
  Fam150a
ctcgccggtgcgact

SEQ ID NO: 21862 - DNA, 15 bp, Artificial Sequence
  dgRNA
  Fam150a
cacatcctgaagccg

SEQ ID NO: 21863 - DNA, 15 bp, Artificial Sequence
  dgRNA
  Gemin2
ctttagacgagaaaa

SEQ ID NO: 21864 - DNA, 15 bp, Artificial Sequence
  dgRNA
  Gemin2
ggaaccacttctgcc

SEQ ID NO: 21865 - DNA, 15 bp, Artificial Sequence
  dgRNA
  Gemin2
gctacattccaccac

SEQ ID NO: 21866 - DNA, 15 bp, Artificial Sequence
  dgRNA
  Gemin2
cttgatgcaaccagc

SEQ ID NO: 21867 - DNA, 15 bp, Artificial Sequence
  dgRNA
  Pcdh8
taaagggattgtcgg

SEQ ID NO: 21868 - DNA, 15 bp, Artificial Sequence
  dgRNA
  Pcdh8
attgtcggtggttgg

SEQ ID NO: 21869 - DNA, 15 bp, Artificial Sequence
  dgRNA
  Pcdh8
gtcggtggttggcgg

SEQ ID NO: 21870 - DNA, 15 bp, Artificial Sequence
  dgRNA
  Pcdh8
taagcgaccattggc

SEQ ID NO: 21871 - DNA, 15 bp, Artificial Sequence
  dgRNA
  Prr36
ggggggtgtcggagc

SEQ ID NO: 21872 - DNA, 15 bp, Artificial Sequence
  dgRNA
  Prr36
cacgaccattgaaat

SEQ ID NO: 21873 - DNA, 15 bp, Artificial Sequence
  dgRNA
  Prr36
gaaatcggcctcttc

SEQ ID NO: 21874 - DNA, 15 bp, Artificial Sequence
  dgRNA
  Prr36
aaatcggcctcttct

SEQ ID NO: 21875 - DNA, 15 bp, Artificial Sequence
  dgRNA
  Dnajc24
ccgcagctgtctcac

SEQ ID NO: 21876 - DNA, 15 bp, Artificial Sequence
  dgRNA
  Dnajc24
cgcagctgtctcact

SEQ ID NO: 21877 - DNA, 15 bp, Artificial Sequence
  dgRNA
  Dnajc24
ttaacggaaattatt

SEQ ID NO: 21878 - DNA, 15 bp, Artificial Sequence
  dgRNA
  Dnajc24
gggcagttggtgata

SEQ ID NO: 21879 - DNA, 15 bp, Artificial Sequence
  dgRNA
  Klhl2
agcgcccgcccgtca

SEQ ID NO: 21880 - DNA, 15 bp, Artificial Sequence
  dgRNA
  Klhl2
cgcccgtcacggcgc

SEQ ID NO: 21881 - DNA, 15 bp, Artificial Sequence
  dgRNA
  Klhl2
gcgccggcgccggcc

SEQ ID NO: 21882 - DNA, 15 bp, Artificial Sequence
  dgRNA
  Klhl2
ccggccgggagaacc

SEQ ID NO: 21883 - DNA, 15 bp, Artificial Sequence
  dgRNA
  Snx11
gactttgcggggtct

SEQ ID NO: 21884 - DNA, 15 bp, Artificial Sequence
  dgRNA
  Snx11
ccccctagcgatttc

SEQ ID NO: 21885 - DNA, 15 bp, Artificial Sequence
  dgRNA
  Snx11
atttccggaaagatg

SEQ ID NO: 21886 - DNA, 15 bp, Artificial Sequence
  dgRNA
  Snx11
tgcggatttcagctt

SEQ ID NO: 21887 - DNA, 15 bp, Artificial Sequence
  dgRNA
  Pou6f2
acctcctgttgacat

SEQ ID NO: 21888 - DNA, 15 bp, Artificial Sequence
  dgRNA
  Pou6f2
aaatatattgtcccc

SEQ ID NO: 21889 - DNA, 15 bp, Artificial Sequence
  dgRNA
  Pou6f2
accaatgtcaacagg

SEQ ID NO: 21890 - DNA, 15 bp, Artificial Sequence
  dgRNA
  Pou6f2
caaagaatggtgcaa

SEQ ID NO: 21891 - DNA, 15 bp, Artificial Sequence
  dgRNA
  Unkl
tgtaacttgctgccg

SEQ ID NO: 21892 - DNA, 15 bp, Artificial Sequence
  dgRNA
  Unkl
aacttgctgccgtgg

SEQ ID NO: 21893 - DNA, 15 bp, Artificial Sequence
  dgRNA
  Unkl
acttgctgccgtggt

SEQ ID NO: 21894 - DNA, 15 bp, Artificial Sequence
  dgRNA
  Unkl
gctgccgtggtgggc

SEQ ID NO: 21895 - DNA, 15 bp, Artificial Sequence
  dgRNA
  Cacna1b
cacgctgcctaaagc

SEQ ID NO: 21896 - DNA, 15 bp, Artificial Sequence
  dgRNA
  Cacna1b
acgctgcctaaagct

SEQ ID NO: 21897 - DNA, 15 bp, Artificial Sequence
  dgRNA
  Cacna1b
ctcacgcaagcaact

SEQ ID NO: 21898 - DNA, 15 bp, Artificial Sequence
  dgRNA
  Cacna1b
actcggcgttccctg

SEQ ID NO: 21899 - DNA, 15 bp, Artificial Sequence
  dgRNA
  Tm6sf2
gagtctcctgatagt

SEQ ID NO: 21900 - DNA, 15 bp, Artificial Sequence
  dgRNA
  Tm6sf2
agtctcctgatagta

SEQ ID NO: 21901 - DNA, 15 bp, Artificial Sequence
  dgRNA
  Tm6sf2
ctcctgatagtaggg

SEQ ID NO: 21902 - DNA, 15 bp, Artificial Sequence
  dgRNA
  Tm6sf2
accccctccgcatac

SEQ ID NO: 21903 - DNA, 15 bp, Artificial Sequence
  dgRNA
  Slc45a4
aataggacttgcctt

SEQ ID NO: 21904 - DNA, 15 bp, Artificial Sequence
  dgRNA
  Slc45a4
agcttggcgagtgcc

SEQ ID NO: 21905 - DNA, 15 bp, Artificial Sequence
  dgRNA
  Slc45a4
gcaatctgtaactcg

SEQ ID NO: 21906 - DNA, 15 bp, Artificial Sequence
  dgRNA
  Mup12
atcctcttcccatat

SEQ ID NO: 21907 - DNA, 15 bp, Artificial Sequence
  dgRNA
  Klk1b11
ggcctactgtacagc

SEQ ID NO: 21908 - DNA, 15 bp, Artificial Sequence
  dgRNA
  Klk1b11
acagcgggcgcaacg

SEQ ID NO: 21909 - DNA, 15 bp, Artificial Sequence
  dgRNA
  Klk1b11
cgcccgctgtacagt

SEQ ID NO: 21910 - DNA, 15 bp, Artificial Sequence
  dgRNA
  Sf3a1
cctccagagcgtctg

SEQ ID NO: 21911 - DNA, 15 bp, Artificial Sequence
  dgRNA
  Sf3a1
ctcgcaactctaagt

SEQ ID NO: 21912 - DNA, 15 bp, Artificial Sequence
  dgRNA
  Sf3a1
tcgcaactctaagtt

SEQ ID NO: 21913 - DNA, 15 bp, Artificial Sequence
  dgRNA
  Sf3a1
ctaagttgggagccc

SEQ ID NO: 21914 - DNA, 15 bp, Artificial Sequence
  dgRNA
  Pdgfrl
catctaggtcacctt

SEQ ID NO: 21915 - DNA, 15 bp, Artificial Sequence
  dgRNA
  Pdgfrl
cgtcaccactccacc

SEQ ID NO: 21916 - DNA, 15 bp, Artificial Sequence
  dgRNA
  Pdgfrl
gtcaccactccacca

SEQ ID NO: 21917 - DNA, 15 bp, Artificial Sequence
  dgRNA
  Pdgfrl
gatcacattacacag

SEQ ID NO: 21918 - DNA, 15 bp, Artificial Sequence
  dgRNA
  Kcnj4
acgatgctgccgccc

SEQ ID NO: 21919 - DNA, 15 bp, Artificial Sequence
  dgRNA
  Kcnj4
atgctgccgcccggg

SEQ ID NO: 21920 - DNA, 15 bp, Artificial Sequence
  dgRNA
  Kcnj4
gcccagctcttgacg

SEQ ID NO: 21921 - DNA, 15 bp, Artificial Sequence
  dgRNA
  Kcnj4
cccagctcttgacgc

SEQ ID NO: 21922 - DNA, 15 bp, Artificial Sequence
  dgRNA
  Gmfg
gggcggggttgcatc

SEQ ID NO: 21923 - DNA, 15 bp, Artificial Sequence
  dgRNA
  Gmfg
gaggaggtgcgaagt

SEQ ID NO: 21924 - DNA, 15 bp, Artificial Sequence
  dgRNA
  Gmfg
gaggtgcgaagtagg

SEQ ID NO: 21925 - DNA, 15 bp, Artificial Sequence
  dgRNA
  Gmfg
aggtgcgaagtaggc

SEQ ID NO: 21926 - DNA, 15 bp, Artificial Sequence
  dgRNA
  Galt
cgatgtcttctgaac

SEQ ID NO: 21927 - DNA, 15 bp, Artificial Sequence
  dgRNA
  Galt
aactcactacacctg

SEQ ID NO: 21928 - DNA, 15 bp, Artificial Sequence
  dgRNA
  Galt
agaatggacccatag

SEQ ID NO: 21929 - DNA, 15 bp, Artificial Sequence
  dgRNA
  Galt
ggtttcttaccggtt

SEQ ID NO: 21930 - DNA, 15 bp, Artificial Sequence
  dgRNA
  Ccdc116
caaaaggcagcgatt

SEQ ID NO: 21931 - DNA, 15 bp, Artificial Sequence
  dgRNA
  Ccdc116
aaaaggcagcgattt

SEQ ID NO: 21932 - DNA, 15 bp, Artificial Sequence
  dgRNA
  Ccdc116
tgaccggtccaagca

SEQ ID NO: 21933 - DNA, 15 bp, Artificial Sequence
  dgRNA
  Ccdc116
gtcgaagtgtgtgtc

SEQ ID NO: 21934 - DNA, 15 bp, Artificial Sequence
  dgRNA
  Tmem225
ttctctctcgggaga

SEQ ID NO: 21935 - DNA, 15 bp, Artificial Sequence
  dgRNA
  Tmem225
tggttccaatgccct

SEQ ID NO: 21936 - DNA, 15 bp, Artificial Sequence
  dgRNA
  Tmem225
atgccctaggtacca

SEQ ID NO: 21937 - DNA, 15 bp, Artificial Sequence
  dgRNA
  Tmem225
aggtaccaaggtcaa

SEQ ID NO: 21938 - DNA, 15 bp, Artificial Sequence
  dgRNA
  Gm13247
ttgggcggattcaga

SEQ ID NO: 21939 - DNA, 15 bp, Artificial Sequence
  dgRNA
  Cdc42
aaaaataccgttaaa

SEQ ID NO: 21940 - DNA, 15 bp, Artificial Sequence
  dgRNA
  Cdc42
cgcgcgtgcgcgcca

SEQ ID NO: 21941 - DNA, 15 bp, Artificial Sequence
  dgRNA
  Cdc42
gcgcgtgcgcgccaa

SEQ ID NO: 21942 - DNA, 15 bp, Artificial Sequence
  dgRNA
  Cdc42
cgcgtgcgcgccaag

SEQ ID NO: 21943 - DNA, 15 bp, Artificial Sequence
  dgRNA
  Dst
agactgcctttcacc

SEQ ID NO: 21944 - DNA, 15 bp, Artificial Sequence
  dgRNA
  Dst
gaagttctcctcgca

SEQ ID NO: 21945 - DNA, 15 bp, Artificial Sequence
  dgRNA
  Dst
tcctcgcatggtcct

SEQ ID NO: 21946 - DNA, 15 bp, Artificial Sequence
  dgRNA
  Dst
aggagaacttctacc

SEQ ID NO: 21947 - DNA, 15 bp, Artificial Sequence
  dgRNA
  Akt3
tcatcactagagagt

SEQ ID NO: 21948 - DNA, 15 bp, Artificial Sequence
  dgRNA
  Akt3
gtaaatgtcttcaat

SEQ ID NO: 21949 - DNA, 15 bp, Artificial Sequence
  dgRNA
  Nphp1
ccctgacaaccggcg

SEQ ID NO: 21950 - DNA, 15 bp, Artificial Sequence
  dgRNA
  Nphp1
ccggcgcggtcccgc

SEQ ID NO: 21951 - DNA, 15 bp, Artificial Sequence
  dgRNA
  Nphp1
gcgcggtcccgccgg

SEQ ID NO: 21952 - DNA, 15 bp, Artificial Sequence
  dgRNA
  Nphp1
cggtcccgccggcgg

SEQ ID NO: 21953 - DNA, 15 bp, Artificial Sequence
  dgRNA
  Plekhb1
ggggagctatgcccc

SEQ ID NO: 21954 - DNA, 15 bp, Artificial Sequence
  dgRNA
  Plekhb1
gggtaagcagagcgc

SEQ ID NO: 21955 - DNA, 15 bp, Artificial Sequence
  dgRNA
  Plekhb1
taaccgagccatgct

SEQ ID NO: 21956 - DNA, 15 bp, Artificial Sequence
  dgRNA
  Plekhb1
ataaccgagccatgc

SEQ ID NO: 21957 - DNA, 15 bp, Artificial Sequence
  dgRNA
  Msx3
cgacaatgctacccc

SEQ ID NO: 21958 - DNA, 15 bp, Artificial Sequence
  dgRNA
  Msx3
ctaccccaggtctcg

SEQ ID NO: 21959 - DNA, 15 bp, Artificial Sequence
  dgRNA
  Msx3
ctgagacccgcacat

SEQ ID NO: 21960 - DNA, 15 bp, Artificial Sequence
  dgRNA
  Msx3
ggctgaaacaaccat

SEQ ID NO: 21961 - DNA, 15 bp, Artificial Sequence
  dgRNA
  F3
atccgcctgcgccga

SEQ ID NO: 21962 - DNA, 15 bp, Artificial Sequence
  dgRNA
  F3
tccgcctgcgccgaa

SEQ ID NO: 21963 - DNA, 15 bp, Artificial Sequence
  dgRNA
  F3
ccgcctgcgccgaag

SEQ ID NO: 21964 - DNA, 15 bp, Artificial Sequence
  dgRNA
  F3
gccgaaggggcagct

SEQ ID NO: 21965 - DNA, 15 bp, Artificial Sequence
  dgRNA
  Larp4
gtctacaggttttaa

SEQ ID NO: 21966 - DNA, 15 bp, Artificial Sequence
  dgRNA
  Larp4
aagcttgcctttagc

SEQ ID NO: 21967 - DNA, 15 bp, Artificial Sequence
  dgRNA
  Tada2a
caccgactagcagcc

SEQ ID NO: 21968 - DNA, 15 bp, Artificial Sequence
  dgRNA
  Tada2a
ccacgctccccatcc

SEQ ID NO: 21969 - DNA, 15 bp, Artificial Sequence
  dgRNA
  Tada2a
acgctccccatcccg

SEQ ID NO: 21970 - DNA, 15 bp, Artificial Sequence
  dgRNA
  Tada2a
ctccccatcccgggg

SEQ ID NO: 21971 - DNA, 15 bp, Artificial Sequence
  dgRNA
  Cyfip2
ggtcatcatcaagct

SEQ ID NO: 21972 - DNA, 15 bp, Artificial Sequence
  dgRNA
  Cyfip2
tgagcccgtgccctc

SEQ ID NO: 21973 - DNA, 15 bp, Artificial Sequence
  dgRNA
  Phactr4
cagtgcaccggactc

SEQ ID NO: 21974 - DNA, 15 bp, Artificial Sequence
  dgRNA
  Phactr4
tgcaccggactctgg

SEQ ID NO: 21975 - DNA, 15 bp, Artificial Sequence
  dgRNA
  Phactr4
ggcgcatgcccagat

SEQ ID NO: 21976 - DNA, 15 bp, Artificial Sequence
  dgRNA
  Phactr4
ccagatcggcagagt

SEQ ID NO: 21977 - DNA, 15 bp, Artificial Sequence
  dgRNA
  Rab27b
gctgtgtataagagc

SEQ ID NO: 21978 - DNA, 15 bp, Artificial Sequence
  dgRNA
  Rab27b
agatggaatccttac

SEQ ID NO: 21979 - DNA, 15 bp, Artificial Sequence
  dgRNA
  Rab27b
ctaaagttagggcgc

SEQ ID NO: 21980 - DNA, 15 bp, Artificial Sequence
  dgRNA
  Rab27b
acccggggcagtgtg

SEQ ID NO: 21981 - DNA, 15 bp, Artificial Sequence
  dgRNA
  Mybl2
ctccgcccctacagt

SEQ ID NO: 21982 - DNA, 15 bp, Artificial Sequence
  dgRNA
  Mybl2
agtaggcccctccta

SEQ ID NO: 21983 - DNA, 15 bp, Artificial Sequence
  dgRNA
  Mybl2
tagggttctggcgcg

SEQ ID NO: 21984 - DNA, 15 bp, Artificial Sequence
  dgRNA
  Mybl2
agggttctggcgcgc

SEQ ID NO: 21985 - DNA, 15 bp, Artificial Sequence
  dgRNA
  Bcl2l15
tcttacatactggca

SEQ ID NO: 21986 - DNA, 15 bp, Artificial Sequence
  dgRNA
  Bcl2l15
cttacatactggcaa

SEQ ID NO: 21987 - DNA, 15 bp, Artificial Sequence
  dgRNA
  Bcl2l15
aggacatatccaatt

SEQ ID NO: 21988 - DNA, 15 bp, Artificial Sequence
  dgRNA
  Lzts2
ccttaggccaccacc

SEQ ID NO: 21989 - DNA, 15 bp, Artificial Sequence
  dgRNA
  Lzts2
aggctacttttggac

SEQ ID NO: 21990 - DNA, 15 bp, Artificial Sequence
  dgRNA
  Lzts2
ggctacttttggact

SEQ ID NO: 21991 - DNA, 15 bp, Artificial Sequence
  dgRNA
  Lzts2
ttttggactgggtac

SEQ ID NO: 21992 - DNA, 15 bp, Artificial Sequence
  dgRNA
  Rffl
ggttttttattcacc

SEQ ID NO: 21993 - DNA, 15 bp, Artificial Sequence
  dgRNA
  Rffl
gttttttattcacct

SEQ ID NO: 21994 - DNA, 15 bp, Artificial Sequence
  dgRNA
  Rffl
agtggtgcatgggcc

SEQ ID NO: 21995 - DNA, 15 bp, Artificial Sequence
  dgRNA
  Rffl
gctgaagtggtgcat

SEQ ID NO: 21996 - DNA, 15 bp, Artificial Sequence
  dgRNA
  Olfr1251
ctgttaacaggtcat

SEQ ID NO: 21997 - DNA, 15 bp, Artificial Sequence
  dgRNA
  Olfr1251
ttaacaggtcatggg

SEQ ID NO: 21998 - DNA, 15 bp, Artificial Sequence
  dgRNA
  Olfr1251
tagttaacaaatagt

SEQ ID NO: 21999 - DNA, 15 bp, Artificial Sequence
  dgRNA
  Olfr1251
ccatgacctgttaac

SEQ ID NO: 22000 - DNA, 15 bp, Artificial Sequence
  dgRNA
  Rad54l2
agcggaactttgctg

SEQ ID NO: 22001 - DNA, 15 bp, Artificial Sequence
  dgRNA
  Rad54l2
gcggaactttgctgc

SEQ ID NO: 22002 - DNA, 15 bp, Artificial Sequence
  dgRNA
  Rad54l2
gaactttgctgcggg

SEQ ID NO: 22003 - DNA, 15 bp, Artificial Sequence
  dgRNA
  Rad54l2
gcttgtgttcccgcc

SEQ ID NO: 22004 - DNA, 15 bp, Artificial Sequence
  dgRNA
  Olfr1366
tggctaagtgaactt

SEQ ID NO: 22005 - DNA, 15 bp, Artificial Sequence
  dgRNA
  Olfr1366
aaccatttggtaaat

SEQ ID NO: 22006 - DNA, 15 bp, Artificial Sequence
  dgRNA
  Olfr1366
accatttggtaaatg

SEQ ID NO: 22007 - DNA, 15 bp, Artificial Sequence
  dgRNA
  Nanos2
gaccttcaagtccat

SEQ ID NO: 22008 - DNA, 15 bp, Artificial Sequence
  dgRNA
  Nanos2
agcaggttattcccc

SEQ ID NO: 22009 - DNA, 15 bp, Artificial Sequence
  dgRNA
  Ptp4a3
taaccttgctgacct

SEQ ID NO: 22010 - DNA, 15 bp, Artificial Sequence
  dgRNA
  Ptp4a3
gaggtagtagcttcc

SEQ ID NO: 22011 - DNA, 15 bp, Artificial Sequence
  dgRNA
  Ptp4a3
cttcctgatccaaat

SEQ ID NO: 22012 - DNA, 15 bp, Artificial Sequence
  dgRNA
  Ptp4a3
tccggccaccaggcc

SEQ ID NO: 22013 - DNA, 15 bp, Artificial Sequence
  dgRNA
  Ugt2b1
tagctcaatactatc

SEQ ID NO: 22014 - DNA, 15 bp, Artificial Sequence
  dgRNA
  Ugt2b1
agctcaatactatca

SEQ ID NO: 22015 - DNA, 15 bp, Artificial Sequence
  dgRNA
  Ugt2b1
atctagtcagtgatg

SEQ ID NO: 22016 - DNA, 15 bp, Artificial Sequence
  dgRNA
  Ugt2b1
actagatgagtctga

SEQ ID NO: 22017 - DNA, 15 bp, Artificial Sequence
  dgRNA
  Ttc9
aaagggcggggacga

SEQ ID NO: 22018 - DNA, 15 bp, Artificial Sequence
  dgRNA
  Ttc9
gagggcgggcgccga

SEQ ID NO: 22019 - DNA, 15 bp, Artificial Sequence
  dgRNA
  Ttc9
cgggcgccgagggaa

SEQ ID NO: 22020 - DNA, 15 bp, Artificial Sequence
  dgRNA
  Ttc9
ggcgccgagggaacg

SEQ ID NO: 22021 - DNA, 15 bp, Artificial Sequence
  dgRNA
  Prpf40b
cgggccgggcacacc

SEQ ID NO: 22022 - DNA, 15 bp, Artificial Sequence
  dgRNA
  Prpf40b
ccgggcacaccgggc

SEQ ID NO: 22023 - DNA, 15 bp, Artificial Sequence
  dgRNA
  Prpf40b
gcacaccgggccggt

SEQ ID NO: 22024 - DNA, 15 bp, Artificial Sequence
  dgRNA
  Prpf40b
cacaccgggccggtt

SEQ ID NO: 22025 - DNA, 15 bp, Artificial Sequence
  dgRNA
  Nabp1
cgagagaccattggt

SEQ ID NO: 22026 - DNA, 15 bp, Artificial Sequence
  dgRNA
  Nabp1
agaccattggtcggc

SEQ ID NO: 22027 - DNA, 15 bp, Artificial Sequence
  dgRNA
  Nabp1
gaccattggtcggcc

SEQ ID NO: 22028 - DNA, 15 bp, Artificial Sequence
  dgRNA
  Nabp1
cattggtcggccggg

SEQ ID NO: 22029 - DNA, 15 bp, Artificial Sequence
  dgRNA
  Kcnh2
gaagggcgggcgctc

SEQ ID NO: 22030 - DNA, 15 bp, Artificial Sequence
  dgRNA
  Kcnh2
aagggcgggcgctcg

SEQ ID NO: 22031 - DNA, 15 bp, Artificial Sequence
  dgRNA
  Kcnh2
ggcgctcggggtggc

SEQ ID NO: 22032 - DNA, 15 bp, Artificial Sequence
  dgRNA
  Kcnh2
gcgctcggggtggcg

SEQ ID NO: 22033 - DNA, 15 bp, Artificial Sequence
  dgRNA
  Fetub
ttgctgcgtcatgcg

SEQ ID NO: 22034 - DNA, 15 bp, Artificial Sequence
  dgRNA
  Fetub
tgctgcgtcatgcgt

SEQ ID NO: 22035 - DNA, 15 bp, Artificial Sequence
  dgRNA
  Fetub
tgcgtcatgcgtggg

SEQ ID NO: 22036 - DNA, 15 bp, Artificial Sequence
  dgRNA
  Fetub
gcgtcatgcgtgggc

SEQ ID NO: 22037 - DNA, 15 bp, Artificial Sequence
  dgRNA
  Hrasls5
gacctaactcctgcg

SEQ ID NO: 22038 - DNA, 15 bp, Artificial Sequence
  dgRNA
  Hrasls5
tttccgttgagttgc

SEQ ID NO: 22039 - DNA, 15 bp, Artificial Sequence
  dgRNA
  Hrasls5
ttccgttgagttgct

SEQ ID NO: 22040 - DNA, 15 bp, Artificial Sequence
  dgRNA
  Hrasls5
tccgttgagttgctg

SEQ ID NO: 22041 - DNA, 15 bp, Artificial Sequence
  dgRNA
  Nipsnap3a
cctcgcccagcattt

SEQ ID NO: 22042 - DNA, 15 bp, Artificial Sequence
  dgRNA
  Nipsnap3a
tgttattgtcctgac

SEQ ID NO: 22043 - DNA, 15 bp, Artificial Sequence
  dgRNA
  Nipsnap3a
gttattgtcctgaca

SEQ ID NO: 22044 - DNA, 15 bp, Artificial Sequence
  dgRNA
  Nipsnap3a
cctgacagggcggga

SEQ ID NO: 22045 - DNA, 15 bp, Artificial Sequence
  dgRNA
  Evi2b
tttcaaaatacgctc

SEQ ID NO: 22046 - DNA, 15 bp, Artificial Sequence
  dgRNA
  Evi2b
aatacgctctggtga

SEQ ID NO: 22047 - DNA, 15 bp, Artificial Sequence
  dgRNA
  Adi1
gacacataactgccg

SEQ ID NO: 22048 - DNA, 15 bp, Artificial Sequence
  dgRNA
  Adi1
acataactgccgagg

SEQ ID NO: 22049 - DNA, 15 bp, Artificial Sequence
  dgRNA
  Adi1
gtgagacgcctttcc

SEQ ID NO: 22050 - DNA, 15 bp, Artificial Sequence
  dgRNA
  Adi1
cccgcccaccaccgt

SEQ ID NO: 22051 - DNA, 15 bp, Artificial Sequence
  dgRNA
  Bpifa1
gccattctataaaag

SEQ ID NO: 22052 - DNA, 15 bp, Artificial Sequence
  dgRNA
  Bpifa1
gcggtgattcttcct

SEQ ID NO: 22053 - DNA, 15 bp, Artificial Sequence
  dgRNA
  Bpifa1
gtcaatcatattaac

SEQ ID NO: 22054 - DNA, 15 bp, Artificial Sequence
  dgRNA
  Bpifa1
tatagaatggcagtt

SEQ ID NO: 22055 - DNA, 15 bp, Artificial Sequence
  dgRNA
  Adgrb2
cccgcgccggcgcct

SEQ ID NO: 22056 - DNA, 15 bp, Artificial Sequence
  dgRNA
  Adgrb2
cggcgcctggggccc

SEQ ID NO: 22057 - DNA, 15 bp, Artificial Sequence
  dgRNA
  Adgrb2
agggcgcgcttggct

SEQ ID NO: 22058 - DNA, 15 bp, Artificial Sequence
  dgRNA
  Adgrb2
cgcgcttggctcggc

SEQ ID NO: 22059 - DNA, 15 bp, Artificial Sequence
  dgRNA
  Drd2
gtccactgctccccg

SEQ ID NO: 22060 - DNA, 15 bp, Artificial Sequence
  dgRNA
  Drd2
tccactgctccccgc

SEQ ID NO: 22061 - DNA, 15 bp, Artificial Sequence
  dgRNA
  Drd2
cccgcgggcccgagc

SEQ ID NO: 22062 - DNA, 15 bp, Artificial Sequence
  dgRNA
  Drd2
cccgagccggccgag

SEQ ID NO: 22063 - DNA, 15 bp, Artificial Sequence
  dgRNA
  Wac
gtgtgacttccgtcg

SEQ ID NO: 22064 - DNA, 15 bp, Artificial Sequence
  dgRNA
  Wac
cgtcgcggcccgccg

SEQ ID NO: 22065 - DNA, 15 bp, Artificial Sequence
  dgRNA
  Wac
tccgcgaccaccgtc

SEQ ID NO: 22066 - DNA, 15 bp, Artificial Sequence
  dgRNA
  Wac
ccgcgaccaccgtcc

SEQ ID NO: 22067 - DNA, 15 bp, Artificial Sequence
  dgRNA
  Myh6
tgcccatcggccctt

SEQ ID NO: 22068 - DNA, 15 bp, Artificial Sequence
  dgRNA
  Myh6
gcccatcggcccttt

SEQ ID NO: 22069 - DNA, 15 bp, Artificial Sequence
  dgRNA
  Myh6
atcggccctttgggg

SEQ ID NO: 22070 - DNA, 15 bp, Artificial Sequence
  dgRNA
  Myh6
gcaacagacctttca

SEQ ID NO: 22071 - DNA, 15 bp, Artificial Sequence
  dgRNA
  Olfr1145
cttggattgtagaaa

SEQ ID NO: 22072 - DNA, 15 bp, Artificial Sequence
  dgRNA
  Ints10
acgcttactcccagg

SEQ ID NO: 22073 - DNA, 15 bp, Artificial Sequence
  dgRNA
  Ints10
gcgcgctaccatcga

SEQ ID NO: 22074 - DNA, 15 bp, Artificial Sequence
  dgRNA
  Ints10
gctaccatcgacgga

SEQ ID NO: 22075 - DNA, 15 bp, Artificial Sequence
  dgRNA
  Ints10
gagtaatgaaaatcc

SEQ ID NO: 22076 - DNA, 15 bp, Artificial Sequence
  dgRNA
  Trim2
gctccttatgcctcc

SEQ ID NO: 22077 - DNA, 15 bp, Artificial Sequence
  dgRNA
  Trim2
ggttaatcctgcagt

SEQ ID NO: 22078 - DNA, 15 bp, Artificial Sequence
  dgRNA
  Trim2
gttaatcctgcagtc

SEQ ID NO: 22079 - DNA, 15 bp, Artificial Sequence
  dgRNA
  Trim2
ttaatcctgcagtcg

SEQ ID NO: 22080 - DNA, 15 bp, Artificial Sequence
  dgRNA
  Nkx6-1
ttcatccgaactgtc

SEQ ID NO: 22081 - DNA, 15 bp, Artificial Sequence
  dgRNA
  Nkx6-1
ggaagagccgccgag

SEQ ID NO: 22082 - DNA, 15 bp, Artificial Sequence
  dgRNA
  Nkx6-1
gaagagccgccgaga

SEQ ID NO: 22083 - DNA, 15 bp, Artificial Sequence
  dgRNA
  Nkx6-1
ccgagagggtcagtt

SEQ ID NO: 22084 - DNA, 15 bp, Artificial Sequence
  dgRNA
  Nsrp1
gacgaggctcgtccc

SEQ ID NO: 22085 - DNA, 15 bp, Artificial Sequence
  dgRNA
  Nsrp1
ctcgtccccggagcg

SEQ ID NO: 22086 - DNA, 15 bp, Artificial Sequence
  dgRNA
  Nsrp1
ccacgagcctctctc

SEQ ID NO: 22087 - DNA, 15 bp, Artificial Sequence
  dgRNA
  Nsrp1
gcaagacacagcggt

SEQ ID NO: 22088 - DNA, 15 bp, Artificial Sequence
  dgRNA
  Fam155a
cactcttcaagggat

SEQ ID NO: 22089 - DNA, 15 bp, Artificial Sequence
  dgRNA
  Fam155a
ggtcggctgatgctt

SEQ ID NO: 22090 - DNA, 15 bp, Artificial Sequence
  dgRNA
  Fam155a
ggctgatgcttaggt

SEQ ID NO: 22091 - DNA, 15 bp, Artificial Sequence
  dgRNA
  Fam155a
gctgtgctggccggt

SEQ ID NO: 22092 - DNA, 15 bp, Artificial Sequence
  dgRNA
  Zfp91
aagcgcagagtaaat

SEQ ID NO: 22093 - DNA, 15 bp, Artificial Sequence
  dgRNA
  Zfp91
tgccctcggcgaagt

SEQ ID NO: 22094 - DNA, 15 bp, Artificial Sequence
  dgRNA
  Zfp91
cccgcgctgtcccct

SEQ ID NO: 22095 - DNA, 15 bp, Artificial Sequence
  dgRNA
  Zfp91
cattgcttccgggtt

SEQ ID NO: 22096 - DNA, 15 bp, Artificial Sequence
  dgRNA
  Grm2
gaggtccggcaaagc

SEQ ID NO: 22097 - DNA, 15 bp, Artificial Sequence
  dgRNA
  Grm2
gtccggcaaagccgg

SEQ ID NO: 22098 - DNA, 15 bp, Artificial Sequence
  dgRNA
  Grm2
aggtgcaggccaaat

SEQ ID NO: 22099 - DNA, 15 bp, Artificial Sequence
  dgRNA
  Grm2
gtgcaggccaaattg

SEQ ID NO: 22100 - DNA, 15 bp, Artificial Sequence
  dgRNA
  Tnc
taacaactactctgc

SEQ ID NO: 22101 - DNA, 15 bp, Artificial Sequence
  dgRNA
  Tnc
aacaactactctgcg

SEQ ID NO: 22102 - DNA, 15 bp, Artificial Sequence
  dgRNA
  Tnc
acaactactctgcgg

SEQ ID NO: 22103 - DNA, 15 bp, Artificial Sequence
  dgRNA
  Tnc
actactctgcggggg

SEQ ID NO: 22104 - DNA, 15 bp, Artificial Sequence
  dgRNA
  Nbas
ccagcggccgcgtcc

SEQ ID NO: 22105 - DNA, 15 bp, Artificial Sequence
  dgRNA
  Nbas
atatgtcttggaccc

SEQ ID NO: 22106 - DNA, 15 bp, Artificial Sequence
  dgRNA
  Nbas
acttgacagatctgt

SEQ ID NO: 22107 - DNA, 15 bp, Artificial Sequence
  dgRNA
  Nbas
aattaagtgcggaaa

SEQ ID NO: 22108 - DNA, 15 bp, Artificial Sequence
  dgRNA
  Hist1h3c
aactaccaatcacac

SEQ ID NO: 22109 - DNA, 15 bp, Artificial Sequence
  dgRNA
  Hist1h3c
aatagcccgtgtgat

SEQ ID NO: 22110 - DNA, 15 bp, Artificial Sequence
  dgRNA
  Hist1h3c
acaaattcattggct

SEQ ID NO: 22111 - DNA, 15 bp, Artificial Sequence
  dgRNA
  Hist1h3c
tacaaattcattggc

SEQ ID NO: 22112 - DNA, 15 bp, Artificial Sequence
  dgRNA
  Mta3
cgaggctagtgcggg

SEQ ID NO: 22113 - DNA, 15 bp, Artificial Sequence
  dgRNA
  Mta3
agtgcgggtggcccc

SEQ ID NO: 22114 - DNA, 15 bp, Artificial Sequence
  dgRNA
  Mta3
gtgcgggtggcccct

SEQ ID NO: 22115 - DNA, 15 bp, Artificial Sequence
  dgRNA
  Mta3
tgcgggtggcccctg

SEQ ID NO: 22116 - DNA, 15 bp, Artificial Sequence
  dgRNA
  Tmem170
agaaacttgccacta

SEQ ID NO: 22117 - DNA, 15 bp, Artificial Sequence
  dgRNA
  Tmem170
gaaacttgccactag

SEQ ID NO: 22118 - DNA, 15 bp, Artificial Sequence
  dgRNA
  Tmem170
gggcgcagcatgccg

SEQ ID NO: 22119 - DNA, 15 bp, Artificial Sequence
  dgRNA
  Tmem170
ggcgcagcatgccgt

SEQ ID NO: 22120 - DNA, 15 bp, Artificial Sequence
  dgRNA
  Lrrc63
gcctgcgcttcttac

SEQ ID NO: 22121 - DNA, 15 bp, Artificial Sequence
  dgRNA
  Lrrc63
cctgcgcttcttacc

SEQ ID NO: 22122 - DNA, 15 bp, Artificial Sequence
  dgRNA
  Lrrc63
tcttaccgggctagc

SEQ ID NO: 22123 - DNA, 15 bp, Artificial Sequence
  dgRNA
  Lrrc63
cttaccgggctagct

SEQ ID NO: 22124 - DNA, 15 bp, Artificial Sequence
  dgRNA
  Pigb
ctccgagcgcctcct

SEQ ID NO: 22125 - DNA, 15 bp, Artificial Sequence
  dgRNA
  Pigb
cgagcgcctcctcgg

SEQ ID NO: 22126 - DNA, 15 bp, Artificial Sequence
  dgRNA
  Pigb
gagcgcctcctcggc

SEQ ID NO: 22127 - DNA, 15 bp, Artificial Sequence
  dgRNA
  Pigb
ggcgggcgctgtgcg

SEQ ID NO: 22128 - DNA, 15 bp, Artificial Sequence
  dgRNA
  Ddhd1
ctgacccccgcttcc

SEQ ID NO: 22129 - DNA, 15 bp, Artificial Sequence
  dgRNA
  Ddhd1
ccccgcttccaggcg

SEQ ID NO: 22130 - DNA, 15 bp, Artificial Sequence
  dgRNA
  Ddhd1
cagcctagcgccaaa

SEQ ID NO: 22131 - DNA, 15 bp, Artificial Sequence
  dgRNA
  Ddhd1
agcctagcgccaaac

SEQ ID NO: 22132 - DNA, 15 bp, Artificial Sequence
  dgRNA
  Gpr68
cactgcggggcggtg

SEQ ID NO: 22133 - DNA, 15 bp, Artificial Sequence
  dgRNA
  Gpr68
actgcggggcggtga

SEQ ID NO: 22134 - DNA, 15 bp, Artificial Sequence
  dgRNA
  Gpr68
ctgcggggcggtgag

SEQ ID NO: 22135 - DNA, 15 bp, Artificial Sequence
  dgRNA
  Gpr68
cagcgccgccccacg

SEQ ID NO: 22136 - DNA, 15 bp, Artificial Sequence
  dgRNA
  Htatip2
gagcgcgctgtcacc

SEQ ID NO: 22137 - DNA, 15 bp, Artificial Sequence
  dgRNA
  Htatip2
acccggaagacgtcg

SEQ ID NO: 22138 - DNA, 15 bp, Artificial Sequence
  dgRNA
  Htatip2
ggaagacgtcgcggc

SEQ ID NO: 22139 - DNA, 15 bp, Artificial Sequence
  dgRNA
  Htatip2
gacgtcgcggccggt

SEQ ID NO: 22140 - DNA, 15 bp, Artificial Sequence
  dgRNA
  Snx13
gcaaacccgccacca

SEQ ID NO: 22141 - DNA, 15 bp, Artificial Sequence
  dgRNA
  Snx13
aacccgccaccacgg

SEQ ID NO: 22142 - DNA, 15 bp, Artificial Sequence
  dgRNA
  Snx13
gccaccacggtggcc

SEQ ID NO: 22143 - DNA, 15 bp, Artificial Sequence
  dgRNA
  Snx13
ggatccagcccgcag

SEQ ID NO: 22144 - DNA, 15 bp, Artificial Sequence
  dgRNA
  Krt86
ttagcacatttaagg

SEQ ID NO: 22145 - DNA, 15 bp, Artificial Sequence
  dgRNA
  Krt86
ttgcttcagaccacg

SEQ ID NO: 22146 - DNA, 15 bp, Artificial Sequence
  dgRNA
  Krt86
cacgtggtcacagtc

SEQ ID NO: 22147 - DNA, 15 bp, Artificial Sequence
  dgRNA
  Krt86
acgtggtcacagtca

SEQ ID NO: 22148 - DNA, 15 bp, Artificial Sequence
  dgRNA
  Rgcc
cggcgggtaaatatt

SEQ ID NO: 22149 - DNA, 15 bp, Artificial Sequence
  dgRNA
  Rgcc
ggcgggtaaatattt

SEQ ID NO: 22150 - DNA, 15 bp, Artificial Sequence
  dgRNA
  Rgcc
gcgggtaaatatttg

SEQ ID NO: 22151 - DNA, 15 bp, Artificial Sequence
  dgRNA
  Rgcc
tttggggcggtatcc

SEQ ID NO: 22152 - DNA, 15 bp, Artificial Sequence
  dgRNA
  Trex1
ctgcggagactgatt

SEQ ID NO: 22153 - DNA, 15 bp, Artificial Sequence
  dgRNA
  Trex1
gacggcggtgggagc

SEQ ID NO: 22154 - DNA, 15 bp, Artificial Sequence
  dgRNA
  Trex1
ggcaaagacggcggt

SEQ ID NO: 22155 - DNA, 15 bp, Artificial Sequence
  dgRNA
  Trex1
tggcaaagacggcgg

SEQ ID NO: 22156 - DNA, 15 bp, Artificial Sequence
  dgRNA
  Tmem232
gtcttaagccaacga

SEQ ID NO: 22157 - DNA, 15 bp, Artificial Sequence
  dgRNA
  Tmem232
atctgagtacacgcg

SEQ ID NO: 22158 - DNA, 15 bp, Artificial Sequence
  dgRNA
  Tmem232
agtacacgcgaggtg

SEQ ID NO: 22159 - DNA, 15 bp, Artificial Sequence
  dgRNA
  Tmem232
gtacacgcgaggtgc

SEQ ID NO: 22160 - DNA, 15 bp, Artificial Sequence
  dgRNA
  Stx1b
ttgggtgcccctccc

SEQ ID NO: 22161 - DNA, 15 bp, Artificial Sequence
  dgRNA
  Stx1b
cggactacaaccccc

SEQ ID NO: 22162 - DNA, 15 bp, Artificial Sequence
  dgRNA
  Stx1b
aggcgcccccagccc

SEQ ID NO: 22163 - DNA, 15 bp, Artificial Sequence
  dgRNA
  Stx1b
ggcgcccccagcccg

SEQ ID NO: 22164 - DNA, 15 bp, Artificial Sequence
  dgRNA
  Cuedc1
cctgcgcaaccgcat

SEQ ID NO: 22165 - DNA, 15 bp, Artificial Sequence
  dgRNA
  Cuedc1
caaccgcattggcct

SEQ ID NO: 22166 - DNA, 15 bp, Artificial Sequence
  dgRNA
  Cuedc1
aaccgcattggcctc

SEQ ID NO: 22167 - DNA, 15 bp, Artificial Sequence
  dgRNA
  Cuedc1
cgcgcgccccacttg

SEQ ID NO: 22168 - DNA, 15 bp, Artificial Sequence
  dgRNA
  Lcn11
catctaaagtgtccc

SEQ ID NO: 22169 - DNA, 15 bp, Artificial Sequence
  dgRNA
  Lcn11
caggcttacctacta

SEQ ID NO: 22170 - DNA, 15 bp, Artificial Sequence
  dgRNA
  Lcn11
gttggctcctatggg

SEQ ID NO: 22171 - DNA, 15 bp, Artificial Sequence
  dgRNA
  Lcn11
ttggctcctatgggt

SEQ ID NO: 22172 - DNA, 15 bp, Artificial Sequence
  dgRNA
  Leap2
gataagatgggtgta

SEQ ID NO: 22173 - DNA, 15 bp, Artificial Sequence
  dgRNA
  Leap2
gctcgtggactttga

SEQ ID NO: 22174 - DNA, 15 bp, Artificial Sequence
  dgRNA
  Leap2
tgtgcttactgctcg

SEQ ID NO: 22175 - DNA, 15 bp, Artificial Sequence
  dgRNA
  Leap2
caaggactacactcc

SEQ ID NO: 22176 - DNA, 15 bp, Artificial Sequence
  dgRNA
  Rtn2
ggagtatgcatattc

SEQ ID NO: 22177 - DNA, 15 bp, Artificial Sequence
  dgRNA
  Rtn2
gagtatgcatattct

SEQ ID NO: 22178 - DNA, 15 bp, Artificial Sequence
  dgRNA
  Rtn2
ccgccccattcctaa

SEQ ID NO: 22179 - DNA, 15 bp, Artificial Sequence
  dgRNA
  Rtn2
cgcctcccattaaaa

SEQ ID NO: 22180 - DNA, 15 bp, Artificial Sequence
  dgRNA
  Ajap1
ccggcgggcggagtt

SEQ ID NO: 22181 - DNA, 15 bp, Artificial Sequence
  dgRNA
  Ajap1
gttgggacccgttcg

SEQ ID NO: 22182 - DNA, 15 bp, Artificial Sequence
  dgRNA
  Ajap1
gggacccgttcgcgg

SEQ ID NO: 22183 - DNA, 15 bp, Artificial Sequence
  dgRNA
  Ajap1
acccgttcgcggagg

SEQ ID NO: 22184 - DNA, 15 bp, Artificial Sequence
  dgRNA
  Nexn
tgggaggtgaccccg

SEQ ID NO: 22185 - DNA, 15 bp, Artificial Sequence
  dgRNA
  Nexn
ctcctcatagagcta

SEQ ID NO: 22186 - DNA, 15 bp, Artificial Sequence
  dgRNA
  Nexn
gctcctcggtttggt

SEQ ID NO: 22187 - DNA, 15 bp, Artificial Sequence
  dgRNA
  Nexn
gttgatggagtgaag

SEQ ID NO: 22188 - DNA, 15 bp, Artificial Sequence
  dgRNA
  Mmp23
tcccaaatttcattg

SEQ ID NO: 22189 - DNA, 15 bp, Artificial Sequence
  dgRNA
  Mmp23
tcattgtggtaccag

SEQ ID NO: 22190 - DNA, 15 bp, Artificial Sequence
  dgRNA
  Mmp23
cattgtggtaccaga

SEQ ID NO: 22191 - DNA, 15 bp, Artificial Sequence
  dgRNA
  Mmp23
ggtaccagagggttg

SEQ ID NO: 22192 - DNA, 15 bp, Artificial Sequence
  dgRNA
  Synj2
ggctgtcgtggtgtt

SEQ ID NO: 22193 - DNA, 15 bp, Artificial Sequence
  dgRNA
  Synj2
gctgtcgtggtgtta

SEQ ID NO: 22194 - DNA, 15 bp, Artificial Sequence
  dgRNA
  Synj2
ctgtcgtggtgttag

SEQ ID NO: 22195 - DNA, 15 bp, Artificial Sequence
  dgRNA
  Synj2
tcgtggtgttagggg

SEQ ID NO: 22196 - DNA, 15 bp, Artificial Sequence
  dgRNA
  Ric8
acctcagacacgcct

SEQ ID NO: 22197 - DNA, 15 bp, Artificial Sequence
  dgRNA
  Ric8
cagacacgcctcggc

SEQ ID NO: 22198 - DNA, 15 bp, Artificial Sequence
  dgRNA
  Ric8
ccgttgctcctctcg

SEQ ID NO: 22199 - DNA, 15 bp, Artificial Sequence
  dgRNA
  Ric8
cgttgctcctctcgc

SEQ ID NO: 22200 - DNA, 15 bp, Artificial Sequence
  dgRNA
  Dmbt1
agcacaccacccaag

SEQ ID NO: 22201 - DNA, 15 bp, Artificial Sequence
  dgRNA
  Dmbt1
gcacaccacccaaga

SEQ ID NO: 22202 - DNA, 15 bp, Artificial Sequence
  dgRNA
  Dmbt1
gttgcccaatgtaga

SEQ ID NO: 22203 - DNA, 15 bp, Artificial Sequence
  dgRNA
  Dmbt1
gtggtaggaacaaac

SEQ ID NO: 22204 - DNA, 15 bp, Artificial Sequence
  dgRNA
  Rbms2
gagaccgaatttttc

SEQ ID NO: 22205 - DNA, 15 bp, Artificial Sequence
  dgRNA
  Rbms2
gcctgctcaactcaa

SEQ ID NO: 22206 - DNA, 15 bp, Artificial Sequence
  dgRNA
  Pitx1
ccgcccggggctagc

SEQ ID NO: 22207 - DNA, 15 bp, Artificial Sequence
  dgRNA
  Pitx1
tcttttgtgcggcca

SEQ ID NO: 22208 - DNA, 15 bp, Artificial Sequence
  dgRNA
  Pitx1
cttttgtgcggccaa

SEQ ID NO: 22209 - DNA, 15 bp, Artificial Sequence
  dgRNA
  Pitx1
aaattcgtgtgtcac

SEQ ID NO: 22210 - DNA, 15 bp, Artificial Sequence
  dgRNA
  Tefm
gactcgccccaaaac

SEQ ID NO: 22211 - DNA, 15 bp, Artificial Sequence
  dgRNA
  Tefm
tactcctatgcatct

SEQ ID NO: 22212 - DNA, 15 bp, Artificial Sequence
  dgRNA
  Tefm
ctcggcgatcccgaa

SEQ ID NO: 22213 - DNA, 15 bp, Artificial Sequence
  dgRNA
  Tefm
cagccatcaattact

SEQ ID NO: 22214 - DNA, 15 bp, Artificial Sequence
  dgRNA
  Cubn
taacttaagccttct

SEQ ID NO: 22215 - DNA, 15 bp, Artificial Sequence
  dgRNA
  Cubn
gcagccctcaaattc

SEQ ID NO: 22216 - DNA, 15 bp, Artificial Sequence
  dgRNA
  Cubn
tccctcttgccggcg

SEQ ID NO: 22217 - DNA, 15 bp, Artificial Sequence
  dgRNA
  Cubn
tgccggcgaggtgag

SEQ ID NO: 22218 - DNA, 15 bp, Artificial Sequence
  dgRNA
  Homer1
tgggggcacgagccg

SEQ ID NO: 22219 - DNA, 15 bp, Artificial Sequence
  dgRNA
  Homer1
gcggctgccgtgcct

SEQ ID NO: 22220 - DNA, 15 bp, Artificial Sequence
  dgRNA
  Homer1
tctcgcctcagcgcg

SEQ ID NO: 22221 - DNA, 15 bp, Artificial Sequence
  dgRNA
  Homer1
cagcgcgcggccgcc

SEQ ID NO: 22222 - DNA, 15 bp, Artificial Sequence
  dgRNA
  Ube2v1
cgctcactgaagact

SEQ ID NO: 22223 - DNA, 15 bp, Artificial Sequence
  dgRNA
  Ube2v1
aaagcccttcccgcc

SEQ ID NO: 22224 - DNA, 15 bp, Artificial Sequence
  dgRNA
  Ube2v1
tcctgcgaccccgag

SEQ ID NO: 22225 - DNA, 15 bp, Artificial Sequence
  dgRNA
  Ube2v1
cctgcgaccccgagc

SEQ ID NO: 22226 - DNA, 15 bp, Artificial Sequence
  dgRNA
  Asap2
gcgggttgttcccgc

SEQ ID NO: 22227 - DNA, 15 bp, Artificial Sequence
  dgRNA
  Asap2
tgggctcgctcgaag

SEQ ID NO: 22228 - DNA, 15 bp, Artificial Sequence
  dgRNA
  Asap2
cgctcgaagaggacg

SEQ ID NO: 22229 - DNA, 15 bp, Artificial Sequence
  dgRNA
  Asap2
tcgaagaggacgcgg

SEQ ID NO: 22230 - DNA, 15 bp, Artificial Sequence
  dgRNA
  mt-Nd1
cttctctaggttaga

SEQ ID NO: 22231 - DNA, 15 bp, Artificial Sequence
  dgRNA
  mt-Nd1
tcttacgcaatttcc

SEQ ID NO: 22232 - DNA, 15 bp, Artificial Sequence
  dgRNA
  Atp6v1g2
gcagtagtcagcaca

SEQ ID NO: 22233 - DNA, 15 bp, Artificial Sequence
  dgRNA
  Atp6v1g2
ctcgggcggccgttt

SEQ ID NO: 22234 - DNA, 15 bp, Artificial Sequence
  dgRNA
  Atp6v1g2
tcgggcggccgtttc

SEQ ID NO: 22235 - DNA, 15 bp, Artificial Sequence
  dgRNA
  Atp6v1g2
cgatgagaatggtgt

SEQ ID NO: 22236 - DNA, 15 bp, Artificial Sequence
  dgRNA
  Mum1l1
tttcgcccctccccg

SEQ ID NO: 22237 - DNA, 15 bp, Artificial Sequence
  dgRNA
  Mum1l1
ttcgcccctccccga

SEQ ID NO: 22238 - DNA, 15 bp, Artificial Sequence
  dgRNA
  Mum1l1
tcgcccctccccgag

SEQ ID NO: 22239 - DNA, 15 bp, Artificial Sequence
  dgRNA
  Mum1l1
gcccccagcatgcga

SEQ ID NO: 22240 - DNA, 15 bp, Artificial Sequence
  dgRNA
  Hdac5
ccccagcctaacctt

SEQ ID NO: 22241 - DNA, 15 bp, Artificial Sequence
  dgRNA
  Hdac5
agcctaaccttgggc

SEQ ID NO: 22242 - DNA, 15 bp, Artificial Sequence
  dgRNA
  Hdac5
gcctaaccttgggct

SEQ ID NO: 22243 - DNA, 15 bp, Artificial Sequence
  dgRNA
  Hdac5
tcacggtggcgctat

SEQ ID NO: 22244 - DNA, 15 bp, Artificial Sequence
  dgRNA
  Olfr1306
actagtagtaatcag

SEQ ID NO: 22245 - DNA, 15 bp, Artificial Sequence
  dgRNA
  Slc10a2
ggccagtagtttctc

SEQ ID NO: 22246 - DNA, 15 bp, Artificial Sequence
  dgRNA
  Slc10a2
tatgtcagtttcgag

SEQ ID NO: 22247 - DNA, 15 bp, Artificial Sequence
  dgRNA
  Ttk
gcacggcgagcgcgt

SEQ ID NO: 22248 - DNA, 15 bp, Artificial Sequence
  dgRNA
  Ttk
gcgcgtcggcagctg

SEQ ID NO: 22249 - DNA, 15 bp, Artificial Sequence
  dgRNA
  Ttk
cgcgtcggcagctgc

SEQ ID NO: 22250 - DNA, 15 bp, Artificial Sequence
  dgRNA
  Ttk
ctgcgggtaactccc

SEQ ID NO: 22251 - DNA, 15 bp, Artificial Sequence
  dgRNA
  Ntsr2
ccaggtgaacctcaa

SEQ ID NO: 22252 - DNA, 15 bp, Artificial Sequence
  dgRNA
  Ntsr2
caacacgtgcttttc

SEQ ID NO: 22253 - DNA, 15 bp, Artificial Sequence
  dgRNA
  Ntsr2
gtgtcctcccagttt

SEQ ID NO: 22254 - DNA, 15 bp, Artificial Sequence
  dgRNA
  Ntsr2
ccgggcagctagccc

SEQ ID NO: 22255 - DNA, 15 bp, Artificial Sequence
  dgRNA
  Prelid2
acgctttcaagctgc

SEQ ID NO: 22256 - DNA, 15 bp, Artificial Sequence
  dgRNA
  Prelid2
cgctttcaagctgct

SEQ ID NO: 22257 - DNA, 15 bp, Artificial Sequence
  dgRNA
  Prelid2
ggtttggggcgtccc

SEQ ID NO: 22258 - DNA, 15 bp, Artificial Sequence
  dgRNA
  Prelid2
tggtgagcgctttat

SEQ ID NO: 22259 - DNA, 15 bp, Artificial Sequence
  dgRNA
  Lhx8
tcagagtaagttgtc

SEQ ID NO: 22260 - DNA, 15 bp, Artificial Sequence
  dgRNA
  Lhx8
ggcgggtttttcata

SEQ ID NO: 22261 - DNA, 15 bp, Artificial Sequence
  dgRNA
  Lhx8
gggtttttcataagg

SEQ ID NO: 22262 - DNA, 15 bp, Artificial Sequence
  dgRNA
  Rbms3
aatttcctttttccg

SEQ ID NO: 22263 - DNA, 15 bp, Artificial Sequence
  dgRNA
  Rbms3
ttcctttttccgcgg

SEQ ID NO: 22264 - DNA, 15 bp, Artificial Sequence
  dgRNA
  Rbms3
tcctttttccgcggt

SEQ ID NO: 22265 - DNA, 15 bp, Artificial Sequence
  dgRNA
  Rbms3
tccgagttgtgctaa

SEQ ID NO: 22266 - DNA, 15 bp, Artificial Sequence
  dgRNA
  Mgam
tgaacacgtgagtat

SEQ ID NO: 22267 - DNA, 15 bp, Artificial Sequence
  dgRNA
  Mgam
ggcagtataaaatgg

SEQ ID NO: 22268 - DNA, 15 bp, Artificial Sequence
  dgRNA
  Mgam
ctattagataacaac

SEQ ID NO: 22269 - DNA, 15 bp, Artificial Sequence
  dgRNA
  Mgam
tgcacgcagaaatca

SEQ ID NO: 22270 - DNA, 15 bp, Artificial Sequence
  dgRNA
  Atp8b3
cacgcccacaactcc

SEQ ID NO: 22271 - DNA, 15 bp, Artificial Sequence
  dgRNA
  Atp8b3
ctgtgccattcaact

SEQ ID NO: 22272 - DNA, 15 bp, Artificial Sequence
  dgRNA
  Atp8b3
cccgcccctgtcgcc

SEQ ID NO: 22273 - DNA, 15 bp, Artificial Sequence
  dgRNA
  Atp8b3
gtcaggtctcgtggg

SEQ ID NO: 22274 - DNA, 15 bp, Artificial Sequence
  dgRNA
  Camta2
ccgagcttccgcctc

SEQ ID NO: 22275 - DNA, 15 bp, Artificial Sequence
  dgRNA
  Camta2
cgctattgcctcttt

SEQ ID NO: 22276 - DNA, 15 bp, Artificial Sequence
  dgRNA
  Camta2
gcgcgtctcgtagac

SEQ ID NO: 22277 - DNA, 15 bp, Artificial Sequence
  dgRNA
  Camta2
ccccgttcccttaat

SEQ ID NO: 22278 - DNA, 15 bp, Artificial Sequence
  dgRNA
  Pou2f2
aatacactcatgatc

SEQ ID NO: 22279 - DNA, 15 bp, Artificial Sequence
  dgRNA
  Pou2f2
atacactcatgatct

SEQ ID NO: 22280 - DNA, 15 bp, Artificial Sequence
  dgRNA
  Pou2f2
tgatctggggtcgcc

SEQ ID NO: 22281 - DNA, 15 bp, Artificial Sequence
  dgRNA
  Pou2f2
gatctggggtcgcct

SEQ ID NO: 22282 - DNA, 15 bp, Artificial Sequence
  dgRNA
  Enox1
ggccagtcgcttctt

SEQ ID NO: 22283 - DNA, 15 bp, Artificial Sequence
  dgRNA
  Enox1
gccagtcgcttcttc

SEQ ID NO: 22284 - DNA, 15 bp, Artificial Sequence
  dgRNA
  Enox1
ttcttcgggccagac

SEQ ID NO: 22285 - DNA, 15 bp, Artificial Sequence
  dgRNA
  Enox1
cctttcaccgcttta

SEQ ID NO: 22286 - DNA, 15 bp, Artificial Sequence
  dgRNA
  Ces1c
aattggtctagagga

SEQ ID NO: 22287 - DNA, 15 bp, Artificial Sequence
  dgRNA
  Aldh3b3
cttggttagccagac

SEQ ID NO: 22288 - DNA, 15 bp, Artificial Sequence
  dgRNA
  Aldh3b3
tggtgacttagcccg

SEQ ID NO: 22289 - DNA, 15 bp, Artificial Sequence
  dgRNA
  Aldh3b3
ggtgacttagcccgt

SEQ ID NO: 22290 - DNA, 15 bp, Artificial Sequence
  dgRNA
  Aldh3b3
gtgacttagcccgtg

SEQ ID NO: 22291 - DNA, 15 bp, Artificial Sequence
  dgRNA
  Ptgis
atcgtcaccacagtc

SEQ ID NO: 22292 - DNA, 15 bp, Artificial Sequence
  dgRNA
  Ptgis
atgggctgggaaccg

SEQ ID NO: 22293 - DNA, 15 bp, Artificial Sequence
  dgRNA
  Ptgis
ttgcaagaatgtggc

SEQ ID NO: 22294 - DNA, 15 bp, Artificial Sequence
  dgRNA
  Ptgis
aagaatgtggccgga

SEQ ID NO: 22295 - DNA, 15 bp, Artificial Sequence
  dgRNA
  1810065E05Rik
agtgtagtgcacttt

SEQ ID NO: 22296 - DNA, 15 bp, Artificial Sequence
  dgRNA
  1810065E05Rik
agcgccttaattgcc

SEQ ID NO: 22297 - DNA, 15 bp, Artificial Sequence
  dgRNA
  1810065E05Rik
aggcaatggacctct

SEQ ID NO: 22298 - DNA, 15 bp, Artificial Sequence
  dgRNA
  1810065E05Rik
cctccattgagctat

SEQ ID NO: 22299 - DNA, 15 bp, Artificial Sequence
  dgRNA
  Psmc2
tcacggccggcaggc

SEQ ID NO: 22300 - DNA, 15 bp, Artificial Sequence
  dgRNA
  Psmc2
cacggccggcaggca

SEQ ID NO: 22301 - DNA, 15 bp, Artificial Sequence
  dgRNA
  Psmc2
cgtccgcactacctg

SEQ ID NO: 22302 - DNA, 15 bp, Artificial Sequence
  dgRNA
  Psmc2
ctgagcctcgcgcct

SEQ ID NO: 22303 - DNA, 15 bp, Artificial Sequence
  dgRNA
  Vmn2r96
acattaggcttaagc

SEQ ID NO: 22304 - DNA, 15 bp, Artificial Sequence
  dgRNA
  Myot
atattgttcagattg

SEQ ID NO: 22305 - DNA, 15 bp, Artificial Sequence
  dgRNA
  Myot
ccagcataggtagat

SEQ ID NO: 22306 - DNA, 15 bp, Artificial Sequence
  dgRNA
  Myot
cagctgataaaagtc

SEQ ID NO: 22307 - DNA, 15 bp, Artificial Sequence
  dgRNA
  Myot
cctatctacctatgc

SEQ ID NO: 22308 - DNA, 15 bp, Artificial Sequence
  dgRNA
  Rnf141
tccaggcaacgcgcg

SEQ ID NO: 22309 - DNA, 15 bp, Artificial Sequence
  dgRNA
  Rnf141
ccaggcaacgcgcga

SEQ ID NO: 22310 - DNA, 15 bp, Artificial Sequence
  dgRNA
  Rnf141
cccccctgttggctt

SEQ ID NO: 22311 - DNA, 15 bp, Artificial Sequence
  dgRNA
  Rnf141
tccacccccccctgt

SEQ ID NO: 22312 - DNA, 15 bp, Artificial Sequence
  dgRNA
  Erich6b
cgtgttccgttccca

SEQ ID NO: 22313 - DNA, 15 bp, Artificial Sequence
  dgRNA
  Erich6b
acttaaactcgagat

SEQ ID NO: 22314 - DNA, 15 bp, Artificial Sequence
  dgRNA
  Erich6b
aaactcgagattgga

SEQ ID NO: 22315 - DNA, 15 bp, Artificial Sequence
  dgRNA
  Erich6b
aactcgagattggaa

SEQ ID NO: 22316 - DNA, 15 bp, Artificial Sequence
  dgRNA
  Fam149b
aatcccggcccatgc

SEQ ID NO: 22317 - DNA, 15 bp, Artificial Sequence
  dgRNA
  Fam149b
atcccggcccatgct

SEQ ID NO: 22318 - DNA, 15 bp, Artificial Sequence
  dgRNA
  Fam149b
gtcctcgcgttcgct

SEQ ID NO: 22319 - DNA, 15 bp, Artificial Sequence
  dgRNA
  Fam149b
tcctcgcgttcgctt

SEQ ID NO: 22320 - DNA, 15 bp, Artificial Sequence
  dgRNA
  Mgp
tactatagcacagcc

SEQ ID NO: 22321 - DNA, 15 bp, Artificial Sequence
  dgRNA
  Mgp
tgtgtagatactatc

SEQ ID NO: 22322 - DNA, 15 bp, Artificial Sequence
  dgRNA
  Mgp
tagatactatctgga

SEQ ID NO: 22323 - DNA, 15 bp, Artificial Sequence
  dgRNA
  Mgp
ttgggccaaatccca

SEQ ID NO: 22324 - DNA, 15 bp, Artificial Sequence
  dgRNA
  Nox1
gtgaaaaccctcagc

SEQ ID NO: 22325 - DNA, 15 bp, Artificial Sequence
  dgRNA
  Nox1
agttccgtttagacg

SEQ ID NO: 22326 - DNA, 15 bp, Artificial Sequence
  dgRNA
  Nox1
ccgtttagacgagga

SEQ ID NO: 22327 - DNA, 15 bp, Artificial Sequence
  dgRNA
  Nox1
ggttttcaccccttc

SEQ ID NO: 22328 - DNA, 15 bp, Artificial Sequence
  dgRNA
  Cdh8
gccgccggagtcacc

SEQ ID NO: 22329 - DNA, 15 bp, Artificial Sequence
  dgRNA
  Cdh8
cgccgccggagtcac

SEQ ID NO: 22330 - DNA, 15 bp, Artificial Sequence
  dgRNA
  Olfr668
gtgcaaacaacttta

SEQ ID NO: 22331 - DNA, 15 bp, Artificial Sequence
  dgRNA
  Olfr132
aacatcatacgctta

SEQ ID NO: 22332 - DNA, 15 bp, Artificial Sequence
  dgRNA
  Olfr132
caagttgcacagcct

SEQ ID NO: 22333 - DNA, 15 bp, Artificial Sequence
  dgRNA
  Olfr132
aagatcctagctggc

SEQ ID NO: 22334 - DNA, 15 bp, Artificial Sequence
  dgRNA
  Olfr132
tgtgaagatcctagc

SEQ ID NO: 22335 - DNA, 15 bp, Artificial Sequence
  dgRNA
  Fndc8
cctaacccaggcgtt

SEQ ID NO: 22336 - DNA, 15 bp, Artificial Sequence
  dgRNA
  Fndc8
gcaaacttcctatca

SEQ ID NO: 22337 - DNA, 15 bp, Artificial Sequence
  dgRNA
  Fndc8
cttcctatcaagggg

SEQ ID NO: 22338 - DNA, 15 bp, Artificial Sequence
  dgRNA
  Fndc8
ctatcaaggggaggc

SEQ ID NO: 22339 - DNA, 15 bp, Artificial Sequence
  dgRNA
  Rasl10b
cggccccgggtaagc

SEQ ID NO: 22340 - DNA, 15 bp, Artificial Sequence
  dgRNA
  Rasl10b
ccccgggtaagcggg

SEQ ID NO: 22341 - DNA, 15 bp, Artificial Sequence
  dgRNA
  Rasl10b
cgggtaagcgggagg

SEQ ID NO: 22342 - DNA, 15 bp, Artificial Sequence
  dgRNA
  Rasl10b
ggagcggggcgaccg

SEQ ID NO: 22343 - DNA, 15 bp, Artificial Sequence
  dgRNA
  Slc25a13
tctcccttgcccccg

SEQ ID NO: 22344 - DNA, 15 bp, Artificial Sequence
  dgRNA
  Slc25a13
gggtatacacgacaa

SEQ ID NO: 22345 - DNA, 15 bp, Artificial Sequence
  dgRNA
  Slc25a13
ctgagtcacgtgtcc

SEQ ID NO: 22346 - DNA, 15 bp, Artificial Sequence
  dgRNA
  Slc25a13
gtagctcccatactg

SEQ ID NO: 22347 - DNA, 15 bp, Artificial Sequence
  dgRNA
  Micu2
tgtcaccggagccga

SEQ ID NO: 22348 - DNA, 15 bp, Artificial Sequence
  dgRNA
  Micu2
cacgcttgaacgtcg

SEQ ID NO: 22349 - DNA, 15 bp, Artificial Sequence
  dgRNA
  Micu2
cacacgcgcagagca

SEQ ID NO: 22350 - DNA, 15 bp, Artificial Sequence
  dgRNA
  Micu2
acgcgcagagcacgg

SEQ ID NO: 22351 - DNA, 15 bp, Artificial Sequence
  dgRNA
  Lmo2
agaccttcgcgagag

SEQ ID NO: 22352 - DNA, 15 bp, Artificial Sequence
  dgRNA
  Lmo2
ccttcgcgagagagg

SEQ ID NO: 22353 - DNA, 15 bp, Artificial Sequence
  dgRNA
  Lmo2
cttcgcgagagagga

SEQ ID NO: 22354 - DNA, 15 bp, Artificial Sequence
  dgRNA
  Lmo2
cctcctctctcgcga

SEQ ID NO: 22355 - DNA, 15 bp, Artificial Sequence
  dgRNA
  Nepn
cacctagagatatta

SEQ ID NO: 22356 - DNA, 15 bp, Artificial Sequence
  dgRNA
  Nepn
gctaacccagacaaa

SEQ ID NO: 22357 - DNA, 15 bp, Artificial Sequence
  dgRNA
  Nepn
tgttatcagactccg

SEQ ID NO: 22358 - DNA, 15 bp, Artificial Sequence
  dgRNA
  Zmat2
cgcagtcagaatgag

SEQ ID NO: 22359 - DNA, 15 bp, Artificial Sequence
  dgRNA
  Zmat2
aggctcggatcttat

SEQ ID NO: 22360 - DNA, 15 bp, Artificial Sequence
  dgRNA
  Zmat2
cgtgatcttgccttc

SEQ ID NO: 22361 - DNA, 15 bp, Artificial Sequence
  dgRNA
  Zmat2
caacgtttttctctc

SEQ ID NO: 22362 - DNA, 15 bp, Artificial Sequence
  dgRNA
  Spag9
attatgtagatcgct

SEQ ID NO: 22363 - DNA, 15 bp, Artificial Sequence
  dgRNA
  Spag9
aggtattgtagccaa

SEQ ID NO: 22364 - DNA, 15 bp, Artificial Sequence
  dgRNA
  Spag9
ggtattgtagccaat

SEQ ID NO: 22365 - DNA, 15 bp, Artificial Sequence
  dgRNA
  Spag9
agactcttagtggcg

SEQ ID NO: 22366 - DNA, 15 bp, Artificial Sequence
  dgRNA
  Scx
ccagaaagatgctcg

SEQ ID NO: 22367 - DNA, 15 bp, Artificial Sequence
  dgRNA
  Scx
gctcgggggccctct

SEQ ID NO: 22368 - DNA, 15 bp, Artificial Sequence
  dgRNA
  Scx
ggggccctctaggca

SEQ ID NO: 22369 - DNA, 15 bp, Artificial Sequence
  dgRNA
  Scx
ggcacggctattaaa

SEQ ID NO: 22370 - DNA, 15 bp, Artificial Sequence
  dgRNA
  Ifnar2
ctacctagtcctcca

SEQ ID NO: 22371 - DNA, 15 bp, Artificial Sequence
  dgRNA
  Ifnar2
cctagtcctccaagg

SEQ ID NO: 22372 - DNA, 15 bp, Artificial Sequence
  dgRNA
  Ifnar2
ccgatccgttaactc

SEQ ID NO: 22373 - DNA, 15 bp, Artificial Sequence
  dgRNA
  Ifnar2
ggactgtacttgaag

SEQ ID NO: 22374 - DNA, 15 bp, Artificial Sequence
  dgRNA
  Traf5
gatccactcatgaaa

SEQ ID NO: 22375 - DNA, 15 bp, Artificial Sequence
  dgRNA
  Traf5
ttggaaacgagacat

SEQ ID NO: 22376 - DNA, 15 bp, Artificial Sequence
  dgRNA
  Znhit1
gcaaccgaatccccc

SEQ ID NO: 22377 - DNA, 15 bp, Artificial Sequence
  dgRNA
  Znhit1
caaccgaatcccccc

SEQ ID NO: 22378 - DNA, 15 bp, Artificial Sequence
  dgRNA
  Znhit1
ccgaatccccccggg

SEQ ID NO: 22379 - DNA, 15 bp, Artificial Sequence
  dgRNA
  Znhit1
cgaatccccccggga

SEQ ID NO: 22380 - DNA, 15 bp, Artificial Sequence
  dgRNA
  Noxa1
atattgagataaccg

SEQ ID NO: 22381 - DNA, 15 bp, Artificial Sequence
  dgRNA
  Noxa1
taaccgtggtttcat

SEQ ID NO: 22382 - DNA, 15 bp, Artificial Sequence
  dgRNA
  Noxa1
gcgttgagctaagcc

SEQ ID NO: 22383 - DNA, 15 bp, Artificial Sequence
  dgRNA
  Noxa1
cgttgagctaagcca

SEQ ID NO: 22384 - DNA, 15 bp, Artificial Sequence
  dgRNA
  Gkn1
agataccttcgtcag

SEQ ID NO: 22385 - DNA, 15 bp, Artificial Sequence
  dgRNA
  Gkn1
agggccctactgagc

SEQ ID NO: 22386 - DNA, 15 bp, Artificial Sequence
  dgRNA
  Gkn1
gaagcagataagccg

SEQ ID NO: 22387 - DNA, 15 bp, Artificial Sequence
  dgRNA
  Gkn1
tagcttgagcaaagc

SEQ ID NO: 22388 - DNA, 15 bp, Artificial Sequence
  dgRNA
  Traf3
gcgccgccgttgcta

SEQ ID NO: 22389 - DNA, 15 bp, Artificial Sequence
  dgRNA
  Traf3
cgccgttgctaaggc

SEQ ID NO: 22390 - DNA, 15 bp, Artificial Sequence
  dgRNA
  Traf3
cgttgctaaggccgg

SEQ ID NO: 22391 - DNA, 15 bp, Artificial Sequence
  dgRNA
  Traf3
ccggcggcgagcgcg

SEQ ID NO: 22392 - DNA, 15 bp, Artificial Sequence
  dgRNA
  Zeb1
actctgcagcgtcca

SEQ ID NO: 22393 - DNA, 15 bp, Artificial Sequence
  dgRNA
  Zeb1
tgccgcaaaccaccc

SEQ ID NO: 22394 - DNA, 15 bp, Artificial Sequence
  dgRNA
  Zeb1
ccggccctagcaaca

SEQ ID NO: 22395 - DNA, 15 bp, Artificial Sequence
  dgRNA
  Zeb1
ctagcaacaaggttc

SEQ ID NO: 22396 - DNA, 15 bp, Artificial Sequence
  dgRNA
  Tomm34
cagagctcacgccaa

SEQ ID NO: 22397 - DNA, 15 bp, Artificial Sequence
  dgRNA
  Tomm34
ggccggacagagcta

SEQ ID NO: 22398 - DNA, 15 bp, Artificial Sequence
  dgRNA
  Tomm34
gccggacagagctaa

SEQ ID NO: 22399 - DNA, 15 bp, Artificial Sequence
  dgRNA
  Tomm34
ttgagcccactcttc

SEQ ID NO: 22400 - DNA, 15 bp, Artificial Sequence
  dgRNA
  Med20
gtcctgtcaacccgt

SEQ ID NO: 22401 - DNA, 15 bp, Artificial Sequence
  dgRNA
  Med20
acccgttggacgcct

SEQ ID NO: 22402 - DNA, 15 bp, Artificial Sequence
  dgRNA
  Med20
cccgttggacgcctt

SEQ ID NO: 22403 - DNA, 15 bp, Artificial Sequence
  dgRNA
  Med20
ccgttggacgccttg

SEQ ID NO: 22404 - DNA, 15 bp, Artificial Sequence
  dgRNA
  Lrrn1
gagctgcccctttgt

SEQ ID NO: 22405 - DNA, 15 bp, Artificial Sequence
  dgRNA
  Lrrn1
tgcccctttgttggg

SEQ ID NO: 22406 - DNA, 15 bp, Artificial Sequence
  dgRNA
  Lrrn1
tgggcgggctacaga

SEQ ID NO: 22407 - DNA, 15 bp, Artificial Sequence
  dgRNA
  Lrrn1
gatggtgccccagcg

SEQ ID NO: 22408 - DNA, 15 bp, Artificial Sequence
  dgRNA
  Stox2
ctcaaaacgcatttt

SEQ ID NO: 22409 - DNA, 15 bp, Artificial Sequence
  dgRNA
  Stox2
ttttggcaacccaaa

SEQ ID NO: 22410 - DNA, 15 bp, Artificial Sequence
  dgRNA
  Stox2
tttggcaacccaaat

SEQ ID NO: 22411 - DNA, 15 bp, Artificial Sequence
  dgRNA
  Stox2
gcaacccaaatgggg

SEQ ID NO: 22412 - DNA, 15 bp, Artificial Sequence
  dgRNA
  Eepd1
aacataactagagct

SEQ ID NO: 22413 - DNA, 15 bp, Artificial Sequence
  dgRNA
  Eepd1
taactagagcttggt

SEQ ID NO: 22414 - DNA, 15 bp, Artificial Sequence
  dgRNA
  Eepd1
cggctcctccccacc

SEQ ID NO: 22415 - DNA, 15 bp, Artificial Sequence
  dgRNA
  Eepd1
caatgatcccgcccc

SEQ ID NO: 22416 - DNA, 15 bp, Artificial Sequence
  dgRNA
  Stag3
tggagcccacgtgac

SEQ ID NO: 22417 - DNA, 15 bp, Artificial Sequence
  dgRNA
  Stag3
cagctacatgcctgg

SEQ ID NO: 22418 - DNA, 15 bp, Artificial Sequence
  dgRNA
  Stag3
gccaagcgcgctgag

SEQ ID NO: 22419 - DNA, 15 bp, Artificial Sequence
  dgRNA
  Stag3
agcgcgctgagaggc

SEQ ID NO: 22420 - DNA, 15 bp, Artificial Sequence
  dgRNA
  Pfdn4
tgatctctagccgct

SEQ ID NO: 22421 - DNA, 15 bp, Artificial Sequence
  dgRNA
  Pfdn4
gatctctagccgctg

SEQ ID NO: 22422 - DNA, 15 bp, Artificial Sequence
  dgRNA
  Pfdn4
tgcgcgctctctgtg

SEQ ID NO: 22423 - DNA, 15 bp, Artificial Sequence
  dgRNA
  Pfdn4
gatgcaccgagtcga

SEQ ID NO: 22424 - DNA, 15 bp, Artificial Sequence
  dgRNA
  Nfil3
tagcagctgcggccg

SEQ ID NO: 22425 - DNA, 15 bp, Artificial Sequence
  dgRNA
  Nfil3
ggccgcggccagaga

SEQ ID NO: 22426 - DNA, 15 bp, Artificial Sequence
  dgRNA
  Nfil3
gacgcggactgccag

SEQ ID NO: 22427 - DNA, 15 bp, Artificial Sequence
  dgRNA
  Nfil3
ctgccagtggcgccg

SEQ ID NO: 22428 - DNA, 15 bp, Artificial Sequence
  dgRNA
  Dpep2
gccctagtcagaaac

SEQ ID NO: 22429 - DNA, 15 bp, Artificial Sequence
  dgRNA
  Dpep2
gtatccgggggaaga

SEQ ID NO: 22430 - DNA, 15 bp, Artificial Sequence
  dgRNA
  Dpep2
cgtggtagtatccgg

SEQ ID NO: 22431 - DNA, 15 bp, Artificial Sequence
  dgRNA
  Dpagt1
ataacactaccggtc

SEQ ID NO: 22432 - DNA, 15 bp, Artificial Sequence
  dgRNA
  Dpagt1
tgcccgttttaaaaa

SEQ ID NO: 22433 - DNA, 15 bp, Artificial Sequence
  dgRNA
  Dpagt1
ttcgcaattaagatc

SEQ ID NO: 22434 - DNA, 15 bp, Artificial Sequence
  dgRNA
  Dpagt1
tcgcaattaagatcc

SEQ ID NO: 22435 - DNA, 15 bp, Artificial Sequence
  dgRNA
  Syt4
cctgaaacgtatcct

SEQ ID NO: 22436 - DNA, 15 bp, Artificial Sequence
  dgRNA
  Syt4
ttctgttagactcgg

SEQ ID NO: 22437 - DNA, 15 bp, Artificial Sequence
  dgRNA
  Syt4
ctattctgttagact

SEQ ID NO: 22438 - DNA, 15 bp, Artificial Sequence
  dgRNA
  Hist1h4c
tccaagacccggatt

SEQ ID NO: 22439 - DNA, 15 bp, Artificial Sequence
  dgRNA
  Hist1h4c
ctctagttttcaacc

SEQ ID NO: 22440 - DNA, 15 bp, Artificial Sequence
  dgRNA
  Hist1h4c
aaccaggtccgcaga

SEQ ID NO: 22441 - DNA, 15 bp, Artificial Sequence
  dgRNA
  Hist1h4c
agaaggcctatttaa

SEQ ID NO: 22442 - DNA, 15 bp, Artificial Sequence
  dgRNA
  Psmd13
cccacagtctgagcg

SEQ ID NO: 22443 - DNA, 15 bp, Artificial Sequence
  dgRNA
  Psmd13
tgctctgcaggacga

SEQ ID NO: 22444 - DNA, 15 bp, Artificial Sequence
  dgRNA
  Psmd13
gacgacggcgcctag

SEQ ID NO: 22445 - DNA, 15 bp, Artificial Sequence
  dgRNA
  Psmd13
acgacggcgcctaga

SEQ ID NO: 22446 - DNA, 15 bp, Artificial Sequence
  dgRNA
  Pyy
accccagtccgaaga

SEQ ID NO: 22447 - DNA, 15 bp, Artificial Sequence
  dgRNA
  Pyy
ccccagtccgaagat

SEQ ID NO: 22448 - DNA, 15 bp, Artificial Sequence
  dgRNA
  Pyy
acagcacgtactggc

SEQ ID NO: 22449 - DNA, 15 bp, Artificial Sequence
  dgRNA
  Pyy
cagcacgtactggct

SEQ ID NO: 22450 - DNA, 15 bp, Artificial Sequence
  dgRNA
  Ttc3
ctgccctctcatgat

SEQ ID NO: 22451 - DNA, 15 bp, Artificial Sequence
  dgRNA
  Ttc3
cttcgtgaggctcag

SEQ ID NO: 22452 - DNA, 15 bp, Artificial Sequence
  dgRNA
  Ttc3
ctcagtccaatgcgc

SEQ ID NO: 22453 - DNA, 15 bp, Artificial Sequence
  dgRNA
  Ttc3
tccaatgcgcaggcg

SEQ ID NO: 22454 - DNA, 15 bp, Artificial Sequence
  dgRNA
  Ltn1
tcctacacactagga

SEQ ID NO: 22455 - DNA, 15 bp, Artificial Sequence
  dgRNA
  Ltn1
ccactacaaatatct

SEQ ID NO: 22456 - DNA, 15 bp, Artificial Sequence
  dgRNA
  Ltn1
tatctcggacaggtt

SEQ ID NO: 22457 - DNA, 15 bp, Artificial Sequence
  dgRNA
  Ltn1
acaggtttggcgcca

SEQ ID NO: 22458 - DNA, 15 bp, Artificial Sequence
  dgRNA
  Gsto1
acaagaccccttgtg

SEQ ID NO: 22459 - DNA, 15 bp, Artificial Sequence
  dgRNA
  Gsto1
ccccttgtgtggagg

SEQ ID NO: 22460 - DNA, 15 bp, Artificial Sequence
  dgRNA
  Gsto1
cctccgcagcgaacc

SEQ ID NO: 22461 - DNA, 15 bp, Artificial Sequence
  dgRNA
  Gsto1
ctccgcagcgaacct

SEQ ID NO: 22462 - DNA, 15 bp, Artificial Sequence
  dgRNA
  Pithd1
agaaaggtggccgct

SEQ ID NO: 22463 - DNA, 15 bp, Artificial Sequence
  dgRNA
  Pithd1
gaaaggtggccgcta

SEQ ID NO: 22464 - DNA, 15 bp, Artificial Sequence
  dgRNA
  Pithd1
agaaagcgcacgctt

SEQ ID NO: 22465 - DNA, 15 bp, Artificial Sequence
  dgRNA
  Pithd1
gcgcacgctttggct

SEQ ID NO: 22466 - DNA, 15 bp, Artificial Sequence
  dgRNA
  Gpr155
tccatgctggaggcg

SEQ ID NO: 22467 - DNA, 15 bp, Artificial Sequence
  dgRNA
  Gpr155
ggcctcacggcagaa

SEQ ID NO: 22468 - DNA, 15 bp, Artificial Sequence
  dgRNA
  Gpr155
cggagcctgaaggcg

SEQ ID NO: 22469 - DNA, 15 bp, Artificial Sequence
  dgRNA
  Gpr155
agcctgaaggcgggg

SEQ ID NO: 22470 - DNA, 15 bp, Artificial Sequence
  dgRNA
  Nf2
cgctgagtagcgtag

SEQ ID NO: 22471 - DNA, 15 bp, Artificial Sequence
  dgRNA
  Nf2
gctgagtagcgtagt

SEQ ID NO: 22472 - DNA, 15 bp, Artificial Sequence
  dgRNA
  Nf2
agcgtagtgggagtc

SEQ ID NO: 22473 - DNA, 15 bp, Artificial Sequence
  dgRNA
  Nf2
gtagtgggagtccgg

SEQ ID NO: 22474 - DNA, 15 bp, Artificial Sequence
  dgRNA
  Col9a1
ggtctcctcccctgt

SEQ ID NO: 22475 - DNA, 15 bp, Artificial Sequence
  dgRNA
  Col9a1
acccttggcagactc

SEQ ID NO: 22476 - DNA, 15 bp, Artificial Sequence
  dgRNA
  Col9a1
cttggtgcagatgcc

SEQ ID NO: 22477 - DNA, 15 bp, Artificial Sequence
  dgRNA
  Col9a1
tgtgccctacagggg

SEQ ID NO: 22478 - DNA, 15 bp, Artificial Sequence
  dgRNA
  Zc2hc1c
caacccaatctgccc

SEQ ID NO: 22479 - DNA, 15 bp, Artificial Sequence
  dgRNA
  Zc2hc1c
cccaatctgccccgg

SEQ ID NO: 22480 - DNA, 15 bp, Artificial Sequence
  dgRNA
  Zc2hc1c
cgtttcccttgggga

SEQ ID NO: 22481 - DNA, 15 bp, Artificial Sequence
  dgRNA
  Zc2hc1c
gcgtttcccttgggg

SEQ ID NO: 22482 - DNA, 15 bp, Artificial Sequence
  dgRNA
  Mmd2
gcagtgctgcccgga

SEQ ID NO: 22483 - DNA, 15 bp, Artificial Sequence
  dgRNA
  Mmd2
ggcaagccgtaacag

SEQ ID NO: 22484 - DNA, 15 bp, Artificial Sequence
  dgRNA
  Mmd2
ggctagaacagcaat

SEQ ID NO: 22485 - DNA, 15 bp, Artificial Sequence
  dgRNA
  Mmd2
cggggagaagctagc

SEQ ID NO: 22486 - DNA, 15 bp, Artificial Sequence
  dgRNA
  Slc35a2
tgaggcgggcgcatg

SEQ ID NO: 22487 - DNA, 15 bp, Artificial Sequence
  dgRNA
  Slc35a2
gaggcgggcgcatga

SEQ ID NO: 22488 - DNA, 15 bp, Artificial Sequence
  dgRNA
  Slc35a2
ggcgcatgagggatg

SEQ ID NO: 22489 - DNA, 15 bp, Artificial Sequence
  dgRNA
  Slc35a2
gcgcatgagggatga

SEQ ID NO: 22490 - DNA, 15 bp, Artificial Sequence
  dgRNA
  Foxp2
ttatggtaagcatgc

SEQ ID NO: 22491 - DNA, 15 bp, Artificial Sequence
  dgRNA
  Foxp2
tggtgtgcaactgag

SEQ ID NO: 22492 - DNA, 15 bp, Artificial Sequence
  dgRNA
  Foxp2
ttggtgtgcaactga

SEQ ID NO: 22493 - DNA, 15 bp, Artificial Sequence
  dgRNA
  Foxp2
tttggtgtgcaactg

SEQ ID NO: 22494 - DNA, 15 bp, Artificial Sequence
  dgRNA
  Pde8b
ggaccgacactggga

SEQ ID NO: 22495 - DNA, 15 bp, Artificial Sequence
  dgRNA
  Pde8b
gaccgacactgggag

SEQ ID NO: 22496 - DNA, 15 bp, Artificial Sequence
  dgRNA
  Pde8b
gcaaggactgaaagt

SEQ ID NO: 22497 - DNA, 15 bp, Artificial Sequence
  dgRNA
  Pde8b
gaagactgagccggc

SEQ ID NO: 22498 - DNA, 15 bp, Artificial Sequence
  dgRNA
  Hipk3
tccgcgcgggccgcc

SEQ ID NO: 22499 - DNA, 15 bp, Artificial Sequence
  dgRNA
  Hipk3
gcgcgggccgcctgg

SEQ ID NO: 22500 - DNA, 15 bp, Artificial Sequence
  dgRNA
  Hipk3
cgcgggccgcctggc

SEQ ID NO: 22501 - DNA, 15 bp, Artificial Sequence
  dgRNA
  Hipk3
gggctgcgagcgtca

SEQ ID NO: 22502 - DNA, 15 bp, Artificial Sequence
  dgRNA
  Ccdc172
gtaatccttgaagac

SEQ ID NO: 22503 - DNA, 15 bp, Artificial Sequence
  dgRNA
  Ccdc172
taatccttgaagact

SEQ ID NO: 22504 - DNA, 15 bp, Artificial Sequence
  dgRNA
  Ccdc172
cagactggccccacc

SEQ ID NO: 22505 - DNA, 15 bp, Artificial Sequence
  dgRNA
  Ccdc172
aagtcttatgctggg

SEQ ID NO: 22506 - DNA, 15 bp, Artificial Sequence
  dgRNA
  Fam171a1
ttcctgcggaccctt

SEQ ID NO: 22507 - DNA, 15 bp, Artificial Sequence
  dgRNA
  Fam171a1
ccagcgtgacgtcga

SEQ ID NO: 22508 - DNA, 15 bp, Artificial Sequence
  dgRNA
  Fam171a1
gggtttggaggcgcc

SEQ ID NO: 22509 - DNA, 15 bp, Artificial Sequence
  dgRNA
  Fam171a1
ggtttggaggcgcct

SEQ ID NO: 22510 - DNA, 15 bp, Artificial Sequence
  dgRNA
  Agtr1a
gggcacatcggtgac

SEQ ID NO: 22511 - DNA, 15 bp, Artificial Sequence
  dgRNA
  Agtr1a
tcggtgactggcagc

SEQ ID NO: 22512 - DNA, 15 bp, Artificial Sequence
  dgRNA
  Agtr1a
cgtcagaaactggag

SEQ ID NO: 22513 - DNA, 15 bp, Artificial Sequence
  dgRNA
  Agtr1a
ggacagagggtctcg

SEQ ID NO: 22514 - DNA, 15 bp, Artificial Sequence
  dgRNA
  7-Sep
ggaagtgcccagacg

SEQ ID NO: 22515 - DNA, 15 bp, Artificial Sequence
  dgRNA
  7-Sep
cggccaatgtaaaca

SEQ ID NO: 22516 - DNA, 15 bp, Artificial Sequence
  dgRNA
  7-Sep
taaacatggcggttg

SEQ ID NO: 22517 - DNA, 15 bp, Artificial Sequence
  dgRNA
  7-Sep
acatggcggttgagg

SEQ ID NO: 22518 - DNA, 15 bp, Artificial Sequence
  dgRNA
  Lin7c
gcacagacccacgaa

SEQ ID NO: 22519 - DNA, 15 bp, Artificial Sequence
  dgRNA
  Lin7c
cagacccacgaaagg

SEQ ID NO: 22520 - DNA, 15 bp, Artificial Sequence
  dgRNA
  Lin7c
aaggaggccacccgt

SEQ ID NO: 22521 - DNA, 15 bp, Artificial Sequence
  dgRNA
  Lin7c
gtcgcaaagcgtccc

SEQ ID NO: 22522 - DNA, 15 bp, Artificial Sequence
  dgRNA
  Rapgef2
atggttaagtagagg

SEQ ID NO: 22523 - DNA, 15 bp, Artificial Sequence
  dgRNA
  Rapgef2
agggggcgagcctta

SEQ ID NO: 22524 - DNA, 15 bp, Artificial Sequence
  dgRNA
  Rapgef2
tatttcagcgtatat

SEQ ID NO: 22525 - DNA, 15 bp, Artificial Sequence
  dgRNA
  Rapgef2
atttcagcgtatatg

SEQ ID NO: 22526 - DNA, 15 bp, Artificial Sequence
  dgRNA
  Dspp
agtgagccaacgtac

SEQ ID NO: 22527 - DNA, 15 bp, Artificial Sequence
  dgRNA
  Dspp
acgtaccggcgagcg

SEQ ID NO: 22528 - DNA, 15 bp, Artificial Sequence
  dgRNA
  Dspp
cgtaccggcgagcga

SEQ ID NO: 22529 - DNA, 15 bp, Artificial Sequence
  dgRNA
  Dspp
ggcgagcgagggagt

SEQ ID NO: 22530 - DNA, 15 bp, Artificial Sequence
  dgRNA
  2810459M11Rik
ccatcttaccctaag

SEQ ID NO: 22531 - DNA, 15 bp, Artificial Sequence
  dgRNA
  2810459M11Rik
catcttaccctaaga

SEQ ID NO: 22532 - DNA, 15 bp, Artificial Sequence
  dgRNA
  2810459M11Rik
gagggtacattagtc

SEQ ID NO: 22533 - DNA, 15 bp, Artificial Sequence
  dgRNA
  2810459M11Rik
cctcttagggtaaga

SEQ ID NO: 22534 - DNA, 15 bp, Artificial Sequence
  dgRNA
  Ppp1r13b
gagcgcgctctcacc

SEQ ID NO: 22535 - DNA, 15 bp, Artificial Sequence
  dgRNA
  Ppp1r13b
gctctcacctggccg

SEQ ID NO: 22536 - DNA, 15 bp, Artificial Sequence
  dgRNA
  Ppp1r13b
cccgcctacccccac

SEQ ID NO: 22537 - DNA, 15 bp, Artificial Sequence
  dgRNA
  Ppp1r13b
caccggaccaatcat

SEQ ID NO: 22538 - DNA, 15 bp, Artificial Sequence
  dgRNA
  Cd302
gcatagtccaccagg

SEQ ID NO: 22539 - DNA, 15 bp, Artificial Sequence
  dgRNA
  Cd302
catagtccaccagga

SEQ ID NO: 22540 - DNA, 15 bp, Artificial Sequence
  dgRNA
  Cd302
tgattcttgccaaaa

SEQ ID NO: 22541 - DNA, 15 bp, Artificial Sequence
  dgRNA
  Cd302
tgcttgttcctggat

SEQ ID NO: 22542 - DNA, 15 bp, Artificial Sequence
  dgRNA
  Dsg3
gtctcagtttttacc

SEQ ID NO: 22543 - DNA, 15 bp, Artificial Sequence
  dgRNA
  Dsg3
tgatgcaagcgtttc

SEQ ID NO: 22544 - DNA, 15 bp, Artificial Sequence
  dgRNA
  Dsg3
ggtgagaccaatcct

SEQ ID NO: 22545 - DNA, 15 bp, Artificial Sequence
  dgRNA
  Dsg3
gaccaatccttggct

SEQ ID NO: 22546 - DNA, 15 bp, Artificial Sequence
  dgRNA
  Olfr1500
gattacacactctct

SEQ ID NO: 22547 - DNA, 15 bp, Artificial Sequence
  dgRNA
  Olfr1500
tccactcaatatcct

SEQ ID NO: 22548 - DNA, 15 bp, Artificial Sequence
  dgRNA
  Olfr1500
acctctcttgaaggc

SEQ ID NO: 22549 - DNA, 15 bp, Artificial Sequence
  dgRNA
  Olfr1500
tcctaggatattgag

SEQ ID NO: 22550 - DNA, 15 bp, Artificial Sequence
  dgRNA
  Reep2
cgaagctgctgtcaa

SEQ ID NO: 22551 - DNA, 15 bp, Artificial Sequence
  dgRNA
  Reep2
aaagggaaccccgcc

SEQ ID NO: 22552 - DNA, 15 bp, Artificial Sequence
  dgRNA
  Reep2
accccgccaggactc

SEQ ID NO: 22553 - DNA, 15 bp, Artificial Sequence
  dgRNA
  Reep2
ccccgccaggactct

SEQ ID NO: 22554 - DNA, 15 bp, Artificial Sequence
  dgRNA
  Atxn3
gttcctccgcacagc

SEQ ID NO: 22555 - DNA, 15 bp, Artificial Sequence
  dgRNA
  Atxn3
gcatcacgcttgccg

SEQ ID NO: 22556 - DNA, 15 bp, Artificial Sequence
  dgRNA
  Atxn3
catcacgcttgccgc

SEQ ID NO: 22557 - DNA, 15 bp, Artificial Sequence
  dgRNA
  Atxn3
atcacgcttgccgcg

SEQ ID NO: 22558 - DNA, 15 bp, Artificial Sequence
  dgRNA
  Gm10100
cagctaagctagcac

SEQ ID NO: 22559 - DNA, 15 bp, Artificial Sequence
  dgRNA
  Gm10100
agcccagcagcgttc

SEQ ID NO: 22560 - DNA, 15 bp, Artificial Sequence
  dgRNA
  Gm10100
gcccagcagcgttct

SEQ ID NO: 22561 - DNA, 15 bp, Artificial Sequence
  dgRNA
  Gm10100
gtggttgagtcaatg

SEQ ID NO: 22562 - DNA, 15 bp, Artificial Sequence
  dgRNA
  Atp7b
ctggaagcccccttg

SEQ ID NO: 22563 - DNA, 15 bp, Artificial Sequence
  dgRNA
  Atp7b
tggaagcccccttga

SEQ ID NO: 22564 - DNA, 15 bp, Artificial Sequence
  dgRNA
  Atp7b
cgcggcgctgccagc

SEQ ID NO: 22565 - DNA, 15 bp, Artificial Sequence
  dgRNA
  Atp7b
gcgctgccagccggt

SEQ ID NO: 22566 - DNA, 15 bp, Artificial Sequence
  dgRNA
  Avl9
ggccagctctcgagc

SEQ ID NO: 22567 - DNA, 15 bp, Artificial Sequence
  dgRNA
  Avl9
acccgccccctgatc

SEQ ID NO: 22568 - DNA, 15 bp, Artificial Sequence
  dgRNA
  Avl9
agacccagccgggac

SEQ ID NO: 22569 - DNA, 15 bp, Artificial Sequence
  dgRNA
  Avl9
acccagccgggacag

SEQ ID NO: 22570 - DNA, 15 bp, Artificial Sequence
  dgRNA
  Tec
ataagagacgctccc

SEQ ID NO: 22571 - DNA, 15 bp, Artificial Sequence
  dgRNA
  Tec
tggaacttcggccgc

SEQ ID NO: 22572 - DNA, 15 bp, Artificial Sequence
  dgRNA
  Tec
tccgattcttccctt

SEQ ID NO: 22573 - DNA, 15 bp, Artificial Sequence
  dgRNA
  Tec
ttggctttgaaatcg

SEQ ID NO: 22574 - DNA, 15 bp, Artificial Sequence
  dgRNA
  Npm1
gcccgcgagcacgag

SEQ ID NO: 22575 - DNA, 15 bp, Artificial Sequence
  dgRNA
  Npm1
cgagcggagaagacg

SEQ ID NO: 22576 - DNA, 15 bp, Artificial Sequence
  dgRNA
  Npm1
aaacgcgcctgcgct

SEQ ID NO: 22577 - DNA, 15 bp, Artificial Sequence
  dgRNA
  Npm1
aacgcgcctgcgctt

SEQ ID NO: 22578 - DNA, 15 bp, Artificial Sequence
  dgRNA
  Cd69
ggatgtcttcgattc

SEQ ID NO: 22579 - DNA, 15 bp, Artificial Sequence
  dgRNA
  Cd69
gatgtcttcgattct

SEQ ID NO: 22580 - DNA, 15 bp, Artificial Sequence
  dgRNA
  Cd69
cacggtgaagtgtct

SEQ ID NO: 22581 - DNA, 15 bp, Artificial Sequence
  dgRNA
  Cd69
aagtgtctaggccgc

SEQ ID NO: 22582 - DNA, 15 bp, Artificial Sequence
  dgRNA
  Twf2
cgcccacagacctcc

SEQ ID NO: 22583 - DNA, 15 bp, Artificial Sequence
  dgRNA
  Twf2
ggatcctggcctaca

SEQ ID NO: 22584 - DNA, 15 bp, Artificial Sequence
  dgRNA
  Twf2
gatcctggcctacaa

SEQ ID NO: 22585 - DNA, 15 bp, Artificial Sequence
  dgRNA
  Twf2
cccacacaatccctt

SEQ ID NO: 22586 - DNA, 15 bp, Artificial Sequence
  dgRNA
  Mfn2
catctgcacgagaca

SEQ ID NO: 22587 - DNA, 15 bp, Artificial Sequence
  dgRNA
  Mfn2
atctgcacgagacac

SEQ ID NO: 22588 - DNA, 15 bp, Artificial Sequence
  dgRNA
  Mfn2
gcacgagacacggga

SEQ ID NO: 22589 - DNA, 15 bp, Artificial Sequence
  dgRNA
  Mfn2
cacgggacggttacc

SEQ ID NO: 22590 - DNA, 15 bp, Artificial Sequence
  dgRNA
  Cenpu
ctaagccggttgctt

SEQ ID NO: 22591 - DNA, 15 bp, Artificial Sequence
  dgRNA
  Cenpu
actccgctccgctgt

SEQ ID NO: 22592 - DNA, 15 bp, Artificial Sequence
  dgRNA
  Cenpu
ctccgctccgctgtt

SEQ ID NO: 22593 - DNA, 15 bp, Artificial Sequence
  dgRNA
  Cenpu
atcgtgctctcgccc

SEQ ID NO: 22594 - DNA, 15 bp, Artificial Sequence
  dgRNA
  Nploc4
attgctcgaactttc

SEQ ID NO: 22595 - DNA, 15 bp, Artificial Sequence
  dgRNA
  Nploc4
gagggggcacggacg

SEQ ID NO: 22596 - DNA, 15 bp, Artificial Sequence
  dgRNA
  Nploc4
agggggcacggacga

SEQ ID NO: 22597 - DNA, 15 bp, Artificial Sequence
  dgRNA
  Nploc4
acgcgcggcaccact

SEQ ID NO: 22598 - DNA, 15 bp, Artificial Sequence
  dgRNA
  Emx2
cagctccagcgccgc

SEQ ID NO: 22599 - DNA, 15 bp, Artificial Sequence
  dgRNA
  Emx2
cagcgccgcaggctt

SEQ ID NO: 22600 - DNA, 15 bp, Artificial Sequence
  dgRNA
  Emx2
aggggtccgcagcaa

SEQ ID NO: 22601 - DNA, 15 bp, Artificial Sequence
  dgRNA
  Emx2
gccccgagactctgc

SEQ ID NO: 22602 - DNA, 15 bp, Artificial Sequence
  dgRNA
  Gtf2h1
accacggagccggac

SEQ ID NO: 22603 - DNA, 15 bp, Artificial Sequence
  dgRNA
  Gtf2h1
gaccggatgctctct

SEQ ID NO: 22604 - DNA, 15 bp, Artificial Sequence
  dgRNA
  Gtf2h1
accggatgctctcta

SEQ ID NO: 22605 - DNA, 15 bp, Artificial Sequence
  dgRNA
  Gtf2h1
tccgccgctcgagac

SEQ ID NO: 22606 - DNA, 15 bp, Artificial Sequence
  dgRNA
  Pla2g12b
tccccccagcgcttc

SEQ ID NO: 22607 - DNA, 15 bp, Artificial Sequence
  dgRNA
  Pla2g12b
ccccccagcgcttcg

SEQ ID NO: 22608 - DNA, 15 bp, Artificial Sequence
  dgRNA
  Pla2g12b
cgcttcggggtccac

SEQ ID NO: 22609 - DNA, 15 bp, Artificial Sequence
  dgRNA
  Pla2g12b
gcttcggggtccact

SEQ ID NO: 22610 - DNA, 15 bp, Artificial Sequence
  dgRNA
  Ano7
accctcttttcaaac

SEQ ID NO: 22611 - DNA, 15 bp, Artificial Sequence
  dgRNA
  Ano7
ctacatgcaaattcg

SEQ ID NO: 22612 - DNA, 15 bp, Artificial Sequence
  dgRNA
  Ano7
gtgcagtcagccacc

SEQ ID NO: 22613 - DNA, 15 bp, Artificial Sequence
  dgRNA
  Pcmt1
ccggccgcaggacgg

SEQ ID NO: 22614 - DNA, 15 bp, Artificial Sequence
  dgRNA
  Pcmt1
ccgcaggacggaggc

SEQ ID NO: 22615 - DNA, 15 bp, Artificial Sequence
  dgRNA
  Pcmt1
tgtgcgacctcgctg

SEQ ID NO: 22616 - DNA, 15 bp, Artificial Sequence
  dgRNA
  Pcmt1
gcccccgctcgctac

SEQ ID NO: 22617 - DNA, 15 bp, Artificial Sequence
  dgRNA
  Nbn
ttaaagcgtccagtt

SEQ ID NO: 22618 - DNA, 15 bp, Artificial Sequence
  dgRNA
  Nbn
atcttcagcactagg

SEQ ID NO: 22619 - DNA, 15 bp, Artificial Sequence
  dgRNA
  Nbn
tggcgcccccgtcag

SEQ ID NO: 22620 - DNA, 15 bp, Artificial Sequence
  dgRNA
  Nbn
agctcggaagtaatg

SEQ ID NO: 22621 - DNA, 15 bp, Artificial Sequence
  dgRNA
  Zfp105
ggtaggggctcggct

SEQ ID NO: 22622 - DNA, 15 bp, Artificial Sequence
  dgRNA
  Zfp105
gtaggggctcggctt

SEQ ID NO: 22623 - DNA, 15 bp, Artificial Sequence
  dgRNA
  Zfp105
gagagtgccgctgcc

SEQ ID NO: 22624 - DNA, 15 bp, Artificial Sequence
  dgRNA
  Zfp105
gtgccgctgcctggc

SEQ ID NO: 22625 - DNA, 15 bp, Artificial Sequence
  dgRNA
  Bco1
tcttccgactcagag

SEQ ID NO: 22626 - DNA, 15 bp, Artificial Sequence
  dgRNA
  Bco1
gtgaaatcagagcgg

SEQ ID NO: 22627 - DNA, 15 bp, Artificial Sequence
  dgRNA
  Bco1
tcggaagagatgatt

SEQ ID NO: 22628 - DNA, 15 bp, Artificial Sequence
  dgRNA
  Il4i1
agtgcgcttgctcag

SEQ ID NO: 22629 - DNA, 15 bp, Artificial Sequence
  dgRNA
  Il4i1
gctcagcggatgcgc

SEQ ID NO: 22630 - DNA, 15 bp, Artificial Sequence
  dgRNA
  Il4i1
gcgcctgcgcgaccg

SEQ ID NO: 22631 - DNA, 15 bp, Artificial Sequence
  dgRNA
  Il4i1
cccgcgagctctgaa

SEQ ID NO: 22632 - DNA, 15 bp, Artificial Sequence
  dgRNA
  Ralbp1
tggcgcatcctctcg

SEQ ID NO: 22633 - DNA, 15 bp, Artificial Sequence
  dgRNA
  Ralbp1
ggcgcatcctctcgc

SEQ ID NO: 22634 - DNA, 15 bp, Artificial Sequence
  dgRNA
  Ralbp1
taacgagttccagct

SEQ ID NO: 22635 - DNA, 15 bp, Artificial Sequence
  dgRNA
  Ralbp1
aacgagttccagctc

SEQ ID NO: 22636 - DNA, 15 bp, Artificial Sequence
  dgRNA
  Kif2b
atctgtgttagggta

SEQ ID NO: 22637 - DNA, 15 bp, Artificial Sequence
  dgRNA
  Kif2b
tcctttcgtcacaaa

SEQ ID NO: 22638 - DNA, 15 bp, Artificial Sequence
  dgRNA
  Kif2b
gtcctttcgtcacaa

SEQ ID NO: 22639 - DNA, 15 bp, Artificial Sequence
  dgRNA
  Cd163l1
tcttacacagttatc

SEQ ID NO: 22640 - DNA, 15 bp, Artificial Sequence
  dgRNA
  Cd163l1
acgaaatgcttctct

SEQ ID NO: 22641 - DNA, 15 bp, Artificial Sequence
  dgRNA
  Cd163l1
gtacactgtctgtgc

SEQ ID NO: 22642 - DNA, 15 bp, Artificial Sequence
  dgRNA
  Cd163l1
gctggtgataggttc

SEQ ID NO: 22643 - DNA, 15 bp, Artificial Sequence
  dgRNA
  Retsat
gcgtccccagcgttc

SEQ ID NO: 22644 - DNA, 15 bp, Artificial Sequence
  dgRNA
  Retsat
cccagcgttccggta

SEQ ID NO: 22645 - DNA, 15 bp, Artificial Sequence
  dgRNA
  Retsat
ccagcgttccggtaa

SEQ ID NO: 22646 - DNA, 15 bp, Artificial Sequence
  dgRNA
  Retsat
cagcgttccggtaag

SEQ ID NO: 22647 - DNA, 15 bp, Artificial Sequence
  dgRNA
  Olfr1006
atgtagtagtctcaa

SEQ ID NO: 22648 - DNA, 15 bp, Artificial Sequence
  dgRNA
  Olfr1006
ttagggtataatcaa

SEQ ID NO: 22649 - DNA, 15 bp, Artificial Sequence
  dgRNA
  Map3k12
gatggactgcgctct

SEQ ID NO: 22650 - DNA, 15 bp, Artificial Sequence
  dgRNA
  Map3k12
atggactgcgctctc

SEQ ID NO: 22651 - DNA, 15 bp, Artificial Sequence
  dgRNA
  Map3k12
tggactgcgctctcg

SEQ ID NO: 22652 - DNA, 15 bp, Artificial Sequence
  dgRNA
  Map3k12
gcgctctcggggtgt

SEQ ID NO: 22653 - DNA, 15 bp, Artificial Sequence
  dgRNA
  Scg5
gatgccatctacttg

SEQ ID NO: 22654 - DNA, 15 bp, Artificial Sequence
  dgRNA
  Scg5
gtaaatgacgttcat

SEQ ID NO: 22655 - DNA, 15 bp, Artificial Sequence
  dgRNA
  Scg5
taaatgacgttcata

SEQ ID NO: 22656 - DNA, 15 bp, Artificial Sequence
  dgRNA
  Scg5
aaatgacgttcatag

SEQ ID NO: 22657 - DNA, 15 bp, Artificial Sequence
  dgRNA
  Slc17a4
tatcttaccaaatgg

SEQ ID NO: 22658 - DNA, 15 bp, Artificial Sequence
  dgRNA
  Ptk2b
gcccccgggtcagcc

SEQ ID NO: 22659 - DNA, 15 bp, Artificial Sequence
  dgRNA
  Ptk2b
tggttaacgaccgag

SEQ ID NO: 22660 - DNA, 15 bp, Artificial Sequence
  dgRNA
  Ptk2b
ttaacgaccgagagg

SEQ ID NO: 22661 - DNA, 15 bp, Artificial Sequence
  dgRNA
  Ptk2b
acgaccgagaggagg

SEQ ID NO: 22662 - DNA, 15 bp, Artificial Sequence
  dgRNA
  Col28a1
ctacatgataacatt

SEQ ID NO: 22663 - DNA, 15 bp, Artificial Sequence
  dgRNA
  Col28a1
acttgttgaagtaga

SEQ ID NO: 22664 - DNA, 15 bp, Artificial Sequence
  dgRNA
  Col28a1
caagcttccctgtaa

SEQ ID NO: 22665 - DNA, 15 bp, Artificial Sequence
  dgRNA
  Hmga1-rs1
aacaatcgccagaca

SEQ ID NO: 22666 - DNA, 15 bp, Artificial Sequence
  dgRNA
  Hmga1-rs1
acaatcgccagacac

SEQ ID NO: 22667 - DNA, 15 bp, Artificial Sequence
  dgRNA
  Hmga1-rs1
tctggcgattgtttg

SEQ ID NO: 22668 - DNA, 15 bp, Artificial Sequence
  dgRNA
  Hmga1-rs1
acctcaacccgtgtc

SEQ ID NO: 22669 - DNA, 15 bp, Artificial Sequence
  dgRNA
  Atg2a
ccgcagcttgaagca

SEQ ID NO: 22670 - DNA, 15 bp, Artificial Sequence
  dgRNA
  Atg2a
agcgtaaactacgat

SEQ ID NO: 22671 - DNA, 15 bp, Artificial Sequence
  dgRNA
  Atg2a
gcgtaaactacgatt

SEQ ID NO: 22672 - DNA, 15 bp, Artificial Sequence
  dgRNA
  Atg2a
ctttttcgctcttca

SEQ ID NO: 22673 - DNA, 15 bp, Artificial Sequence
  dgRNA
  Apoh
atttcacaacgggcc

SEQ ID NO: 22674 - DNA, 15 bp, Artificial Sequence
  dgRNA
  Apoh
agtacaccccaaaca

SEQ ID NO: 22675 - DNA, 15 bp, Artificial Sequence
  dgRNA
  Apoh
ccgttgtgaaatctt

SEQ ID NO: 22676 - DNA, 15 bp, Artificial Sequence
  dgRNA
  Apoh
cgctgcgctttggaa

SEQ ID NO: 22677 - DNA, 15 bp, Artificial Sequence
  dgRNA
  Csn1s2a
gttccacagattcta

SEQ ID NO: 22678 - DNA, 15 bp, Artificial Sequence
  dgRNA
  Chmp4c
accctcagagtttga

SEQ ID NO: 22679 - DNA, 15 bp, Artificial Sequence
  dgRNA
  Chmp4c
ctcggtagtttctcc

SEQ ID NO: 22680 - DNA, 15 bp, Artificial Sequence
  dgRNA
  Chmp4c
agagggcggtggcgt

SEQ ID NO: 22681 - DNA, 15 bp, Artificial Sequence
  dgRNA
  Chmp4c
ccgggtagttattcg

SEQ ID NO: 22682 - DNA, 15 bp, Artificial Sequence
  dgRNA
  Smurf1
cggtggtggccacgg

SEQ ID NO: 22683 - DNA, 15 bp, Artificial Sequence
  dgRNA
  Smurf1
ttcaaggctccccgc

SEQ ID NO: 22684 - DNA, 15 bp, Artificial Sequence
  dgRNA
  Smurf1
ctccccgccggctgc

SEQ ID NO: 22685 - DNA, 15 bp, Artificial Sequence
  dgRNA
  Smurf1
cccttgcgcgcgccc

SEQ ID NO: 22686 - DNA, 15 bp, Artificial Sequence
  dgRNA
  Rab37
cagttatttatctcc

SEQ ID NO: 22687 - DNA, 15 bp, Artificial Sequence
  dgRNA
  Rab37
ctgtctagagacgaa

SEQ ID NO: 22688 - DNA, 15 bp, Artificial Sequence
  dgRNA
  Rab37
tgtctagagacgaaa

SEQ ID NO: 22689 - DNA, 15 bp, Artificial Sequence
  dgRNA
  Rab37
cagcgccagcaccgc

SEQ ID NO: 22690 - DNA, 15 bp, Artificial Sequence
  dgRNA
  Gfra4
gatacctgtgccccg

SEQ ID NO: 22691 - DNA, 15 bp, Artificial Sequence
  dgRNA
  Gfra4
ccccctgaccaaatg

SEQ ID NO: 22692 - DNA, 15 bp, Artificial Sequence
  dgRNA
  Gfra4
tcccctactgattca

SEQ ID NO: 22693 - DNA, 15 bp, Artificial Sequence
  dgRNA
  Gfra4
cctactgattcatgg

SEQ ID NO: 22694 - DNA, 15 bp, Artificial Sequence
  dgRNA
  Slc2a4
gcaggcgggaacctt

SEQ ID NO: 22695 - DNA, 15 bp, Artificial Sequence
  dgRNA
  Slc2a4
caggcgggaacctta

SEQ ID NO: 22696 - DNA, 15 bp, Artificial Sequence
  dgRNA
  Slc2a4
aggcgggaaccttag

SEQ ID NO: 22697 - DNA, 15 bp, Artificial Sequence
  dgRNA
  Slc2a4
cgggctcctggccaa

SEQ ID NO: 22698 - DNA, 15 bp, Artificial Sequence
  dgRNA
  Dbf4
ggtctgaggccccgc

SEQ ID NO: 22699 - DNA, 15 bp, Artificial Sequence
  dgRNA
  Dbf4
gggctggcgcgccgg

SEQ ID NO: 22700 - DNA, 15 bp, Artificial Sequence
  dgRNA
  Dbf4
ggcgtggtcagcatc

SEQ ID NO: 22701 - DNA, 15 bp, Artificial Sequence
  dgRNA
  Dbf4
gcgtggtcagcatcc

SEQ ID NO: 22702 - DNA, 15 bp, Artificial Sequence
  dgRNA
  Apoo
accctgccggagccg

SEQ ID NO: 22703 - DNA, 15 bp, Artificial Sequence
  dgRNA
  Apoo
gggtcacccctccct

SEQ ID NO: 22704 - DNA, 15 bp, Artificial Sequence
  dgRNA
  Apoo
gccgcggctccggca

SEQ ID NO: 22705 - DNA, 15 bp, Artificial Sequence
  dgRNA
  Apoo
agccgcggctccggc

SEQ ID NO: 22706 - DNA, 15 bp, Artificial Sequence
  dgRNA
  Crispld1
aaactagagaccaat

SEQ ID NO: 22707 - DNA, 15 bp, Artificial Sequence
  dgRNA
  Crispld1
ctaatggatccccat

SEQ ID NO: 22708 - DNA, 15 bp, Artificial Sequence
  dgRNA
  Sec61a1
tgagggccaccgaca

SEQ ID NO: 22709 - DNA, 15 bp, Artificial Sequence
  dgRNA
  Sec61a1
aatcgcctgcttcgt

SEQ ID NO: 22710 - DNA, 15 bp, Artificial Sequence
  dgRNA
  Sec61a1
atcgcctgcttcgta

SEQ ID NO: 22711 - DNA, 15 bp, Artificial Sequence
  dgRNA
  Sec61a1
cgtccactagtaaca

SEQ ID NO: 22712 - DNA, 15 bp, Artificial Sequence
  dgRNA
  Nol7
cctcagcacgtttcg

SEQ ID NO: 22713 - DNA, 15 bp, Artificial Sequence
  dgRNA
  Nol7
cctccgaaccagcag

SEQ ID NO: 22714 - DNA, 15 bp, Artificial Sequence
  dgRNA
  Nol7
ctccgaaccagcaga

SEQ ID NO: 22715 - DNA, 15 bp, Artificial Sequence
  dgRNA
  Nol7
agcgcgcaccgcgca

SEQ ID NO: 22716 - DNA, 15 bp, Artificial Sequence
  dgRNA
  Rbms1
tcttgagagcctagg

SEQ ID NO: 22717 - DNA, 15 bp, Artificial Sequence
  dgRNA
  Rbms1
acctccagcgggtcc

SEQ ID NO: 22718 - DNA, 15 bp, Artificial Sequence
  dgRNA
  Rbms1
cctccagcgggtccc

SEQ ID NO: 22719 - DNA, 15 bp, Artificial Sequence
  dgRNA
  Rbms1
gggtcccgggctcgg

SEQ ID NO: 22720 - DNA, 15 bp, Artificial Sequence
  dgRNA
  Tbata
tgttgggctatgttc

SEQ ID NO: 22721 - DNA, 15 bp, Artificial Sequence
  dgRNA
  Tbata
taacctagcaaccac

SEQ ID NO: 22722 - DNA, 15 bp, Artificial Sequence
  dgRNA
  Tbata
gcttgtcggaattgt

SEQ ID NO: 22723 - DNA, 15 bp, Artificial Sequence
  dgRNA
  Tbata
ggcttgtcggaattg

SEQ ID NO: 22724 - DNA, 15 bp, Artificial Sequence
  dgRNA
  Mprip
tgcgcccgctgctcc

SEQ ID NO: 22725 - DNA, 15 bp, Artificial Sequence
  dgRNA
  Mprip
gcccccgtcatccat

SEQ ID NO: 22726 - DNA, 15 bp, Artificial Sequence
  dgRNA
  Mprip
tcatccattggtcga

SEQ ID NO: 22727 - DNA, 15 bp, Artificial Sequence
  dgRNA
  Mprip
catccattggtcgac

SEQ ID NO: 22728 - DNA, 15 bp, Artificial Sequence
  dgRNA
  Fam21
cgggactcctcagca

SEQ ID NO: 22729 - DNA, 15 bp, Artificial Sequence
  dgRNA
  Fam21
ctctttcgcactagc

SEQ ID NO: 22730 - DNA, 15 bp, Artificial Sequence
  dgRNA
  Fam21
atagctcccgatcag

SEQ ID NO: 22731 - DNA, 15 bp, Artificial Sequence
  dgRNA
  Fam21
gccccaggtcacgtg

SEQ ID NO: 22732 - DNA, 15 bp, Artificial Sequence
  dgRNA
  Ccdc157
atgactgcgacgctc

SEQ ID NO: 22733 - DNA, 15 bp, Artificial Sequence
  dgRNA
  Ccdc157
tgactgcgacgctca

SEQ ID NO: 22734 - DNA, 15 bp, Artificial Sequence
  dgRNA
  Ccdc157
gccagtccacctcgg

SEQ ID NO: 22735 - DNA, 15 bp, Artificial Sequence
  dgRNA
  Ccdc157
ctcggtggcgacaac

SEQ ID NO: 22736 - DNA, 15 bp, Artificial Sequence
  dgRNA
  1110017D15Rik
cttggatactttgag

SEQ ID NO: 22737 - DNA, 15 bp, Artificial Sequence
  dgRNA
  1110017D15Rik
taggccttctgtgca

SEQ ID NO: 22738 - DNA, 15 bp, Artificial Sequence
  dgRNA
  1110017D15Rik
caggtgatatcataa

SEQ ID NO: 22739 - DNA, 15 bp, Artificial Sequence
  dgRNA
  1110017D15Rik
aggtgatatcataat

SEQ ID NO: 22740 - DNA, 15 bp, Artificial Sequence
  dgRNA
  Myh13
cactgaataggaata

SEQ ID NO: 22741 - DNA, 15 bp, Artificial Sequence
  dgRNA
  Myh13
cagttggccagttca

SEQ ID NO: 22742 - DNA, 15 bp, Artificial Sequence
  dgRNA
  Myh13
taggggaacatcagt

SEQ ID NO: 22743 - DNA, 15 bp, Artificial Sequence
  dgRNA
  Myh13
ggggggtgaagactc

SEQ ID NO: 22744 - DNA, 15 bp, Artificial Sequence
  dgRNA
  Trhde
ccctccgcccgcgtg

SEQ ID NO: 22745 - DNA, 15 bp, Artificial Sequence
  dgRNA
  Trhde
ctccaatgactgcgc

SEQ ID NO: 22746 - DNA, 15 bp, Artificial Sequence
  dgRNA
  Trhde
caatgactgcgctgg

SEQ ID NO: 22747 - DNA, 15 bp, Artificial Sequence
  dgRNA
  Trhde
gcgctggaggtggcc

SEQ ID NO: 22748 - DNA, 15 bp, Artificial Sequence
  dgRNA
  Zfp385b
ggctgaggggcgcgt

SEQ ID NO: 22749 - DNA, 15 bp, Artificial Sequence
  dgRNA
  Zfp385b
ggggcgcgtgggacc

SEQ ID NO: 22750 - DNA, 15 bp, Artificial Sequence
  dgRNA
  Zfp385b
tgggacccggtgacc

SEQ ID NO: 22751 - DNA, 15 bp, Artificial Sequence
  dgRNA
  Zfp385b
gacccggtgaccagg

SEQ ID NO: 22752 - DNA, 15 bp, Artificial Sequence
  dgRNA
  Axin1
tcagggaagcgcttg

SEQ ID NO: 22753 - DNA, 15 bp, Artificial Sequence
  dgRNA
  Axin1
gccgcaggagcctgc

SEQ ID NO: 22754 - DNA, 15 bp, Artificial Sequence
  dgRNA
  Axin1
gtgagcagccggttt

SEQ ID NO: 22755 - DNA, 15 bp, Artificial Sequence
  dgRNA
  Axin1
agcagccggttttgg

SEQ ID NO: 22756 - DNA, 15 bp, Artificial Sequence
  dgRNA
  Caln1
gagttaatgtgacac

SEQ ID NO: 22757 - DNA, 15 bp, Artificial Sequence
  dgRNA
  Caln1
ctccatctgcccggt

SEQ ID NO: 22758 - DNA, 15 bp, Artificial Sequence
  dgRNA
  Caln1
gcccggtaggtcagc

SEQ ID NO: 22759 - DNA, 15 bp, Artificial Sequence
  dgRNA
  Caln1
cccggtaggtcagct

SEQ ID NO: 22760 - DNA, 15 bp, Artificial Sequence
  dgRNA
  Adcy7
ccgctgttgccgagc

SEQ ID NO: 22761 - DNA, 15 bp, Artificial Sequence
  dgRNA
  Adcy7
ttgccgagcaggaag

SEQ ID NO: 22762 - DNA, 15 bp, Artificial Sequence
  dgRNA
  Adcy7
gactcactcttaact

SEQ ID NO: 22763 - DNA, 15 bp, Artificial Sequence
  dgRNA
  Adcy7
gttctcgctgtggtg

SEQ ID NO: 22764 - DNA, 15 bp, Artificial Sequence
  dgRNA
  Lce1d
ctcatggagcaaacc

SEQ ID NO: 22765 - DNA, 15 bp, Artificial Sequence
  dgRNA
  Lce1d
ggagcaaacctggtg

SEQ ID NO: 22766 - DNA, 15 bp, Artificial Sequence
  dgRNA
  Lce1d
caggatcagtataaa

SEQ ID NO: 22767 - DNA, 15 bp, Artificial Sequence
  dgRNA
  Lce1d
tatggtttcagcatg

SEQ ID NO: 22768 - DNA, 15 bp, Artificial Sequence
  dgRNA
  Phf23
tgggtccgtagccta

SEQ ID NO: 22769 - DNA, 15 bp, Artificial Sequence
  dgRNA
  Phf23
gggtccgtagcctaa

SEQ ID NO: 22770 - DNA, 15 bp, Artificial Sequence
  dgRNA
  Phf23
gggactcgctgagtc

SEQ ID NO: 22771 - DNA, 15 bp, Artificial Sequence
  dgRNA
  Phf23
ggactcgctgagtcc

SEQ ID NO: 22772 - DNA, 15 bp, Artificial Sequence
  dgRNA
  Srek1
ggtagcttcagtaac

SEQ ID NO: 22773 - DNA, 15 bp, Artificial Sequence
  dgRNA
  Tmem145
gacacacgcatcctg

SEQ ID NO: 22774 - DNA, 15 bp, Artificial Sequence
  dgRNA
  Tmem145
agacgcctgtagaag

SEQ ID NO: 22775 - DNA, 15 bp, Artificial Sequence
  dgRNA
  Tmem145
cagtttagtccatcc

SEQ ID NO: 22776 - DNA, 15 bp, Artificial Sequence
  dgRNA
  Tmem145
tttagtccatcccgg

SEQ ID NO: 22777 - DNA, 15 bp, Artificial Sequence
  dgRNA
  Bmp7
cttgtattgggcacg

SEQ ID NO: 22778 - DNA, 15 bp, Artificial Sequence
  dgRNA
  Bmp7
ttgtattgggcacgc

SEQ ID NO: 22779 - DNA, 15 bp, Artificial Sequence
  dgRNA
  Bmp7
gggcacgcgggagat

SEQ ID NO: 22780 - DNA, 15 bp, Artificial Sequence
  dgRNA
  Bmp7
cgcgggagatcggaa

SEQ ID NO: 22781 - DNA, 15 bp, Artificial Sequence
  dgRNA
  Cd320
ctcctttaatagcct

SEQ ID NO: 22782 - DNA, 15 bp, Artificial Sequence
  dgRNA
  Cd320
agcctgtagaatatc

SEQ ID NO: 22783 - DNA, 15 bp, Artificial Sequence
  dgRNA
  Cd320
gcctgtagaatatct

SEQ ID NO: 22784 - DNA, 15 bp, Artificial Sequence
  dgRNA
  Cd320
gtcaccaaacacatt

SEQ ID NO: 22785 - DNA, 15 bp, Artificial Sequence
  dgRNA
  Smpd1
agcctcgcgcagcaa

SEQ ID NO: 22786 - DNA, 15 bp, Artificial Sequence
  dgRNA
  Smpd1
gcgcagcaatggctc

SEQ ID NO: 22787 - DNA, 15 bp, Artificial Sequence
  dgRNA
  Smpd1
cgcagcaatggctca

SEQ ID NO: 22788 - DNA, 15 bp, Artificial Sequence
  dgRNA
  Smpd1
agcttgtctctaccg

SEQ ID NO: 22789 - DNA, 15 bp, Artificial Sequence
  dgRNA
  Lias
tcggctccatgccgc

SEQ ID NO: 22790 - DNA, 15 bp, Artificial Sequence
  dgRNA
  Lias
cggctccatgccgcc

SEQ ID NO: 22791 - DNA, 15 bp, Artificial Sequence
  dgRNA
  Lias
ggctccatgccgccg

SEQ ID NO: 22792 - DNA, 15 bp, Artificial Sequence
  dgRNA
  Lias
ggggtccccaaacag

SEQ ID NO: 22793 - DNA, 15 bp, Artificial Sequence
  dgRNA
  Fam73a
caaacatggcgggag

SEQ ID NO: 22794 - DNA, 15 bp, Artificial Sequence
  dgRNA
  Fam73a
cacgcagtccgcccg

SEQ ID NO: 22795 - DNA, 15 bp, Artificial Sequence
  dgRNA
  Fam73a
acttcttaggactat

SEQ ID NO: 22796 - DNA, 15 bp, Artificial Sequence
  dgRNA
  Fam73a
aataaaccttgtcag

SEQ ID NO: 22797 - DNA, 15 bp, Artificial Sequence
  dgRNA
  Gp1bb
ggcgtccacccttcc

SEQ ID NO: 22798 - DNA, 15 bp, Artificial Sequence
  dgRNA
  Gp1bb
tccccgcctatcata

SEQ ID NO: 22799 - DNA, 15 bp, Artificial Sequence
  dgRNA
  Gp1bb
ccccgcctatcataa

SEQ ID NO: 22800 - DNA, 15 bp, Artificial Sequence
  dgRNA
  Gp1bb
attagggtcatctgg

SEQ ID NO: 22801 - DNA, 15 bp, Artificial Sequence
  dgRNA
  Rad51d
aagacgctccagtcc

SEQ ID NO: 22802 - DNA, 15 bp, Artificial Sequence
  dgRNA
  Rad51d
tccagtcccggaacc

SEQ ID NO: 22803 - DNA, 15 bp, Artificial Sequence
  dgRNA
  Rad51d
ggaacccggaagcgt

SEQ ID NO: 22804 - DNA, 15 bp, Artificial Sequence
  dgRNA
  Rad51d
cccggaagcgtcggc

SEQ ID NO: 22805 - DNA, 15 bp, Artificial Sequence
  dgRNA
  Grm6
tcttctcggggtggc

SEQ ID NO: 22806 - DNA, 15 bp, Artificial Sequence
  dgRNA
  Grm6
ttaatcggcatattg

SEQ ID NO: 22807 - DNA, 15 bp, Artificial Sequence
  dgRNA
  Grm6
agtggccaagcttat

SEQ ID NO: 22808 - DNA, 15 bp, Artificial Sequence
  dgRNA
  Grm6
gcttattggtgttgc

SEQ ID NO: 22809 - DNA, 15 bp, Artificial Sequence
  dgRNA
  Fabp1
gttaagtcaccataa

SEQ ID NO: 22810 - DNA, 15 bp, Artificial Sequence
  dgRNA
  Fabp1
acaatcactgaccta

SEQ ID NO: 22811 - DNA, 15 bp, Artificial Sequence
  dgRNA
  Fabp1
agtgagtccaaccaa

SEQ ID NO: 22812 - DNA, 15 bp, Artificial Sequence
  dgRNA
  Fabp1
tagtgagtccaacca

SEQ ID NO: 22813 - DNA, 15 bp, Artificial Sequence
  dgRNA
  Poli
tctaggaagtgttat

SEQ ID NO: 22814 - DNA, 15 bp, Artificial Sequence
  dgRNA
  Prom2
actctgaggtactcc

SEQ ID NO: 22815 - DNA, 15 bp, Artificial Sequence
  dgRNA
  Prom2
ctcctggacggactc

SEQ ID NO: 22816 - DNA, 15 bp, Artificial Sequence
  dgRNA
  Prom2
gcccagcatgttagg

SEQ ID NO: 22817 - DNA, 15 bp, Artificial Sequence
  dgRNA
  Prom2
cccagcatgttagga

SEQ ID NO: 22818 - DNA, 15 bp, Artificial Sequence
  dgRNA
  Ccdc158
cgccaaccgtcagac

SEQ ID NO: 22819 - DNA, 15 bp, Artificial Sequence
  dgRNA
  Ccdc158
gccaaccgtcagacc

SEQ ID NO: 22820 - DNA, 15 bp, Artificial Sequence
  dgRNA
  Ccdc158
gcgctccgcagaagc

SEQ ID NO: 22821 - DNA, 15 bp, Artificial Sequence
  dgRNA
  Ccdc158
cgctccgcagaagca

SEQ ID NO: 22822 - DNA, 15 bp, Artificial Sequence
  dgRNA
  Bpifc
cagtaatgattgcat

SEQ ID NO: 22823 - DNA, 15 bp, Artificial Sequence
  dgRNA
  Bpifc
actacaattactcaa

SEQ ID NO: 22824 - DNA, 15 bp, Artificial Sequence
  dgRNA
  Gm14139
tactctagaccccta

SEQ ID NO: 22825 - DNA, 15 bp, Artificial Sequence
  dgRNA
  Gm14139
actctagacccctaa

SEQ ID NO: 22826 - DNA, 15 bp, Artificial Sequence
  dgRNA
  Cnot4
attcccggcctgccc

SEQ ID NO: 22827 - DNA, 15 bp, Artificial Sequence
  dgRNA
  Cnot4
tcccggcctgccccg

SEQ ID NO: 22828 - DNA, 15 bp, Artificial Sequence
  dgRNA
  Cnot4
cggcctgccccgggg

SEQ ID NO: 22829 - DNA, 15 bp, Artificial Sequence
  dgRNA
  Cnot4
cggggcggttactat

SEQ ID NO: 22830 - DNA, 15 bp, Artificial Sequence
  dgRNA
  Vti1a
ttacgttcgaagatt

SEQ ID NO: 22831 - DNA, 15 bp, Artificial Sequence
  dgRNA
  Vti1a
tacgttcgaagattt

SEQ ID NO: 22832 - DNA, 15 bp, Artificial Sequence
  dgRNA
  Vti1a
gttcgaagatttggg

SEQ ID NO: 22833 - DNA, 15 bp, Artificial Sequence
  dgRNA
  Vti1a
aggcagcgcagtttc

SEQ ID NO: 22834 - DNA, 15 bp, Artificial Sequence
  dgRNA
  Tph1
cagacagcgactaag

SEQ ID NO: 22835 - DNA, 15 bp, Artificial Sequence
  dgRNA
  Tph1
agcgactaagaggtc

SEQ ID NO: 22836 - DNA, 15 bp, Artificial Sequence
  dgRNA
  Tph1
gcgactaagaggtca

SEQ ID NO: 22837 - DNA, 15 bp, Artificial Sequence
  dgRNA
  Tph1
cctcaaccgtgcgcc

SEQ ID NO: 22838 - DNA, 15 bp, Artificial Sequence
  dgRNA
  BC048609
gtgtagaggattgaa

SEQ ID NO: 22839 - DNA, 15 bp, Artificial Sequence
  dgRNA
  BC048609
gaggattgaatggcg

SEQ ID NO: 22840 - DNA, 15 bp, Artificial Sequence
  dgRNA
  BC048609
aggattgaatggcgt

SEQ ID NO: 22841 - DNA, 15 bp, Artificial Sequence
  dgRNA
  BC048609
ctgtttgttggaatc

SEQ ID NO: 22842 - DNA, 15 bp, Artificial Sequence
  dgRNA
  Ctsf
atggttaaaaggatc

SEQ ID NO: 22843 - DNA, 15 bp, Artificial Sequence
  dgRNA
  Ctsf
tgcgtaagatagaaa

SEQ ID NO: 22844 - DNA, 15 bp, Artificial Sequence
  dgRNA
  Ctsf
gcgtaagatagaaaa

SEQ ID NO: 22845 - DNA, 15 bp, Artificial Sequence
  dgRNA
  Ctsf
gcatcccgcaccccg

SEQ ID NO: 22846 - DNA, 15 bp, Artificial Sequence
  dgRNA
  Phtf1
ccccttagtgttgtg

SEQ ID NO: 22847 - DNA, 15 bp, Artificial Sequence
  dgRNA
  Phtf1
gctgccgagagccga

SEQ ID NO: 22848 - DNA, 15 bp, Artificial Sequence
  dgRNA
  Phtf1
gccgagagccgaagg

SEQ ID NO: 22849 - DNA, 15 bp, Artificial Sequence
  dgRNA
  Phtf1
cgaaggaggaaccac

SEQ ID NO: 22850 - DNA, 15 bp, Artificial Sequence
  dgRNA
  Zfp248
ctgactccgttttcc

SEQ ID NO: 22851 - DNA, 15 bp, Artificial Sequence
  dgRNA
  Zfp248
cactacgagcaccgt

SEQ ID NO: 22852 - DNA, 15 bp, Artificial Sequence
  dgRNA
  Zfp248
actacgagcaccgtt

SEQ ID NO: 22853 - DNA, 15 bp, Artificial Sequence
  dgRNA
  Zfp248
ctcatttcccaggat

SEQ ID NO: 22854 - DNA, 15 bp, Artificial Sequence
  dgRNA
  Noa1
cgagagtgcgagaat

SEQ ID NO: 22855 - DNA, 15 bp, Artificial Sequence
  dgRNA
  Noa1
aatcggccgcactgt

SEQ ID NO: 22856 - DNA, 15 bp, Artificial Sequence
  dgRNA
  Noa1
ctctcgtctagtcgc

SEQ ID NO: 22857 - DNA, 15 bp, Artificial Sequence
  dgRNA
  Noa1
tctcgtctagtcgct

SEQ ID NO: 22858 - DNA, 15 bp, Artificial Sequence
  dgRNA
  Lss
cgcagccacgccccc

SEQ ID NO: 22859 - DNA, 15 bp, Artificial Sequence
  dgRNA
  Lss
cccctggtgccctcg

SEQ ID NO: 22860 - DNA, 15 bp, Artificial Sequence
  dgRNA
  Lss
gtgccctcgcggcgt

SEQ ID NO: 22861 - DNA, 15 bp, Artificial Sequence
  dgRNA
  Lss
tgccctcgcggcgtc

SEQ ID NO: 22862 - DNA, 15 bp, Artificial Sequence
  dgRNA
  Bub3
tgcagcatacaattg

SEQ ID NO: 22863 - DNA, 15 bp, Artificial Sequence
  dgRNA
  Bub3
gcatacaattgtggg

SEQ ID NO: 22864 - DNA, 15 bp, Artificial Sequence
  dgRNA
  Bub3
catacaattgtgggc

SEQ ID NO: 22865 - DNA, 15 bp, Artificial Sequence
  dgRNA
  Bub3
tgacctgagcatact

SEQ ID NO: 22866 - DNA, 15 bp, Artificial Sequence
  dgRNA
  Acsm2
tgatcccttgggcta

SEQ ID NO: 22867 - DNA, 15 bp, Artificial Sequence
  dgRNA
  Acsm2
cacataaacttcgtt

SEQ ID NO: 22868 - DNA, 15 bp, Artificial Sequence
  dgRNA
  Acsm2
ataaacttcgttagg

SEQ ID NO: 22869 - DNA, 15 bp, Artificial Sequence
  dgRNA
  Acsm2
gattagctgagccct

SEQ ID NO: 22870 - DNA, 15 bp, Artificial Sequence
  dgRNA
  Ccdc83
cgctggagacgatac

SEQ ID NO: 22871 - DNA, 15 bp, Artificial Sequence
  dgRNA
  Ccdc83
gctggagacgatact

SEQ ID NO: 22872 - DNA, 15 bp, Artificial Sequence
  dgRNA
  Ccdc83
tgccctgacacgaga

SEQ ID NO: 22873 - DNA, 15 bp, Artificial Sequence
  dgRNA
  Ccdc83
gccctgacacgagat

SEQ ID NO: 22874 - DNA, 15 bp, Artificial Sequence
  dgRNA
  Sc5d
gcatcatgaagcgcc

SEQ ID NO: 22875 - DNA, 15 bp, Artificial Sequence
  dgRNA
  Sc5d
gcgcctggatagtcc

SEQ ID NO: 22876 - DNA, 15 bp, Artificial Sequence
  dgRNA
  Sc5d
gtcccggcagagtgc

SEQ ID NO: 22877 - DNA, 15 bp, Artificial Sequence
  dgRNA
  Sc5d
gtgctggacctggtt

SEQ ID NO: 22878 - DNA, 15 bp, Artificial Sequence
  dgRNA
  Olfr720
actcaatttcatgcc

SEQ ID NO: 22879 - DNA, 15 bp, Artificial Sequence
  dgRNA
  Olfr720
gtaatctgacaatca

SEQ ID NO: 22880 - DNA, 15 bp, Artificial Sequence
  dgRNA
  Olfr720
agtaatctgacaatc

SEQ ID NO: 22881 - DNA, 15 bp, Artificial Sequence
  dgRNA
  Rab7b
cgtccctcatcccct

SEQ ID NO: 22882 - DNA, 15 bp, Artificial Sequence
  dgRNA
  Rab7b
cagctgaggtcacgc

SEQ ID NO: 22883 - DNA, 15 bp, Artificial Sequence
  dgRNA
  Rab7b
cggcaggtttgagtt

SEQ ID NO: 22884 - DNA, 15 bp, Artificial Sequence
  dgRNA
  Rab7b
acggcaggtttgagt

SEQ ID NO: 22885 - DNA, 15 bp, Artificial Sequence
  dgRNA
  Ep400
cagcgcctcagcttc

SEQ ID NO: 22886 - DNA, 15 bp, Artificial Sequence
  dgRNA
  Ep400
tcaggcgaccccgcg

SEQ ID NO: 22887 - DNA, 15 bp, Artificial Sequence
  dgRNA
  Ep400
ccgcgcggctgcgag

SEQ ID NO: 22888 - DNA, 15 bp, Artificial Sequence
  dgRNA
  Ep400
tgcgagcggccctac

SEQ ID NO: 22889 - DNA, 15 bp, Artificial Sequence
  dgRNA
  Ddx51
ggagctcgccgaagc

SEQ ID NO: 22890 - DNA, 15 bp, Artificial Sequence
  dgRNA
  Ddx51
gagctcgccgaagct

SEQ ID NO: 22891 - DNA, 15 bp, Artificial Sequence
  dgRNA
  Ddx51
cgccgatgctgctcc

SEQ ID NO: 22892 - DNA, 15 bp, Artificial Sequence
  dgRNA
  Ddx51
gaagtgtgcgccgag

SEQ ID NO: 22893 - DNA, 15 bp, Artificial Sequence
  dgRNA
  Sh2d2a
gccttataacacttt

SEQ ID NO: 22894 - DNA, 15 bp, Artificial Sequence
  dgRNA
  Sh2d2a
actaccccaagtgcc

SEQ ID NO: 22895 - DNA, 15 bp, Artificial Sequence
  dgRNA
  Sh2d2a
gcactttccatgacg

SEQ ID NO: 22896 - DNA, 15 bp, Artificial Sequence
  dgRNA
  Sh2d2a
cactttccatgacgt

SEQ ID NO: 22897 - DNA, 15 bp, Artificial Sequence
  dgRNA
  Vps50
cgctcttccaagtcc

SEQ ID NO: 22898 - DNA, 15 bp, Artificial Sequence
  dgRNA
  Vps50
gaagcgactgcttct

SEQ ID NO: 22899 - DNA, 15 bp, Artificial Sequence
  dgRNA
  Vps50
aagcgactgcttctt

SEQ ID NO: 22900 - DNA, 15 bp, Artificial Sequence
  dgRNA
  Vps50
atgtagtactgaagt

SEQ ID NO: 22901 - DNA, 15 bp, Artificial Sequence
  dgRNA
  Fam195a
agatggcatacccct

SEQ ID NO: 22902 - DNA, 15 bp, Artificial Sequence
  dgRNA
  Fam195a
tcaaatttagtgact

SEQ ID NO: 22903 - DNA, 15 bp, Artificial Sequence
  dgRNA
  Fam195a
ggccaattttccaaa

SEQ ID NO: 22904 - DNA, 15 bp, Artificial Sequence
  dgRNA
  Fam195a
ggaaggctaccaagt

SEQ ID NO: 22905 - DNA, 15 bp, Artificial Sequence
  dgRNA
  Fam65b
gagaattacctcacc

SEQ ID NO: 22906 - DNA, 15 bp, Artificial Sequence
  dgRNA
  Fam65b
ttgggcaatccgctg

SEQ ID NO: 22907 - DNA, 15 bp, Artificial Sequence
  dgRNA
  Fam65b
tgggcaatccgctgt

SEQ ID NO: 22908 - DNA, 15 bp, Artificial Sequence
  dgRNA
  Fam65b
gggcaatccgctgtg

SEQ ID NO: 22909 - DNA, 15 bp, Artificial Sequence
  dgRNA
  Cdc25c
gagccaatatgtacc

SEQ ID NO: 22910 - DNA, 15 bp, Artificial Sequence
  dgRNA
  Cdc25c
gctgcccagcggact

SEQ ID NO: 22911 - DNA, 15 bp, Artificial Sequence
  dgRNA
  Cdc25c
tacgaaaatagcgat

SEQ ID NO: 22912 - DNA, 15 bp, Artificial Sequence
  dgRNA
  Cdc25c
aaatagcgattggtt

SEQ ID NO: 22913 - DNA, 15 bp, Artificial Sequence
  dgRNA
  Brat1
gcggtgtctgagggg

SEQ ID NO: 22914 - DNA, 15 bp, Artificial Sequence
  dgRNA
  Brat1
gacttgaagctggcg

SEQ ID NO: 22915 - DNA, 15 bp, Artificial Sequence
  dgRNA
  Brat1
tggagccaattcccg

SEQ ID NO: 22916 - DNA, 15 bp, Artificial Sequence
  dgRNA
  Brat1
agccaattcccgcgg

SEQ ID NO: 22917 - DNA, 15 bp, Artificial Sequence
  dgRNA
  Clptm1
ccaaattgcggtgaa

SEQ ID NO: 22918 - DNA, 15 bp, Artificial Sequence
  dgRNA
  Clptm1
caaattgcggtgaaa

SEQ ID NO: 22919 - DNA, 15 bp, Artificial Sequence
  dgRNA
  Clptm1
aaattgcggtgaaag

SEQ ID NO: 22920 - DNA, 15 bp, Artificial Sequence
  dgRNA
  Clptm1
ttgcggtgaaagggg

SEQ ID NO: 22921 - DNA, 15 bp, Artificial Sequence
  dgRNA
  Dctn1
ttgtcagctagggcg

SEQ ID NO: 22922 - DNA, 15 bp, Artificial Sequence
  dgRNA
  Dctn1
ctagggcgaggcagc

SEQ ID NO: 22923 - DNA, 15 bp, Artificial Sequence
  dgRNA
  Dctn1
gttttctgggacccg

SEQ ID NO: 22924 - DNA, 15 bp, Artificial Sequence
  dgRNA
  Dctn1
ggatcactgcgggag

SEQ ID NO: 22925 - DNA, 15 bp, Artificial Sequence
  dgRNA
  Arfip1
tagttcacagggccg

SEQ ID NO: 22926 - DNA, 15 bp, Artificial Sequence
  dgRNA
  Arfip1
acagggccgcggccc

SEQ ID NO: 22927 - DNA, 15 bp, Artificial Sequence
  dgRNA
  Arfip1
cagggccgcggcccg

SEQ ID NO: 22928 - DNA, 15 bp, Artificial Sequence
  dgRNA
  Arfip1
ggcccggggcggagt

SEQ ID NO: 22929 - DNA, 15 bp, Artificial Sequence
  dgRNA
  Asb14
gatttcgtcttcgtt

SEQ ID NO: 22930 - DNA, 15 bp, Artificial Sequence
  dgRNA
  Asb14
agatttcgtcttcgt

SEQ ID NO: 22931 - DNA, 15 bp, Artificial Sequence
  dgRNA
  Asb14
gatcataagacagtc

SEQ ID NO: 22932 - DNA, 15 bp, Artificial Sequence
  dgRNA
  Arnt
gattagggaaacagc

SEQ ID NO: 22933 - DNA, 15 bp, Artificial Sequence
  dgRNA
  Arnt
ggtcaccggactcac

SEQ ID NO: 22934 - DNA, 15 bp, Artificial Sequence
  dgRNA
  Arnt
gccgagtcactagcc

SEQ ID NO: 22935 - DNA, 15 bp, Artificial Sequence
  dgRNA
  Arnt
ctagcccggcctcta

SEQ ID NO: 22936 - DNA, 15 bp, Artificial Sequence
  dgRNA
  Gprc5d
acctctctcgggcca

SEQ ID NO: 22937 - DNA, 15 bp, Artificial Sequence
  dgRNA
  Gprc5d
gccttggcccgagag

SEQ ID NO: 22938 - DNA, 15 bp, Artificial Sequence
  dgRNA
  Gprc5d
cctagtccagtttca

SEQ ID NO: 22939 - DNA, 15 bp, Artificial Sequence
  dgRNA
  Gprc5d
ataaaaagaaccgga

SEQ ID NO: 22940 - DNA, 15 bp, Artificial Sequence
  dgRNA
  Dag1
ttcttcgggagaagt

SEQ ID NO: 22941 - DNA, 15 bp, Artificial Sequence
  dgRNA
  Dag1
tcttcgggagaagtt

SEQ ID NO: 22942 - DNA, 15 bp, Artificial Sequence
  dgRNA
  Dag1
gcgctcccagctacc

SEQ ID NO: 22943 - DNA, 15 bp, Artificial Sequence
  dgRNA
  Dag1
cccagctacccggac

SEQ ID NO: 22944 - DNA, 15 bp, Artificial Sequence
  dgRNA
  Fpr-rs4
taaggcgggacaaga

SEQ ID NO: 22945 - DNA, 15 bp, Artificial Sequence
  dgRNA
  Fpr-rs4
aagtacctattctag

SEQ ID NO: 22946 - DNA, 15 bp, Artificial Sequence
  dgRNA
  Fpr-rs4
aaagtacctattcta

SEQ ID NO: 22947 - DNA, 15 bp, Artificial Sequence
  dgRNA
  Fpr-rs4
aaaagtacctattct

SEQ ID NO: 22948 - DNA, 15 bp, Artificial Sequence
  dgRNA
  Gcc2
acagggtagtagtgc

SEQ ID NO: 22949 - DNA, 15 bp, Artificial Sequence
  dgRNA
  Gcc2
cagggtagtagtgca

SEQ ID NO: 22950 - DNA, 15 bp, Artificial Sequence
  dgRNA
  Gcc2
cgactcagcgcgttc

SEQ ID NO: 22951 - DNA, 15 bp, Artificial Sequence
  dgRNA
  Gcc2
agcgcgttccggcac

SEQ ID NO: 22952 - DNA, 15 bp, Artificial Sequence
  dgRNA
  Zkscan1
ctgaacaccctaaac

SEQ ID NO: 22953 - DNA, 15 bp, Artificial Sequence
  dgRNA
  Zkscan1
agctcaactcgatcc

SEQ ID NO: 22954 - DNA, 15 bp, Artificial Sequence
  dgRNA
  Zkscan1
cgatcccggaagatg

SEQ ID NO: 22955 - DNA, 15 bp, Artificial Sequence
  dgRNA
  Zkscan1
ttccgggtctcctct

SEQ ID NO: 22956 - DNA, 15 bp, Artificial Sequence
  dgRNA
  Olfr643
aatgttgagtactat

SEQ ID NO: 22957 - DNA, 15 bp, Artificial Sequence
  dgRNA
  Olfr643
aatgaagggctacat

SEQ ID NO: 22958 - DNA, 15 bp, Artificial Sequence
  dgRNA
  Olfr643
aataatattggactc

SEQ ID NO: 22959 - DNA, 15 bp, Artificial Sequence
  dgRNA
  Agrn
gcccgcgcgggtcgc

SEQ ID NO: 22960 - DNA, 15 bp, Artificial Sequence
  dgRNA
  Agrn
cccgcgcgggtcgca

SEQ ID NO: 22961 - DNA, 15 bp, Artificial Sequence
  dgRNA
  Agrn
gcgggtcgcagggag

SEQ ID NO: 22962 - DNA, 15 bp, Artificial Sequence
  dgRNA
  Agrn
cgggtcgcagggagc

SEQ ID NO: 22963 - DNA, 15 bp, Artificial Sequence
  dgRNA
  Papss1
ccacgcccctcgtcc

SEQ ID NO: 22964 - DNA, 15 bp, Artificial Sequence
  dgRNA
  Papss1
cacgcccctcgtcct

SEQ ID NO: 22965 - DNA, 15 bp, Artificial Sequence
  dgRNA
  Papss1
cctcgtcctgggtca

SEQ ID NO: 22966 - DNA, 15 bp, Artificial Sequence
  dgRNA
  Papss1
cgtcctgggtcaagg

SEQ ID NO: 22967 - DNA, 15 bp, Artificial Sequence
  dgRNA
  Plppr2
gtgtttaggggtgct

SEQ ID NO: 22968 - DNA, 15 bp, Artificial Sequence
  dgRNA
  Plppr2
gtgaatgagcaaatc

SEQ ID NO: 22969 - DNA, 15 bp, Artificial Sequence
  dgRNA
  Dclre1c
ttctccgtgcccagc

SEQ ID NO: 22970 - DNA, 15 bp, Artificial Sequence
  dgRNA
  Dclre1c
ggattggatgcccat

SEQ ID NO: 22971 - DNA, 15 bp, Artificial Sequence
  dgRNA
  Dclre1c
tccgcccctacctca

SEQ ID NO: 22972 - DNA, 15 bp, Artificial Sequence
  dgRNA
  Dclre1c
ccgcccctacctcaa

SEQ ID NO: 22973 - DNA, 15 bp, Artificial Sequence
  dgRNA
  Rnf25
atgcgaaccgcccat

SEQ ID NO: 22974 - DNA, 15 bp, Artificial Sequence
  dgRNA
  Rnf25
ggcacttctgtcgct

SEQ ID NO: 22975 - DNA, 15 bp, Artificial Sequence
  dgRNA
  Rnf25
tgtcgcttggctagc

SEQ ID NO: 22976 - DNA, 15 bp, Artificial Sequence
  dgRNA
  Rnf25
tagcaggccccacaa

SEQ ID NO: 22977 - DNA, 15 bp, Artificial Sequence
  dgRNA
  Mtfmt
gccacgcctccaaag

SEQ ID NO: 22978 - DNA, 15 bp, Artificial Sequence
  dgRNA
  Mtfmt
cgcctccaaagcggc

SEQ ID NO: 22979 - DNA, 15 bp, Artificial Sequence
  dgRNA
  Mtfmt
tcgtctgcgcgtgct

SEQ ID NO: 22980 - DNA, 15 bp, Artificial Sequence
  dgRNA
  Mtfmt
cgtctgcgcgtgctt

SEQ ID NO: 22981 - DNA, 15 bp, Artificial Sequence
  dgRNA
  Zbtb34
tacccgcccgtctac

SEQ ID NO: 22982 - DNA, 15 bp, Artificial Sequence
  dgRNA
  Zbtb34
cgcccgtctactggt

SEQ ID NO: 22983 - DNA, 15 bp, Artificial Sequence
  dgRNA
  Zbtb34
agctgggattccgac

SEQ ID NO: 22984 - DNA, 15 bp, Artificial Sequence
  dgRNA
  Zbtb34
ccgccgcgagaagtc

SEQ ID NO: 22985 - DNA, 15 bp, Artificial Sequence
  dgRNA
  Hrnr
atactagcccagatt

SEQ ID NO: 22986 - DNA, 15 bp, Artificial Sequence
  dgRNA
  Hrnr
tactagcccagattt

SEQ ID NO: 22987 - DNA, 15 bp, Artificial Sequence
  dgRNA
  Hrnr
tgctattgcaatctc

SEQ ID NO: 22988 - DNA, 15 bp, Artificial Sequence
  dgRNA
  Hrnr
tcaggttaacgtgta

SEQ ID NO: 22989 - DNA, 15 bp, Artificial Sequence
  dgRNA
  Gm7325
tgctgaatccaccgc

SEQ ID NO: 22990 - DNA, 15 bp, Artificial Sequence
  dgRNA
  Gm7325
ctggccggttagaac

SEQ ID NO: 22991 - DNA, 15 bp, Artificial Sequence
  dgRNA
  Gm7325
tggattcagcatcac

SEQ ID NO: 22992 - DNA, 15 bp, Artificial Sequence
  dgRNA
  Gm7325
tgcttttgcctgcgg

SEQ ID NO: 22993 - DNA, 15 bp, Artificial Sequence
  dgRNA
  Vmn2r60
aactctcattgatag

SEQ ID NO: 22994 - DNA, 15 bp, Artificial Sequence
  dgRNA
  Vmn2r60
tctcattgatagtgg

SEQ ID NO: 22995 - DNA, 15 bp, Artificial Sequence
  dgRNA
  Vmn2r60
ctcattaacagtcag

SEQ ID NO: 22996 - DNA, 15 bp, Artificial Sequence
  dgRNA
  Vmn2r60
cctattgggcgtcat

SEQ ID NO: 22997 - DNA, 15 bp, Artificial Sequence
  dgRNA
  Slc5a10
tagttgctaagtagc

SEQ ID NO: 22998 - DNA, 15 bp, Artificial Sequence
  dgRNA
  Slc5a10
gctaagtagcaggct

SEQ ID NO: 22999 - DNA, 15 bp, Artificial Sequence
  dgRNA
  Slc5a10
actcattaacacttt

SEQ ID NO: 23000 - DNA, 15 bp, Artificial Sequence
  dgRNA
  Slc5a10
attaacacttttgga

SEQ ID NO: 23001 - DNA, 15 bp, Artificial Sequence
  dgRNA
  Mier1
aggttcggcgatgcc

SEQ ID NO: 23002 - DNA, 15 bp, Artificial Sequence
  dgRNA
  Mier1
gtttgccgggcgcca

SEQ ID NO: 23003 - DNA, 15 bp, Artificial Sequence
  dgRNA
  Mier1
gcgccatggcgaccg

SEQ ID NO: 23004 - DNA, 15 bp, Artificial Sequence
  dgRNA
  Mier1
ggcgaccgcggagcc

SEQ ID NO: 23005 - DNA, 15 bp, Artificial Sequence
  dgRNA
  Dnal4
cgcagctgctccggc

SEQ ID NO: 23006 - DNA, 15 bp, Artificial Sequence
  dgRNA
  Dnal4
ccctcgcgtaagctc

SEQ ID NO: 23007 - DNA, 15 bp, Artificial Sequence
  dgRNA
  Dnal4
aagctccggcctcct

SEQ ID NO: 23008 - DNA, 15 bp, Artificial Sequence
  dgRNA
  Dnal4
cctcctaggcccctt

SEQ ID NO: 23009 - DNA, 15 bp, Artificial Sequence
  dgRNA
  Slc10a3
cagtcaggtctcacg

SEQ ID NO: 23010 - DNA, 15 bp, Artificial Sequence
  dgRNA
  Slc10a3
aggtctcacgtggta

SEQ ID NO: 23011 - DNA, 15 bp, Artificial Sequence
  dgRNA
  Slc10a3
aaacgtcacatccgt

SEQ ID NO: 23012 - DNA, 15 bp, Artificial Sequence
  dgRNA
  Slc10a3
aacgtcacatccgtt

SEQ ID NO: 23013 - DNA, 15 bp, Artificial Sequence
  dgRNA
  Mon1b
cgaagtgggccggtc

SEQ ID NO: 23014 - DNA, 15 bp, Artificial Sequence
  dgRNA
  Mon1b
cttcacagccgatcc

SEQ ID NO: 23015 - DNA, 15 bp, Artificial Sequence
  dgRNA
  Mon1b
cctggctgcgtccgg

SEQ ID NO: 23016 - DNA, 15 bp, Artificial Sequence
  dgRNA
  Mon1b
gctgcgtccggtgga

SEQ ID NO: 23017 - DNA, 15 bp, Artificial Sequence
  dgRNA
  Ogn
catttcaccccgaga

SEQ ID NO: 23018 - DNA, 15 bp, Artificial Sequence
  dgRNA
  Ogn
cccgagaaggaatgt

SEQ ID NO: 23019 - DNA, 15 bp, Artificial Sequence
  dgRNA
  Ogn
gggatttaaactgtt

SEQ ID NO: 23020 - DNA, 15 bp, Artificial Sequence
  dgRNA
  Ogn
gaaactgcggcacta

SEQ ID NO: 23021 - DNA, 15 bp, Artificial Sequence
  dgRNA
  Rtfdc1
gggaccgcccacgac

SEQ ID NO: 23022 - DNA, 15 bp, Artificial Sequence
  dgRNA
  Rtfdc1
gcccacgaccggaag

SEQ ID NO: 23023 - DNA, 15 bp, Artificial Sequence
  dgRNA
  Rtfdc1
agtggacgcactcca

SEQ ID NO: 23024 - DNA, 15 bp, Artificial Sequence
  dgRNA
  Rtfdc1
aattggtgtggacca

SEQ ID NO: 23025 - DNA, 15 bp, Artificial Sequence
  dgRNA
  Ngb
ggtagtaccttccta

SEQ ID NO: 23026 - DNA, 15 bp, Artificial Sequence
  dgRNA
  Ngb
agtaccttcctaagg

SEQ ID NO: 23027 - DNA, 15 bp, Artificial Sequence
  dgRNA
  Ngb
gtaccttcctaaggc

SEQ ID NO: 23028 - DNA, 15 bp, Artificial Sequence
  dgRNA
  Ngb
ctaaggcgggtgcag

SEQ ID NO: 23029 - DNA, 15 bp, Artificial Sequence
  dgRNA
  Aftph
ttccccgctgcatga

SEQ ID NO: 23030 - DNA, 15 bp, Artificial Sequence
  dgRNA
  Aftph
tccccgctgcatgat

SEQ ID NO: 23031 - DNA, 15 bp, Artificial Sequence
  dgRNA
  Aftph
gggtctccgcggagg

SEQ ID NO: 23032 - DNA, 15 bp, Artificial Sequence
  dgRNA
  Aftph
gcggaagagggcgga

SEQ ID NO: 23033 - DNA, 15 bp, Artificial Sequence
  dgRNA
  Olfr323
taagttgcaaactac

SEQ ID NO: 23034 - DNA, 15 bp, Artificial Sequence
  dgRNA
  Olfr323
ttagggtctaagggt

SEQ ID NO: 23035 - DNA, 15 bp, Artificial Sequence
  dgRNA
  Olfr323
atgtttagggtctaa

SEQ ID NO: 23036 - DNA, 15 bp, Artificial Sequence
  dgRNA
  Olfr323
gatgtttagggtcta

SEQ ID NO: 23037 - DNA, 15 bp, Artificial Sequence
  dgRNA
  Mvp
gtctggaccgagact

SEQ ID NO: 23038 - DNA, 15 bp, Artificial Sequence
  dgRNA
  Mvp
gctaactggcgggtc

SEQ ID NO: 23039 - DNA, 15 bp, Artificial Sequence
  dgRNA
  Mvp
atcagtgctaactgg

SEQ ID NO: 23040 - DNA, 15 bp, Artificial Sequence
  dgRNA
  Mvp
tgaatcagtgctaac

SEQ ID NO: 23041 - DNA, 15 bp, Artificial Sequence
  dgRNA
  Fam13c
ctcgtttgcatccct

SEQ ID NO: 23042 - DNA, 15 bp, Artificial Sequence
  dgRNA
  Fam13c
tcgtttgcatcccta

SEQ ID NO: 23043 - DNA, 15 bp, Artificial Sequence
  dgRNA
  Fam13c
ttgcatccctagggt

SEQ ID NO: 23044 - DNA, 15 bp, Artificial Sequence
  dgRNA
  Fam13c
cattgtatccactgg

SEQ ID NO: 23045 - DNA, 15 bp, Artificial Sequence
  dgRNA
  Smarca4
cccgagccccccaca

SEQ ID NO: 23046 - DNA, 15 bp, Artificial Sequence
  dgRNA
  Smarca4
ccgagccccccacag

SEQ ID NO: 23047 - DNA, 15 bp, Artificial Sequence
  dgRNA
  Smarca4
caggggcggtgcacc

SEQ ID NO: 23048 - DNA, 15 bp, Artificial Sequence
  dgRNA
  Smarca4
tcctcgcgccctcaa

SEQ ID NO: 23049 - DNA, 15 bp, Artificial Sequence
  dgRNA
  Zfp7
gtcgtgcctggcctt

SEQ ID NO: 23050 - DNA, 15 bp, Artificial Sequence
  dgRNA
  Zfp7
tagcccagcccttta

SEQ ID NO: 23051 - DNA, 15 bp, Artificial Sequence
  dgRNA
  Zfp7
ggccgtgacaacttc

SEQ ID NO: 23052 - DNA, 15 bp, Artificial Sequence
  dgRNA
  Zfp7
ccctgtaacctggcg

SEQ ID NO: 23053 - DNA, 15 bp, Artificial Sequence
  dgRNA
  Mtrr
ggagcttccgagccc

SEQ ID NO: 23054 - DNA, 15 bp, Artificial Sequence
  dgRNA
  Mtrr
gagcttccgagccct

SEQ ID NO: 23055 - DNA, 15 bp, Artificial Sequence
  dgRNA
  Mtrr
gggagcgtccgtaca

SEQ ID NO: 23056 - DNA, 15 bp, Artificial Sequence
  dgRNA
  Mtrr
acgctgccccttacc

SEQ ID NO: 23057 - DNA, 15 bp, Artificial Sequence
  dgRNA
  Ctnnbip1
ccgagtgcagctcct

SEQ ID NO: 23058 - DNA, 15 bp, Artificial Sequence
  dgRNA
  Ctnnbip1
ccgtgagtcctagac

SEQ ID NO: 23059 - DNA, 15 bp, Artificial Sequence
  dgRNA
  Ctnnbip1
gcactcggggaatga

SEQ ID NO: 23060 - DNA, 15 bp, Artificial Sequence
  dgRNA
  Ctnnbip1
tgcactcggggaatg

SEQ ID NO: 23061 - DNA, 15 bp, Artificial Sequence
  dgRNA
  Nfya
gatgccgaccccgac

SEQ ID NO: 23062 - DNA, 15 bp, Artificial Sequence
  dgRNA
  Nfya
gagcgcttgcgcatt

SEQ ID NO: 23063 - DNA, 15 bp, Artificial Sequence
  dgRNA
  Nfya
cgcattcggccccag

SEQ ID NO: 23064 - DNA, 15 bp, Artificial Sequence
  dgRNA
  Nfya
gcattcggccccaga

SEQ ID NO: 23065 - DNA, 15 bp, Artificial Sequence
  dgRNA
  Tia1
ctaaacccggctgcc

SEQ ID NO: 23066 - DNA, 15 bp, Artificial Sequence
  dgRNA
  Tia1
aacccggctgccagg

SEQ ID NO: 23067 - DNA, 15 bp, Artificial Sequence
  dgRNA
  Tia1
acccggctgccagga

SEQ ID NO: 23068 - DNA, 15 bp, Artificial Sequence
  dgRNA
  Tia1
ggctgtgcgcatgcg

SEQ ID NO: 23069 - DNA, 15 bp, Artificial Sequence
  dgRNA
  Bmx
gctaagtgttgagcg

SEQ ID NO: 23070 - DNA, 15 bp, Artificial Sequence
  dgRNA
  Bmx
agcgtggtttcctgt

SEQ ID NO: 23071 - DNA, 15 bp, Artificial Sequence
  dgRNA
  Bmx
tgtgtaaggccctgc

SEQ ID NO: 23072 - DNA, 15 bp, Artificial Sequence
  dgRNA
  Bmx
ggacaataaatgctt

SEQ ID NO: 23073 - DNA, 15 bp, Artificial Sequence
  dgRNA
  Rsc1a1
actctgataagttag

SEQ ID NO: 23074 - DNA, 15 bp, Artificial Sequence
  dgRNA
  Snrk
gccccgcccgaccca

SEQ ID NO: 23075 - DNA, 15 bp, Artificial Sequence
  dgRNA
  Snrk
cgtcacgatgacgca

SEQ ID NO: 23076 - DNA, 15 bp, Artificial Sequence
  dgRNA
  Snrk
gcgcggccgcacccc

SEQ ID NO: 23077 - DNA, 15 bp, Artificial Sequence
  dgRNA
  Snrk
ccccggccgcccgct

SEQ ID NO: 23078 - DNA, 15 bp, Artificial Sequence
  dgRNA
  Hnrnpd
tgcgcacgccacttc

SEQ ID NO: 23079 - DNA, 15 bp, Artificial Sequence
  dgRNA
  Hnrnpd
tccggtcctctttaa

SEQ ID NO: 23080 - DNA, 15 bp, Artificial Sequence
  dgRNA
  Hnrnpd
gcgccgcgcgaccgc

SEQ ID NO: 23081 - DNA, 15 bp, Artificial Sequence
  dgRNA
  Hnrnpd
cgccgcgcgaccgcg

SEQ ID NO: 23082 - DNA, 15 bp, Artificial Sequence
  dgRNA
  Sez6l
gctcggccagagcca

SEQ ID NO: 23083 - DNA, 15 bp, Artificial Sequence
  dgRNA
  Sez6l
agctgcgcgtccgcc

SEQ ID NO: 23084 - DNA, 15 bp, Artificial Sequence
  dgRNA
  Sez6l
gtctggacctcggtc

SEQ ID NO: 23085 - DNA, 15 bp, Artificial Sequence
  dgRNA
  Sez6l
tctggacctcggtct

SEQ ID NO: 23086 - DNA, 15 bp, Artificial Sequence
  dgRNA
  Fam205c
gagtttatccaagat

SEQ ID NO: 23087 - DNA, 15 bp, Artificial Sequence
  dgRNA
  Fam205c
agtttatccaagata

SEQ ID NO: 23088 - DNA, 15 bp, Artificial Sequence
  dgRNA
  Fam205c
tctgcgcctgatttg

SEQ ID NO: 23089 - DNA, 15 bp, Artificial Sequence
  dgRNA
  Fam205c
tcggtgtccagatga

SEQ ID NO: 23090 - DNA, 15 bp, Artificial Sequence
  dgRNA
  Tagap
cggcgctgccctaaa

SEQ ID NO: 23091 - DNA, 15 bp, Artificial Sequence
  dgRNA
  Tagap
gccctaaaaggaatg

SEQ ID NO: 23092 - DNA, 15 bp, Artificial Sequence
  dgRNA
  Tagap
aacactcagcacacg

SEQ ID NO: 23093 - DNA, 15 bp, Artificial Sequence
  dgRNA
  Tagap
cttttagggcagcgc

SEQ ID NO: 23094 - DNA, 15 bp, Artificial Sequence
  dgRNA
  Telo2
agcggacacgcctac

SEQ ID NO: 23095 - DNA, 15 bp, Artificial Sequence
  dgRNA
  Telo2
cggagtcctgccctc

SEQ ID NO: 23096 - DNA, 15 bp, Artificial Sequence
  dgRNA
  Telo2
ccaccgtaggctctt

SEQ ID NO: 23097 - DNA, 15 bp, Artificial Sequence
  dgRNA
  Telo2
ttcctcctcttgcgc

SEQ ID NO: 23098 - DNA, 15 bp, Artificial Sequence
  dgRNA
  Fgd4
gcatgcttctccact

SEQ ID NO: 23099 - DNA, 15 bp, Artificial Sequence
  dgRNA
  Fgd4
tctaccaatcgcctt

SEQ ID NO: 23100 - DNA, 15 bp, Artificial Sequence
  dgRNA
  Fgd4
accaatcgccttagg

SEQ ID NO: 23101 - DNA, 15 bp, Artificial Sequence
  dgRNA
  Fgd4
ccaatcgccttagga

SEQ ID NO: 23102 - DNA, 15 bp, Artificial Sequence
  dgRNA
  Adcy5
gcttgagtatgttcg

SEQ ID NO: 23103 - DNA, 15 bp, Artificial Sequence
  dgRNA
  Adcy5
cttgagtatgttcgc

SEQ ID NO: 23104 - DNA, 15 bp, Artificial Sequence
  dgRNA
  Adcy5
ttgagtatgttcgcg

SEQ ID NO: 23105 - DNA, 15 bp, Artificial Sequence
  dgRNA
  Adcy5
atgttcgcggggtgc

SEQ ID NO: 23106 - DNA, 15 bp, Artificial Sequence
  dgRNA
  Cp
gtgaggtgtagtgcc

SEQ ID NO: 23107 - DNA, 15 bp, Artificial Sequence
  dgRNA
  Cp
tgaggtgtagtgcct

SEQ ID NO: 23108 - DNA, 15 bp, Artificial Sequence
  dgRNA
  Cp
aatttacacgatgaa

SEQ ID NO: 23109 - DNA, 15 bp, Artificial Sequence
  dgRNA
  Cp
tcttctagcaatccc

SEQ ID NO: 23110 - DNA, 15 bp, Artificial Sequence
  dgRNA
  Sh3kbp1
aggcaacctatatta

SEQ ID NO: 23111 - DNA, 15 bp, Artificial Sequence
  dgRNA
  Sh3kbp1
aacctatattacggc

SEQ ID NO: 23112 - DNA, 15 bp, Artificial Sequence
  dgRNA
  Sh3kbp1
acctatattacggca

SEQ ID NO: 23113 - DNA, 15 bp, Artificial Sequence
  dgRNA
  Sh3kbp1
ttacggcagggatgt

SEQ ID NO: 23114 - DNA, 15 bp, Artificial Sequence
  dgRNA
  Chodl
ggctccggcttttag

SEQ ID NO: 23115 - DNA, 15 bp, Artificial Sequence
  dgRNA
  Chodl
tccggcttttagggg

SEQ ID NO: 23116 - DNA, 15 bp, Artificial Sequence
  dgRNA
  Chodl
ccggcttttagggga

SEQ ID NO: 23117 - DNA, 15 bp, Artificial Sequence
  dgRNA
  Chodl
cggcttttaggggag

SEQ ID NO: 23118 - DNA, 15 bp, Artificial Sequence
  dgRNA
  Sbsn
gggcagaaccctact

SEQ ID NO: 23119 - DNA, 15 bp, Artificial Sequence
  dgRNA
  Sbsn
ggcagaaccctactg

SEQ ID NO: 23120 - DNA, 15 bp, Artificial Sequence
  dgRNA
  Sbsn
agaaccctactgggg

SEQ ID NO: 23121 - DNA, 15 bp, Artificial Sequence
  dgRNA
  Sbsn
tgagcaattaagagg

SEQ ID NO: 23122 - DNA, 15 bp, Artificial Sequence
  dgRNA
  Cerk
ctgggactaacctgc

SEQ ID NO: 23123 - DNA, 15 bp, Artificial Sequence
  dgRNA
  Cerk
ctcttgctagccgcc

SEQ ID NO: 23124 - DNA, 15 bp, Artificial Sequence
  dgRNA
  Cerk
aggtcaaatcgctcc

SEQ ID NO: 23125 - DNA, 15 bp, Artificial Sequence
  dgRNA
  Cerk
ggtcaaatcgctcct

SEQ ID NO: 23126 - DNA, 15 bp, Artificial Sequence
  dgRNA
  Tc2n
cttgtgccccgtatt

SEQ ID NO: 23127 - DNA, 15 bp, Artificial Sequence
  dgRNA
  Tc2n
tgccccgtattaggc

SEQ ID NO: 23128 - DNA, 15 bp, Artificial Sequence
  dgRNA
  Trmt61a
cgcgcggacaggccg

SEQ ID NO: 23129 - DNA, 15 bp, Artificial Sequence
  dgRNA
  Trmt61a
gcgcggacaggccgc

SEQ ID NO: 23130 - DNA, 15 bp, Artificial Sequence
  dgRNA
  Trmt61a
ggccgcgggcgagca

SEQ ID NO: 23131 - DNA, 15 bp, Artificial Sequence
  dgRNA
  Trmt61a
gccgcgggcgagcag

SEQ ID NO: 23132 - DNA, 15 bp, Artificial Sequence
  dgRNA
  Poc1b
ttcccgacaacaacc

SEQ ID NO: 23133 - DNA, 15 bp, Artificial Sequence
  dgRNA
  Poc1b
tacctccgaagctcg

SEQ ID NO: 23134 - DNA, 15 bp, Artificial Sequence
  dgRNA
  Poc1b
acctccgaagctcgc

SEQ ID NO: 23135 - DNA, 15 bp, Artificial Sequence
  dgRNA
  Poc1b
cgctgtgtgcgcgcg

SEQ ID NO: 23136 - DNA, 15 bp, Artificial Sequence
  dgRNA
  Ubap1l
agagtagcaggccgt

SEQ ID NO: 23137 - DNA, 15 bp, Artificial Sequence
  dgRNA
  Ubap1l
gtagcaggccgttgg

SEQ ID NO: 23138 - DNA, 15 bp, Artificial Sequence
  dgRNA
  Ubap1l
ctgcaacaagccagc

SEQ ID NO: 23139 - DNA, 15 bp, Artificial Sequence
  dgRNA
  Ubap1l
cttaaaaagcttagc

SEQ ID NO: 23140 - DNA, 15 bp, Artificial Sequence
  dgRNA
  Anapc16
catcctacgctagag

SEQ ID NO: 23141 - DNA, 15 bp, Artificial Sequence
  dgRNA
  Anapc16
cctacgctagagagg

SEQ ID NO: 23142 - DNA, 15 bp, Artificial Sequence
  dgRNA
  Anapc16
aaaccaaaactgcgg

SEQ ID NO: 23143 - DNA, 15 bp, Artificial Sequence
  dgRNA
  Anapc16
aaaactgcgggggac

SEQ ID NO: 23144 - DNA, 15 bp, Artificial Sequence
  dgRNA
  Lhx3
cgctgtctccgtcct

SEQ ID NO: 23145 - DNA, 15 bp, Artificial Sequence
  dgRNA
  Lhx3
taggcacctcggttc

SEQ ID NO: 23146 - DNA, 15 bp, Artificial Sequence
  dgRNA
  Lhx3
tcggttccggctgaa

SEQ ID NO: 23147 - DNA, 15 bp, Artificial Sequence
  dgRNA
  Lhx3
cgtctctgcgacccc

SEQ ID NO: 23148 - DNA, 15 bp, Artificial Sequence
  dgRNA
  Xxylt1
tgagctgagcgtagc

SEQ ID NO: 23149 - DNA, 15 bp, Artificial Sequence
  dgRNA
  Xxylt1
agccaaaatctgcac

SEQ ID NO: 23150 - DNA, 15 bp, Artificial Sequence
  dgRNA
  Xxylt1
tgcacgggccatctg

SEQ ID NO: 23151 - DNA, 15 bp, Artificial Sequence
  dgRNA
  Xxylt1
tgcggtctaatccct

SEQ ID NO: 23152 - DNA, 15 bp, Artificial Sequence
  dgRNA
  Pphln1
gtgggagcttacctt

SEQ ID NO: 23153 - DNA, 15 bp, Artificial Sequence
  dgRNA
  Pphln1
ttaccttcggcgcag

SEQ ID NO: 23154 - DNA, 15 bp, Artificial Sequence
  dgRNA
  Pphln1
gaggatgcgagcccg

SEQ ID NO: 23155 - DNA, 15 bp, Artificial Sequence
  dgRNA
  Pphln1
gatgcgagcccgcgg

SEQ ID NO: 23156 - DNA, 15 bp, Artificial Sequence
  dgRNA
  Rap1gap
ttggcacctctccct

SEQ ID NO: 23157 - DNA, 15 bp, Artificial Sequence
  dgRNA
  Rap1gap
ggctgggcggcagcg

SEQ ID NO: 23158 - DNA, 15 bp, Artificial Sequence
  dgRNA
  Rap1gap
gctgggcggcagcgt

SEQ ID NO: 23159 - DNA, 15 bp, Artificial Sequence
  dgRNA
  Rap1gap
ctgggcggcagcgtg

SEQ ID NO: 23160 - DNA, 15 bp, Artificial Sequence
  dgRNA
  Sult2b1
tgagccgctgccctg

SEQ ID NO: 23161 - DNA, 15 bp, Artificial Sequence
  dgRNA
  Sult2b1
gccgctgccctgagg

SEQ ID NO: 23162 - DNA, 15 bp, Artificial Sequence
  dgRNA
  Sult2b1
ctgcggtggccactc

SEQ ID NO: 23163 - DNA, 15 bp, Artificial Sequence
  dgRNA
  Sult2b1
tgcggtggccactca

SEQ ID NO: 23164 - DNA, 15 bp, Artificial Sequence
  dgRNA
  2510009E07Rik
cgccctcccaacccg

SEQ ID NO: 23165 - DNA, 15 bp, Artificial Sequence
  dgRNA
  2510009E07Rik
gccctcccaacccga

SEQ ID NO: 23166 - DNA, 15 bp, Artificial Sequence
  dgRNA
  2510009E07Rik
ccaacccgagggcgt

SEQ ID NO: 23167 - DNA, 15 bp, Artificial Sequence
  dgRNA
  2510009E07Rik
caacccgagggcgta

SEQ ID NO: 23168 - DNA, 15 bp, Artificial Sequence
  dgRNA
  Zrsr2
cgtctggggcgctca

SEQ ID NO: 23169 - DNA, 15 bp, Artificial Sequence
  dgRNA
  Zrsr2
gtctggggcgctcat

SEQ ID NO: 23170 - DNA, 15 bp, Artificial Sequence
  dgRNA
  Zrsr2
tggggcgctcatggg

SEQ ID NO: 23171 - DNA, 15 bp, Artificial Sequence
  dgRNA
  Zrsr2
tcatgggtggagccg

SEQ ID NO: 23172 - DNA, 15 bp, Artificial Sequence
  dgRNA
  Rps27a
ttagacagtgtaatc

SEQ ID NO: 23173 - DNA, 15 bp, Artificial Sequence
  dgRNA
  Rps27a
gtgtaatcaggtatc

SEQ ID NO: 23174 - DNA, 15 bp, Artificial Sequence
  dgRNA
  Rps27a
tgtaatcaggtatcc

SEQ ID NO: 23175 - DNA, 15 bp, Artificial Sequence
  dgRNA
  Rps27a
ggtatccgggaagtg

SEQ ID NO: 23176 - DNA, 15 bp, Artificial Sequence
  dgRNA
  Svbp
gctgcgcgggcgcag

SEQ ID NO: 23177 - DNA, 15 bp, Artificial Sequence
  dgRNA
  Svbp
gcgcagtggctcctg

SEQ ID NO: 23178 - DNA, 15 bp, Artificial Sequence
  dgRNA
  Svbp
agtggctcctgcggg

SEQ ID NO: 23179 - DNA, 15 bp, Artificial Sequence
  dgRNA
  Svbp
cgggaggggcacctc

SEQ ID NO: 23180 - DNA, 15 bp, Artificial Sequence
  dgRNA
  Slc22a22
taacttcaagcaccc

SEQ ID NO: 23181 - DNA, 15 bp, Artificial Sequence
  dgRNA
  Slc22a22
ccctggcatccttta

SEQ ID NO: 23182 - DNA, 15 bp, Artificial Sequence
  dgRNA
  Slc22a22
ctttaaggtccttat

SEQ ID NO: 23183 - DNA, 15 bp, Artificial Sequence
  dgRNA
  Slc22a22
gtccttatgggttac

SEQ ID NO: 23184 - DNA, 15 bp, Artificial Sequence
  dgRNA
  Cryba1
gggcccctgcacttc

SEQ ID NO: 23185 - DNA, 15 bp, Artificial Sequence
  dgRNA
  Cryba1
gacacctcccccaat

SEQ ID NO: 23186 - DNA, 15 bp, Artificial Sequence
  dgRNA
  Cryba1
agccactaaagctct

SEQ ID NO: 23187 - DNA, 15 bp, Artificial Sequence
  dgRNA
  Cryba1
tgtgggactataaag

SEQ ID NO: 23188 - DNA, 15 bp, Artificial Sequence
  dgRNA
  Serpina10
gactcttgtgaattc

SEQ ID NO: 23189 - DNA, 15 bp, Artificial Sequence
  dgRNA
  Serpina10
aattctggtcatagt

SEQ ID NO: 23190 - DNA, 15 bp, Artificial Sequence
  dgRNA
  Serpina10
catagttggggccat

SEQ ID NO: 23191 - DNA, 15 bp, Artificial Sequence
  dgRNA
  Serpina10
gccataggacgagcc

SEQ ID NO: 23192 - DNA, 15 bp, Artificial Sequence
  dgRNA
  Ankrd2
ggctgtccgaggtga

SEQ ID NO: 23193 - DNA, 15 bp, Artificial Sequence
  dgRNA
  Ankrd2
cgaggtgaaggtgac

SEQ ID NO: 23194 - DNA, 15 bp, Artificial Sequence
  dgRNA
  Ankrd2
taagctcatgacaga

SEQ ID NO: 23195 - DNA, 15 bp, Artificial Sequence
  dgRNA
  Ankrd2
aaggcgcccagtggg

SEQ ID NO: 23196 - DNA, 15 bp, Artificial Sequence
  dgRNA
  Acsbg2
gagaaaagtactccc

SEQ ID NO: 23197 - DNA, 15 bp, Artificial Sequence
  dgRNA
  Gspt1
ccgagaaaaccgcac

SEQ ID NO: 23198 - DNA, 15 bp, Artificial Sequence
  dgRNA
  Gspt1
cgagaaaaccgcacc

SEQ ID NO: 23199 - DNA, 15 bp, Artificial Sequence
  dgRNA
  Gspt1
cgcaccgggtcttcg

SEQ ID NO: 23200 - DNA, 15 bp, Artificial Sequence
  dgRNA
  Gspt1
gcaccgggtcttcgc

SEQ ID NO: 23201 - DNA, 15 bp, Artificial Sequence
  dgRNA
  Fgfr2
gactgccccagcgcg

SEQ ID NO: 23202 - DNA, 15 bp, Artificial Sequence
  dgRNA
  Fgfr2
gcgcgaggcgctgat

SEQ ID NO: 23203 - DNA, 15 bp, Artificial Sequence
  dgRNA
  Fgfr2
cgggcgccgccgtcc

SEQ ID NO: 23204 - DNA, 15 bp, Artificial Sequence
  dgRNA
  Fgfr2
ccgccgtccaggaaa

SEQ ID NO: 23205 - DNA, 15 bp, Artificial Sequence
  dgRNA
  Yrdc
aacccaccgccccgc

SEQ ID NO: 23206 - DNA, 15 bp, Artificial Sequence
  dgRNA
  Yrdc
gtgaccagcctgcgc

SEQ ID NO: 23207 - DNA, 15 bp, Artificial Sequence
  dgRNA
  Yrdc
tgaccagcctgcgcc

SEQ ID NO: 23208 - DNA, 15 bp, Artificial Sequence
  dgRNA
  Yrdc
cccccgcgccgcgcg

SEQ ID NO: 23209 - DNA, 15 bp, Artificial Sequence
  dgRNA
  Vwa8
gctcaactgtgctaa

SEQ ID NO: 23210 - DNA, 15 bp, Artificial Sequence
  dgRNA
  Vwa8
agctccgggcgtccc

SEQ ID NO: 23211 - DNA, 15 bp, Artificial Sequence
  dgRNA
  Vwa8
gctccgggcgtccct

SEQ ID NO: 23212 - DNA, 15 bp, Artificial Sequence
  dgRNA
  Vwa8
ctccgggcgtccctg

SEQ ID NO: 23213 - DNA, 15 bp, Artificial Sequence
  dgRNA
  Zfp799
aggctcacggattgt

SEQ ID NO: 23214 - DNA, 15 bp, Artificial Sequence
  dgRNA
  Zfp799
atcaaggagaacgtt

SEQ ID NO: 23215 - DNA, 15 bp, Artificial Sequence
  dgRNA
  Zfp799
aggagtttcggtctt

SEQ ID NO: 23216 - DNA, 15 bp, Artificial Sequence
  dgRNA
  Zfp799
aacgttctccttgat

SEQ ID NO: 23217 - DNA, 15 bp, Artificial Sequence
  dgRNA
  Ndufa11
aggcgtttttcttca

SEQ ID NO: 23218 - DNA, 15 bp, Artificial Sequence
  dgRNA
  Ndufa11
ctttcctgacgtcac

SEQ ID NO: 23219 - DNA, 15 bp, Artificial Sequence
  dgRNA
  Ndufa11
gtccagattcacttg

SEQ ID NO: 23220 - DNA, 15 bp, Artificial Sequence
  dgRNA
  Ndufa11
cacagatcttgctac

SEQ ID NO: 23221 - DNA, 15 bp, Artificial Sequence
  dgRNA
  Vps35
tccactatacaccgc

SEQ ID NO: 23222 - DNA, 15 bp, Artificial Sequence
  dgRNA
  Vps35
acgcgagattttaag

SEQ ID NO: 23223 - DNA, 15 bp, Artificial Sequence
  dgRNA
  Vps35
cgcgagattttaagt

SEQ ID NO: 23224 - DNA, 15 bp, Artificial Sequence
  dgRNA
  Vps35
agccgcttctatcca

SEQ ID NO: 23225 - DNA, 15 bp, Artificial Sequence
  dgRNA
  Cxcl12
cacccagcggagccg

SEQ ID NO: 23226 - DNA, 15 bp, Artificial Sequence
  dgRNA
  Cxcl12
gagccgcggacactg

SEQ ID NO: 23227 - DNA, 15 bp, Artificial Sequence
  dgRNA
  Cxcl12
agccgcggacactga

SEQ ID NO: 23228 - DNA, 15 bp, Artificial Sequence
  dgRNA
  Cxcl12
ctgagggcgccaaga

SEQ ID NO: 23229 - DNA, 15 bp, Artificial Sequence
  dgRNA
  4931406B18Rik
aatcaatctcttaac

SEQ ID NO: 23230 - DNA, 15 bp, Artificial Sequence
  dgRNA
  4931406B18Rik
tctcttaactggtag

SEQ ID NO: 23231 - DNA, 15 bp, Artificial Sequence
  dgRNA
  4931406B18Rik
aagggacccgctctg

SEQ ID NO: 23232 - DNA, 15 bp, Artificial Sequence
  dgRNA
  4931406B18Rik
ggacccgctctgagg

SEQ ID NO: 23233 - DNA, 15 bp, Artificial Sequence
  dgRNA
  Enkur
tttccagatgtaccg

SEQ ID NO: 23234 - DNA, 15 bp, Artificial Sequence
  dgRNA
  Enkur
aaatgtttgggtgcg

SEQ ID NO: 23235 - DNA, 15 bp, Artificial Sequence
  dgRNA
  Enkur
aatgtttgggtgcgg

SEQ ID NO: 23236 - DNA, 15 bp, Artificial Sequence
  dgRNA
  Enkur
cttttccaaagacgc

SEQ ID NO: 23237 - DNA, 15 bp, Artificial Sequence
  dgRNA
  Oprk1
aagcggcaagcagct

SEQ ID NO: 23238 - DNA, 15 bp, Artificial Sequence
  dgRNA
  Oprk1
agcggcaagcagctt

SEQ ID NO: 23239 - DNA, 15 bp, Artificial Sequence
  dgRNA
  Oprk1
agcggcagactggcc

SEQ ID NO: 23240 - DNA, 15 bp, Artificial Sequence
  dgRNA
  Oprk1
gcggcagactggcct

SEQ ID NO: 23241 - DNA, 15 bp, Artificial Sequence
  dgRNA
  Crxos
gacaaatggacggcc

SEQ ID NO: 23242 - DNA, 15 bp, Artificial Sequence
  dgRNA
  Crxos
acaaatggacggcca

SEQ ID NO: 23243 - DNA, 15 bp, Artificial Sequence
  dgRNA
  Crxos
aatggacggccaggg

SEQ ID NO: 23244 - DNA, 15 bp, Artificial Sequence
  dgRNA
  Crxos
ggcccctgacacact

SEQ ID NO: 23245 - DNA, 15 bp, Artificial Sequence
  dgRNA
  Pllp
gcagttgccactacc

SEQ ID NO: 23246 - DNA, 15 bp, Artificial Sequence
  dgRNA
  Pllp
ctgtagatcggtcta

SEQ ID NO: 23247 - DNA, 15 bp, Artificial Sequence
  dgRNA
  Pllp
caaacaggcgaaccc

SEQ ID NO: 23248 - DNA, 15 bp, Artificial Sequence
  dgRNA
  Pllp
aaacaggcgaaccca

SEQ ID NO: 23249 - DNA, 15 bp, Artificial Sequence
  dgRNA
  Nwd1
gccttgtttccgctg

SEQ ID NO: 23250 - DNA, 15 bp, Artificial Sequence
  dgRNA
  Nwd1
aaatgacgccctcca

SEQ ID NO: 23251 - DNA, 15 bp, Artificial Sequence
  dgRNA
  Nwd1
gggaagcgggcatct

SEQ ID NO: 23252 - DNA, 15 bp, Artificial Sequence
  dgRNA
  Nwd1
gttctcccagcaagt

SEQ ID NO: 23253 - DNA, 15 bp, Artificial Sequence
  dgRNA
  Grasp
ccctcccgctgccgt

SEQ ID NO: 23254 - DNA, 15 bp, Artificial Sequence
  dgRNA
  Grasp
gatggctgcgcactg

SEQ ID NO: 23255 - DNA, 15 bp, Artificial Sequence
  dgRNA
  Grasp
atggctgcgcactgt

SEQ ID NO: 23256 - DNA, 15 bp, Artificial Sequence
  dgRNA
  Grasp
tgcgcactgtgggcg

SEQ ID NO: 23257 - DNA, 15 bp, Artificial Sequence
  dgRNA
  Ubr1
cctgccccggggtta

SEQ ID NO: 23258 - DNA, 15 bp, Artificial Sequence
  dgRNA
  Ubr1
ctgccccggggttaa

SEQ ID NO: 23259 - DNA, 15 bp, Artificial Sequence
  dgRNA
  Ubr1
cccggggttaaggga

SEQ ID NO: 23260 - DNA, 15 bp, Artificial Sequence
  dgRNA
  Ubr1
ggcgacaaagctgtg

SEQ ID NO: 23261 - DNA, 15 bp, Artificial Sequence
  dgRNA
  Pacrg
cccacgtacctatca

SEQ ID NO: 23262 - DNA, 15 bp, Artificial Sequence
  dgRNA
  Pacrg
atcatggtcaccggg

SEQ ID NO: 23263 - DNA, 15 bp, Artificial Sequence
  dgRNA
  Pacrg
tcatggtcaccgggc

SEQ ID NO: 23264 - DNA, 15 bp, Artificial Sequence
  dgRNA
  Pacrg
tggtcaccgggcggg

SEQ ID NO: 23265 - DNA, 15 bp, Artificial Sequence
  dgRNA
  Bad
acgcagcaagcacct

SEQ ID NO: 23266 - DNA, 15 bp, Artificial Sequence
  dgRNA
  Bad
gggctaccagtgcca

SEQ ID NO: 23267 - DNA, 15 bp, Artificial Sequence
  dgRNA
  Bad
ccagctcttaatgtt

SEQ ID NO: 23268 - DNA, 15 bp, Artificial Sequence
  dgRNA
  Bad
aatccacatcgcgtt

SEQ ID NO: 23269 - DNA, 15 bp, Artificial Sequence
  dgRNA
  Slc9a1
ccttccctgggcgac

SEQ ID NO: 23270 - DNA, 15 bp, Artificial Sequence
  dgRNA
  Slc9a1
cttccctgggcgaca

SEQ ID NO: 23271 - DNA, 15 bp, Artificial Sequence
  dgRNA
  Slc9a1
ttccctgggcgacag

SEQ ID NO: 23272 - DNA, 15 bp, Artificial Sequence
  dgRNA
  Slc9a1
ggccgctgcaccgcg

SEQ ID NO: 23273 - DNA, 15 bp, Artificial Sequence
  dgRNA
  Olfr959
ggaatactatctgtg

SEQ ID NO: 23274 - DNA, 15 bp, Artificial Sequence
  dgRNA
  Olfr959
agtgtgattactatg

SEQ ID NO: 23275 - DNA, 15 bp, Artificial Sequence
  dgRNA
  Olfr959
gagtgtgattactat

SEQ ID NO: 23276 - DNA, 15 bp, Artificial Sequence
  dgRNA
  Olfr959
tgagtgtgattacta

SEQ ID NO: 23277 - DNA, 15 bp, Artificial Sequence
  dgRNA
  Phf23
agactacaaatccct

SEQ ID NO: 23278 - DNA, 15 bp, Artificial Sequence
  dgRNA
  Phf23
actgcgcgatagtgc

SEQ ID NO: 23279 - DNA, 15 bp, Artificial Sequence
  dgRNA
  Phf23
gcgcgatagtgccgg

SEQ ID NO: 23280 - DNA, 15 bp, Artificial Sequence
  dgRNA
  Phf23
cgcgatagtgccggc

SEQ ID NO: 23281 - DNA, 15 bp, Artificial Sequence
  dgRNA
  Crot
aagcccctaagagtt

SEQ ID NO: 23282 - DNA, 15 bp, Artificial Sequence
  dgRNA
  Crot
agttcggcgaaaagc

SEQ ID NO: 23283 - DNA, 15 bp, Artificial Sequence
  dgRNA
  Crot
agcaggctgagccgt

SEQ ID NO: 23284 - DNA, 15 bp, Artificial Sequence
  dgRNA
  Crot
tccttacgcagccac

SEQ ID NO: 23285 - DNA, 15 bp, Artificial Sequence
  dgRNA
  Krt71
gggagggccgatctc

SEQ ID NO: 23286 - DNA, 15 bp, Artificial Sequence
  dgRNA
  Krt71
tataaaggcacctgc

SEQ ID NO: 23287 - DNA, 15 bp, Artificial Sequence
  dgRNA
  Krt71
aactgttaaattgct

SEQ ID NO: 23288 - DNA, 15 bp, Artificial Sequence
  dgRNA
  Krt71
aaactgttaaattgc

SEQ ID NO: 23289 - DNA, 15 bp, Artificial Sequence
  dgRNA
  Olfr1280
atattgtgtctcatc

SEQ ID NO: 23290 - DNA, 15 bp, Artificial Sequence
  dgRNA
  Olfr1280
catcttagtattata

SEQ ID NO: 23291 - DNA, 15 bp, Artificial Sequence
  dgRNA
  Gnai3
agccggagaagtaaa

SEQ ID NO: 23292 - DNA, 15 bp, Artificial Sequence
  dgRNA
  Gnai3
gccggagaagtaaaa

SEQ ID NO: 23293 - DNA, 15 bp, Artificial Sequence
  dgRNA
  Gnai3
aaagggtattaaggc

SEQ ID NO: 23294 - DNA, 15 bp, Artificial Sequence
  dgRNA
  Gnai3
ggaggtgcggagcga

SEQ ID NO: 23295 - DNA, 15 bp, Artificial Sequence
  dgRNA
  Fam83e
atgtggggcaaggcg

SEQ ID NO: 23296 - DNA, 15 bp, Artificial Sequence
  dgRNA
  Fam83e
tgtggggcaaggcgt

SEQ ID NO: 23297 - DNA, 15 bp, Artificial Sequence
  dgRNA
  Fam83e
gcaaggcgtgggaac

SEQ ID NO: 23298 - DNA, 15 bp, Artificial Sequence
  dgRNA
  Fam83e
acaattgctccccgt

SEQ ID NO: 23299 - DNA, 15 bp, Artificial Sequence
  dgRNA
  Urm1
tagacgtctttcttc

SEQ ID NO: 23300 - DNA, 15 bp, Artificial Sequence
  dgRNA
  Urm1
ccgcagcccactgag

SEQ ID NO: 23301 - DNA, 15 bp, Artificial Sequence
  dgRNA
  Urm1
cgcagcccactgagc

SEQ ID NO: 23302 - DNA, 15 bp, Artificial Sequence
  dgRNA
  Urm1
ctgagcagtaacgaa

SEQ ID NO: 23303 - DNA, 15 bp, Artificial Sequence
  dgRNA
  Zfp790
gcactgcgagtttcc

SEQ ID NO: 23304 - DNA, 15 bp, Artificial Sequence
  dgRNA
  Zfp790
cactgcgagtttcca

SEQ ID NO: 23305 - DNA, 15 bp, Artificial Sequence
  dgRNA
  Zfp790
ggaaccgaggtattc

SEQ ID NO: 23306 - DNA, 15 bp, Artificial Sequence
  dgRNA
  Zfp790
gaaccgaggtattct

SEQ ID NO: 23307 - DNA, 15 bp, Artificial Sequence
  dgRNA
  Serpinb9g
tagcttcatgaggct

SEQ ID NO: 23308 - DNA, 15 bp, Artificial Sequence
  dgRNA
  Serpinb9g
acgtcctcaccatgc

SEQ ID NO: 23309 - DNA, 15 bp, Artificial Sequence
  dgRNA
  Serpinb9g
cgtcctcaccatgca

SEQ ID NO: 23310 - DNA, 15 bp, Artificial Sequence
  dgRNA
  Serpinb9g
aggacgtcatgctta

SEQ ID NO: 23311 - DNA, 15 bp, Artificial Sequence
  dgRNA
  4932411N23Rik
tgaacattgatatag

SEQ ID NO: 23312 - DNA, 15 bp, Artificial Sequence
  dgRNA
  4932411N23Rik
ttgatattcaattaa

SEQ ID NO: 23313 - DNA, 15 bp, Artificial Sequence
  dgRNA
  Oxsr1
cgcttgcctcttgtc

SEQ ID NO: 23314 - DNA, 15 bp, Artificial Sequence
  dgRNA
  Oxsr1
cggccacactcaaga

SEQ ID NO: 23315 - DNA, 15 bp, Artificial Sequence
  dgRNA
  Oxsr1
actcaagatggcggc

SEQ ID NO: 23316 - DNA, 15 bp, Artificial Sequence
  dgRNA
  Oxsr1
tcaagatggcggccg

SEQ ID NO: 23317 - DNA, 15 bp, Artificial Sequence
  dgRNA
  Golga4
ccatattgtccgccg

SEQ ID NO: 23318 - DNA, 15 bp, Artificial Sequence
  dgRNA
  Golga4
tccgtagcaagcccc

SEQ ID NO: 23319 - DNA, 15 bp, Artificial Sequence
  dgRNA
  Golga4
ccacgtcgaccgcgc

SEQ ID NO: 23320 - DNA, 15 bp, Artificial Sequence
  dgRNA
  Golga4
gaccgcgcaggcgcc

SEQ ID NO: 23321 - DNA, 15 bp, Artificial Sequence
  dgRNA
  Nphs2
caatttggttaggtg

SEQ ID NO: 23322 - DNA, 15 bp, Artificial Sequence
  dgRNA
  Nphs2
aatttggttaggtgt

SEQ ID NO: 23323 - DNA, 15 bp, Artificial Sequence
  dgRNA
  Nphs2
acagcaaggtcctta

SEQ ID NO: 23324 - DNA, 15 bp, Artificial Sequence
  dgRNA
  Nphs2
ggggtcgctccccat

SEQ ID NO: 23325 - DNA, 15 bp, Artificial Sequence
  dgRNA
  Sh3gl3
cgcaacaatgaagcg

SEQ ID NO: 23326 - DNA, 15 bp, Artificial Sequence
  dgRNA
  Sh3gl3
gcaacaatgaagcgt

SEQ ID NO: 23327 - DNA, 15 bp, Artificial Sequence
  dgRNA
  Sh3gl3
acaatgaagcgtggg

SEQ ID NO: 23328 - DNA, 15 bp, Artificial Sequence
  dgRNA
  Sh3gl3
atttgcatgctgccg

SEQ ID NO: 23329 - DNA, 15 bp, Artificial Sequence
  dgRNA
  Erbb2ip
agttttttccttcgg

SEQ ID NO: 23330 - DNA, 15 bp, Artificial Sequence
  dgRNA
  Erbb2ip
ggcggagaagcgagc

SEQ ID NO: 23331 - DNA, 15 bp, Artificial Sequence
  dgRNA
  Erbb2ip
gcggagaagcgagcc

SEQ ID NO: 23332 - DNA, 15 bp, Artificial Sequence
  dgRNA
  Erbb2ip
cggagaagcgagccg

SEQ ID NO: 23333 - DNA, 15 bp, Artificial Sequence
  dgRNA
  Atp2b1
ctgcggacgccggcg

SEQ ID NO: 23334 - DNA, 15 bp, Artificial Sequence
  dgRNA
  Atp2b1
tgcggacgccggcgc

SEQ ID NO: 23335 - DNA, 15 bp, Artificial Sequence
  dgRNA
  Atp2b1
acgccggcgcggggc

SEQ ID NO: 23336 - DNA, 15 bp, Artificial Sequence
  dgRNA
  Atp2b1
ctgctgtgccgagcg

SEQ ID NO: 23337 - DNA, 15 bp, Artificial Sequence
  dgRNA
  Zmym6
cgactggcgtctcat

SEQ ID NO: 23338 - DNA, 15 bp, Artificial Sequence
  dgRNA
  Zmym6
ctggcgtctcattgg

SEQ ID NO: 23339 - DNA, 15 bp, Artificial Sequence
  dgRNA
  Zmym6
gcgtctcattggagg

SEQ ID NO: 23340 - DNA, 15 bp, Artificial Sequence
  dgRNA
  Zmym6
cgtctcattggaggc

SEQ ID NO: 23341 - DNA, 15 bp, Artificial Sequence
  dgRNA
  Oxa1l
cgatggtatttgaag

SEQ ID NO: 23342 - DNA, 15 bp, Artificial Sequence
  dgRNA
  Oxa1l
ctgacgtcacagatc

SEQ ID NO: 23343 - DNA, 15 bp, Artificial Sequence
  dgRNA
  Oxa1l
cgggggaggccattt

SEQ ID NO: 23344 - DNA, 15 bp, Artificial Sequence
  dgRNA
  Oxa1l
ttgacgctgcggggg

SEQ ID NO: 23345 - DNA, 15 bp, Artificial Sequence
  dgRNA
  Lrrc27
tagggtctatggact

SEQ ID NO: 23346 - DNA, 15 bp, Artificial Sequence
  dgRNA
  Lrrc27
aacccggcaccagcc

SEQ ID NO: 23347 - DNA, 15 bp, Artificial Sequence
  dgRNA
  Lrrc27
gagagcgcagcactg

SEQ ID NO: 23348 - DNA, 15 bp, Artificial Sequence
  dgRNA
  Lrrc27
cctagtgtggaaact

SEQ ID NO: 23349 - DNA, 15 bp, Artificial Sequence
  dgRNA
  Olfr1049
tagtcacagttagat

SEQ ID NO: 23350 - DNA, 15 bp, Artificial Sequence
  dgRNA
  Brox
gacggagagaaccga

SEQ ID NO: 23351 - DNA, 15 bp, Artificial Sequence
  dgRNA
  Brox
acggagagaaccgac

SEQ ID NO: 23352 - DNA, 15 bp, Artificial Sequence
  dgRNA
  Brox
cggagagaaccgacg

SEQ ID NO: 23353 - DNA, 15 bp, Artificial Sequence
  dgRNA
  Brox
acggggccgcgacag

SEQ ID NO: 23354 - DNA, 15 bp, Artificial Sequence
  dgRNA
  Atp2b2
cctatctaacaaagt

SEQ ID NO: 23355 - DNA, 15 bp, Artificial Sequence
  dgRNA
  Atp2b2
cccccttgctcgtcc

SEQ ID NO: 23356 - DNA, 15 bp, Artificial Sequence
  dgRNA
  Atp2b2
ttgctcgtcctgggc

SEQ ID NO: 23357 - DNA, 15 bp, Artificial Sequence
  dgRNA
  Atp2b2
tgctcgtcctgggct

SEQ ID NO: 23358 - DNA, 15 bp, Artificial Sequence
  dgRNA
  Aktip
gggcgctgttacgta

SEQ ID NO: 23359 - DNA, 15 bp, Artificial Sequence
  dgRNA
  Aktip
ggcgctgttacgtaa

SEQ ID NO: 23360 - DNA, 15 bp, Artificial Sequence
  dgRNA
  Aktip
gcgctgttacgtaag

SEQ ID NO: 23361 - DNA, 15 bp, Artificial Sequence
  dgRNA
  Aktip
cgctgttacgtaagg

SEQ ID NO: 23362 - DNA, 15 bp, Artificial Sequence
  dgRNA
  Cnga3
accggacttagccac

SEQ ID NO: 23363 - DNA, 15 bp, Artificial Sequence
  dgRNA
  Cnga3
ccggacttagccaca

SEQ ID NO: 23364 - DNA, 15 bp, Artificial Sequence
  dgRNA
  Cnga3
cttagtggctagggt

SEQ ID NO: 23365 - DNA, 15 bp, Artificial Sequence
  dgRNA
  Cnga3
gattttaagggatca

SEQ ID NO: 23366 - DNA, 15 bp, Artificial Sequence
  dgRNA
  Tfeb
actcctagggaacag

SEQ ID NO: 23367 - DNA, 15 bp, Artificial Sequence
  dgRNA
  Tfeb
cagcggccagtagaa

SEQ ID NO: 23368 - DNA, 15 bp, Artificial Sequence
  dgRNA
  Tfeb
ccggcgagcccttcg

SEQ ID NO: 23369 - DNA, 15 bp, Artificial Sequence
  dgRNA
  Tfeb
ccttcgcggctgcga

SEQ ID NO: 23370 - DNA, 15 bp, Artificial Sequence
  dgRNA
  Zak
gtgcattcagtctca

SEQ ID NO: 23371 - DNA, 15 bp, Artificial Sequence
  dgRNA
  Zak
cattcagtctcacgg

SEQ ID NO: 23372 - DNA, 15 bp, Artificial Sequence
  dgRNA
  Zak
attcagtctcacggg

SEQ ID NO: 23373 - DNA, 15 bp, Artificial Sequence
  dgRNA
  Zak
gtctcacggggggta

SEQ ID NO: 23374 - DNA, 15 bp, Artificial Sequence
  dgRNA
  Sele
agctcccctataaag

SEQ ID NO: 23375 - DNA, 15 bp, Artificial Sequence
  dgRNA
  Sele
caaaatctggctaag

SEQ ID NO: 23376 - DNA, 15 bp, Artificial Sequence
  dgRNA
  Sele
tctttataggggagc

SEQ ID NO: 23377 - DNA, 15 bp, Artificial Sequence
  dgRNA
  Sele
tggagcctctttata

SEQ ID NO: 23378 - DNA, 15 bp, Artificial Sequence
  dgRNA
  Skiv2l2
ctgccggactcgcag

SEQ ID NO: 23379 - DNA, 15 bp, Artificial Sequence
  dgRNA
  Skiv2l2
cggactcgcagtggt

SEQ ID NO: 23380 - DNA, 15 bp, Artificial Sequence
  dgRNA
  Skiv2l2
ggagaaaagtcacgc

SEQ ID NO: 23381 - DNA, 15 bp, Artificial Sequence
  dgRNA
  Skiv2l2
gagaaaagtcacgcg

SEQ ID NO: 23382 - DNA, 15 bp, Artificial Sequence
  dgRNA
  Lnp
aaccgccctaccctg

SEQ ID NO: 23383 - DNA, 15 bp, Artificial Sequence
  dgRNA
  Lnp
cagcctacactagcg

SEQ ID NO: 23384 - DNA, 15 bp, Artificial Sequence
  dgRNA
  Lnp
cctacactagcgcgg

SEQ ID NO: 23385 - DNA, 15 bp, Artificial Sequence
  dgRNA
  Lnp
acacccgccgctctg

SEQ ID NO: 23386 - DNA, 15 bp, Artificial Sequence
  dgRNA
  Stk32a
cgacgcacagtcccc

SEQ ID NO: 23387 - DNA, 15 bp, Artificial Sequence
  dgRNA
  Stk32a
cagtcccctggcgac

SEQ ID NO: 23388 - DNA, 15 bp, Artificial Sequence
  dgRNA
  Stk32a
tctaatccaggcgac

SEQ ID NO: 23389 - DNA, 15 bp, Artificial Sequence
  dgRNA
  Stk32a
actggcaattcgctc

SEQ ID NO: 23390 - DNA, 15 bp, Artificial Sequence
  dgRNA
  Ccny
agcggagaagcgcac

SEQ ID NO: 23391 - DNA, 15 bp, Artificial Sequence
  dgRNA
  Ccny
gatcagacagcgtgc

SEQ ID NO: 23392 - DNA, 15 bp, Artificial Sequence
  dgRNA
  Ccny
gcgtgcttccagagc

SEQ ID NO: 23393 - DNA, 15 bp, Artificial Sequence
  dgRNA
  Ccny
ccgggctgcgtgtag

SEQ ID NO: 23394 - DNA, 15 bp, Artificial Sequence
  dgRNA
  Myl9
agaaaggctgcgtcg

SEQ ID NO: 23395 - DNA, 15 bp, Artificial Sequence
  dgRNA
  Myl9
gaaaggctgcgtcga

SEQ ID NO: 23396 - DNA, 15 bp, Artificial Sequence
  dgRNA
  Myl9
aaaggctgcgtcgag

SEQ ID NO: 23397 - DNA, 15 bp, Artificial Sequence
  dgRNA
  Myl9
aaggctgcgtcgagg

SEQ ID NO: 23398 - DNA, 15 bp, Artificial Sequence
  dgRNA
  C1rb
cgccatcaagcaacg

SEQ ID NO: 23399 - DNA, 15 bp, Artificial Sequence
  dgRNA
  C1rb
gaccaaacctaaact

SEQ ID NO: 23400 - DNA, 15 bp, Artificial Sequence
  dgRNA
  C1rb
gggagactttcccgg

SEQ ID NO: 23401 - DNA, 15 bp, Artificial Sequence
  dgRNA
  C1rb
atctggtggtcaatg

SEQ ID NO: 23402 - DNA, 15 bp, Artificial Sequence
  dgRNA
  Slc35f6
tctcctaccaaagac

SEQ ID NO: 23403 - DNA, 15 bp, Artificial Sequence
  dgRNA
  Slc35f6
cctaccaaagaccgg

SEQ ID NO: 23404 - DNA, 15 bp, Artificial Sequence
  dgRNA
  Slc35f6
gaccggtggcagctc

SEQ ID NO: 23405 - DNA, 15 bp, Artificial Sequence
  dgRNA
  Slc35f6
accggtggcagctcc

SEQ ID NO: 23406 - DNA, 15 bp, Artificial Sequence
  dgRNA
  Apool
ggagactattcttag

SEQ ID NO: 23407 - DNA, 15 bp, Artificial Sequence
  dgRNA
  Apool
gaggttagatgtatg

SEQ ID NO: 23408 - DNA, 15 bp, Artificial Sequence
  dgRNA
  Apool
tagatgtatgaggac

SEQ ID NO: 23409 - DNA, 15 bp, Artificial Sequence
  dgRNA
  Apool
gtcaaccgcaaagat

SEQ ID NO: 23410 - DNA, 15 bp, Artificial Sequence
  dgRNA
  Glmp
taggtggggccggta

SEQ ID NO: 23411 - DNA, 15 bp, Artificial Sequence
  dgRNA
  Glmp
tagtctaggatgcct

SEQ ID NO: 23412 - DNA, 15 bp, Artificial Sequence
  dgRNA
  Glmp
caacttaaacagatc

SEQ ID NO: 23413 - DNA, 15 bp, Artificial Sequence
  dgRNA
  Glmp
tggcccgccctcaaa

SEQ ID NO: 23414 - DNA, 15 bp, Artificial Sequence
  dgRNA
  Cdk5rap2
ctcacccacgaaaca

SEQ ID NO: 23415 - DNA, 15 bp, Artificial Sequence
  dgRNA
  Cdk5rap2
cctagtgttgcacgc

SEQ ID NO: 23416 - DNA, 15 bp, Artificial Sequence
  dgRNA
  Cdk5rap2
cacgctggagtgcgc

SEQ ID NO: 23417 - DNA, 15 bp, Artificial Sequence
  dgRNA
  Cdk5rap2
gttaagatggcgtcc

SEQ ID NO: 23418 - DNA, 15 bp, Artificial Sequence
  dgRNA
  Tfdp2
tttaagactaactgt

SEQ ID NO: 23419 - DNA, 15 bp, Artificial Sequence
  dgRNA
  Tfdp2
gcctgtcattcactt

SEQ ID NO: 23420 - DNA, 15 bp, Artificial Sequence
  dgRNA
  Tfdp2
tttggcgttgaagca

SEQ ID NO: 23421 - DNA, 15 bp, Artificial Sequence
  dgRNA
  Tfdp2
agcatggcctatctc

SEQ ID NO: 23422 - DNA, 15 bp, Artificial Sequence
  dgRNA
  2310022A10Rik
cgcccacctgtgcgc

SEQ ID NO: 23423 - DNA, 15 bp, Artificial Sequence
  dgRNA
  2310022A10Rik
agtcgcgctagactg

SEQ ID NO: 23424 - DNA, 15 bp, Artificial Sequence
  dgRNA
  2310022A10Rik
gtcgcgctagactgc

SEQ ID NO: 23425 - DNA, 15 bp, Artificial Sequence
  dgRNA
  2310022A10Rik
cgctagactgcgggc

SEQ ID NO: 23426 - DNA, 15 bp, Artificial Sequence
  dgRNA
  Cbfb
agtggcggccgcagc

SEQ ID NO: 23427 - DNA, 15 bp, Artificial Sequence
  dgRNA
  Cbfb
gtggcggccgcagcc

SEQ ID NO: 23428 - DNA, 15 bp, Artificial Sequence
  dgRNA
  Cbfb
ggccgcagccggggg

SEQ ID NO: 23429 - DNA, 15 bp, Artificial Sequence
  dgRNA
  Cbfb
agcctcccccggctg

SEQ ID NO: 23430 - DNA, 15 bp, Artificial Sequence
  dgRNA
  Sox2
gccagatctccgcgc

SEQ ID NO: 23431 - DNA, 15 bp, Artificial Sequence
  dgRNA
  Sox2
ccagatctccgcgca

SEQ ID NO: 23432 - DNA, 15 bp, Artificial Sequence
  dgRNA
  Sox2
gggccgtgcacgccg

SEQ ID NO: 23433 - DNA, 15 bp, Artificial Sequence
  dgRNA
  Sox2
cgaggcccccgcccg

SEQ ID NO: 23434 - DNA, 15 bp, Artificial Sequence
  dgRNA
  Neu2
gggtgtttaccttgc

SEQ ID NO: 23435 - DNA, 15 bp, Artificial Sequence
  dgRNA
  Neu2
gggtgccctgcacct

SEQ ID NO: 23436 - DNA, 15 bp, Artificial Sequence
  dgRNA
  Neu2
gtgccactgaggtgc

SEQ ID NO: 23437 - DNA, 15 bp, Artificial Sequence
  dgRNA
  Neu2
atagtactcagggac

SEQ ID NO: 23438 - DNA, 15 bp, Artificial Sequence
  dgRNA
  Cttn
gtatggctagatgag

SEQ ID NO: 23439 - DNA, 15 bp, Artificial Sequence
  dgRNA
  Cttn
gggtagaagattgac

SEQ ID NO: 23440 - DNA, 15 bp, Artificial Sequence
  dgRNA
  Cttn
ggtagaagattgaca

SEQ ID NO: 23441 - DNA, 15 bp, Artificial Sequence
  dgRNA
  Cttn
gtagaagattgacag

SEQ ID NO: 23442 - DNA, 15 bp, Artificial Sequence
  dgRNA
  Chst2
tcgtgccccagagcc

SEQ ID NO: 23443 - DNA, 15 bp, Artificial Sequence
  dgRNA
  Chst2
gtcccgagagaccta

SEQ ID NO: 23444 - DNA, 15 bp, Artificial Sequence
  dgRNA
  Chst2
ctaaggagacgtcgc

SEQ ID NO: 23445 - DNA, 15 bp, Artificial Sequence
  dgRNA
  Chst2
agacgtcgctggagc

SEQ ID NO: 23446 - DNA, 15 bp, Artificial Sequence
  dgRNA
  Kcns1
ccgtcccatccttcc

SEQ ID NO: 23447 - DNA, 15 bp, Artificial Sequence
  dgRNA
  Kcns1
agaaaccaccgcctc

SEQ ID NO: 23448 - DNA, 15 bp, Artificial Sequence
  dgRNA
  Kcns1
gcctccggccgcccg

SEQ ID NO: 23449 - DNA, 15 bp, Artificial Sequence
  dgRNA
  Kcns1
cggcagcgatcgatg

SEQ ID NO: 23450 - DNA, 15 bp, Artificial Sequence
  dgRNA
  H2-M9
ctgagctggcgattc

SEQ ID NO: 23451 - DNA, 15 bp, Artificial Sequence
  dgRNA
  H2-M9
gcgattcaggaccct

SEQ ID NO: 23452 - DNA, 15 bp, Artificial Sequence
  dgRNA
  H2-M9
cgattcaggacccta

SEQ ID NO: 23453 - DNA, 15 bp, Artificial Sequence
  dgRNA
  H2-M9
gtttatcactaccat

SEQ ID NO: 23454 - DNA, 15 bp, Artificial Sequence
  dgRNA
  Rps19
tattcgccctcagaa

SEQ ID NO: 23455 - DNA, 15 bp, Artificial Sequence
  dgRNA
  Rps19
tcgccctcagaaagg

SEQ ID NO: 23456 - DNA, 15 bp, Artificial Sequence
  dgRNA
  Rps19
aaaggcggagccctc

SEQ ID NO: 23457 - DNA, 15 bp, Artificial Sequence
  dgRNA
  Rps19
cccgacttgtgcgcc

SEQ ID NO: 23458 - DNA, 15 bp, Artificial Sequence
  dgRNA
  Ap3s1
cgcagcgagttatga

SEQ ID NO: 23459 - DNA, 15 bp, Artificial Sequence
  dgRNA
  Ap3s1
gcagcgagttatgaa

SEQ ID NO: 23460 - DNA, 15 bp, Artificial Sequence
  dgRNA
  Ap3s1
gaccacgtacccctc

SEQ ID NO: 23461 - DNA, 15 bp, Artificial Sequence
  dgRNA
  Ap3s1
acccctccggagagt

SEQ ID NO: 23462 - DNA, 15 bp, Artificial Sequence
  dgRNA
  Rims4
gagcacctcgcgtct

SEQ ID NO: 23463 - DNA, 15 bp, Artificial Sequence
  dgRNA
  Rims4
agcacctcgcgtctc

SEQ ID NO: 23464 - DNA, 15 bp, Artificial Sequence
  dgRNA
  Rims4
cgcgccgccagtgtc

SEQ ID NO: 23465 - DNA, 15 bp, Artificial Sequence
  dgRNA
  Rims4
ccggccctctgcgcc

SEQ ID NO: 23466 - DNA, 15 bp, Artificial Sequence
  dgRNA
  Srsf9
acctaccagcttagg

SEQ ID NO: 23467 - DNA, 15 bp, Artificial Sequence
  dgRNA
  Srsf9
agcttaggaggcgct

SEQ ID NO: 23468 - DNA, 15 bp, Artificial Sequence
  dgRNA
  Srsf9
gcttaggaggcgctc

SEQ ID NO: 23469 - DNA, 15 bp, Artificial Sequence
  dgRNA
  Srsf9
ctcgggtcccacctc

SEQ ID NO: 23470 - DNA, 15 bp, Artificial Sequence
  dgRNA
  Efhc2
ccatgacgctatctc

SEQ ID NO: 23471 - DNA, 15 bp, Artificial Sequence
  dgRNA
  Efhc2
ctgaccgcccacctg

SEQ ID NO: 23472 - DNA, 15 bp, Artificial Sequence
  dgRNA
  Efhc2
ggggtcgagtccgca

SEQ ID NO: 23473 - DNA, 15 bp, Artificial Sequence
  dgRNA
  Efhc2
cggggtcgagtccgc

SEQ ID NO: 23474 - DNA, 15 bp, Artificial Sequence
  dgRNA
  4933417A18Rik
tctgaattatttggc

SEQ ID NO: 23475 - DNA, 15 bp, Artificial Sequence
  dgRNA
  4933417A18Rik
gcaggataccttcca

SEQ ID NO: 23476 - DNA, 15 bp, Artificial Sequence
  dgRNA
  4933417A18Rik
tccaggccaatacct

SEQ ID NO: 23477 - DNA, 15 bp, Artificial Sequence
  dgRNA
  Olfr666
gtcaatatactgtaa

SEQ ID NO: 23478 - DNA, 15 bp, Artificial Sequence
  dgRNA
  Olfr666
tgactggcacgatga

SEQ ID NO: 23479 - DNA, 15 bp, Artificial Sequence
  dgRNA
  Olfr666
atgactggcacgatg

SEQ ID NO: 23480 - DNA, 15 bp, Artificial Sequence
  dgRNA
  Cxcr5
aagagatgagtcgag

SEQ ID NO: 23481 - DNA, 15 bp, Artificial Sequence
  dgRNA
  Cxcr5
ccaggagaccgcaca

SEQ ID NO: 23482 - DNA, 15 bp, Artificial Sequence
  dgRNA
  Cxcr5
atgtgcggtctcctg

SEQ ID NO: 23483 - DNA, 15 bp, Artificial Sequence
  dgRNA
  Cxcr5
catgtgcggtctcct

SEQ ID NO: 23484 - DNA, 15 bp, Artificial Sequence
  dgRNA
  Emc1
cgtgtgcctgaactg

SEQ ID NO: 23485 - DNA, 15 bp, Artificial Sequence
  dgRNA
  Emc1
cgcccagtgtcctga

SEQ ID NO: 23486 - DNA, 15 bp, Artificial Sequence
  dgRNA
  Emc1
aagtccctcgcgaac

SEQ ID NO: 23487 - DNA, 15 bp, Artificial Sequence
  dgRNA
  Emc1
accggttcctctcta

SEQ ID NO: 23488 - DNA, 15 bp, Artificial Sequence
  dgRNA
  Dynlt1b
acaagccctgttact

SEQ ID NO: 23489 - DNA, 15 bp, Artificial Sequence
  dgRNA
  Dynlt1b
gccctagagcgtagg

SEQ ID NO: 23490 - DNA, 15 bp, Artificial Sequence
  dgRNA
  Dynlt1b
accacctacgctcta

SEQ ID NO: 23491 - DNA, 15 bp, Artificial Sequence
  dgRNA
  Dynlt1b
aaccacctacgctct

SEQ ID NO: 23492 - DNA, 15 bp, Artificial Sequence
  dgRNA
  Bricd5
agtttgattcatcaa

SEQ ID NO: 23493 - DNA, 15 bp, Artificial Sequence
  dgRNA
  Eif4e2
cgagccgctcgctcc

SEQ ID NO: 23494 - DNA, 15 bp, Artificial Sequence
  dgRNA
  Eif4e2
gagccgctcgctccc

SEQ ID NO: 23495 - DNA, 15 bp, Artificial Sequence
  dgRNA
  Eif4e2
gccttcctgcgcccg

SEQ ID NO: 23496 - DNA, 15 bp, Artificial Sequence
  dgRNA
  Eif4e2
ccttcctgcgcccgc

SEQ ID NO: 23497 - DNA, 15 bp, Artificial Sequence
  dgRNA
  Zfp946
gggccggaacctccc

SEQ ID NO: 23498 - DNA, 15 bp, Artificial Sequence
  dgRNA
  Zfp946
gccggaacctccctg

SEQ ID NO: 23499 - DNA, 15 bp, Artificial Sequence
  dgRNA
  Zfp946
acctccctggggcgt

SEQ ID NO: 23500 - DNA, 15 bp, Artificial Sequence
  dgRNA
  Zfp946
ggcgtgggtacttgt

SEQ ID NO: 23501 - DNA, 15 bp, Artificial Sequence
  dgRNA
  Nefl
catagaaaagcggcc

SEQ ID NO: 23502 - DNA, 15 bp, Artificial Sequence
  dgRNA
  Nefl
gaaaagcggccaggc

SEQ ID NO: 23503 - DNA, 15 bp, Artificial Sequence
  dgRNA
  Nefl
acgcgctgcccccac

SEQ ID NO: 23504 - DNA, 15 bp, Artificial Sequence
  dgRNA
  Nefl
ccactggcctgcgca

SEQ ID NO: 23505 - DNA, 15 bp, Artificial Sequence
  dgRNA
  A630073D07Rik
tcattgttacactac

SEQ ID NO: 23506 - DNA, 15 bp, Artificial Sequence
  dgRNA
  A630073D07Rik
ttggcaacagttaga

SEQ ID NO: 23507 - DNA, 15 bp, Artificial Sequence
  dgRNA
  A630073D07Rik
tagagagcgtaactt

SEQ ID NO: 23508 - DNA, 15 bp, Artificial Sequence
  dgRNA
  A630073D07Rik
cagctcaacaggata

SEQ ID NO: 23509 - DNA, 15 bp, Artificial Sequence
  dgRNA
  Prdm12
tgtgaatctccggtt

SEQ ID NO: 23510 - DNA, 15 bp, Artificial Sequence
  dgRNA
  Prdm12
acaagggtggatacc

SEQ ID NO: 23511 - DNA, 15 bp, Artificial Sequence
  dgRNA
  Prdm12
cgcgggtggagacaa

SEQ ID NO: 23512 - DNA, 15 bp, Artificial Sequence
  dgRNA
  Prdm12
ccgcgggtggagaca

SEQ ID NO: 23513 - DNA, 15 bp, Artificial Sequence
  dgRNA
  Cst12
tatgccaccaaggtc

SEQ ID NO: 23514 - DNA, 15 bp, Artificial Sequence
  dgRNA
  Cst12
gccctagtcaaaatg

SEQ ID NO: 23515 - DNA, 15 bp, Artificial Sequence
  dgRNA
  Cst12
ggctcttaacactcc

SEQ ID NO: 23516 - DNA, 15 bp, Artificial Sequence
  dgRNA
  Cst12
gcctcattttgacta

SEQ ID NO: 23517 - DNA, 15 bp, Artificial Sequence
  dgRNA
  Mpp4
tattaagggcttgta

SEQ ID NO: 23518 - DNA, 15 bp, Artificial Sequence
  dgRNA
  Mpp4
attaagggcttgtat

SEQ ID NO: 23519 - DNA, 15 bp, Artificial Sequence
  dgRNA
  Mpp4
ctagggctgctgcgg

SEQ ID NO: 23520 - DNA, 15 bp, Artificial Sequence
  dgRNA
  Mpp4
gcggaggcttagaag

SEQ ID NO: 23521 - DNA, 15 bp, Artificial Sequence
  dgRNA
  Zfp882
tgatccaatcaagac

SEQ ID NO: 23522 - DNA, 15 bp, Artificial Sequence
  dgRNA
  Zfp882
gatccaatcaagact

SEQ ID NO: 23523 - DNA, 15 bp, Artificial Sequence
  dgRNA
  Zfp882
cccagtatcagagtc

SEQ ID NO: 23524 - DNA, 15 bp, Artificial Sequence
  dgRNA
  Zfp882
tcagagtcaggtcgc

SEQ ID NO: 23525 - DNA, 15 bp, Artificial Sequence
  dgRNA
  Afap1l2
gctgattgtcctgac

SEQ ID NO: 23526 - DNA, 15 bp, Artificial Sequence
  dgRNA
  Afap1l2
tgtcctgaccggctg

SEQ ID NO: 23527 - DNA, 15 bp, Artificial Sequence
  dgRNA
  Afap1l2
gtggagatccctggc

SEQ ID NO: 23528 - DNA, 15 bp, Artificial Sequence
  dgRNA
  Afap1l2
tggagatccctggcg

SEQ ID NO: 23529 - DNA, 15 bp, Artificial Sequence
  dgRNA
  H2-Ke6
atggtcacgcccccg

SEQ ID NO: 23530 - DNA, 15 bp, Artificial Sequence
  dgRNA
  H2-Ke6
gtcacgcccccgtgg

SEQ ID NO: 23531 - DNA, 15 bp, Artificial Sequence
  dgRNA
  H2-Ke6
tcacgcccccgtggt

SEQ ID NO: 23532 - DNA, 15 bp, Artificial Sequence
  dgRNA
  H2-Ke6
ggtgggaggtcgcgc

SEQ ID NO: 23533 - DNA, 15 bp, Artificial Sequence
  dgRNA
  Ms4a10
gatcttcacctgccc

SEQ ID NO: 23534 - DNA, 15 bp, Artificial Sequence
  dgRNA
  Ms4a10
catctctgattagct

SEQ ID NO: 23535 - DNA, 15 bp, Artificial Sequence
  dgRNA
  Mcidas
gcgcgcagattgtcc

SEQ ID NO: 23536 - DNA, 15 bp, Artificial Sequence
  dgRNA
  Mcidas
cgcgcagattgtccc

SEQ ID NO: 23537 - DNA, 15 bp, Artificial Sequence
  dgRNA
  Mcidas
attgtcccgggctga

SEQ ID NO: 23538 - DNA, 15 bp, Artificial Sequence
  dgRNA
  Mcidas
tgaaggcgccacctc

SEQ ID NO: 23539 - DNA, 15 bp, Artificial Sequence
  dgRNA
  Olfr370
tacgacagcttgatc

SEQ ID NO: 23540 - DNA, 15 bp, Artificial Sequence
  dgRNA
  Olfr370
ggaattctcgtttct

SEQ ID NO: 23541 - DNA, 15 bp, Artificial Sequence
  dgRNA
  Olfr370
aatggcaagtttagc

SEQ ID NO: 23542 - DNA, 15 bp, Artificial Sequence
  dgRNA
  Olfr370
ggcaagtttagcagg

SEQ ID NO: 23543 - DNA, 15 bp, Artificial Sequence
  dgRNA
  Chd5
gtgtcccgggtcggg

SEQ ID NO: 23544 - DNA, 15 bp, Artificial Sequence
  dgRNA
  Chd5
tgtcccgggtcgggc

SEQ ID NO: 23545 - DNA, 15 bp, Artificial Sequence
  dgRNA
  Chd5
cacctcgacagctcc

SEQ ID NO: 23546 - DNA, 15 bp, Artificial Sequence
  dgRNA
  Chd5
gttaactagtcgcgc

SEQ ID NO: 23547 - DNA, 15 bp, Artificial Sequence
  dgRNA
  Taf5l
tgagggaggcgcttc

SEQ ID NO: 23548 - DNA, 15 bp, Artificial Sequence
  dgRNA
  Taf5l
agacgttgacgccaa

SEQ ID NO: 23549 - DNA, 15 bp, Artificial Sequence
  dgRNA
  Taf5l
ttgacgccaacggct

SEQ ID NO: 23550 - DNA, 15 bp, Artificial Sequence
  dgRNA
  Taf5l
tgacgccaacggctc

SEQ ID NO: 23551 - DNA, 15 bp, Artificial Sequence
  dgRNA
  Borcs7
ggtagcctgcctaaa

SEQ ID NO: 23552 - DNA, 15 bp, Artificial Sequence
  dgRNA
  Borcs7
tgagctaagcgcatg

SEQ ID NO: 23553 - DNA, 15 bp, Artificial Sequence
  dgRNA
  Borcs7
tcctcttcgcacgat

SEQ ID NO: 23554 - DNA, 15 bp, Artificial Sequence
  dgRNA
  Borcs7
cttcgcacgattgga

SEQ ID NO: 23555 - DNA, 15 bp, Artificial Sequence
  dgRNA
  Eps8l1
gacacgcataatttc

SEQ ID NO: 23556 - DNA, 15 bp, Artificial Sequence
  dgRNA
  Eps8l1
acacgcataatttcc

SEQ ID NO: 23557 - DNA, 15 bp, Artificial Sequence
  dgRNA
  Eps8l1
gactgtaggggatcc

SEQ ID NO: 23558 - DNA, 15 bp, Artificial Sequence
  dgRNA
  Eps8l1
gcagggttgactgta

SEQ ID NO: 23559 - DNA, 15 bp, Artificial Sequence
  dgRNA
  Fdx1l
atacagtacgaccta

SEQ ID NO: 23560 - DNA, 15 bp, Artificial Sequence
  dgRNA
  Fdx1l
tacagtacgacctaa

SEQ ID NO: 23561 - DNA, 15 bp, Artificial Sequence
  dgRNA
  Fdx1l
tccaaccacagggcg

SEQ ID NO: 23562 - DNA, 15 bp, Artificial Sequence
  dgRNA
  Fdx1l
accacagggcgaggc

SEQ ID NO: 23563 - DNA, 15 bp, Artificial Sequence
  dgRNA
  Ecsit
ccagcgcctccgtac

SEQ ID NO: 23564 - DNA, 15 bp, Artificial Sequence
  dgRNA
  Ecsit
gtatccaaagtctcc

SEQ ID NO: 23565 - DNA, 15 bp, Artificial Sequence
  dgRNA
  Ecsit
cccccttcctattgg

SEQ ID NO: 23566 - DNA, 15 bp, Artificial Sequence
  dgRNA
  Ecsit
gggacctatcgtcac

SEQ ID NO: 23567 - DNA, 15 bp, Artificial Sequence
  dgRNA
  Obp2a
ccatgggagatataa

SEQ ID NO: 23568 - DNA, 15 bp, Artificial Sequence
  dgRNA
  Gdpd2
agttgcaaaattgtg

SEQ ID NO: 23569 - DNA, 15 bp, Artificial Sequence
  dgRNA
  Gdpd2
tgcaacttggcagcg

SEQ ID NO: 23570 - DNA, 15 bp, Artificial Sequence
  dgRNA
  Gdpd2
gactgagggcatagg

SEQ ID NO: 23571 - DNA, 15 bp, Artificial Sequence
  dgRNA
  Tbr1
atgatcgtcgcgacc

SEQ ID NO: 23572 - DNA, 15 bp, Artificial Sequence
  dgRNA
  Tbr1
tcgcgaccaggagcc

SEQ ID NO: 23573 - DNA, 15 bp, Artificial Sequence
  dgRNA
  Tbr1
tattgttggcttggg

SEQ ID NO: 23574 - DNA, 15 bp, Artificial Sequence
  dgRNA
  Tbr1
tggtcgcgacgatca

SEQ ID NO: 23575 - DNA, 15 bp, Artificial Sequence
  dgRNA
  CK137956
gcccgcccaggcgct

SEQ ID NO: 23576 - DNA, 15 bp, Artificial Sequence
  dgRNA
  CK137956
ttccggggcattcca

SEQ ID NO: 23577 - DNA, 15 bp, Artificial Sequence
  dgRNA
  CK137956
cggttactaagttac

SEQ ID NO: 23578 - DNA, 15 bp, Artificial Sequence
  dgRNA
  CK137956
tttcttctacgggag

SEQ ID NO: 23579 - DNA, 15 bp, Artificial Sequence
  dgRNA
  Xpa
ccccatcgcttagtc

SEQ ID NO: 23580 - DNA, 15 bp, Artificial Sequence
  dgRNA
  Xpa
actcctcggctgcgc

SEQ ID NO: 23581 - DNA, 15 bp, Artificial Sequence
  dgRNA
  Xpa
tgcctcgcccttcat

SEQ ID NO: 23582 - DNA, 15 bp, Artificial Sequence
  dgRNA
  Xpa
cgatgggggagaatc

SEQ ID NO: 23583 - DNA, 15 bp, Artificial Sequence
  dgRNA
  Vmn1r64
gctttagcacactac

SEQ ID NO: 23584 - DNA, 15 bp, Artificial Sequence
  dgRNA
  Rergl
agatagtctaaaaat

SEQ ID NO: 23585 - DNA, 15 bp, Artificial Sequence
  dgRNA
  Slco1a1
tcactagagtaattt

SEQ ID NO: 23586 - DNA, 15 bp, Artificial Sequence
  dgRNA
  Slco1a1
tgaaggtctagcaca

SEQ ID NO: 23587 - DNA, 15 bp, Artificial Sequence
  dgRNA
  Slco1a1
taggtgggtcttgtt

SEQ ID NO: 23588 - DNA, 15 bp, Artificial Sequence
  dgRNA
  Slco1a1
gtcaagcaagtcttg

SEQ ID NO: 23589 - DNA, 15 bp, Artificial Sequence
  dgRNA
  Eomes
ccgagaggaaatggc

SEQ ID NO: 23590 - DNA, 15 bp, Artificial Sequence
  dgRNA
  Eomes
tggctggttgctaaa

SEQ ID NO: 23591 - DNA, 15 bp, Artificial Sequence
  dgRNA
  Eomes
ggctggttgctaaat

SEQ ID NO: 23592 - DNA, 15 bp, Artificial Sequence
  dgRNA
  Eomes
atgtgcggccaggga

SEQ ID NO: 23593 - DNA, 15 bp, Artificial Sequence
  dgRNA
  Pi4ka
ccatgaacttacggt

SEQ ID NO: 23594 - DNA, 15 bp, Artificial Sequence
  dgRNA
  Pi4ka
ttataacgcattgat

SEQ ID NO: 23595 - DNA, 15 bp, Artificial Sequence
  dgRNA
  Pi4ka
aacgcattgattggc

SEQ ID NO: 23596 - DNA, 15 bp, Artificial Sequence
  dgRNA
  Pi4ka
ggctcacctcggaag

SEQ ID NO: 23597 - DNA, 15 bp, Artificial Sequence
  dgRNA
  Dnase2a
ggagaggcgtgtcca

SEQ ID NO: 23598 - DNA, 15 bp, Artificial Sequence
  dgRNA
  Dnase2a
cggatgaagcctatc

SEQ ID NO: 23599 - DNA, 15 bp, Artificial Sequence
  dgRNA
  Dnase2a
tatccggagctgagt

SEQ ID NO: 23600 - DNA, 15 bp, Artificial Sequence
  dgRNA
  Dnase2a
gcgctccaagttctg

SEQ ID NO: 23601 - DNA, 15 bp, Artificial Sequence
  dgRNA
  Thap4
aatgccttaacagcc

SEQ ID NO: 23602 - DNA, 15 bp, Artificial Sequence
  dgRNA
  Thap4
ctgttaaggcattgc

SEQ ID NO: 23603 - DNA, 15 bp, Artificial Sequence
  dgRNA
  Thap4
ggaaacgtgtgcacc

SEQ ID NO: 23604 - DNA, 15 bp, Artificial Sequence
  dgRNA
  Ube2v1
cctgggaacaggcgc

SEQ ID NO: 23605 - DNA, 15 bp, Artificial Sequence
  dgRNA
  Ube2v1
ctgggaacaggcgcg

SEQ ID NO: 23606 - DNA, 15 bp, Artificial Sequence
  dgRNA
  Ube2v1
tctcccggaagcgca

SEQ ID NO: 23607 - DNA, 15 bp, Artificial Sequence
  dgRNA
  Ube2v1
agcgcacggtcaccc

SEQ ID NO: 23608 - DNA, 15 bp, Artificial Sequence
  dgRNA
  Dnajc3
cagctccacgaccag

SEQ ID NO: 23609 - DNA, 15 bp, Artificial Sequence
  dgRNA
  Dnajc3
acgttatcctatcag

SEQ ID NO: 23610 - DNA, 15 bp, Artificial Sequence
  dgRNA
  Dnajc3
ttatcctatcagagg

SEQ ID NO: 23611 - DNA, 15 bp, Artificial Sequence
  dgRNA
  Dnajc3
atcctatcagaggcg

SEQ ID NO: 23612 - DNA, 15 bp, Artificial Sequence
  dgRNA
  Fam57b
agggctagtgtttgg

SEQ ID NO: 23613 - DNA, 15 bp, Artificial Sequence
  dgRNA
  Fam57b
gtatatctctagaat

SEQ ID NO: 23614 - DNA, 15 bp, Artificial Sequence
  dgRNA
  Fam57b
tagaatagggccgcc

SEQ ID NO: 23615 - DNA, 15 bp, Artificial Sequence
  dgRNA
  Fam57b
gccatggtaagaatc

SEQ ID NO: 23616 - DNA, 15 bp, Artificial Sequence
  dgRNA
  Tlk1
ctccgcgccgcgccg

SEQ ID NO: 23617 - DNA, 15 bp, Artificial Sequence
  dgRNA
  Tlk1
tccgcgccgcgccgc

SEQ ID NO: 23618 - DNA, 15 bp, Artificial Sequence
  dgRNA
  Tlk1
cgccctcgccccgcc

SEQ ID NO: 23619 - DNA, 15 bp, Artificial Sequence
  dgRNA
  Tlk1
tcgccccgcccgggc

SEQ ID NO: 23620 - DNA, 15 bp, Artificial Sequence
  dgRNA
  Lce1a2
gtccaagatgaatga

SEQ ID NO: 23621 - DNA, 15 bp, Artificial Sequence
  dgRNA
  Lce1a2
ctggtaaggaacatt

SEQ ID NO: 23622 - DNA, 15 bp, Artificial Sequence
  dgRNA
  Lce1a2
cataaagctagcagg

SEQ ID NO: 23623 - DNA, 15 bp, Artificial Sequence
  dgRNA
  Gm933
ttatacccacgctct

SEQ ID NO: 23624 - DNA, 15 bp, Artificial Sequence
  dgRNA
  Gm933
tttatacccacgctc

SEQ ID NO: 23625 - DNA, 15 bp, Artificial Sequence
  dgRNA
  Gm933
gacttagccaaacag

SEQ ID NO: 23626 - DNA, 15 bp, Artificial Sequence
  dgRNA
  Gm933
ggcaccgtggctgtg

SEQ ID NO: 23627 - DNA, 15 bp, Artificial Sequence
  dgRNA
  Gm4861
tctagtcttggaccc

SEQ ID NO: 23628 - DNA, 15 bp, Artificial Sequence
  dgRNA
  Gm4861
gcaatattttggcac

SEQ ID NO: 23629 - DNA, 15 bp, Artificial Sequence
  dgRNA
  Gm4861
aggtctgcaatattt

SEQ ID NO: 23630 - DNA, 15 bp, Artificial Sequence
  dgRNA
  Gm4861
aattgagtggcatcc

SEQ ID NO: 23631 - DNA, 15 bp, Artificial Sequence
  dgRNA
  Olfr661
gaatcagtgacagta

SEQ ID NO: 23632 - DNA, 15 bp, Artificial Sequence
  dgRNA
  Olfr661
ttactcttacaatac

SEQ ID NO: 23633 - DNA, 15 bp, Artificial Sequence
  dgRNA
  Fev
cccccgcgtgtctcc

SEQ ID NO: 23634 - DNA, 15 bp, Artificial Sequence
  dgRNA
  Fev
ccccgcgtgtctcct

SEQ ID NO: 23635 - DNA, 15 bp, Artificial Sequence
  dgRNA
  Fev
gtctcctgggctgcg

SEQ ID NO: 23636 - DNA, 15 bp, Artificial Sequence
  dgRNA
  Fev
gcgcggggggctgct

SEQ ID NO: 23637 - DNA, 15 bp, Artificial Sequence
  dgRNA
  Fcnb
gaagtgaacctccaa

SEQ ID NO: 23638 - DNA, 15 bp, Artificial Sequence
  dgRNA
  Fcnb
gaacagacataccct

SEQ ID NO: 23639 - DNA, 15 bp, Artificial Sequence
  dgRNA
  Fcnb
gagatagtcacttcc

SEQ ID NO: 23640 - DNA, 15 bp, Artificial Sequence
  dgRNA
  Fcnb
ctgctcttatagggc

SEQ ID NO: 23641 - DNA, 15 bp, Artificial Sequence
  dgRNA
  Gnrh1
aacagatagaccagc

SEQ ID NO: 23642 - DNA, 15 bp, Artificial Sequence
  dgRNA
  Gnrh1
acattcaccattaag

SEQ ID NO: 23643 - DNA, 15 bp, Artificial Sequence
  dgRNA
  Gnrh1
taactattaagacta

SEQ ID NO: 23644 - DNA, 15 bp, Artificial Sequence
  dgRNA
  Gnrh1
ctgtgctcaccagcg

SEQ ID NO: 23645 - DNA, 15 bp, Artificial Sequence
  dgRNA
  Wnt2
cctctatgttgctcc

SEQ ID NO: 23646 - DNA, 15 bp, Artificial Sequence
  dgRNA
  Wnt2
ctccgggccactccg

SEQ ID NO: 23647 - DNA, 15 bp, Artificial Sequence
  dgRNA
  Wnt2
ccctacgcccccgcc

SEQ ID NO: 23648 - DNA, 15 bp, Artificial Sequence
  dgRNA
  Wnt2
gcccccgcccggcgt

SEQ ID NO: 23649 - DNA, 15 bp, Artificial Sequence
  dgRNA
  Epyc
gagcatgaagtgacc

SEQ ID NO: 23650 - DNA, 15 bp, Artificial Sequence
  dgRNA
  Epyc
atctatcaaaggacg

SEQ ID NO: 23651 - DNA, 15 bp, Artificial Sequence
  dgRNA
  Epyc
ccttccatctatcaa

SEQ ID NO: 23652 - DNA, 15 bp, Artificial Sequence
  dgRNA
  Epyc
accataacactctag

SEQ ID NO: 23653 - DNA, 15 bp, Artificial Sequence
  dgRNA
  Grhl1
gcatgtttctagggc

SEQ ID NO: 23654 - DNA, 15 bp, Artificial Sequence
  dgRNA
  Grhl1
gggcaggcatttagc

SEQ ID NO: 23655 - DNA, 15 bp, Artificial Sequence
  dgRNA
  Grhl1
agtaggccactctgc

SEQ ID NO: 23656 - DNA, 15 bp, Artificial Sequence
  dgRNA
  Zdhhc2
cgagcgcccctgcgg

SEQ ID NO: 23657 - DNA, 15 bp, Artificial Sequence
  dgRNA
  Zdhhc2
cccctgcggtggccc

SEQ ID NO: 23658 - DNA, 15 bp, Artificial Sequence
  dgRNA
  Zdhhc2
ccctgcggtggccca

SEQ ID NO: 23659 - DNA, 15 bp, Artificial Sequence
  dgRNA
  Zdhhc2
cagggcaagggcgca

SEQ ID NO: 23660 - DNA, 15 bp, Artificial Sequence
  dgRNA
  Sort1
atcagtcccgcatct

SEQ ID NO: 23661 - DNA, 15 bp, Artificial Sequence
  dgRNA
  Sort1
ttggcatccgaatcc

SEQ ID NO: 23662 - DNA, 15 bp, Artificial Sequence
  dgRNA
  Sort1
caggacccccgaagc

SEQ ID NO: 23663 - DNA, 15 bp, Artificial Sequence
  dgRNA
  Sort1
gacccccgaagccgg

SEQ ID NO: 23664 - DNA, 15 bp, Artificial Sequence
  dgRNA
  Krcc1
aggtgagttcccgcc

SEQ ID NO: 23665 - DNA, 15 bp, Artificial Sequence
  dgRNA
  Krcc1
tgagttcccgcccgg

SEQ ID NO: 23666 - DNA, 15 bp, Artificial Sequence
  dgRNA
  Krcc1
ttcccgcccggcggc

SEQ ID NO: 23667 - DNA, 15 bp, Artificial Sequence
  dgRNA
  Krcc1
tcccgcccggcggcg

SEQ ID NO: 23668 - DNA, 15 bp, Artificial Sequence
  dgRNA
  Olfr1216
gtatctattcgcata

SEQ ID NO: 23669 - DNA, 15 bp, Artificial Sequence
  dgRNA
  Vav1
gcaccttagttcagc

SEQ ID NO: 23670 - DNA, 15 bp, Artificial Sequence
  dgRNA
  Vav1
cagccgtaggcacct

SEQ ID NO: 23671 - DNA, 15 bp, Artificial Sequence
  dgRNA
  Vav1
atctcatccagccgt

SEQ ID NO: 23672 - DNA, 15 bp, Artificial Sequence
  dgRNA
  Vav1
gtcgccccggggtgg

SEQ ID NO: 23673 - DNA, 15 bp, Artificial Sequence
  dgRNA
  Pde1a
cccatgttgtcttgt

SEQ ID NO: 23674 - DNA, 15 bp, Artificial Sequence
  dgRNA
  Pde1a
cggactgtctgtctt

SEQ ID NO: 23675 - DNA, 15 bp, Artificial Sequence
  dgRNA
  Pde1a
acaacatgggtataa

SEQ ID NO: 23676 - DNA, 15 bp, Artificial Sequence
  dgRNA
  Pde1a
ccgacaagacaacat

SEQ ID NO: 23677 - DNA, 15 bp, Artificial Sequence
  dgRNA
  Gmds
tcatggggcgatatg

SEQ ID NO: 23678 - DNA, 15 bp, Artificial Sequence
  dgRNA
  Gmds
cgatatgaggattcc

SEQ ID NO: 23679 - DNA, 15 bp, Artificial Sequence
  dgRNA
  Gmds
gattcccggagaccg

SEQ ID NO: 23680 - DNA, 15 bp, Artificial Sequence
  dgRNA
  Gmds
gaccgaggcccatgc

SEQ ID NO: 23681 - DNA, 15 bp, Artificial Sequence
  dgRNA
  Krt83
gccccggagctgacc

SEQ ID NO: 23682 - DNA, 15 bp, Artificial Sequence
  dgRNA
  Krt83
tgaccaggcgcttcg

SEQ ID NO: 23683 - DNA, 15 bp, Artificial Sequence
  dgRNA
  Krt83
tggcaccataaagcc

SEQ ID NO: 23684 - DNA, 15 bp, Artificial Sequence
  dgRNA
  Krt83
ggcaccataaagcca

SEQ ID NO: 23685 - DNA, 15 bp, Artificial Sequence
  dgRNA
  Agtpbp1
acagtcaagtccatc

SEQ ID NO: 23686 - DNA, 15 bp, Artificial Sequence
  dgRNA
  Agtpbp1
cgcctaacacaattc

SEQ ID NO: 23687 - DNA, 15 bp, Artificial Sequence
  dgRNA
  Agtpbp1
cgttaatactatatc

SEQ ID NO: 23688 - DNA, 15 bp, Artificial Sequence
  dgRNA
  Ccl3
ctacctataagagaa

SEQ ID NO: 23689 - DNA, 15 bp, Artificial Sequence
  dgRNA
  Ccl3
tacctataagagaag

SEQ ID NO: 23690 - DNA, 15 bp, Artificial Sequence
  dgRNA
  Ccl3
atattacacaaccca

SEQ ID NO: 23691 - DNA, 15 bp, Artificial Sequence
  dgRNA
  Ccl3
gatattacacaaccc

SEQ ID NO: 23692 - DNA, 15 bp, Artificial Sequence
  dgRNA
  Ddx21
caagcggaggcagca

SEQ ID NO: 23693 - DNA, 15 bp, Artificial Sequence
  dgRNA
  Ddx21
ctccaagtctagccg

SEQ ID NO: 23694 - DNA, 15 bp, Artificial Sequence
  dgRNA
  Ddx21
tccacgccgcacaca

SEQ ID NO: 23695 - DNA, 15 bp, Artificial Sequence
  dgRNA
  Ddx21
ccacgccgcacacac

SEQ ID NO: 23696 - DNA, 15 bp, Artificial Sequence
  dgRNA
  Pak3
cgtttacttgaattt

SEQ ID NO: 23697 - DNA, 15 bp, Artificial Sequence
  dgRNA
  Pak3
tattagcctttagag

SEQ ID NO: 23698 - DNA, 15 bp, Artificial Sequence
  dgRNA
  Pak3
gagatgatagactcc

SEQ ID NO: 23699 - DNA, 15 bp, Artificial Sequence
  dgRNA
  Pak3
tggtgtgtaccagac

SEQ ID NO: 23700 - DNA, 15 bp, Artificial Sequence
  dgRNA
  Ykt6
aaaagagcgatggta

SEQ ID NO: 23701 - DNA, 15 bp, Artificial Sequence
  dgRNA
  Ykt6
tccccaccggcagcc

SEQ ID NO: 23702 - DNA, 15 bp, Artificial Sequence
  dgRNA
  Ykt6
ccccaccggcagcca

SEQ ID NO: 23703 - DNA, 15 bp, Artificial Sequence
  dgRNA
  Ykt6
gtccgcgcgacagcc

SEQ ID NO: 23704 - DNA, 15 bp, Artificial Sequence
  dgRNA
  Pard3
cggcaagtgggctgg

SEQ ID NO: 23705 - DNA, 15 bp, Artificial Sequence
  dgRNA
  Pard3
ccgagcacagcgccg

SEQ ID NO: 23706 - DNA, 15 bp, Artificial Sequence
  dgRNA
  Pard3
cgagcacagcgccgc

SEQ ID NO: 23707 - DNA, 15 bp, Artificial Sequence
  dgRNA
  Pard3
acgcgcttcgccgtg

SEQ ID NO: 23708 - DNA, 15 bp, Artificial Sequence
  dgRNA
  Akr1d1
gcagttgtcgtagtc

SEQ ID NO: 23709 - DNA, 15 bp, Artificial Sequence
  dgRNA
  Nckipsd
ccgccaaacctctct

SEQ ID NO: 23710 - DNA, 15 bp, Artificial Sequence
  dgRNA
  Nckipsd
cctctctcggccgcg

SEQ ID NO: 23711 - DNA, 15 bp, Artificial Sequence
  dgRNA
  Nckipsd
ctctctcggccgcga

SEQ ID NO: 23712 - DNA, 15 bp, Artificial Sequence
  dgRNA
  Nckipsd
tctctcggccgcgag

SEQ ID NO: 23713 - DNA, 15 bp, Artificial Sequence
  dgRNA
  Yy2
ggtgtgcaatcaaaa

SEQ ID NO: 23714 - DNA, 15 bp, Artificial Sequence
  dgRNA
  Yy2
tagtgacgtttccag

SEQ ID NO: 23715 - DNA, 15 bp, Artificial Sequence
  dgRNA
  Yy2
atgcgtcttgtcctc

SEQ ID NO: 23716 - DNA, 15 bp, Artificial Sequence
  dgRNA
  Yy2
acctataagctcctc

SEQ ID NO: 23717 - DNA, 15 bp, Artificial Sequence
  dgRNA
  Rps6ka5
ggactagccgcccaa

SEQ ID NO: 23718 - DNA, 15 bp, Artificial Sequence
  dgRNA
  Rps6ka5
gactagccgcccaat

SEQ ID NO: 23719 - DNA, 15 bp, Artificial Sequence
  dgRNA
  Rps6ka5
gccgcccaatgggaa

SEQ ID NO: 23720 - DNA, 15 bp, Artificial Sequence
  dgRNA
  Rps6ka5
ccgcccaatgggaac

SEQ ID NO: 23721 - DNA, 15 bp, Artificial Sequence
  dgRNA
  Mrgpra4
catatcatgcattga

SEQ ID NO: 23722 - DNA, 15 bp, Artificial Sequence
  dgRNA
  Mrgpra4
gttcagggggttggt

SEQ ID NO: 23723 - DNA, 15 bp, Artificial Sequence
  dgRNA
  Mrgpra4
catcaatgcatgata

SEQ ID NO: 23724 - DNA, 15 bp, Artificial Sequence
  dgRNA
  Cdh17
cattacattcagtcc

SEQ ID NO: 23725 - DNA, 15 bp, Artificial Sequence
  dgRNA
  Cdh17
actgggtatcataaa

SEQ ID NO: 23726 - DNA, 15 bp, Artificial Sequence
  dgRNA
  Olfr224
tctgtgctgatcgtt

SEQ ID NO: 23727 - DNA, 15 bp, Artificial Sequence
  dgRNA
  Olfr224
gcatcttagttgcct

SEQ ID NO: 23728 - DNA, 15 bp, Artificial Sequence
  dgRNA
  Olfr224
gcctaggagacaccc

SEQ ID NO: 23729 - DNA, 15 bp, Artificial Sequence
  dgRNA
  Olfr224
gcaactaagatgctt

SEQ ID NO: 23730 - DNA, 15 bp, Artificial Sequence
  dgRNA
  Sh3bp1
gattcgctgcagacc

SEQ ID NO: 23731 - DNA, 15 bp, Artificial Sequence
  dgRNA
  Sh3bp1
gtcgcctccttctag

SEQ ID NO: 23732 - DNA, 15 bp, Artificial Sequence
  dgRNA
  Sh3bp1
ttctagtggcgcccg

SEQ ID NO: 23733 - DNA, 15 bp, Artificial Sequence
  dgRNA
  Sh3bp1
ttctccgagctcctt

SEQ ID NO: 23734 - DNA, 15 bp, Artificial Sequence
  dgRNA
  Pls3
cccagttgatgtgac

SEQ ID NO: 23735 - DNA, 15 bp, Artificial Sequence
  dgRNA
  Pls3
gcccaatcctcttcc

SEQ ID NO: 23736 - DNA, 15 bp, Artificial Sequence
  dgRNA
  Pls3
ccattccctacctgg

SEQ ID NO: 23737 - DNA, 15 bp, Artificial Sequence
  dgRNA
  Pls3
tttccattccctacc

SEQ ID NO: 23738 - DNA, 15 bp, Artificial Sequence
  dgRNA
  Uspl1
caagccacgcctctg

SEQ ID NO: 23739 - DNA, 15 bp, Artificial Sequence
  dgRNA
  Uspl1
tctgcggagccctgc

SEQ ID NO: 23740 - DNA, 15 bp, Artificial Sequence
  dgRNA
  Uspl1
ctgccggaagtgctc

SEQ ID NO: 23741 - DNA, 15 bp, Artificial Sequence
  dgRNA
  Uspl1
cgcgtgctctcaagc

SEQ ID NO: 23742 - DNA, 15 bp, Artificial Sequence
  dgRNA
  Hsbp1
ggcggagctaagaac

SEQ ID NO: 23743 - DNA, 15 bp, Artificial Sequence
  dgRNA
  Hsbp1
gcggagctaagaact

SEQ ID NO: 23744 - DNA, 15 bp, Artificial Sequence
  dgRNA
  Hsbp1
cggagctaagaactg

SEQ ID NO: 23745 - DNA, 15 bp, Artificial Sequence
  dgRNA
  Hsbp1
ggagctaagaactgg

SEQ ID NO: 23746 - DNA, 15 bp, Artificial Sequence
  dgRNA
  Dapk3
cgggcggggactcga

SEQ ID NO: 23747 - DNA, 15 bp, Artificial Sequence
  dgRNA
  Dapk3
gggactcgatggctg

SEQ ID NO: 23748 - DNA, 15 bp, Artificial Sequence
  dgRNA
  Dapk3
ctcgatggctgagga

SEQ ID NO: 23749 - DNA, 15 bp, Artificial Sequence
  dgRNA
  Dapk3
tgaggacggtacgaa

SEQ ID NO: 23750 - DNA, 15 bp, Artificial Sequence
  dgRNA
  Schip1
acgcagacaaaaacc

SEQ ID NO: 23751 - DNA, 15 bp, Artificial Sequence
  dgRNA
  Schip1
tgctttaagctgccg

SEQ ID NO: 23752 - DNA, 15 bp, Artificial Sequence
  dgRNA
  Schip1
gggttgttaactaaa

SEQ ID NO: 23753 - DNA, 15 bp, Artificial Sequence
  dgRNA
  Schip1
cgttgttcaaatagg

SEQ ID NO: 23754 - DNA, 15 bp, Artificial Sequence
  dgRNA
  Fam129b
caagcaggtccgtcc

SEQ ID NO: 23755 - DNA, 15 bp, Artificial Sequence
  dgRNA
  Fam129b
aagcaggtccgtccc

SEQ ID NO: 23756 - DNA, 15 bp, Artificial Sequence
  dgRNA
  Fam129b
cccgggtctcctttc

SEQ ID NO: 23757 - DNA, 15 bp, Artificial Sequence
  dgRNA
  Fam129b
cgggtctcctttctg

SEQ ID NO: 23758 - DNA, 15 bp, Artificial Sequence
  dgRNA
  Tnfsf12
ctgcctgcacgcgcc

SEQ ID NO: 23759 - DNA, 15 bp, Artificial Sequence
  dgRNA
  Tnfsf12
tgcctgcacgcgccc

SEQ ID NO: 23760 - DNA, 15 bp, Artificial Sequence
  dgRNA
  Tnfsf12
cacgcgcccgggcgc

SEQ ID NO: 23761 - DNA, 15 bp, Artificial Sequence
  dgRNA
  Tnfsf12
cttgcacagcactcc

SEQ ID NO: 23762 - DNA, 15 bp, Artificial Sequence
  dgRNA
  Gucd1
ggagcccacgtcgct

SEQ ID NO: 23763 - DNA, 15 bp, Artificial Sequence
  dgRNA
  Gucd1
gagcccacgtcgcta

SEQ ID NO: 23764 - DNA, 15 bp, Artificial Sequence
  dgRNA
  Gucd1
agcccacgtcgctag

SEQ ID NO: 23765 - DNA, 15 bp, Artificial Sequence
  dgRNA
  Gucd1
cacgtcgctagggga

SEQ ID NO: 23766 - DNA, 15 bp, Artificial Sequence
  dgRNA
  Vmn1r194
accaagtatctggtc

SEQ ID NO: 23767 - DNA, 15 bp, Artificial Sequence
  dgRNA
  Vmn1r194
ggtcaggaatcatta

SEQ ID NO: 23768 - DNA, 15 bp, Artificial Sequence
  dgRNA
  Vmn1r194
ggatgtaaacatata

SEQ ID NO: 23769 - DNA, 15 bp, Artificial Sequence
  dgRNA
  Eif1ax
ctactgcgtgcccac

SEQ ID NO: 23770 - DNA, 15 bp, Artificial Sequence
  dgRNA
  Eif1ax
gaacgcctccctggc

SEQ ID NO: 23771 - DNA, 15 bp, Artificial Sequence
  dgRNA
  Eif1ax
ctaggctcccaccct

SEQ ID NO: 23772 - DNA, 15 bp, Artificial Sequence
  dgRNA
  Eif1ax
tgcgccttagagtcg

SEQ ID NO: 23773 - DNA, 15 bp, Artificial Sequence
  dgRNA
  Hbp1
ttgtgcgcgtacctc

SEQ ID NO: 23774 - DNA, 15 bp, Artificial Sequence
  dgRNA
  Hbp1
tgtgcgcgtacctct

SEQ ID NO: 23775 - DNA, 15 bp, Artificial Sequence
  dgRNA
  Hbp1
agagcgtccttggtt

SEQ ID NO: 23776 - DNA, 15 bp, Artificial Sequence
  dgRNA
  Hbp1
tagagcgtccttggt

SEQ ID NO: 23777 - DNA, 15 bp, Artificial Sequence
  dgRNA
  Hcrtr1
ctcttaacaccaatc

SEQ ID NO: 23778 - DNA, 15 bp, Artificial Sequence
  dgRNA
  Hcrtr1
cttaacaccaatctg

SEQ ID NO: 23779 - DNA, 15 bp, Artificial Sequence
  dgRNA
  Hcrtr1
ggagcggcctgagcc

SEQ ID NO: 23780 - DNA, 15 bp, Artificial Sequence
  dgRNA
  Hcrtr1
ggccggatttatgaa

SEQ ID NO: 23781 - DNA, 15 bp, Artificial Sequence
  dgRNA
  Ntpcr
cacctcacgtgagtc

SEQ ID NO: 23782 - DNA, 15 bp, Artificial Sequence
  dgRNA
  Ntpcr
atagcaccaggagta

SEQ ID NO: 23783 - DNA, 15 bp, Artificial Sequence
  dgRNA
  Ntpcr
gtgcgccttgtgtgt

SEQ ID NO: 23784 - DNA, 15 bp, Artificial Sequence
  dgRNA
  Ntpcr
tgcgccttgtgtgtc

SEQ ID NO: 23785 - DNA, 15 bp, Artificial Sequence
  dgRNA
  Dync2h1
cctgatacttgattg

SEQ ID NO: 23786 - DNA, 15 bp, Artificial Sequence
  dgRNA
  Dync2h1
ggtttgcacgagaag

SEQ ID NO: 23787 - DNA, 15 bp, Artificial Sequence
  dgRNA
  Dync2h1
cagatgtcctacttc

SEQ ID NO: 23788 - DNA, 15 bp, Artificial Sequence
  dgRNA
  Dync2h1
cggtgcgcgctcagt

SEQ ID NO: 23789 - DNA, 15 bp, Artificial Sequence
  dgRNA
  Grb2
gggcctgtctttaag

SEQ ID NO: 23790 - DNA, 15 bp, Artificial Sequence
  dgRNA
  Grb2
gccggagatgtgtga

SEQ ID NO: 23791 - DNA, 15 bp, Artificial Sequence
  dgRNA
  Grb2
ccggagatgtgtgaa

SEQ ID NO: 23792 - DNA, 15 bp, Artificial Sequence
  dgRNA
  Grb2
gagtttacaccctgc

SEQ ID NO: 23793 - DNA, 15 bp, Artificial Sequence
  dgRNA
  Col4a3
gcctcccgcttaatc

SEQ ID NO: 23794 - DNA, 15 bp, Artificial Sequence
  dgRNA
  Col4a3
cctcccgcttaatct

SEQ ID NO: 23795 - DNA, 15 bp, Artificial Sequence
  dgRNA
  Col4a3
ccgcttaatctgggc

SEQ ID NO: 23796 - DNA, 15 bp, Artificial Sequence
  dgRNA
  Col4a3
cgcttaatctgggca

SEQ ID NO: 23797 - DNA, 15 bp, Artificial Sequence
  dgRNA
  Taz
ctgattcgtcgagtg

SEQ ID NO: 23798 - DNA, 15 bp, Artificial Sequence
  dgRNA
  Bpgm
tcgagaacttcaaac

SEQ ID NO: 23799 - DNA, 15 bp, Artificial Sequence
  dgRNA
  Bpgm
gccccggcgatgctc

SEQ ID NO: 23800 - DNA, 15 bp, Artificial Sequence
  dgRNA
  Bpgm
ccccggcgatgctca

SEQ ID NO: 23801 - DNA, 15 bp, Artificial Sequence
  dgRNA
  Bpgm
cccggcgatgctcag

SEQ ID NO: 23802 - DNA, 15 bp, Artificial Sequence
  dgRNA
  Stx18
ggtgccgatgcactg

SEQ ID NO: 23803 - DNA, 15 bp, Artificial Sequence
  dgRNA
  Stx18
gtgccgatgcactgc

SEQ ID NO: 23804 - DNA, 15 bp, Artificial Sequence
  dgRNA
  Stx18
ctgcgggtagctgtc

SEQ ID NO: 23805 - DNA, 15 bp, Artificial Sequence
  dgRNA
  Stx18
tggaacggagaattc

SEQ ID NO: 23806 - DNA, 15 bp, Artificial Sequence
  dgRNA
  Pgd
gtgccatcgactgct

SEQ ID NO: 23807 - DNA, 15 bp, Artificial Sequence
  dgRNA
  Pgd
ggcgctctacagatc

SEQ ID NO: 23808 - DNA, 15 bp, Artificial Sequence
  dgRNA
  Pgd
gcgctctacagatct

SEQ ID NO: 23809 - DNA, 15 bp, Artificial Sequence
  dgRNA
  Pgd
cagatctgggccccg

SEQ ID NO: 23810 - DNA, 15 bp, Artificial Sequence
  dgRNA
  Unc80
gccgcgccgctcctc

SEQ ID NO: 23811 - DNA, 15 bp, Artificial Sequence
  dgRNA
  Unc80
gccatgttccgcgcg

SEQ ID NO: 23812 - DNA, 15 bp, Artificial Sequence
  dgRNA
  Unc80
ccatgttccgcgcgc

SEQ ID NO: 23813 - DNA, 15 bp, Artificial Sequence
  dgRNA
  Unc80
catgttccgcgcgcg

SEQ ID NO: 23814 - DNA, 15 bp, Artificial Sequence
  dgRNA
  Abcb6
tggggagtgcaaatt

SEQ ID NO: 23815 - DNA, 15 bp, Artificial Sequence
  dgRNA
  Abcb6
ggacgcactactctg

SEQ ID NO: 23816 - DNA, 15 bp, Artificial Sequence
  dgRNA
  Abcb6
cgcactactctgtgg

SEQ ID NO: 23817 - DNA, 15 bp, Artificial Sequence
  dgRNA
  Abcb6
ttagagttcccgcct

SEQ ID NO: 23818 - DNA, 15 bp, Artificial Sequence
  dgRNA
  Krit1
ccgaagctggtggag

SEQ ID NO: 23819 - DNA, 15 bp, Artificial Sequence
  dgRNA
  Krit1
ggttcctggagccga

SEQ ID NO: 23820 - DNA, 15 bp, Artificial Sequence
  dgRNA
  Krit1
tgagacccgaactcg

SEQ ID NO: 23821 - DNA, 15 bp, Artificial Sequence
  dgRNA
  Krit1
gagacccgaactcgc

SEQ ID NO: 23822 - DNA, 15 bp, Artificial Sequence
  dgRNA
  Wbp1
atcgaattgctggag

SEQ ID NO: 23823 - DNA, 15 bp, Artificial Sequence
  dgRNA
  Wbp1
tcgaattgctggagt

SEQ ID NO: 23824 - DNA, 15 bp, Artificial Sequence
  dgRNA
  Wbp1
tgaacggccgttcat

SEQ ID NO: 23825 - DNA, 15 bp, Artificial Sequence
  dgRNA
  Wbp1
ttctgttgtccgtac

SEQ ID NO: 23826 - DNA, 15 bp, Artificial Sequence
  dgRNA
  Gdap1
gggcctcagccgact

SEQ ID NO: 23827 - DNA, 15 bp, Artificial Sequence
  dgRNA
  Gdap1
ccttggacgttgctt

SEQ ID NO: 23828 - DNA, 15 bp, Artificial Sequence
  dgRNA
  Gdap1
gccttggacgttgct

SEQ ID NO: 23829 - DNA, 15 bp, Artificial Sequence
  dgRNA
  Gdap1
gcaaataatactcct

SEQ ID NO: 23830 - DNA, 15 bp, Artificial Sequence
  dgRNA
  Csnk2b
caatcaaatagccac

SEQ ID NO: 23831 - DNA, 15 bp, Artificial Sequence
  dgRNA
  Csnk2b
ccacagggcagaacg

SEQ ID NO: 23832 - DNA, 15 bp, Artificial Sequence
  dgRNA
  Csnk2b
gaacgaggcatgcgc

SEQ ID NO: 23833 - DNA, 15 bp, Artificial Sequence
  dgRNA
  Csnk2b
gtgcccagtagcgcg

SEQ ID NO: 23834 - DNA, 15 bp, Artificial Sequence
  dgRNA
  Hist2h3b
gcggttcataaatac

SEQ ID NO: 23835 - DNA, 15 bp, Artificial Sequence
  dgRNA
  Hist2h3b
tttatgaaccgcaga

SEQ ID NO: 23836 - DNA, 15 bp, Artificial Sequence
  dgRNA
  Hist2h3b
atttatgaaccgcag

SEQ ID NO: 23837 - DNA, 15 bp, Artificial Sequence
  dgRNA
  Hist2h3b
acttgcagtctgatt

SEQ ID NO: 23838 - DNA, 15 bp, Artificial Sequence
  dgRNA
  Cdkn1c
agcccgctcgccgtg

SEQ ID NO: 23839 - DNA, 15 bp, Artificial Sequence
  dgRNA
  Cdkn1c
gtcacccgccccgcc

SEQ ID NO: 23840 - DNA, 15 bp, Artificial Sequence
  dgRNA
  Cdkn1c
cgcagccaatgagcg

SEQ ID NO: 23841 - DNA, 15 bp, Artificial Sequence
  dgRNA
  Cdkn1c
ccaatgagcgtggcg

SEQ ID NO: 23842 - DNA, 15 bp, Artificial Sequence
  dgRNA
  Trmt2b
gatccctatttgata

SEQ ID NO: 23843 - DNA, 15 bp, Artificial Sequence
  dgRNA
  Trmt2b
cggcggatctcaaaa

SEQ ID NO: 23844 - DNA, 15 bp, Artificial Sequence
  dgRNA
  Trmt2b
tagagtccgccagac

SEQ ID NO: 23845 - DNA, 15 bp, Artificial Sequence
  dgRNA
  Trmt2b
agagtccgccagact

SEQ ID NO: 23846 - DNA, 15 bp, Artificial Sequence
  dgRNA
  Ftcd
ccatcgcactgtccc

SEQ ID NO: 23847 - DNA, 15 bp, Artificial Sequence
  dgRNA
  Ftcd
aggtataaaggcccc

SEQ ID NO: 23848 - DNA, 15 bp, Artificial Sequence
  dgRNA
  Ftcd
ggtataaaggcccca

SEQ ID NO: 23849 - DNA, 15 bp, Artificial Sequence
  dgRNA
  Ftcd
gccaacttgagctca

SEQ ID NO: 23850 - DNA, 15 bp, Artificial Sequence
  dgRNA
  Ripply1
ccctgtttactcaac

SEQ ID NO: 23851 - DNA, 15 bp, Artificial Sequence
  dgRNA
  Ripply1
cctgtttactcaact

SEQ ID NO: 23852 - DNA, 15 bp, Artificial Sequence
  dgRNA
  Ripply1
ataattgatgagtca

SEQ ID NO: 23853 - DNA, 15 bp, Artificial Sequence
  dgRNA
  Ripply1
gcagggcttataaaa

SEQ ID NO: 23854 - DNA, 15 bp, Artificial Sequence
  dgRNA
  Crkl
ctttgcggtccagga

SEQ ID NO: 23855 - DNA, 15 bp, Artificial Sequence
  dgRNA
  Crkl
tttgcggtccaggaa

SEQ ID NO: 23856 - DNA, 15 bp, Artificial Sequence
  dgRNA
  Crkl
cctcctcccggaacg

SEQ ID NO: 23857 - DNA, 15 bp, Artificial Sequence
  dgRNA
  Crkl
ctcctcccggaacgc

SEQ ID NO: 23858 - DNA, 15 bp, Artificial Sequence
  dgRNA
  Fzd2
gaccaatccagccct

SEQ ID NO: 23859 - DNA, 15 bp, Artificial Sequence
  dgRNA
  Fzd2
ccaatccagcccttg

SEQ ID NO: 23860 - DNA, 15 bp, Artificial Sequence
  dgRNA
  Fzd2
gccgagagcacattt

SEQ ID NO: 23861 - DNA, 15 bp, Artificial Sequence
  dgRNA
  Fzd2
ccgagagcacatttt

SEQ ID NO: 23862 - DNA, 15 bp, Artificial Sequence
  dgRNA
  Kcnk7
catatgtgaccaagg

SEQ ID NO: 23863 - DNA, 15 bp, Artificial Sequence
  dgRNA
  Kcnk7
gcgtacgttcgtgtg

SEQ ID NO: 23864 - DNA, 15 bp, Artificial Sequence
  dgRNA
  Kcnk7
aaactgggcgtgctg

SEQ ID NO: 23865 - DNA, 15 bp, Artificial Sequence
  dgRNA
  Kcnk7
actcattcagacacc

SEQ ID NO: 23866 - DNA, 15 bp, Artificial Sequence
  dgRNA
  Tubgcp4
agtgacccggccgga

SEQ ID NO: 23867 - DNA, 15 bp, Artificial Sequence
  dgRNA
  Tubgcp4
gagtgacccggccgg

SEQ ID NO: 23868 - DNA, 15 bp, Artificial Sequence
  dgRNA
  Tubgcp4
ccagagtgacccggc

SEQ ID NO: 23869 - DNA, 15 bp, Artificial Sequence
  dgRNA
  4932438A13Rik
tagatctcatcccta

SEQ ID NO: 23870 - DNA, 15 bp, Artificial Sequence
  dgRNA
  4932438A13Rik
tgccccggccttcca

SEQ ID NO: 23871 - DNA, 15 bp, Artificial Sequence
  dgRNA
  4932438A13Rik
cgcccccggcccaag

SEQ ID NO: 23872 - DNA, 15 bp, Artificial Sequence
  dgRNA
  4932438A13Rik
cggcgcttctccgtt

SEQ ID NO: 23873 - DNA, 15 bp, Artificial Sequence
  dgRNA
  Gml
ttccgggccctttct

SEQ ID NO: 23874 - DNA, 15 bp, Artificial Sequence
  dgRNA
  Gml
tccgggccctttctt

SEQ ID NO: 23875 - DNA, 15 bp, Artificial Sequence
  dgRNA
  Gml
gttgggaatacttga

SEQ ID NO: 23876 - DNA, 15 bp, Artificial Sequence
  dgRNA
  Gml
ggttgggaatacttg

SEQ ID NO: 23877 - DNA, 15 bp, Artificial Sequence
  dgRNA
  Polg
tcgctttatttccaa

SEQ ID NO: 23878 - DNA, 15 bp, Artificial Sequence
  dgRNA
  Polg
cgctttatttccaaa

SEQ ID NO: 23879 - DNA, 15 bp, Artificial Sequence
  dgRNA
  Polg
catacaagtcgaccg

SEQ ID NO: 23880 - DNA, 15 bp, Artificial Sequence
  dgRNA
  Polg
caagtcgaccgcggc

SEQ ID NO: 23881 - DNA, 15 bp, Artificial Sequence
  dgRNA
  Neurog1
atagcaggcgccgca

SEQ ID NO: 23882 - DNA, 15 bp, Artificial Sequence
  dgRNA
  Neurog1
tagcaggcgccgcac

SEQ ID NO: 23883 - DNA, 15 bp, Artificial Sequence
  dgRNA
  Neurog1
agcaggcgccgcacg

SEQ ID NO: 23884 - DNA, 15 bp, Artificial Sequence
  dgRNA
  Neurog1
tcacccgcgccgcct

SEQ ID NO: 23885 - DNA, 15 bp, Artificial Sequence
  dgRNA
  Reln
ccctgcccttccggg

SEQ ID NO: 23886 - DNA, 15 bp, Artificial Sequence
  dgRNA
  Reln
cccttccgggcggag

SEQ ID NO: 23887 - DNA, 15 bp, Artificial Sequence
  dgRNA
  Reln
ccttccgggcggagc

SEQ ID NO: 23888 - DNA, 15 bp, Artificial Sequence
  dgRNA
  Reln
ggcggagcgggccgt

SEQ ID NO: 23889 - DNA, 15 bp, Artificial Sequence
  dgRNA
  Hist3h2a
tacattacgtcatcg

SEQ ID NO: 23890 - DNA, 15 bp, Artificial Sequence
  dgRNA
  Hist3h2a
acattacgtcatcgc

SEQ ID NO: 23891 - DNA, 15 bp, Artificial Sequence
  dgRNA
  Hist3h2a
cattacgtcatcgcg

SEQ ID NO: 23892 - DNA, 15 bp, Artificial Sequence
  dgRNA
  Hist3h2a
cgtcatcgcggggta

SEQ ID NO: 23893 - DNA, 15 bp, Artificial Sequence
  dgRNA
  Mkrn3
ggcacgcgaaaaaca

SEQ ID NO: 23894 - DNA, 15 bp, Artificial Sequence
  dgRNA
  Mkrn3
acgcgaaaaacatgg

SEQ ID NO: 23895 - DNA, 15 bp, Artificial Sequence
  dgRNA
  Mkrn3
ggcggaagcaacttc

SEQ ID NO: 23896 - DNA, 15 bp, Artificial Sequence
  dgRNA
  Mkrn3
ttccggtgaagccct

SEQ ID NO: 23897 - DNA, 15 bp, Artificial Sequence
  dgRNA
  Lhx5
agcgcactccctgcc

SEQ ID NO: 23898 - DNA, 15 bp, Artificial Sequence
  dgRNA
  Lhx5
gcgcactccctgcct

SEQ ID NO: 23899 - DNA, 15 bp, Artificial Sequence
  dgRNA
  Lhx5
cttctacaggttgcg

SEQ ID NO: 23900 - DNA, 15 bp, Artificial Sequence
  dgRNA
  Lhx5
ttctacaggttgcga

SEQ ID NO: 23901 - DNA, 15 bp, Artificial Sequence
  dgRNA
  Arhgap6
cagtggacttctgat

SEQ ID NO: 23902 - DNA, 15 bp, Artificial Sequence
  dgRNA
  Arhgap6
tctgatgggccggcc

SEQ ID NO: 23903 - DNA, 15 bp, Artificial Sequence
  dgRNA
  Arhgap6
ctgatgggccggcct

SEQ ID NO: 23904 - DNA, 15 bp, Artificial Sequence
  dgRNA
  Arhgap6
ccggcctgggaacca

SEQ ID NO: 23905 - DNA, 15 bp, Artificial Sequence
  dgRNA
  Dnajc1
gagacgtgatgtcac

SEQ ID NO: 23906 - DNA, 15 bp, Artificial Sequence
  dgRNA
  Dnajc1
atgtcaccggaagcg

SEQ ID NO: 23907 - DNA, 15 bp, Artificial Sequence
  dgRNA
  Dnajc1
accggaagcgaggcc

SEQ ID NO: 23908 - DNA, 15 bp, Artificial Sequence
  dgRNA
  Dnajc1
ccggaagcgaggcct

SEQ ID NO: 23909 - DNA, 15 bp, Artificial Sequence
  dgRNA
  Mbtd1
tacctcatcgacttg

SEQ ID NO: 23910 - DNA, 15 bp, Artificial Sequence
  dgRNA
  Mbtd1
atcgacttgtggtct

SEQ ID NO: 23911 - DNA, 15 bp, Artificial Sequence
  dgRNA
  Mbtd1
acggtccttagagta

SEQ ID NO: 23912 - DNA, 15 bp, Artificial Sequence
  dgRNA
  Mbtd1
gtacggcgcctgccg

SEQ ID NO: 23913 - DNA, 15 bp, Artificial Sequence
  dgRNA
  Olfr424
attattggtcccaaa

SEQ ID NO: 23914 - DNA, 15 bp, Artificial Sequence
  dgRNA
  Olfr424
tatgaacaatatgtc

SEQ ID NO: 23915 - DNA, 15 bp, Artificial Sequence
  dgRNA
  Olfr424
gtgtttccacccatg

SEQ ID NO: 23916 - DNA, 15 bp, Artificial Sequence
  dgRNA
  Olfr424
ccatgaggataaact

SEQ ID NO: 23917 - DNA, 15 bp, Artificial Sequence
  dgRNA
  Tcf3
catggtaatctttgt

SEQ ID NO: 23918 - DNA, 15 bp, Artificial Sequence
  dgRNA
  Tcf3
tactatcgcctcaag

SEQ ID NO: 23919 - DNA, 15 bp, Artificial Sequence
  dgRNA
  Tcf3
cgcctcaagaggtag

SEQ ID NO: 23920 - DNA, 15 bp, Artificial Sequence
  dgRNA
  Tcf3
agggatctgtgtatc

SEQ ID NO: 23921 - DNA, 15 bp, Artificial Sequence
  dgRNA
  Magi1
gagcgcgagagagtc

SEQ ID NO: 23922 - DNA, 15 bp, Artificial Sequence
  dgRNA
  Magi1
cgagagagtcgggcg

SEQ ID NO: 23923 - DNA, 15 bp, Artificial Sequence
  dgRNA
  Magi1
gagagtcgggcgagg

SEQ ID NO: 23924 - DNA, 15 bp, Artificial Sequence
  dgRNA
  Magi1
gtgagcccgccgctc

SEQ ID NO: 23925 - DNA, 15 bp, Artificial Sequence
  dgRNA
  Park7
acttaaacgtcgaag

SEQ ID NO: 23926 - DNA, 15 bp, Artificial Sequence
  dgRNA
  Park7
gaggggcaattgcgc

SEQ ID NO: 23927 - DNA, 15 bp, Artificial Sequence
  dgRNA
  Park7
gcgcaggcgcccgca

SEQ ID NO: 23928 - DNA, 15 bp, Artificial Sequence
  dgRNA
  Park7
caggcgcccgcaggg

SEQ ID NO: 23929 - DNA, 15 bp, Artificial Sequence
  dgRNA
  Armcx1
aagctccttgcggtt

SEQ ID NO: 23930 - DNA, 15 bp, Artificial Sequence
  dgRNA
  Armcx1
agctccttgcggttt

SEQ ID NO: 23931 - DNA, 15 bp, Artificial Sequence
  dgRNA
  Armcx1
gctccttgcggtttg

SEQ ID NO: 23932 - DNA, 15 bp, Artificial Sequence
  dgRNA
  Armcx1
ggacctggtgtggcg

SEQ ID NO: 23933 - DNA, 15 bp, Artificial Sequence
  dgRNA
  Cdcp2
ccacccccgtgggat

SEQ ID NO: 23934 - DNA, 15 bp, Artificial Sequence
  dgRNA
  Cdcp2
gatgggctgactcaa

SEQ ID NO: 23935 - DNA, 15 bp, Artificial Sequence
  dgRNA
  Cdcp2
ccatcccacgggggt

SEQ ID NO: 23936 - DNA, 15 bp, Artificial Sequence
  dgRNA
  Cdcp2
cagcccatcccacgg

SEQ ID NO: 23937 - DNA, 15 bp, Artificial Sequence
  dgRNA
  Ppp1r3b
acactgcagatcacg

SEQ ID NO: 23938 - DNA, 15 bp, Artificial Sequence
  dgRNA
  Ppp1r3b
gtagctattggtctg

SEQ ID NO: 23939 - DNA, 15 bp, Artificial Sequence
  dgRNA
  Ppp1r3b
ctgcggctcatgtcc

SEQ ID NO: 23940 - DNA, 15 bp, Artificial Sequence
  dgRNA
  Ppp1r3b
agtcctgcgttcacg

SEQ ID NO: 23941 - DNA, 15 bp, Artificial Sequence
  dgRNA
  Fbp1
tctggcaggttatag

SEQ ID NO: 23942 - DNA, 15 bp, Artificial Sequence
  dgRNA
  Fbp1
ctggcaggttatagc

SEQ ID NO: 23943 - DNA, 15 bp, Artificial Sequence
  dgRNA
  Fbp1
ggttatagcgggcat

SEQ ID NO: 23944 - DNA, 15 bp, Artificial Sequence
  dgRNA
  Fbp1
tatagcgggcattgg

SEQ ID NO: 23945 - DNA, 15 bp, Artificial Sequence
  dgRNA
  Tmem248
aacccccccactaag

SEQ ID NO: 23946 - DNA, 15 bp, Artificial Sequence
  dgRNA
  Tmem248
acccccccactaagt

SEQ ID NO: 23947 - DNA, 15 bp, Artificial Sequence
  dgRNA
  Tmem248
ggtaacctctctggg

SEQ ID NO: 23948 - DNA, 15 bp, Artificial Sequence
  dgRNA
  Tmem248
tcccacttagtgggg

SEQ ID NO: 23949 - DNA, 15 bp, Artificial Sequence
  dgRNA
  Apbb1
ggaggttccttagta

SEQ ID NO: 23950 - DNA, 15 bp, Artificial Sequence
  dgRNA
  Apbb1
ggttccttagtatgg

SEQ ID NO: 23951 - DNA, 15 bp, Artificial Sequence
  dgRNA
  Apbb1
ttagtatggtggtct

SEQ ID NO: 23952 - DNA, 15 bp, Artificial Sequence
  dgRNA
  Apbb1
tccctcgagaactcc

SEQ ID NO: 23953 - DNA, 15 bp, Artificial Sequence
  dgRNA
  P3h1
tgcgcatgagattag

SEQ ID NO: 23954 - DNA, 15 bp, Artificial Sequence
  dgRNA
  P3h1
cgaagagtaagtgtt

SEQ ID NO: 23955 - DNA, 15 bp, Artificial Sequence
  dgRNA
  P3h1
cttgccacgagcttc

SEQ ID NO: 23956 - DNA, 15 bp, Artificial Sequence
  dgRNA
  P3h1
acgagcttctggact

SEQ ID NO: 23957 - DNA, 15 bp, Artificial Sequence
  dgRNA
  Serpini1
caggtgcgatgccag

SEQ ID NO: 23958 - DNA, 15 bp, Artificial Sequence
  dgRNA
  Serpini1
aggtgcgatgccaga

SEQ ID NO: 23959 - DNA, 15 bp, Artificial Sequence
  dgRNA
  Serpini1
ggtgcgatgccagag

SEQ ID NO: 23960 - DNA, 15 bp, Artificial Sequence
  dgRNA
  Serpini1
gaaagtccgaaatga

SEQ ID NO: 23961 - DNA, 15 bp, Artificial Sequence
  dgRNA
  Tagln
caagtccgggtaaca

SEQ ID NO: 23962 - DNA, 15 bp, Artificial Sequence
  dgRNA
  Tagln
tccgggtaacaagga

SEQ ID NO: 23963 - DNA, 15 bp, Artificial Sequence
  dgRNA
  Tagln
ccgggtaacaaggaa

SEQ ID NO: 23964 - DNA, 15 bp, Artificial Sequence
  dgRNA
  Tagln
ggtcctgcccataaa

SEQ ID NO: 23965 - DNA, 15 bp, Artificial Sequence
  dgRNA
  Elf2
ccggcccggtttgac

SEQ ID NO: 23966 - DNA, 15 bp, Artificial Sequence
  dgRNA
  Elf2
gtttgacaggcgctg

SEQ ID NO: 23967 - DNA, 15 bp, Artificial Sequence
  dgRNA
  Elf2
aggcgctgcggtgac

SEQ ID NO: 23968 - DNA, 15 bp, Artificial Sequence
  dgRNA
  Elf2
cgctgcggtgactgg

SEQ ID NO: 23969 - DNA, 15 bp, Artificial Sequence
  dgRNA
  Sult1b1
ttcaacagttgtaat

SEQ ID NO: 23970 - DNA, 15 bp, Artificial Sequence
  dgRNA
  Ntn5
ccctgtgggaaagcg

SEQ ID NO: 23971 - DNA, 15 bp, Artificial Sequence
  dgRNA
  Ntn5
ggtgggcggtagtgt

SEQ ID NO: 23972 - DNA, 15 bp, Artificial Sequence
  dgRNA
  Ntn5
agtgttggattctgc

SEQ ID NO: 23973 - DNA, 15 bp, Artificial Sequence
  dgRNA
  Ntn5
gaacccccactagcc

SEQ ID NO: 23974 - DNA, 15 bp, Artificial Sequence
  dgRNA
  Gapdhs
cactctagatgccag

SEQ ID NO: 23975 - DNA, 15 bp, Artificial Sequence
  dgRNA
  Pfdn2
ttaaagcatcgcagg

SEQ ID NO: 23976 - DNA, 15 bp, Artificial Sequence
  dgRNA
  Pfdn2
tggaattcaccgcag

SEQ ID NO: 23977 - DNA, 15 bp, Artificial Sequence
  dgRNA
  Pfdn2
ggaattcaccgcagc

SEQ ID NO: 23978 - DNA, 15 bp, Artificial Sequence
  dgRNA
  Pfdn2
ttcaccgcagcgggc

SEQ ID NO: 23979 - DNA, 15 bp, Artificial Sequence
  dgRNA
  Slc52a2
tacacttagcttccg

SEQ ID NO: 23980 - DNA, 15 bp, Artificial Sequence
  dgRNA
  Slc52a2
acacttagcttccgg

SEQ ID NO: 23981 - DNA, 15 bp, Artificial Sequence
  dgRNA
  Slc52a2
cttagcttccggggg

SEQ ID NO: 23982 - DNA, 15 bp, Artificial Sequence
  dgRNA
  Slc52a2
gtctagcgcattagc

SEQ ID NO: 23983 - DNA, 15 bp, Artificial Sequence
  dgRNA
  Myo18a
ggctgtggacctacc

SEQ ID NO: 23984 - DNA, 15 bp, Artificial Sequence
  dgRNA
  Myo18a
gtaggtccacagcca

SEQ ID NO: 23985 - DNA, 15 bp, Artificial Sequence
  dgRNA
  Myo18a
ggtaggtccacagcc

SEQ ID NO: 23986 - DNA, 15 bp, Artificial Sequence
  dgRNA
  Myo18a
aggactgcgggcacc

SEQ ID NO: 23987 - DNA, 15 bp, Artificial Sequence
  dgRNA
  Coch
agaaccccacaccgc

SEQ ID NO: 23988 - DNA, 15 bp, Artificial Sequence
  dgRNA
  Coch
ccacaccgcaggaag

SEQ ID NO: 23989 - DNA, 15 bp, Artificial Sequence
  dgRNA
  Coch
gaggcgccagtccgc

SEQ ID NO: 23990 - DNA, 15 bp, Artificial Sequence
  dgRNA
  Coch
ccgctggcctccccc

SEQ ID NO: 23991 - DNA, 15 bp, Artificial Sequence
  dgRNA
  Map4
cgcgcgccgcgccaa

SEQ ID NO: 23992 - DNA, 15 bp, Artificial Sequence
  dgRNA
  Map4
gctgcttccacggag

SEQ ID NO: 23993 - DNA, 15 bp, Artificial Sequence
  dgRNA
  Map4
tccacggagagggcg

SEQ ID NO: 23994 - DNA, 15 bp, Artificial Sequence
  dgRNA
  Map4
gcgaggagtaggggc

SEQ ID NO: 23995 - DNA, 15 bp, Artificial Sequence
  dgRNA
  Jak2
cggagcccgccgagc

SEQ ID NO: 23996 - DNA, 15 bp, Artificial Sequence
  dgRNA
  Jak2
ggagcccgccgagca

SEQ ID NO: 23997 - DNA, 15 bp, Artificial Sequence
  dgRNA
  Jak2
gctgagccggcgtcg

SEQ ID NO: 23998 - DNA, 15 bp, Artificial Sequence
  dgRNA
  Jak2
ctgagccggcgtcgc

SEQ ID NO: 23999 - DNA, 15 bp, Artificial Sequence
  dgRNA
  Rgs19
tacccagctccctag

SEQ ID NO: 24000 - DNA, 15 bp, Artificial Sequence
  dgRNA
  Rgs19
tccagtccccttggg

SEQ ID NO: 24001 - DNA, 15 bp, Artificial Sequence
  dgRNA
  Rgs19
cagtccccttgggag

SEQ ID NO: 24002 - DNA, 15 bp, Artificial Sequence
  dgRNA
  Rgs19
accgaatccctgacc

SEQ ID NO: 24003 - DNA, 15 bp, Artificial Sequence
  dgRNA
  Igf1
atagagcctgcgcaa

SEQ ID NO: 24004 - DNA, 15 bp, Artificial Sequence
  dgRNA
  Igf1
caaagttatcgagta

SEQ ID NO: 24005 - DNA, 15 bp, Artificial Sequence
  dgRNA
  Igf1
tttattccattgcgc

SEQ ID NO: 24006 - DNA, 15 bp, Artificial Sequence
  dgRNA
  Cops2
cctcacctaggacgc

SEQ ID NO: 24007 - DNA, 15 bp, Artificial Sequence
  dgRNA
  Cops2
ctggatacagctaga

SEQ ID NO: 24008 - DNA, 15 bp, Artificial Sequence
  dgRNA
  Cops2
cgaagcccctcagat

SEQ ID NO: 24009 - DNA, 15 bp, Artificial Sequence
  dgRNA
  Cops2
cacaaactgtcgctc

SEQ ID NO: 24010 - DNA, 15 bp, Artificial Sequence
  dgRNA
  Per1
cccaagtccacgtgc

SEQ ID NO: 24011 - DNA, 15 bp, Artificial Sequence
  dgRNA
  Per1
ccaagtccacgtgca

SEQ ID NO: 24012 - DNA, 15 bp, Artificial Sequence
  dgRNA
  Per1
gatccttagccaacc

SEQ ID NO: 24013 - DNA, 15 bp, Artificial Sequence
  dgRNA
  Per1
atccttagccaaccg

SEQ ID NO: 24014 - DNA, 15 bp, Artificial Sequence
  dgRNA
  Rpl19
acttagcgtgacttc

SEQ ID NO: 24015 - DNA, 15 bp, Artificial Sequence
  dgRNA
  Rpl19
cttccggctacccag

SEQ ID NO: 24016 - DNA, 15 bp, Artificial Sequence
  dgRNA
  Rpl19
acggcggagagccag

SEQ ID NO: 24017 - DNA, 15 bp, Artificial Sequence
  dgRNA
  Rpl19
gtttctagattagct

SEQ ID NO: 24018 - DNA, 15 bp, Artificial Sequence
  dgRNA
  Gria2
acctcagcccatagc

SEQ ID NO: 24019 - DNA, 15 bp, Artificial Sequence
  dgRNA
  Gria2
ccaaagcgctgtccg

SEQ ID NO: 24020 - DNA, 15 bp, Artificial Sequence
  dgRNA
  Gria2
tcgaatgcgcaagac

SEQ ID NO: 24021 - DNA, 15 bp, Artificial Sequence
  dgRNA
  Gria2
aatgcgcaagactgg

SEQ ID NO: 24022 - DNA, 15 bp, Artificial Sequence
  dgRNA
  Mdga1
cggcgccctcgcctc

SEQ ID NO: 24023 - DNA, 15 bp, Artificial Sequence
  dgRNA
  Mdga1
ggcgccctcgcctcc

SEQ ID NO: 24024 - DNA, 15 bp, Artificial Sequence
  dgRNA
  Mdga1
ccctcgcctccggga

SEQ ID NO: 24025 - DNA, 15 bp, Artificial Sequence
  dgRNA
  Mdga1
cctcgcctccgggaa

SEQ ID NO: 24026 - DNA, 15 bp, Artificial Sequence
  dgRNA
  S100a13
ggcacgctgcaaatg

SEQ ID NO: 24027 - DNA, 15 bp, Artificial Sequence
  dgRNA
  S100a13
atgtggccactggac

SEQ ID NO: 24028 - DNA, 15 bp, Artificial Sequence
  dgRNA
  S100a13
cactggaccggtgtg

SEQ ID NO: 24029 - DNA, 15 bp, Artificial Sequence
  dgRNA
  S100a13
cgacctcctccccaa

SEQ ID NO: 24030 - DNA, 15 bp, Artificial Sequence
  dgRNA
  Tatdn3
ggcatcgtggtcctg

SEQ ID NO: 24031 - DNA, 15 bp, Artificial Sequence
  dgRNA
  Tatdn3
gcatcgtggtcctgc

SEQ ID NO: 24032 - DNA, 15 bp, Artificial Sequence
  dgRNA
  Tatdn3
catcgtggtcctgcg

SEQ ID NO: 24033 - DNA, 15 bp, Artificial Sequence
  dgRNA
  Tatdn3
cgtggtcctgcgggg

SEQ ID NO: 24034 - DNA, 15 bp, Artificial Sequence
  dgRNA
  Igfals
caatccccgagactt

SEQ ID NO: 24035 - DNA, 15 bp, Artificial Sequence
  dgRNA
  Igfals
aatccccgagacttt

SEQ ID NO: 24036 - DNA, 15 bp, Artificial Sequence
  dgRNA
  Igfals
atccccgagactttg

SEQ ID NO: 24037 - DNA, 15 bp, Artificial Sequence
  dgRNA
  Igfals
cccgagactttgggg

SEQ ID NO: 24038 - DNA, 15 bp, Artificial Sequence
  dgRNA
  Akap4
ctccagtaggtagct

SEQ ID NO: 24039 - DNA, 15 bp, Artificial Sequence
  dgRNA
  Akap4
tagcttggcatactt

SEQ ID NO: 24040 - DNA, 15 bp, Artificial Sequence
  dgRNA
  Akap4
ggttgctacatcacc

SEQ ID NO: 24041 - DNA, 15 bp, Artificial Sequence
  dgRNA
  Akap4
tacttgtcataccac

SEQ ID NO: 24042 - DNA, 15 bp, Artificial Sequence
  dgRNA
  Mypn
taaatgaaattccgt

SEQ ID NO: 24043 - DNA, 15 bp, Artificial Sequence
  dgRNA
  Mypn
gaccccagctcccgt

SEQ ID NO: 24044 - DNA, 15 bp, Artificial Sequence
  dgRNA
  Mypn
ggtgctgtcccgcaa

SEQ ID NO: 24045 - DNA, 15 bp, Artificial Sequence
  dgRNA
  Mypn
ttctcctgtccaatc

SEQ ID NO: 24046 - DNA, 15 bp, Artificial Sequence
  dgRNA
  Kbtbd8
gagaggcccttgccg

SEQ ID NO: 24047 - DNA, 15 bp, Artificial Sequence
  dgRNA
  Kbtbd8
aaatttccccggcaa

SEQ ID NO: 24048 - DNA, 15 bp, Artificial Sequence
  dgRNA
  Kbtbd8
caaatttccccggca

SEQ ID NO: 24049 - DNA, 15 bp, Artificial Sequence
  dgRNA
  Kbtbd8
cgaactgtcactctg

SEQ ID NO: 24050 - DNA, 15 bp, Artificial Sequence
  dgRNA
  Crxos
tcagagtagctactc

SEQ ID NO: 24051 - DNA, 15 bp, Artificial Sequence
  dgRNA
  Crxos
gggagggtcctaaat

SEQ ID NO: 24052 - DNA, 15 bp, Artificial Sequence
  dgRNA
  Crxos
agggtcctaaatagg

SEQ ID NO: 24053 - DNA, 15 bp, Artificial Sequence
  dgRNA
  Crxos
agtagctactctgag

SEQ ID NO: 24054 - DNA, 15 bp, Artificial Sequence
  dgRNA
  Zcrb1
cccctcgcgcctctg

SEQ ID NO: 24055 - DNA, 15 bp, Artificial Sequence
  dgRNA
  Zcrb1
cgccgcctcagccgc

SEQ ID NO: 24056 - DNA, 15 bp, Artificial Sequence
  dgRNA
  Zcrb1
gtccgctcgccctaa

SEQ ID NO: 24057 - DNA, 15 bp, Artificial Sequence
  dgRNA
  Zcrb1
cacttccggcgcgcg

SEQ ID NO: 24058 - DNA, 15 bp, Artificial Sequence
  dgRNA
  Mmp13
taccttcgcctcact

SEQ ID NO: 24059 - DNA, 15 bp, Artificial Sequence
  dgRNA
  Mmp13
ttgtggcagaatctg

SEQ ID NO: 24060 - DNA, 15 bp, Artificial Sequence
  dgRNA
  Mmp13
ttcctagtgaggcga

SEQ ID NO: 24061 - DNA, 15 bp, Artificial Sequence
  dgRNA
  Mmp13
tgagtcaccactttg

SEQ ID NO: 24062 - DNA, 15 bp, Artificial Sequence
  dgRNA
  Nol4l
ctcgctccccgtgcc

SEQ ID NO: 24063 - DNA, 15 bp, Artificial Sequence
  dgRNA
  Nol4l
tcgctccccgtgccc

SEQ ID NO: 24064 - DNA, 15 bp, Artificial Sequence
  dgRNA
  Nol4l
cgctccccgtgcccg

SEQ ID NO: 24065 - DNA, 15 bp, Artificial Sequence
  dgRNA
  Nol4l
tcccctggccgcccg

SEQ ID NO: 24066 - DNA, 15 bp, Artificial Sequence
  dgRNA
  Olfr874
gatttgtaatgatgg

SEQ ID NO: 24067 - DNA, 15 bp, Artificial Sequence
  dgRNA
  Gm10094
ttatttcgagggggc

SEQ ID NO: 24068 - DNA, 15 bp, Artificial Sequence
  dgRNA
  Gm10094
tatttcgagggggcg

SEQ ID NO: 24069 - DNA, 15 bp, Artificial Sequence
  dgRNA
  Gm10094
gttcattgcaaagtc

SEQ ID NO: 24070 - DNA, 15 bp, Artificial Sequence
  dgRNA
  Gm10094
cacagtacatccctc

SEQ ID NO: 24071 - DNA, 15 bp, Artificial Sequence
  dgRNA
  Cylc1
tagatgtattagtat

SEQ ID NO: 24072 - DNA, 15 bp, Artificial Sequence
  dgRNA
  Cylc1
tgtattagtataggg

SEQ ID NO: 24073 - DNA, 15 bp, Artificial Sequence
  dgRNA
  Ugt2b34
tgagcaatcatcctt

SEQ ID NO: 24074 - DNA, 15 bp, Artificial Sequence
  dgRNA
  Taar1
gagttagttgctgac

SEQ ID NO: 24075 - DNA, 15 bp, Artificial Sequence
  dgRNA
  Taar1
ccagaactcatagtc

SEQ ID NO: 24076 - DNA, 15 bp, Artificial Sequence
  dgRNA
  F10
gacaccaacagttca

SEQ ID NO: 24077 - DNA, 15 bp, Artificial Sequence
  dgRNA
  F10
gtgcttgatggccga

SEQ ID NO: 24078 - DNA, 15 bp, Artificial Sequence
  dgRNA
  F10
tcccgcaggcctgga

SEQ ID NO: 24079 - DNA, 15 bp, Artificial Sequence
  dgRNA
  F10
ttcccgcaggcctgg

SEQ ID NO: 24080 - DNA, 15 bp, Artificial Sequence
  dgRNA
  H2-Aa
tggttctggcgagtt

SEQ ID NO: 24081 - DNA, 15 bp, Artificial Sequence
  dgRNA
  H2-Aa
ctggcgagtttggtt

SEQ ID NO: 24082 - DNA, 15 bp, Artificial Sequence
  dgRNA
  H2-Aa
tggcgagtttggttt

SEQ ID NO: 24083 - DNA, 15 bp, Artificial Sequence
  dgRNA
  H2-Aa
agactttgtattagg

SEQ ID NO: 24084 - DNA, 15 bp, Artificial Sequence
  dgRNA
  Pcdh1
ccgcggcggtcctga

SEQ ID NO: 24085 - DNA, 15 bp, Artificial Sequence
  dgRNA
  Pcdh1
gcggtcctgaaggcg

SEQ ID NO: 24086 - DNA, 15 bp, Artificial Sequence
  dgRNA
  Pcdh1
cggtcctgaaggcga

SEQ ID NO: 24087 - DNA, 15 bp, Artificial Sequence
  dgRNA
  Pcdh1
ggcgagggacgcaag

SEQ ID NO: 24088 - DNA, 15 bp, Artificial Sequence
  dgRNA
  Samd14
tgttctgttcaacgg

SEQ ID NO: 24089 - DNA, 15 bp, Artificial Sequence
  dgRNA
  Samd14
ctgcttcagcgcccc

SEQ ID NO: 24090 - DNA, 15 bp, Artificial Sequence
  dgRNA
  Samd14
ttcagcgccccaggc

SEQ ID NO: 24091 - DNA, 15 bp, Artificial Sequence
  dgRNA
  Samd14
ggctggccgctcgcc

SEQ ID NO: 24092 - DNA, 15 bp, Artificial Sequence
  dgRNA
  Arrb2
ggggaggcttccccg

SEQ ID NO: 24093 - DNA, 15 bp, Artificial Sequence
  dgRNA
  Arrb2
gggaggcttccccga

SEQ ID NO: 24094 - DNA, 15 bp, Artificial Sequence
  dgRNA
  Arrb2
cttccccgagggaaa

SEQ ID NO: 24095 - DNA, 15 bp, Artificial Sequence
  dgRNA
  Arrb2
ccccgagggaaacgg

SEQ ID NO: 24096 - DNA, 15 bp, Artificial Sequence
  dgRNA
  B2m
actggtgacgacctc

SEQ ID NO: 24097 - DNA, 15 bp, Artificial Sequence
  dgRNA
  B2m
ctccggatctgagtc

SEQ ID NO: 24098 - DNA, 15 bp, Artificial Sequence
  dgRNA
  B2m
gatctgagtccggat

SEQ ID NO: 24099 - DNA, 15 bp, Artificial Sequence
  dgRNA
  B2m
taagagcgcgcgccc

SEQ ID NO: 24100 - DNA, 15 bp, Artificial Sequence
  dgRNA
  Crem
tacgccccgtcccca

SEQ ID NO: 24101 - DNA, 15 bp, Artificial Sequence
  dgRNA
  Crem
ccgctgactgccagc

SEQ ID NO: 24102 - DNA, 15 bp, Artificial Sequence
  dgRNA
  Crem
cgctgactgccagca

SEQ ID NO: 24103 - DNA, 15 bp, Artificial Sequence
  dgRNA
  Crem
ccagtccccttagag

SEQ ID NO: 24104 - DNA, 15 bp, Artificial Sequence
  dgRNA
  Commd9
tgagcttagtcatac

SEQ ID NO: 24105 - DNA, 15 bp, Artificial Sequence
  dgRNA
  Commd9
gcttagtcatacagg

SEQ ID NO: 24106 - DNA, 15 bp, Artificial Sequence
  dgRNA
  Commd9
cgttcccgccagcca

SEQ ID NO: 24107 - DNA, 15 bp, Artificial Sequence
  dgRNA
  Commd9
ccagcatgtcctgcg

SEQ ID NO: 24108 - DNA, 15 bp, Artificial Sequence
  dgRNA
  Slc16a8
ggttttgtgccccag

SEQ ID NO: 24109 - DNA, 15 bp, Artificial Sequence
  dgRNA
  Slc16a8
ttttaagccccagcc

SEQ ID NO: 24110 - DNA, 15 bp, Artificial Sequence
  dgRNA
  Slc16a8
tcacaatctggggat

SEQ ID NO: 24111 - DNA, 15 bp, Artificial Sequence
  dgRNA
  Slc16a8
aggggtcacaatctg

SEQ ID NO: 24112 - DNA, 15 bp, Artificial Sequence
  dgRNA
  Glul
gctcgccccaccctg

SEQ ID NO: 24113 - DNA, 15 bp, Artificial Sequence
  dgRNA
  Glul
tcccgcacagttcct

SEQ ID NO: 24114 - DNA, 15 bp, Artificial Sequence
  dgRNA
  Glul
cagttcctcggccaa

SEQ ID NO: 24115 - DNA, 15 bp, Artificial Sequence
  dgRNA
  Glul
tcggccaatggcctc

SEQ ID NO: 24116 - DNA, 15 bp, Artificial Sequence
  dgRNA
  Slc45a2
attctaaggaccccg

SEQ ID NO: 24117 - DNA, 15 bp, Artificial Sequence
  dgRNA
  Slc45a2
ttctaaggaccccga

SEQ ID NO: 24118 - DNA, 15 bp, Artificial Sequence
  dgRNA
  Slc45a2
cgtaacttgtgatct

SEQ ID NO: 24119 - DNA, 15 bp, Artificial Sequence
  dgRNA
  Slc45a2
aacttgtgatcttgg

SEQ ID NO: 24120 - DNA, 15 bp, Artificial Sequence
  dgRNA
  Ces1b
tcctaacaaatacct

SEQ ID NO: 24121 - DNA, 15 bp, Artificial Sequence
  dgRNA
  Ces1b
cccaaggtatttgtt

SEQ ID NO: 24122 - DNA, 15 bp, Artificial Sequence
  dgRNA
  Chmp4b
gcgccatagtacgcc

SEQ ID NO: 24123 - DNA, 15 bp, Artificial Sequence
  dgRNA
  Chmp4b
tagtacgccaggagc

SEQ ID NO: 24124 - DNA, 15 bp, Artificial Sequence
  dgRNA
  Chmp4b
ccggcttgcagcgcg

SEQ ID NO: 24125 - DNA, 15 bp, Artificial Sequence
  dgRNA
  Chmp4b
ctcccttagactcga

SEQ ID NO: 24126 - DNA, 15 bp, Artificial Sequence
  dgRNA
  Dpy19l1
acccgagagcggcaa

SEQ ID NO: 24127 - DNA, 15 bp, Artificial Sequence
  dgRNA
  Dpy19l1
cgagagcggcaacgg

SEQ ID NO: 24128 - DNA, 15 bp, Artificial Sequence
  dgRNA
  Dpy19l1
gcaacggcggaggcg

SEQ ID NO: 24129 - DNA, 15 bp, Artificial Sequence
  dgRNA
  Dpy19l1
caacggcggaggcgc

SEQ ID NO: 24130 - DNA, 15 bp, Artificial Sequence
  dgRNA
  Olfr509
cttaaacctactttt

SEQ ID NO: 24131 - DNA, 15 bp, Artificial Sequence
  dgRNA
  Olfr509
taaacctactttttg

SEQ ID NO: 24132 - DNA, 15 bp, Artificial Sequence
  dgRNA
  Kbtbd12
cggccgcttcccgcg

SEQ ID NO: 24133 - DNA, 15 bp, Artificial Sequence
  dgRNA
  Kbtbd12
ccgcttcccgcgcgg

SEQ ID NO: 24134 - DNA, 15 bp, Artificial Sequence
  dgRNA
  Kbtbd12
gcacctgttacctct

SEQ ID NO: 24135 - DNA, 15 bp, Artificial Sequence
  dgRNA
  Kbtbd12
ctcctcgtcctcgct

SEQ ID NO: 24136 - DNA, 15 bp, Artificial Sequence
  dgRNA
  Elovl1
ccaagccatagtcat

SEQ ID NO: 24137 - DNA, 15 bp, Artificial Sequence
  dgRNA
  Elovl1
agccatagtcatcgg

SEQ ID NO: 24138 - DNA, 15 bp, Artificial Sequence
  dgRNA
  Elovl1
gccatagtcatcggc

SEQ ID NO: 24139 - DNA, 15 bp, Artificial Sequence
  dgRNA
  Elovl1
agtcatcggcgggac

SEQ ID NO: 24140 - DNA, 15 bp, Artificial Sequence
  dgRNA
  Slc28a2
aagctcctcccctag

SEQ ID NO: 24141 - DNA, 15 bp, Artificial Sequence
  dgRNA
  Slc28a2
ggtggcccttttcag

SEQ ID NO: 24142 - DNA, 15 bp, Artificial Sequence
  dgRNA
  Slc28a2
aaagggccacctcta

SEQ ID NO: 24143 - DNA, 15 bp, Artificial Sequence
  dgRNA
  Slc28a2
aaaagggccacctct

SEQ ID NO: 24144 - DNA, 15 bp, Artificial Sequence
  dgRNA
  Zfp607
gttactagtagaacc

SEQ ID NO: 24145 - DNA, 15 bp, Artificial Sequence
  dgRNA
  Zfp607
aactattttgatcac

SEQ ID NO: 24146 - DNA, 15 bp, Artificial Sequence
  dgRNA
  Zfp607
cctcccctttaaagt

SEQ ID NO: 24147 - DNA, 15 bp, Artificial Sequence
  dgRNA
  Zfp607
ctcccctttaaagtc

SEQ ID NO: 24148 - DNA, 15 bp, Artificial Sequence
  dgRNA
  Tspan6
tcagtaacgatcagt

SEQ ID NO: 24149 - DNA, 15 bp, Artificial Sequence
  dgRNA
  Tspan6
cagtaacgatcagta

SEQ ID NO: 24150 - DNA, 15 bp, Artificial Sequence
  dgRNA
  Tspan6
agtaacgatcagtag

SEQ ID NO: 24151 - DNA, 15 bp, Artificial Sequence
  dgRNA
  Tspan6
gtaacgatcagtagg

SEQ ID NO: 24152 - DNA, 15 bp, Artificial Sequence
  dgRNA
  Rps11
atctcgcgagatgat

SEQ ID NO: 24153 - DNA, 15 bp, Artificial Sequence
  dgRNA
  Rps11
agtcctcccccgtca

SEQ ID NO: 24154 - DNA, 15 bp, Artificial Sequence
  dgRNA
  Rps11
cctcccccgtcatgg

SEQ ID NO: 24155 - DNA, 15 bp, Artificial Sequence
  dgRNA
  Rps11
cgtcatggcggcgta

SEQ ID NO: 24156 - DNA, 15 bp, Artificial Sequence
  dgRNA
  Chrdl1
ggcccgcaggagtga

SEQ ID NO: 24157 - DNA, 15 bp, Artificial Sequence
  dgRNA
  Chrdl1
caggacacgcagcat

SEQ ID NO: 24158 - DNA, 15 bp, Artificial Sequence
  dgRNA
  Chrdl1
gacacgcagcatagg

SEQ ID NO: 24159 - DNA, 15 bp, Artificial Sequence
  dgRNA
  Chrdl1
gttgcagaagatgcg

SEQ ID NO: 24160 - DNA, 15 bp, Artificial Sequence
  dgRNA
  1810030O07Rik
catcaggaggggatc

SEQ ID NO: 24161 - DNA, 15 bp, Artificial Sequence
  dgRNA
  1810030O07Rik
atcaggttggttaga

SEQ ID NO: 24162 - DNA, 15 bp, Artificial Sequence
  dgRNA
  1810030O07Rik
gttggcagggtattc

SEQ ID NO: 24163 - DNA, 15 bp, Artificial Sequence
  dgRNA
  1810030O07Rik
agcggttcctttaag

SEQ ID NO: 24164 - DNA, 15 bp, Artificial Sequence
  dgRNA
  Mcrs1
ctgcgttttccaaca

SEQ ID NO: 24165 - DNA, 15 bp, Artificial Sequence
  dgRNA
  Mcrs1
acacggaaacctccg

SEQ ID NO: 24166 - DNA, 15 bp, Artificial Sequence
  dgRNA
  Mcrs1
ataattaacactgcc

SEQ ID NO: 24167 - DNA, 15 bp, Artificial Sequence
  dgRNA
  Mcrs1
agcgcttctgccaac

SEQ ID NO: 24168 - DNA, 15 bp, Artificial Sequence
  dgRNA
  Atp5c1
gctacaactacaaag

SEQ ID NO: 24169 - DNA, 15 bp, Artificial Sequence
  dgRNA
  Atp5c1
caactacaaagcggt

SEQ ID NO: 24170 - DNA, 15 bp, Artificial Sequence
  dgRNA
  Atp5c1
caaagcggtcggaag

SEQ ID NO: 24171 - DNA, 15 bp, Artificial Sequence
  dgRNA
  Atp5c1
ggtcggaagcggaac

SEQ ID NO: 24172 - DNA, 15 bp, Artificial Sequence
  dgRNA
  Plxnb2
cccttgggcctacca

SEQ ID NO: 24173 - DNA, 15 bp, Artificial Sequence
  dgRNA
  Plxnb2
accacttctaggaga

SEQ ID NO: 24174 - DNA, 15 bp, Artificial Sequence
  dgRNA
  Plxnb2
gagaagggctattat

SEQ ID NO: 24175 - DNA, 15 bp, Artificial Sequence
  dgRNA
  Plxnb2
ggccagagtattggg

SEQ ID NO: 24176 - DNA, 15 bp, Artificial Sequence
  dgRNA
  Casc3
cgcccgccggggcta

SEQ ID NO: 24177 - DNA, 15 bp, Artificial Sequence
  dgRNA
  Casc3
gcccgccggggctag

SEQ ID NO: 24178 - DNA, 15 bp, Artificial Sequence
  dgRNA
  Casc3
gggaaataaagcgct

SEQ ID NO: 24179 - DNA, 15 bp, Artificial Sequence
  dgRNA
  Casc3
cagaaaacgtgccgc

SEQ ID NO: 24180 - DNA, 15 bp, Artificial Sequence
  dgRNA
  Dcp1a
gagtcaggttcattc

SEQ ID NO: 24181 - DNA, 15 bp, Artificial Sequence
  dgRNA
  Dcp1a
agtcaggttcattca

SEQ ID NO: 24182 - DNA, 15 bp, Artificial Sequence
  dgRNA
  Dcp1a
ggttcacaccccgcc

SEQ ID NO: 24183 - DNA, 15 bp, Artificial Sequence
  dgRNA
  Dcp1a
cccgccaggtgagag

SEQ ID NO: 24184 - DNA, 15 bp, Artificial Sequence
  dgRNA
  Utp20
gcacgactgacaatc

SEQ ID NO: 24185 - DNA, 15 bp, Artificial Sequence
  dgRNA
  Utp20
aagagcacgcatgct

SEQ ID NO: 24186 - DNA, 15 bp, Artificial Sequence
  dgRNA
  Utp20
cagtcgtgcagtttg

SEQ ID NO: 24187 - DNA, 15 bp, Artificial Sequence
  dgRNA
  Utp20
tcatgtgggcggaag

SEQ ID NO: 24188 - DNA, 15 bp, Artificial Sequence
  dgRNA
  Gar1
agctgttagcacgga

SEQ ID NO: 24189 - DNA, 15 bp, Artificial Sequence
  dgRNA
  Gar1
gcgccgccacacttc

SEQ ID NO: 24190 - DNA, 15 bp, Artificial Sequence
  dgRNA
  Gar1
cggaaacgtcgcgta

SEQ ID NO: 24191 - DNA, 15 bp, Artificial Sequence
  dgRNA
  Gar1
aaacgtcgcgtacgg

SEQ ID NO: 24192 - DNA, 15 bp, Artificial Sequence
  dgRNA
  Xylb
gggattatattaggt

SEQ ID NO: 24193 - DNA, 15 bp, Artificial Sequence
  dgRNA
  Xylb
atattaggtcggcgc

SEQ ID NO: 24194 - DNA, 15 bp, Artificial Sequence
  dgRNA
  Xylb
tattaggtcggcgca

SEQ ID NO: 24195 - DNA, 15 bp, Artificial Sequence
  dgRNA
  Xylb
attaggtcggcgcag

SEQ ID NO: 24196 - DNA, 15 bp, Artificial Sequence
  dgRNA
  Olfr1289
aggagtctagtacca

SEQ ID NO: 24197 - DNA, 15 bp, Artificial Sequence
  dgRNA
  Olfr1289
tagcaagaccttaat

SEQ ID NO: 24198 - DNA, 15 bp, Artificial Sequence
  dgRNA
  Maged2
aatgaatcgttttcg

SEQ ID NO: 24199 - DNA, 15 bp, Artificial Sequence
  dgRNA
  Maged2
atgaatcgttttcgt

SEQ ID NO: 24200 - DNA, 15 bp, Artificial Sequence
  dgRNA
  Maged2
tgaatcgttttcgtg

SEQ ID NO: 24201 - DNA, 15 bp, Artificial Sequence
  dgRNA
  Maged2
gaatcgttttcgtgg

SEQ ID NO: 24202 - DNA, 15 bp, Artificial Sequence
  dgRNA
  Rab37
aggctaatgtctctc

SEQ ID NO: 24203 - DNA, 15 bp, Artificial Sequence
  dgRNA
  Rab37
ctaatgtctctcagg

SEQ ID NO: 24204 - DNA, 15 bp, Artificial Sequence
  dgRNA
  Rab37
gagtctcagacgtcc

SEQ ID NO: 24205 - DNA, 15 bp, Artificial Sequence
  dgRNA
  Rab37
ctcagacgtcctggc

SEQ ID NO: 24206 - DNA, 15 bp, Artificial Sequence
  dgRNA
  Gm13030
tggttcctacggctc

SEQ ID NO: 24207 - DNA, 15 bp, Artificial Sequence
  dgRNA
  Gm13030
caatggtggttccta

SEQ ID NO: 24208 - DNA, 15 bp, Artificial Sequence
  dgRNA
  Gm13030
aaggggttggtagtc

SEQ ID NO: 24209 - DNA, 15 bp, Artificial Sequence
  dgRNA
  Gm13030
ttatgaataaggggt

SEQ ID NO: 24210 - DNA, 15 bp, Artificial Sequence
  dgRNA
  Fam192a
tgtcacgtgatctcg

SEQ ID NO: 24211 - DNA, 15 bp, Artificial Sequence
  dgRNA
  Fam192a
gtcacgtgatctcgc

SEQ ID NO: 24212 - DNA, 15 bp, Artificial Sequence
  dgRNA
  Fam192a
cgtgatctcgcgggt

SEQ ID NO: 24213 - DNA, 15 bp, Artificial Sequence
  dgRNA
  Fam192a
gtcggcccgccagcc

SEQ ID NO: 24214 - DNA, 15 bp, Artificial Sequence
  dgRNA
  Olfr316
gtacatgtattaaac

SEQ ID NO: 24215 - DNA, 15 bp, Artificial Sequence
  dgRNA
  Olfr316
ctattattgcagaac

SEQ ID NO: 24216 - DNA, 15 bp, Artificial Sequence
  dgRNA
  Dtx2
catcagtgattagcg

SEQ ID NO: 24217 - DNA, 15 bp, Artificial Sequence
  dgRNA
  Dtx2
aggcactgcgtgagg

SEQ ID NO: 24218 - DNA, 15 bp, Artificial Sequence
  dgRNA
  Dtx2
tggacatgcgcagcg

SEQ ID NO: 24219 - DNA, 15 bp, Artificial Sequence
  dgRNA
  Dtx2
gcgcagcgcggtgct

SEQ ID NO: 24220 - DNA, 15 bp, Artificial Sequence
  dgRNA
  Zfp512b
cgtgcctcagtttac

SEQ ID NO: 24221 - DNA, 15 bp, Artificial Sequence
  dgRNA
  Zfp512b
agcgactcttgccca

SEQ ID NO: 24222 - DNA, 15 bp, Artificial Sequence
  dgRNA
  Zfp512b
gcgtgaccgatcgct

SEQ ID NO: 24223 - DNA, 15 bp, Artificial Sequence
  dgRNA
  Zfp512b
ccgatcgctcggccc

SEQ ID NO: 24224 - DNA, 15 bp, Artificial Sequence
  dgRNA
  Pfkp
cgactccacctctca

SEQ ID NO: 24225 - DNA, 15 bp, Artificial Sequence
  dgRNA
  Pfkp
agtctttgacacaac

SEQ ID NO: 24226 - DNA, 15 bp, Artificial Sequence
  dgRNA
  Pfkp
atcgccacagcccat

SEQ ID NO: 24227 - DNA, 15 bp, Artificial Sequence
  dgRNA
  Pfkp
cagcccattggcgct

SEQ ID NO: 24228 - DNA, 15 bp, Artificial Sequence
  dgRNA
  Acmsd
gttaccaaagaatgc

SEQ ID NO: 24229 - DNA, 15 bp, Artificial Sequence
  dgRNA
  Acmsd
tcttgaactttaata

SEQ ID NO: 24230 - DNA, 15 bp, Artificial Sequence
  dgRNA
  Acmsd
ttgacatgaaccaac

SEQ ID NO: 24231 - DNA, 15 bp, Artificial Sequence
  dgRNA
  Acmsd
ctgacgggtacctga

SEQ ID NO: 24232 - DNA, 15 bp, Artificial Sequence
  dgRNA
  Higd1a
gcctacctctctcag

SEQ ID NO: 24233 - DNA, 15 bp, Artificial Sequence
  dgRNA
  Higd1a
ctacgctgagagtct

SEQ ID NO: 24234 - DNA, 15 bp, Artificial Sequence
  dgRNA
  Higd1a
agacacgtcccatag

SEQ ID NO: 24235 - DNA, 15 bp, Artificial Sequence
  dgRNA
  Higd1a
gacacgtcccatagt

SEQ ID NO: 24236 - DNA, 15 bp, Artificial Sequence
  dgRNA
  Wdfy2
aagtaaaggactgcg

SEQ ID NO: 24237 - DNA, 15 bp, Artificial Sequence
  dgRNA
  Wdfy2
cagcactgcgggcct

SEQ ID NO: 24238 - DNA, 15 bp, Artificial Sequence
  dgRNA
  Wdfy2
ggcctcggttactta

SEQ ID NO: 24239 - DNA, 15 bp, Artificial Sequence
  dgRNA
  Wdfy2
gcctcggttacttac

SEQ ID NO: 24240 - DNA, 15 bp, Artificial Sequence
  dgRNA
  Slc7a7
tggctattcccgagc

SEQ ID NO: 24241 - DNA, 15 bp, Artificial Sequence
  dgRNA
  Slc7a7
ggctattcccgagca

SEQ ID NO: 24242 - DNA, 15 bp, Artificial Sequence
  dgRNA
  Slc7a7
tattcccgagcaggg

SEQ ID NO: 24243 - DNA, 15 bp, Artificial Sequence
  dgRNA
  Slc7a7
ctgtgcatccgtagc

SEQ ID NO: 24244 - DNA, 15 bp, Artificial Sequence
  dgRNA
  Kif9
tactctaagccttcc

SEQ ID NO: 24245 - DNA, 15 bp, Artificial Sequence
  dgRNA
  Kif9
tttaacggagaaatg

SEQ ID NO: 24246 - DNA, 15 bp, Artificial Sequence
  dgRNA
  Kif9
ttaacggagaaatgt

SEQ ID NO: 24247 - DNA, 15 bp, Artificial Sequence
  dgRNA
  Kif9
ttccgtaatccctgc

SEQ ID NO: 24248 - DNA, 15 bp, Artificial Sequence
  dgRNA
  Fbxo15
gattccaacagatct

SEQ ID NO: 24249 - DNA, 15 bp, Artificial Sequence
  dgRNA
  Slc25a53
acgaaggtagtggcg

SEQ ID NO: 24250 - DNA, 15 bp, Artificial Sequence
  dgRNA
  Slc25a53
caatcagctgttcgc

SEQ ID NO: 24251 - DNA, 15 bp, Artificial Sequence
  dgRNA
  Slc25a53
aatcagctgttcgca

SEQ ID NO: 24252 - DNA, 15 bp, Artificial Sequence
  dgRNA
  Slc25a53
atcagctgttcgcag

SEQ ID NO: 24253 - DNA, 15 bp, Artificial Sequence
  dgRNA
  Limch1
cccgggaaggacgcc

SEQ ID NO: 24254 - DNA, 15 bp, Artificial Sequence
  dgRNA
  Limch1
gacgcccggagctcc

SEQ ID NO: 24255 - DNA, 15 bp, Artificial Sequence
  dgRNA
  Limch1
aggggacgaagcggc

SEQ ID NO: 24256 - DNA, 15 bp, Artificial Sequence
  dgRNA
  Limch1
acgaagcggcgggcc

SEQ ID NO: 24257 - DNA, 15 bp, Artificial Sequence
  dgRNA
  Arhgef2
gacttcctgtccccg

SEQ ID NO: 24258 - DNA, 15 bp, Artificial Sequence
  dgRNA
  Arhgef2
cgaggccgacgcgtg

SEQ ID NO: 24259 - DNA, 15 bp, Artificial Sequence
  dgRNA
  Arhgef2
gccgacgcgtgcggc

SEQ ID NO: 24260 - DNA, 15 bp, Artificial Sequence
  dgRNA
  Arhgef2
ctcccccgccgttgc

SEQ ID NO: 24261 - DNA, 15 bp, Artificial Sequence
  dgRNA
  Gale
atgtcctacatatgc

SEQ ID NO: 24262 - DNA, 15 bp, Artificial Sequence
  dgRNA
  Gale
ggccctcctaataca

SEQ ID NO: 24263 - DNA, 15 bp, Artificial Sequence
  dgRNA
  Gale
ccctcctaatacatg

SEQ ID NO: 24264 - DNA, 15 bp, Artificial Sequence
  dgRNA
  Gale
accccatgtattagg

SEQ ID NO: 24265 - DNA, 15 bp, Artificial Sequence
  dgRNA
  Zmiz1
cagcgagcgcgcaga

SEQ ID NO: 24266 - DNA, 15 bp, Artificial Sequence
  dgRNA
  Zmiz1
atggagagcgaacca

SEQ ID NO: 24267 - DNA, 15 bp, Artificial Sequence
  dgRNA
  Zmiz1
agcagagctgcgcgc

SEQ ID NO: 24268 - DNA, 15 bp, Artificial Sequence
  dgRNA
  Zmiz1
agagctgcgcgccgg

SEQ ID NO: 24269 - DNA, 15 bp, Artificial Sequence
  dgRNA
  Tmem110
gctagagccccgccc

SEQ ID NO: 24270 - DNA, 15 bp, Artificial Sequence
  dgRNA
  Tmem110
agagccccgccccgg

SEQ ID NO: 24271 - DNA, 15 bp, Artificial Sequence
  dgRNA
  Tmem110
gagccccgccccgga

SEQ ID NO: 24272 - DNA, 15 bp, Artificial Sequence
  dgRNA
  Tmem110
agcccgcctcacgcc

SEQ ID NO: 24273 - DNA, 15 bp, Artificial Sequence
  dgRNA
  Rad23b
tgcgcctgcgcacgc

SEQ ID NO: 24274 - DNA, 15 bp, Artificial Sequence
  dgRNA
  Rad23b
cccgcctccaattcc

SEQ ID NO: 24275 - DNA, 15 bp, Artificial Sequence
  dgRNA
  Rad23b
ccgcctccaattccc

SEQ ID NO: 24276 - DNA, 15 bp, Artificial Sequence
  dgRNA
  Rad23b
cctccaattcccggg

SEQ ID NO: 24277 - DNA, 15 bp, Artificial Sequence
  dgRNA
  Phka2
ctccaaaccccacgg

SEQ ID NO: 24278 - DNA, 15 bp, Artificial Sequence
  dgRNA
  Phka2
caaaccccacggagg

SEQ ID NO: 24279 - DNA, 15 bp, Artificial Sequence
  dgRNA
  Phka2
acggaggaggcggac

SEQ ID NO: 24280 - DNA, 15 bp, Artificial Sequence
  dgRNA
  Phka2
cggaggaggcggact

SEQ ID NO: 24281 - DNA, 15 bp, Artificial Sequence
  dgRNA
  Mbtps1
ccagagagggcgatt

SEQ ID NO: 24282 - DNA, 15 bp, Artificial Sequence
  dgRNA
  Mbtps1
atttggcctcgccct

SEQ ID NO: 24283 - DNA, 15 bp, Artificial Sequence
  dgRNA
  Mbtps1
cacagcctctcgcct

SEQ ID NO: 24284 - DNA, 15 bp, Artificial Sequence
  dgRNA
  Mbtps1
tctcgcctcggtgcc

SEQ ID NO: 24285 - DNA, 15 bp, Artificial Sequence
  dgRNA
  Asph
tcgcgagagtcctgc

SEQ ID NO: 24286 - DNA, 15 bp, Artificial Sequence
  dgRNA
  Asph
aagccacaagccgct

SEQ ID NO: 24287 - DNA, 15 bp, Artificial Sequence
  dgRNA
  Asph
cctgccagcggtcct

SEQ ID NO: 24288 - DNA, 15 bp, Artificial Sequence
  dgRNA
  Asph
ctgccagcggtcctc

SEQ ID NO: 24289 - DNA, 15 bp, Artificial Sequence
  dgRNA
  Trim26
acaaccgtgacgcac

SEQ ID NO: 24290 - DNA, 15 bp, Artificial Sequence
  dgRNA
  Trim26
tccttttctcgggcc

SEQ ID NO: 24291 - DNA, 15 bp, Artificial Sequence
  dgRNA
  Trim26
tctttggccgctgcc

SEQ ID NO: 24292 - DNA, 15 bp, Artificial Sequence
  dgRNA
  Trim26
tttggccgctgcctg

SEQ ID NO: 24293 - DNA, 15 bp, Artificial Sequence
  dgRNA
  Golga7b
tgacctgtcaatgac

SEQ ID NO: 24294 - DNA, 15 bp, Artificial Sequence
  dgRNA
  Golga7b
ccaaacccatgtgac

SEQ ID NO: 24295 - DNA, 15 bp, Artificial Sequence
  dgRNA
  Golga7b
aggctagggtttagt

SEQ ID NO: 24296 - DNA, 15 bp, Artificial Sequence
  dgRNA
  Golga7b
aaggctagggtttag

SEQ ID NO: 24297 - DNA, 15 bp, Artificial Sequence
  dgRNA
  Scnn1g
ggcactgcggggtcg

SEQ ID NO: 24298 - DNA, 15 bp, Artificial Sequence
  dgRNA
  Scnn1g
ggtcgcggccttctc

SEQ ID NO: 24299 - DNA, 15 bp, Artificial Sequence
  dgRNA
  Scnn1g
gtcgcggccttctcc

SEQ ID NO: 24300 - DNA, 15 bp, Artificial Sequence
  dgRNA
  Scnn1g
cgggctaagacaagt

SEQ ID NO: 24301 - DNA, 15 bp, Artificial Sequence
  dgRNA
  Apc
aacgaaataccgcag

SEQ ID NO: 24302 - DNA, 15 bp, Artificial Sequence
  dgRNA
  Apc
aaataccgcagaggc

SEQ ID NO: 24303 - DNA, 15 bp, Artificial Sequence
  dgRNA
  Apc
aataccgcagaggca

SEQ ID NO: 24304 - DNA, 15 bp, Artificial Sequence
  dgRNA
  Apc
tccaatccctcattc

SEQ ID NO: 24305 - DNA, 15 bp, Artificial Sequence
  dgRNA
  A930009A15Rik
tctagtacaacagtt

SEQ ID NO: 24306 - DNA, 15 bp, Artificial Sequence
  dgRNA
  A930009A15Rik
acaacagtttggtta

SEQ ID NO: 24307 - DNA, 15 bp, Artificial Sequence
  dgRNA
  A930009A15Rik
agtagtagatttctc

SEQ ID NO: 24308 - DNA, 15 bp, Artificial Sequence
  dgRNA
  A930009A15Rik
ctgttgtactagata

SEQ ID NO: 24309 - DNA, 15 bp, Artificial Sequence
  dgRNA
  Syne2
taggcacggaggcgg

SEQ ID NO: 24310 - DNA, 15 bp, Artificial Sequence
  dgRNA
  Syne2
tcgtgaacctgcgtt

SEQ ID NO: 24311 - DNA, 15 bp, Artificial Sequence
  dgRNA
  Syne2
ctgcaagggtctgta

SEQ ID NO: 24312 - DNA, 15 bp, Artificial Sequence
  dgRNA
  Syne2
caagggtctgtaagg

SEQ ID NO: 24313 - DNA, 15 bp, Artificial Sequence
  dgRNA
  Olfr805
ttactaaggatatgg

SEQ ID NO: 24314 - DNA, 15 bp, Artificial Sequence
  dgRNA
  Vmn1r30
tagggggtacacgga

SEQ ID NO: 24315 - DNA, 15 bp, Artificial Sequence
  dgRNA
  Tekt1
ccagtagtaatgcaa

SEQ ID NO: 24316 - DNA, 15 bp, Artificial Sequence
  dgRNA
  Tekt1
aacacgatgaaacaa

SEQ ID NO: 24317 - DNA, 15 bp, Artificial Sequence
  dgRNA
  Tekt1
ttggcgctgtctgtg

SEQ ID NO: 24318 - DNA, 15 bp, Artificial Sequence
  dgRNA
  Tekt1
attactactggaaat

SEQ ID NO: 24319 - DNA, 15 bp, Artificial Sequence
  dgRNA
  Vmo1
gggccgcaaatcttc

SEQ ID NO: 24320 - DNA, 15 bp, Artificial Sequence
  dgRNA
  Vmo1
ggccgcaaatcttca

SEQ ID NO: 24321 - DNA, 15 bp, Artificial Sequence
  dgRNA
  Vmo1
aatcttgatagggcc

SEQ ID NO: 24322 - DNA, 15 bp, Artificial Sequence
  dgRNA
  Vmo1
cggcccccaggagtt

SEQ ID NO: 24323 - DNA, 15 bp, Artificial Sequence
  dgRNA
  Ercc5
tgtcaagtgtcaacg

SEQ ID NO: 24324 - DNA, 15 bp, Artificial Sequence
  dgRNA
  Ercc5
gtcaagtgtcaacgc

SEQ ID NO: 24325 - DNA, 15 bp, Artificial Sequence
  dgRNA
  Ercc5
accctcgcgttcact

SEQ ID NO: 24326 - DNA, 15 bp, Artificial Sequence
  dgRNA
  Ercc5
agaggtttcatcgtt

SEQ ID NO: 24327 - DNA, 15 bp, Artificial Sequence
  dgRNA
  Gng8
cgttccttttcattc

SEQ ID NO: 24328 - DNA, 15 bp, Artificial Sequence
  dgRNA
  Gng8
gtgttgaatggggcg

SEQ ID NO: 24329 - DNA, 15 bp, Artificial Sequence
  dgRNA
  Prl3d2
tgctaataatcctta

SEQ ID NO: 24330 - DNA, 15 bp, Artificial Sequence
  dgRNA
  Nsun2
gagattcacgctcag

SEQ ID NO: 24331 - DNA, 15 bp, Artificial Sequence
  dgRNA
  Nsun2
gctcagtggcgttta

SEQ ID NO: 24332 - DNA, 15 bp, Artificial Sequence
  dgRNA
  Nsun2
aaacacgttctctat

SEQ ID NO: 24333 - DNA, 15 bp, Artificial Sequence
  dgRNA
  Nsun2
tgcgtgagttctcgg

SEQ ID NO: 24334 - DNA, 15 bp, Artificial Sequence
  dgRNA
  Itpa
acgtaaaagactgct

SEQ ID NO: 24335 - DNA, 15 bp, Artificial Sequence
  dgRNA
  Itpa
cttaagttcgcagtg

SEQ ID NO: 24336 - DNA, 15 bp, Artificial Sequence
  dgRNA
  Itpa
gttcgcagtgaggtt

SEQ ID NO: 24337 - DNA, 15 bp, Artificial Sequence
  dgRNA
  Itpa
ttcggatagactccc

SEQ ID NO: 24338 - DNA, 15 bp, Artificial Sequence
  dgRNA
  Ms4a6c
ggcttcaagtggagc

SEQ ID NO: 24339 - DNA, 15 bp, Artificial Sequence
  dgRNA
  Ms4a6c
gagctggtgcgtgtt

SEQ ID NO: 24340 - DNA, 15 bp, Artificial Sequence
  dgRNA
  Nup210
ccagagacgggcgcg

SEQ ID NO: 24341 - DNA, 15 bp, Artificial Sequence
  dgRNA
  Nup210
acgggcgcgcggcag

SEQ ID NO: 24342 - DNA, 15 bp, Artificial Sequence
  dgRNA
  Nup210
cgcggcagaggcctt

SEQ ID NO: 24343 - DNA, 15 bp, Artificial Sequence
  dgRNA
  Nup210
ttaggccacgcgcta

SEQ ID NO: 24344 - DNA, 15 bp, Artificial Sequence
  dgRNA
  Ugt2b36
ctctggggtattcaa

SEQ ID NO: 24345 - DNA, 15 bp, Artificial Sequence
  dgRNA
  Ugt2b36
tctggggtattcaaa

SEQ ID NO: 24346 - DNA, 15 bp, Artificial Sequence
  dgRNA
  Ugt2b36
ctggggtattcaaag

SEQ ID NO: 24347 - DNA, 15 bp, Artificial Sequence
  dgRNA
  Tead4
aagcggtggcggatc

SEQ ID NO: 24348 - DNA, 15 bp, Artificial Sequence
  dgRNA
  Tead4
agcggtggcggatct

SEQ ID NO: 24349 - DNA, 15 bp, Artificial Sequence
  dgRNA
  Tead4
cctccgtagcagcct

SEQ ID NO: 24350 - DNA, 15 bp, Artificial Sequence
  dgRNA
  Tead4
ctccgtagcagcctc

SEQ ID NO: 24351 - DNA, 15 bp, Artificial Sequence
  dgRNA
  H2-T24
gggctcactccccct

SEQ ID NO: 24352 - DNA, 15 bp, Artificial Sequence
  dgRNA
  H2-T24
ggctcactcccccta

SEQ ID NO: 24353 - DNA, 15 bp, Artificial Sequence
  dgRNA
  H2-T24
gctcactccccctag

SEQ ID NO: 24354 - DNA, 15 bp, Artificial Sequence
  dgRNA
  H2-T24
aagccttcatcctag

SEQ ID NO: 24355 - DNA, 15 bp, Artificial Sequence
  dgRNA
  Brat1
aatttgcggagggga

SEQ ID NO: 24356 - DNA, 15 bp, Artificial Sequence
  dgRNA
  Brat1
acaccggaacctcag

SEQ ID NO: 24357 - DNA, 15 bp, Artificial Sequence
  dgRNA
  Brat1
caccggaacctcagc

SEQ ID NO: 24358 - DNA, 15 bp, Artificial Sequence
  dgRNA
  Brat1
gaacctcagcgggcg

SEQ ID NO: 24359 - DNA, 15 bp, Artificial Sequence
  dgRNA
  Cdt1
ggccgctcccattct

SEQ ID NO: 24360 - DNA, 15 bp, Artificial Sequence
  dgRNA
  Cdt1
aatccaaagctgccg

SEQ ID NO: 24361 - DNA, 15 bp, Artificial Sequence
  dgRNA
  Cdt1
atccaaagctgccgc

SEQ ID NO: 24362 - DNA, 15 bp, Artificial Sequence
  dgRNA
  Cdt1
tccaaagctgccgcg

SEQ ID NO: 24363 - DNA, 15 bp, Artificial Sequence
  dgRNA
  Tpd52
ctacagacctgctcg

SEQ ID NO: 24364 - DNA, 15 bp, Artificial Sequence
  dgRNA
  Tpd52
tacagacctgctcgt

SEQ ID NO: 24365 - DNA, 15 bp, Artificial Sequence
  dgRNA
  Tpd52
gagccggagccacgc

SEQ ID NO: 24366 - DNA, 15 bp, Artificial Sequence
  dgRNA
  Tpd52
agccggagccacgcc

SEQ ID NO: 24367 - DNA, 15 bp, Artificial Sequence
  dgRNA
  Col7a1
ccgcctcctgggatc

SEQ ID NO: 24368 - DNA, 15 bp, Artificial Sequence
  dgRNA
  Col7a1
cgcctcctgggatca

SEQ ID NO: 24369 - DNA, 15 bp, Artificial Sequence
  dgRNA
  Col7a1
cggcaggacttgctg

SEQ ID NO: 24370 - DNA, 15 bp, Artificial Sequence
  dgRNA
  Col7a1
ggacttgctgcggcg

SEQ ID NO: 24371 - DNA, 15 bp, Artificial Sequence
  dgRNA
  Fam76a
ccgaatcagagccgt

SEQ ID NO: 24372 - DNA, 15 bp, Artificial Sequence
  dgRNA
  Fam76a
cgaatcagagccgtc

SEQ ID NO: 24373 - DNA, 15 bp, Artificial Sequence
  dgRNA
  Fam76a
acgcgagccagcgaa

SEQ ID NO: 24374 - DNA, 15 bp, Artificial Sequence
  dgRNA
  Fam76a
acggcctctgagcac

SEQ ID NO: 24375 - DNA, 15 bp, Artificial Sequence
  dgRNA
  Mccc2
ttgtgacaaacgctt

SEQ ID NO: 24376 - DNA, 15 bp, Artificial Sequence
  dgRNA
  Mccc2
gacaaacgcttcggc

SEQ ID NO: 24377 - DNA, 15 bp, Artificial Sequence
  dgRNA
  Mccc2
tctgttcgctctact

SEQ ID NO: 24378 - DNA, 15 bp, Artificial Sequence
  dgRNA
  Mccc2
tcggcccagtgttcc

SEQ ID NO: 24379 - DNA, 15 bp, Artificial Sequence
  dgRNA
  Ngdn
gcgtttgacacattc

SEQ ID NO: 24380 - DNA, 15 bp, Artificial Sequence
  dgRNA
  Ngdn
cgtttgacacattca

SEQ ID NO: 24381 - DNA, 15 bp, Artificial Sequence
  dgRNA
  Ngdn
gcgtaaaggtgggcg

SEQ ID NO: 24382 - DNA, 15 bp, Artificial Sequence
  dgRNA
  Ngdn
ggcgtaaaggtgggc

SEQ ID NO: 24383 - DNA, 15 bp, Artificial Sequence
  dgRNA
  Add2
ggttattacgtgaga

SEQ ID NO: 24384 - DNA, 15 bp, Artificial Sequence
  dgRNA
  Add2
acgtgagatggaaca

SEQ ID NO: 24385 - DNA, 15 bp, Artificial Sequence
  dgRNA
  Add2
gcctttatctgaaca

SEQ ID NO: 24386 - DNA, 15 bp, Artificial Sequence
  dgRNA
  Add2
gcccacccctattct

SEQ ID NO: 24387 - DNA, 15 bp, Artificial Sequence
  dgRNA
  Oog2
ttgactccaagggtg

SEQ ID NO: 24388 - DNA, 15 bp, Artificial Sequence
  dgRNA
  Oog2
gtcaaatgaagcctc

SEQ ID NO: 24389 - DNA, 15 bp, Artificial Sequence
  dgRNA
  Oog2
ttgtagccacaccct

SEQ ID NO: 24390 - DNA, 15 bp, Artificial Sequence
  dgRNA
  Mybph
gtagtatgcttctca

SEQ ID NO: 24391 - DNA, 15 bp, Artificial Sequence
  dgRNA
  Mybph
tagtatgcttctcaa

SEQ ID NO: 24392 - DNA, 15 bp, Artificial Sequence
  dgRNA
  Mybph
agtatgcttctcaag

SEQ ID NO: 24393 - DNA, 15 bp, Artificial Sequence
  dgRNA
  Mybph
ccccagagctattcc

SEQ ID NO: 24394 - DNA, 15 bp, Artificial Sequence
  dgRNA
  Gabpb1
cttgcggtcgccccg

SEQ ID NO: 24395 - DNA, 15 bp, Artificial Sequence
  dgRNA
  Gabpb1
gccgcagcctttgtg

SEQ ID NO: 24396 - DNA, 15 bp, Artificial Sequence
  dgRNA
  Gabpb1
gccgaacgctagaaa

SEQ ID NO: 24397 - DNA, 15 bp, Artificial Sequence
  dgRNA
  Gabpb1
atccctttctcccgc

SEQ ID NO: 24398 - DNA, 15 bp, Artificial Sequence
  dgRNA
  Zbtb2
ttgcagaactttggc

SEQ ID NO: 24399 - DNA, 15 bp, Artificial Sequence
  dgRNA
  Zbtb2
tggggccgcgagccc

SEQ ID NO: 24400 - DNA, 15 bp, Artificial Sequence
  dgRNA
  Zbtb2
gccgcgagcccaggc

SEQ ID NO: 24401 - DNA, 15 bp, Artificial Sequence
  dgRNA
  Zbtb2
ccgcgagcccaggct

SEQ ID NO: 24402 - DNA, 15 bp, Artificial Sequence
  dgRNA
  Swt1
ctgcgcagaagcgtg

SEQ ID NO: 24403 - DNA, 15 bp, Artificial Sequence
  dgRNA
  Swt1
cgcagaagcgtgtgg

SEQ ID NO: 24404 - DNA, 15 bp, Artificial Sequence
  dgRNA
  Swt1
ggacagtgtccaatg

SEQ ID NO: 24405 - DNA, 15 bp, Artificial Sequence
  dgRNA
  Swt1
agagttccgtttcct

SEQ ID NO: 24406 - DNA, 15 bp, Artificial Sequence
  dgRNA
  Ptgdr
ttcagctttgcagcg

SEQ ID NO: 24407 - DNA, 15 bp, Artificial Sequence
  dgRNA
  Ptgdr
tcagctttgcagcgc

SEQ ID NO: 24408 - DNA, 15 bp, Artificial Sequence
  dgRNA
  Ptgdr
gcgcgggatactcac

SEQ ID NO: 24409 - DNA, 15 bp, Artificial Sequence
  dgRNA
  Ptgdr
cgcgggatactcaca

SEQ ID NO: 24410 - DNA, 15 bp, Artificial Sequence
  dgRNA
  Rbm41
ccaaaggtgaatcct

SEQ ID NO: 24411 - DNA, 15 bp, Artificial Sequence
  dgRNA
  Rbm41
atgttatctttaacc

SEQ ID NO: 24412 - DNA, 15 bp, Artificial Sequence
  dgRNA
  Rbm41
cctaggattcacctt

SEQ ID NO: 24413 - DNA, 15 bp, Artificial Sequence
  dgRNA
  Rbm41
aaagctcataagcct

SEQ ID NO: 24414 - DNA, 15 bp, Artificial Sequence
  dgRNA
  Olfr23
gcattttggtatctc

SEQ ID NO: 24415 - DNA, 15 bp, Artificial Sequence
  dgRNA
  Olfr23
gataccaaaatgcat

SEQ ID NO: 24416 - DNA, 15 bp, Artificial Sequence
  dgRNA
  Olfr23
atatacgtaagacaa

SEQ ID NO: 24417 - DNA, 15 bp, Artificial Sequence
  dgRNA
  Olfr23
catatacgtaagaca

SEQ ID NO: 24418 - DNA, 15 bp, Artificial Sequence
  dgRNA
  Kpna6
ctgatatcccttgga

SEQ ID NO: 24419 - DNA, 15 bp, Artificial Sequence
  dgRNA
  Kpna6
gaacgcgttttagca

SEQ ID NO: 24420 - DNA, 15 bp, Artificial Sequence
  dgRNA
  Kpna6
acgtttgtccccgtc

SEQ ID NO: 24421 - DNA, 15 bp, Artificial Sequence
  dgRNA
  Kpna6
tggaatagacagccg

SEQ ID NO: 24422 - DNA, 15 bp, Artificial Sequence
  dgRNA
  Mpv17
gtgcagtccacgaga

SEQ ID NO: 24423 - DNA, 15 bp, Artificial Sequence
  dgRNA
  Mpv17
tgcagtccacgagaa

SEQ ID NO: 24424 - DNA, 15 bp, Artificial Sequence
  dgRNA
  Mpv17
gcagtccacgagaag

SEQ ID NO: 24425 - DNA, 15 bp, Artificial Sequence
  dgRNA
  Mpv17
cagtccacgagaagg

SEQ ID NO: 24426 - DNA, 15 bp, Artificial Sequence
  dgRNA
  Rnf183
gagtagccatgtatc

SEQ ID NO: 24427 - DNA, 15 bp, Artificial Sequence
  dgRNA
  Rnf183
gagcccttgcaatga

SEQ ID NO: 24428 - DNA, 15 bp, Artificial Sequence
  dgRNA
  Rnf183
cacttatcctggctt

SEQ ID NO: 24429 - DNA, 15 bp, Artificial Sequence
  dgRNA
  Rnf183
gactcacacttatcc

SEQ ID NO: 24430 - DNA, 15 bp, Artificial Sequence
  dgRNA
  Adarb2
tctaattagactttg

SEQ ID NO: 24431 - DNA, 15 bp, Artificial Sequence
  dgRNA
  Adarb2
tgattggctttaaag

SEQ ID NO: 24432 - DNA, 15 bp, Artificial Sequence
  dgRNA
  Adarb2
ccaaacaactcgcag

SEQ ID NO: 24433 - DNA, 15 bp, Artificial Sequence
  dgRNA
  Adarb2
tggatggagccgccc

SEQ ID NO: 24434 - DNA, 15 bp, Artificial Sequence
  dgRNA
  Cox5a
caggaatgttcacta

SEQ ID NO: 24435 - DNA, 15 bp, Artificial Sequence
  dgRNA
  Cox5a
ttcactacggtcacc

SEQ ID NO: 24436 - DNA, 15 bp, Artificial Sequence
  dgRNA
  Cox5a
tcactacggtcaccc

SEQ ID NO: 24437 - DNA, 15 bp, Artificial Sequence
  dgRNA
  Cox5a
ggtcacccgggtcat

SEQ ID NO: 24438 - DNA, 15 bp, Artificial Sequence
  dgRNA
  Immt
gttcacctagtaacc

SEQ ID NO: 24439 - DNA, 15 bp, Artificial Sequence
  dgRNA
  Immt
cgcccaagcgcgacc

SEQ ID NO: 24440 - DNA, 15 bp, Artificial Sequence
  dgRNA
  Immt
caagcgcgacccgga

SEQ ID NO: 24441 - DNA, 15 bp, Artificial Sequence
  dgRNA
  Immt
tccccttttcgcagc

SEQ ID NO: 24442 - DNA, 15 bp, Artificial Sequence
  dgRNA
  Ifi44l
atcttggcaaccagc

SEQ ID NO: 24443 - DNA, 15 bp, Artificial Sequence
  dgRNA
  Ifi44l
tcttggcaaccagct

SEQ ID NO: 24444 - DNA, 15 bp, Artificial Sequence
  dgRNA
  Ifi44l
tttaactaagcaacc

SEQ ID NO: 24445 - DNA, 15 bp, Artificial Sequence
  dgRNA
  Ifi44l
tggttgcttagttaa

SEQ ID NO: 24446 - DNA, 15 bp, Artificial Sequence
  dgRNA
  Pnkd
cggccgaaagagcga

SEQ ID NO: 24447 - DNA, 15 bp, Artificial Sequence
  dgRNA
  Pnkd
aagagcgacggcatc

SEQ ID NO: 24448 - DNA, 15 bp, Artificial Sequence
  dgRNA
  Pnkd
agagcgacggcatcc

SEQ ID NO: 24449 - DNA, 15 bp, Artificial Sequence
  dgRNA
  Pnkd
cggcatccgggccaa

SEQ ID NO: 24450 - DNA, 15 bp, Artificial Sequence
  dgRNA
  Xiap
ctctcacaggatacc

SEQ ID NO: 24451 - DNA, 15 bp, Artificial Sequence
  dgRNA
  Tlcd1
ccttcggatgtcggg

SEQ ID NO: 24452 - DNA, 15 bp, Artificial Sequence
  dgRNA
  Tlcd1
cgggaggcgccagac

SEQ ID NO: 24453 - DNA, 15 bp, Artificial Sequence
  dgRNA
  Tlcd1
gggaggcgccagaca

SEQ ID NO: 24454 - DNA, 15 bp, Artificial Sequence
  dgRNA
  Tlcd1
gtgcctcggcaacga

SEQ ID NO: 24455 - DNA, 15 bp, Artificial Sequence
  dgRNA
  Lancl1
tttataaacgagtgt

SEQ ID NO: 24456 - DNA, 15 bp, Artificial Sequence
  dgRNA
  Lancl1
cgagtgtcggaaacc

SEQ ID NO: 24457 - DNA, 15 bp, Artificial Sequence
  dgRNA
  Lancl1
accaccgctgcccac

SEQ ID NO: 24458 - DNA, 15 bp, Artificial Sequence
  dgRNA
  Lancl1
ctcgtgcccgttgat

SEQ ID NO: 24459 - DNA, 15 bp, Artificial Sequence
  dgRNA
  P4ha2
tgggggcgccgcccc

SEQ ID NO: 24460 - DNA, 15 bp, Artificial Sequence
  dgRNA
  P4ha2
cgccgcccctggtgc

SEQ ID NO: 24461 - DNA, 15 bp, Artificial Sequence
  dgRNA
  P4ha2
ggtgccggtcccacg

SEQ ID NO: 24462 - DNA, 15 bp, Artificial Sequence
  dgRNA
  P4ha2
gtcccacgcggcgca

SEQ ID NO: 24463 - DNA, 15 bp, Artificial Sequence
  dgRNA
  Jdp2
tccccctctgacgtg

SEQ ID NO: 24464 - DNA, 15 bp, Artificial Sequence
  dgRNA
  Jdp2
tctgacgtgtggagc

SEQ ID NO: 24465 - DNA, 15 bp, Artificial Sequence
  dgRNA
  Jdp2
agctggcagctcggc

SEQ ID NO: 24466 - DNA, 15 bp, Artificial Sequence
  dgRNA
  Jdp2
cctccccgccactca

SEQ ID NO: 24467 - DNA, 15 bp, Artificial Sequence
  dgRNA
  Plpp2
ttgacgaaagggccc

SEQ ID NO: 24468 - DNA, 15 bp, Artificial Sequence
  dgRNA
  Plpp2
cttgacgaaagggcc

SEQ ID NO: 24469 - DNA, 15 bp, Artificial Sequence
  dgRNA
  Plpp2
cagggcttgacgaaa

SEQ ID NO: 24470 - DNA, 15 bp, Artificial Sequence
  dgRNA
  Plpp2
gcagggcttgacgaa

SEQ ID NO: 24471 - DNA, 15 bp, Artificial Sequence
  dgRNA
  Cryz
tgagagcgtgcagcc

SEQ ID NO: 24472 - DNA, 15 bp, Artificial Sequence
  dgRNA
  Cryz
gagctaaaatgccca

SEQ ID NO: 24473 - DNA, 15 bp, Artificial Sequence
  dgRNA
  Cryz
atgacaccggccacc

SEQ ID NO: 24474 - DNA, 15 bp, Artificial Sequence
  dgRNA
  Cryz
tgacaccggccacca

SEQ ID NO: 24475 - DNA, 15 bp, Artificial Sequence
  dgRNA
  Arntl2
ctgctgcttaaatcg

SEQ ID NO: 24476 - DNA, 15 bp, Artificial Sequence
  dgRNA
  Arntl2
gttttcctcacttac

SEQ ID NO: 24477 - DNA, 15 bp, Artificial Sequence
  dgRNA
  Arntl2
ctcacttacaggtaa

SEQ ID NO: 24478 - DNA, 15 bp, Artificial Sequence
  dgRNA
  Arntl2
ctttacctgtaagtg

SEQ ID NO: 24479 - DNA, 15 bp, Artificial Sequence
  dgRNA
  2310035C23Rik
atcctcgagagcttg

SEQ ID NO: 24480 - DNA, 15 bp, Artificial Sequence
  dgRNA
  2310035C23Rik
cgagagcttgtgggc

SEQ ID NO: 24481 - DNA, 15 bp, Artificial Sequence
  dgRNA
  2310035C23Rik
gggcggggcgaagat

SEQ ID NO: 24482 - DNA, 15 bp, Artificial Sequence
  dgRNA
  2310035C23Rik
agttctcgcgagact

SEQ ID NO: 24483 - DNA, 15 bp, Artificial Sequence
  dgRNA
  Cacng5
cctacagcctccacg

SEQ ID NO: 24484 - DNA, 15 bp, Artificial Sequence
  dgRNA
  Cacng5
cgcaactgactgcat

SEQ ID NO: 24485 - DNA, 15 bp, Artificial Sequence
  dgRNA
  Cacng5
gcaactgactgcatt

SEQ ID NO: 24486 - DNA, 15 bp, Artificial Sequence
  dgRNA
  Cacng5
ctgcattgggaagtc

SEQ ID NO: 24487 - DNA, 15 bp, Artificial Sequence
  dgRNA
  Hsd17b3
tgcctgcgaatcaca

SEQ ID NO: 24488 - DNA, 15 bp, Artificial Sequence
  dgRNA
  Hsd17b3
atctggcgggcaccc

SEQ ID NO: 24489 - DNA, 15 bp, Artificial Sequence
  dgRNA
  Hsd17b3
aaccttgtgattcgc

SEQ ID NO: 24490 - DNA, 15 bp, Artificial Sequence
  dgRNA
  Hsd17b3
gagcatttagattag

SEQ ID NO: 24491 - DNA, 15 bp, Artificial Sequence
  dgRNA
  Ptpro
aagttatgtgttgtc

SEQ ID NO: 24492 - DNA, 15 bp, Artificial Sequence
  dgRNA
  Ptpro
aaactattaatagtc

SEQ ID NO: 24493 - DNA, 15 bp, Artificial Sequence
  dgRNA
  Epha10
aggctggatcagccg

SEQ ID NO: 24494 - DNA, 15 bp, Artificial Sequence
  dgRNA
  Epha10
gatcagccgcggccg

SEQ ID NO: 24495 - DNA, 15 bp, Artificial Sequence
  dgRNA
  Epha10
atcagccgcggccgc

SEQ ID NO: 24496 - DNA, 15 bp, Artificial Sequence
  dgRNA
  Epha10
ggcagcgcatcttcg

SEQ ID NO: 24497 - DNA, 15 bp, Artificial Sequence
  dgRNA
  Dis3l2
aggctgctgtcgcta

SEQ ID NO: 24498 - DNA, 15 bp, Artificial Sequence
  dgRNA
  Dis3l2
ctgctgtcgctaagg

SEQ ID NO: 24499 - DNA, 15 bp, Artificial Sequence
  dgRNA
  Dis3l2
tgctgtcgctaaggc

SEQ ID NO: 24500 - DNA, 15 bp, Artificial Sequence
  dgRNA
  Dis3l2
gggagccgcccacgc

SEQ ID NO: 24501 - DNA, 15 bp, Artificial Sequence
  dgRNA
  Pm20d2
attaggacagccgag

SEQ ID NO: 24502 - DNA, 15 bp, Artificial Sequence
  dgRNA
  Pm20d2
gacagccgagcggtg

SEQ ID NO: 24503 - DNA, 15 bp, Artificial Sequence
  dgRNA
  Pm20d2
cggtgcggactgcca

SEQ ID NO: 24504 - DNA, 15 bp, Artificial Sequence
  dgRNA
  Pm20d2
tgccaagggctgccg

SEQ ID NO: 24505 - DNA, 15 bp, Artificial Sequence
  dgRNA
  Mff
gacatcactgcatag

SEQ ID NO: 24506 - DNA, 15 bp, Artificial Sequence
  dgRNA
  Mff
tcctgtagggtgagt

SEQ ID NO: 24507 - DNA, 15 bp, Artificial Sequence
  dgRNA
  Mff
cactcaccctacagg

SEQ ID NO: 24508 - DNA, 15 bp, Artificial Sequence
  dgRNA
  Rfx4
gtctataatgagtgc

SEQ ID NO: 24509 - DNA, 15 bp, Artificial Sequence
  dgRNA
  Rfx4
atgagtgccgggcta

SEQ ID NO: 24510 - DNA, 15 bp, Artificial Sequence
  dgRNA
  Rfx4
gtgccgggctaaggc

SEQ ID NO: 24511 - DNA, 15 bp, Artificial Sequence
  dgRNA
  Rfx4
taatgctataataga

SEQ ID NO: 24512 - DNA, 15 bp, Artificial Sequence
  dgRNA
  Tmem200b
tgcggaaaacccgag

SEQ ID NO: 24513 - DNA, 15 bp, Artificial Sequence
  dgRNA
  Tmem200b
gcggaaaacccgagc

SEQ ID NO: 24514 - DNA, 15 bp, Artificial Sequence
  dgRNA
  Tmem200b
cggaaaacccgagcg

SEQ ID NO: 24515 - DNA, 15 bp, Artificial Sequence
  dgRNA
  Tmem200b
ggaaaacccgagcgg

SEQ ID NO: 24516 - DNA, 15 bp, Artificial Sequence
  dgRNA
  Cchcr1
ccggctgcttctgat

SEQ ID NO: 24517 - DNA, 15 bp, Artificial Sequence
  dgRNA
  Cchcr1
acccatttgctctat

SEQ ID NO: 24518 - DNA, 15 bp, Artificial Sequence
  dgRNA
  Cchcr1
tattggccgatgcgc

SEQ ID NO: 24519 - DNA, 15 bp, Artificial Sequence
  dgRNA
  Cchcr1
attggccgatgcgca

SEQ ID NO: 24520 - DNA, 15 bp, Artificial Sequence
  dgRNA
  Cbln3
cggatccctcctcct

SEQ ID NO: 24521 - DNA, 15 bp, Artificial Sequence
  dgRNA
  Cbln3
tctggcacctagccc

SEQ ID NO: 24522 - DNA, 15 bp, Artificial Sequence
  dgRNA
  Cbln3
gtctggcacctagcc

SEQ ID NO: 24523 - DNA, 15 bp, Artificial Sequence
  dgRNA
  Stag1
cggcaacccagcgag

SEQ ID NO: 24524 - DNA, 15 bp, Artificial Sequence
  dgRNA
  Stag1
ggcaacccagcgagc

SEQ ID NO: 24525 - DNA, 15 bp, Artificial Sequence
  dgRNA
  Stag1
gcgagcgggtcgcgc

SEQ ID NO: 24526 - DNA, 15 bp, Artificial Sequence
  dgRNA
  Stag1
gtcgcgcaggcgccg

SEQ ID NO: 24527 - DNA, 15 bp, Artificial Sequence
  dgRNA
  AU040320
tgagtgctcgagcta

SEQ ID NO: 24528 - DNA, 15 bp, Artificial Sequence
  dgRNA
  AU040320
gtgctcgagctaagg

SEQ ID NO: 24529 - DNA, 15 bp, Artificial Sequence
  dgRNA
  AU040320
gcgggccgccccgca

SEQ ID NO: 24530 - DNA, 15 bp, Artificial Sequence
  dgRNA
  AU040320
cgggccgccccgcaa

SEQ ID NO: 24531 - DNA, 15 bp, Artificial Sequence
  dgRNA
  Unk
taccacaaggcattg

SEQ ID NO: 24532 - DNA, 15 bp, Artificial Sequence
  dgRNA
  Unk
cggatcctcagcatc

SEQ ID NO: 24533 - DNA, 15 bp, Artificial Sequence
  dgRNA
  Unk
gtccgcaaagatctc

SEQ ID NO: 24534 - DNA, 15 bp, Artificial Sequence
  dgRNA
  Unk
tccgcaaagatctct

SEQ ID NO: 24535 - DNA, 15 bp, Artificial Sequence
  dgRNA
  4930452B06Rik
aagggctcagtgcgc

SEQ ID NO: 24536 - DNA, 15 bp, Artificial Sequence
  dgRNA
  4930452B06Rik
gtgcgcaggcgcctc

SEQ ID NO: 24537 - DNA, 15 bp, Artificial Sequence
  dgRNA
  4930452B06Rik
tgcgcaggcgcctcc

SEQ ID NO: 24538 - DNA, 15 bp, Artificial Sequence
  dgRNA
  4930452B06Rik
cctccggggagccaa

SEQ ID NO: 24539 - DNA, 15 bp, Artificial Sequence
  dgRNA
  7420461P10Rik
ggtgcattttgcaac

SEQ ID NO: 24540 - DNA, 15 bp, Artificial Sequence
  dgRNA
  7420461P10Rik
actggtagactccat

SEQ ID NO: 24541 - DNA, 15 bp, Artificial Sequence
  dgRNA
  7420461P10Rik
ccagcttagaccatg

SEQ ID NO: 24542 - DNA, 15 bp, Artificial Sequence
  dgRNA
  7420461P10Rik
accagcttagaccat

SEQ ID NO: 24543 - DNA, 15 bp, Artificial Sequence
  dgRNA
  Zdhhc15
gatgcagtgcagtaa

SEQ ID NO: 24544 - DNA, 15 bp, Artificial Sequence
  dgRNA
  Zdhhc15
cggacccacatttct

SEQ ID NO: 24545 - DNA, 15 bp, Artificial Sequence
  dgRNA
  Zdhhc15
ggacccacatttctt

SEQ ID NO: 24546 - DNA, 15 bp, Artificial Sequence
  dgRNA
  Zdhhc15
ttttacatttggcgg

SEQ ID NO: 24547 - DNA, 15 bp, Artificial Sequence
  dgRNA
  Sprr2h
ttgagagtcctggtt

SEQ ID NO: 24548 - DNA, 15 bp, Artificial Sequence
  dgRNA
  Sprr2h
gtctttacaacctac

SEQ ID NO: 24549 - DNA, 15 bp, Artificial Sequence
  dgRNA
  Sprr2h
ttacaacctacaggg

SEQ ID NO: 24550 - DNA, 15 bp, Artificial Sequence
  dgRNA
  Sprr2h
tacaacctacagggc

SEQ ID NO: 24551 - DNA, 15 bp, Artificial Sequence
  dgRNA
  Trim34b
ttaccaaattactga

SEQ ID NO: 24552 - DNA, 15 bp, Artificial Sequence
  dgRNA
  Trim34b
aaaccctcagtaatt

SEQ ID NO: 24553 - DNA, 15 bp, Artificial Sequence
  dgRNA
  Mcoln3
ctcttcgtttcgcgc

SEQ ID NO: 24554 - DNA, 15 bp, Artificial Sequence
  dgRNA
  Cog1
ccataatgaacccca

SEQ ID NO: 24555 - DNA, 15 bp, Artificial Sequence
  dgRNA
  Cog1
tttgggtgcgacgca

SEQ ID NO: 24556 - DNA, 15 bp, Artificial Sequence
  dgRNA
  Cog1
ttgggtgcgacgcaa

SEQ ID NO: 24557 - DNA, 15 bp, Artificial Sequence
  dgRNA
  Cog1
tgggtgcgacgcaag

SEQ ID NO: 24558 - DNA, 15 bp, Artificial Sequence
  dgRNA
  Ankrd33b
gtcccgagcagggaa

SEQ ID NO: 24559 - DNA, 15 bp, Artificial Sequence
  dgRNA
  Ankrd33b
actttgtcccgagca

SEQ ID NO: 24560 - DNA, 15 bp, Artificial Sequence
  dgRNA
  Pdilt
ttcctacagtcagtt

SEQ ID NO: 24561 - DNA, 15 bp, Artificial Sequence
  dgRNA
  Pdilt
gtacacgctttgaac

SEQ ID NO: 24562 - DNA, 15 bp, Artificial Sequence
  dgRNA
  Pdilt
tacacgctttgaaca

SEQ ID NO: 24563 - DNA, 15 bp, Artificial Sequence
  dgRNA
  Pdilt
taaagctccctcacc

SEQ ID NO: 24564 - DNA, 15 bp, Artificial Sequence
  dgRNA
  Fn1
catctcttttgttcg

SEQ ID NO: 24565 - DNA, 15 bp, Artificial Sequence
  dgRNA
  Fn1
ccccgtgacgtcacc

SEQ ID NO: 24566 - DNA, 15 bp, Artificial Sequence
  dgRNA
  Fn1
acgtcacccggactc

SEQ ID NO: 24567 - DNA, 15 bp, Artificial Sequence
  dgRNA
  Fn1
cgtcacccggactct

SEQ ID NO: 24568 - DNA, 15 bp, Artificial Sequence
  dgRNA
  Coro1c
aggagcccgtgggcg

SEQ ID NO: 24569 - DNA, 15 bp, Artificial Sequence
  dgRNA
  Coro1c
gccattcaagtgccc

SEQ ID NO: 24570 - DNA, 15 bp, Artificial Sequence
  dgRNA
  Coro1c
aagtgccccggaaag

SEQ ID NO: 24571 - DNA, 15 bp, Artificial Sequence
  dgRNA
  Coro1c
agtgccccggaaagc

SEQ ID NO: 24572 - DNA, 15 bp, Artificial Sequence
  dgRNA
  Cacna1c
gtccacccggcgccg

SEQ ID NO: 24573 - DNA, 15 bp, Artificial Sequence
  dgRNA
  Cacna1c
tccacccggcgccgc

SEQ ID NO: 24574 - DNA, 15 bp, Artificial Sequence
  dgRNA
  Cacna1c
tggtgtagccgccag

SEQ ID NO: 24575 - DNA, 15 bp, Artificial Sequence
  dgRNA
  Cacna1c
tagccgccagaggtg

SEQ ID NO: 24576 - DNA, 15 bp, Artificial Sequence
  dgRNA
  Fibp
tcactagctccgtcc

SEQ ID NO: 24577 - DNA, 15 bp, Artificial Sequence
  dgRNA
  Fibp
gctccgtcccggaag

SEQ ID NO: 24578 - DNA, 15 bp, Artificial Sequence
  dgRNA
  Fibp
ttttcggaagatgtc

SEQ ID NO: 24579 - DNA, 15 bp, Artificial Sequence
  dgRNA
  Fibp
tttttcggaagatgt

SEQ ID NO: 24580 - DNA, 15 bp, Artificial Sequence
  dgRNA
  Fam126a
gtcaatcgtctcccc

SEQ ID NO: 24581 - DNA, 15 bp, Artificial Sequence
  dgRNA
  Fam126a
tcaatcgtctcccct

SEQ ID NO: 24582 - DNA, 15 bp, Artificial Sequence
  dgRNA
  Fam126a
tcccctgggcgttcc

SEQ ID NO: 24583 - DNA, 15 bp, Artificial Sequence
  dgRNA
  Fam126a
tcagattctcattgg

SEQ ID NO: 24584 - DNA, 15 bp, Artificial Sequence
  dgRNA
  Ablim2
cggggcaaaggggcg

SEQ ID NO: 24585 - DNA, 15 bp, Artificial Sequence
  dgRNA
  Ablim2
gggagccccgagctg

SEQ ID NO: 24586 - DNA, 15 bp, Artificial Sequence
  dgRNA
  Ablim2
agccccgagctgcgg

SEQ ID NO: 24587 - DNA, 15 bp, Artificial Sequence
  dgRNA
  Ablim2
ctgcggtggcgctgc

SEQ ID NO: 24588 - DNA, 15 bp, Artificial Sequence
  dgRNA
  Pde4a
gagtatgtttctatc

SEQ ID NO: 24589 - DNA, 15 bp, Artificial Sequence
  dgRNA
  Pde4a
gatgtgtcctcatcg

SEQ ID NO: 24590 - DNA, 15 bp, Artificial Sequence
  dgRNA
  Pde4a
ctttgaacctcgatg

SEQ ID NO: 24591 - DNA, 15 bp, Artificial Sequence
  dgRNA
  Pde4a
tgggggggcgttaaa

SEQ ID NO: 24592 - DNA, 15 bp, Artificial Sequence
  dgRNA
  Osbp
aatcgaaagcaggcc

SEQ ID NO: 24593 - DNA, 15 bp, Artificial Sequence
  dgRNA
  Osbp
cgaaagcaggcctgg

SEQ ID NO: 24594 - DNA, 15 bp, Artificial Sequence
  dgRNA
  Osbp
gcggagtagcatgac

SEQ ID NO: 24595 - DNA, 15 bp, Artificial Sequence
  dgRNA
  Osbp
aaatgccaatgtccg

SEQ ID NO: 24596 - DNA, 15 bp, Artificial Sequence
  dgRNA
  Cenpn
aggtggaattcgaga

SEQ ID NO: 24597 - DNA, 15 bp, Artificial Sequence
  dgRNA
  Cenpn
tgagtacagcgactc

SEQ ID NO: 24598 - DNA, 15 bp, Artificial Sequence
  dgRNA
  Cenpn
gagtacagcgactct

SEQ ID NO: 24599 - DNA, 15 bp, Artificial Sequence
  dgRNA
  Cenpn
agtacagcgactctg

SEQ ID NO: 24600 - DNA, 15 bp, Artificial Sequence
  dgRNA
  Bin1
cagtgcccgccctcc

SEQ ID NO: 24601 - DNA, 15 bp, Artificial Sequence
  dgRNA
  Bin1
aggcagtgtcgtgtc

SEQ ID NO: 24602 - DNA, 15 bp, Artificial Sequence
  dgRNA
  Bin1
cagtgtcgtgtccgg

SEQ ID NO: 24603 - DNA, 15 bp, Artificial Sequence
  dgRNA
  Bin1
agtgtcgtgtccgga

SEQ ID NO: 24604 - DNA, 15 bp, Artificial Sequence
  dgRNA
  Ddhd1
cccggaacggcgctg

SEQ ID NO: 24605 - DNA, 15 bp, Artificial Sequence
  dgRNA
  Ddhd1
ggaacggcgctgcgg

SEQ ID NO: 24606 - DNA, 15 bp, Artificial Sequence
  dgRNA
  Ddhd1
cggcgctgcggcggc

SEQ ID NO: 24607 - DNA, 15 bp, Artificial Sequence
  dgRNA
  Ddhd1
ggcgctgcggcggcc

SEQ ID NO: 24608 - DNA, 15 bp, Artificial Sequence
  dgRNA
  Six4
ttttccggcaggtaa

SEQ ID NO: 24609 - DNA, 15 bp, Artificial Sequence
  dgRNA
  Six4
aggcgggtgatcgac

SEQ ID NO: 24610 - DNA, 15 bp, Artificial Sequence
  dgRNA
  Six4
ggcgggtgatcgaca

SEQ ID NO: 24611 - DNA, 15 bp, Artificial Sequence
  dgRNA
  Six4
atgcgaaatagccaa

SEQ ID NO: 24612 - DNA, 15 bp, Artificial Sequence
  dgRNA
  Rsl24d1
cctctgcgtctgcgc

SEQ ID NO: 24613 - DNA, 15 bp, Artificial Sequence
  dgRNA
  Rsl24d1
gctgctgcgcacacg

SEQ ID NO: 24614 - DNA, 15 bp, Artificial Sequence
  dgRNA
  Rsl24d1
ctgctgcgcacacgc

SEQ ID NO: 24615 - DNA, 15 bp, Artificial Sequence
  dgRNA
  Rsl24d1
gcgcacacgcgggtc

SEQ ID NO: 24616 - DNA, 15 bp, Artificial Sequence
  dgRNA
  Fbxl8
cgtgtcaccaccgcg

SEQ ID NO: 24617 - DNA, 15 bp, Artificial Sequence
  dgRNA
  Fbxl8
cgcggtgctcgccct

SEQ ID NO: 24618 - DNA, 15 bp, Artificial Sequence
  dgRNA
  Fbxl8
gcggtgctcgccctc

SEQ ID NO: 24619 - DNA, 15 bp, Artificial Sequence
  dgRNA
  Fbxl8
gatctctcgctttgc

SEQ ID NO: 24620 - DNA, 15 bp, Artificial Sequence
  dgRNA
  Zfp518a
taggatccccgcggc

SEQ ID NO: 24621 - DNA, 15 bp, Artificial Sequence
  dgRNA
  Zfp518a
cggctggtgagtaga

SEQ ID NO: 24622 - DNA, 15 bp, Artificial Sequence
  dgRNA
  Zfp518a
gctggtgagtagacg

SEQ ID NO: 24623 - DNA, 15 bp, Artificial Sequence
  dgRNA
  Zfp518a
ctggtgagtagacgg

SEQ ID NO: 24624 - DNA, 15 bp, Artificial Sequence
  dgRNA
  Ednrb
ccgctcaagctgctg

SEQ ID NO: 24625 - DNA, 15 bp, Artificial Sequence
  dgRNA
  Ednrb
tgaggatccgctgcc

SEQ ID NO: 24626 - DNA, 15 bp, Artificial Sequence
  dgRNA
  Ednrb
gcattcagttgcgag

SEQ ID NO: 24627 - DNA, 15 bp, Artificial Sequence
  dgRNA
  Ednrb
gcgagaggcctgttt

SEQ ID NO: 24628 - DNA, 15 bp, Artificial Sequence
  dgRNA
  Olfr894
acaaatcatgggtag

SEQ ID NO: 24629 - DNA, 15 bp, Artificial Sequence
  dgRNA
  Olfr894
gcaagagatgatcta

SEQ ID NO: 24630 - DNA, 15 bp, Artificial Sequence
  dgRNA
  Ddx39b
atggagagctctgcg

SEQ ID NO: 24631 - DNA, 15 bp, Artificial Sequence
  dgRNA
  Ddx39b
tggagagctctgcgg

SEQ ID NO: 24632 - DNA, 15 bp, Artificial Sequence
  dgRNA
  Ddx39b
acaccctccgacggt

SEQ ID NO: 24633 - DNA, 15 bp, Artificial Sequence
  dgRNA
  Ddx39b
tgcaacaccctccga

SEQ ID NO: 24634 - DNA, 15 bp, Artificial Sequence
  dgRNA
  Kdr
atgcgacttgccgcc

SEQ ID NO: 24635 - DNA, 15 bp, Artificial Sequence
  dgRNA
  Kdr
cgcccggcacagttc

SEQ ID NO: 24636 - DNA, 15 bp, Artificial Sequence
  dgRNA
  Kdr
gcccggcacagttcc

SEQ ID NO: 24637 - DNA, 15 bp, Artificial Sequence
  dgRNA
  Kdr
cccggcacagttccg

SEQ ID NO: 24638 - DNA, 15 bp, Artificial Sequence
  dgRNA
  Rxfp2
cccagtgacaagcgt

SEQ ID NO: 24639 - DNA, 15 bp, Artificial Sequence
  dgRNA
  Rxfp2
cgacgcttgtcactg

SEQ ID NO: 24640 - DNA, 15 bp, Artificial Sequence
  dgRNA
  Rxfp2
ccgacgcttgtcact

SEQ ID NO: 24641 - DNA, 15 bp, Artificial Sequence
  dgRNA
  Rxfp2
accgacgcttgtcac

SEQ ID NO: 24642 - DNA, 15 bp, Artificial Sequence
  dgRNA
  2700049A03Rik
agattcgttaccacg

SEQ ID NO: 24643 - DNA, 15 bp, Artificial Sequence
  dgRNA
  2700049A03Rik
gattcgttaccacgt

SEQ ID NO: 24644 - DNA, 15 bp, Artificial Sequence
  dgRNA
  2700049A03Rik
cagctttccgcggcg

SEQ ID NO: 24645 - DNA, 15 bp, Artificial Sequence
  dgRNA
  2700049A03Rik
cgaatctgcgtctaa

SEQ ID NO: 24646 - DNA, 15 bp, Artificial Sequence
  dgRNA
  Atp10a
tctctgggactaaac

SEQ ID NO: 24647 - DNA, 15 bp, Artificial Sequence
  dgRNA
  Atp10a
ctaaagtttccagcg

SEQ ID NO: 24648 - DNA, 15 bp, Artificial Sequence
  dgRNA
  Atp10a
taaagtttccagcgc

SEQ ID NO: 24649 - DNA, 15 bp, Artificial Sequence
  dgRNA
  Atp10a
cgcccaatctgaatc

SEQ ID NO: 24650 - DNA, 15 bp, Artificial Sequence
  dgRNA
  Dpysl3
ttcacctatagtaca

SEQ ID NO: 24651 - DNA, 15 bp, Artificial Sequence
  dgRNA
  Dpysl3
tcacctatagtacat

SEQ ID NO: 24652 - DNA, 15 bp, Artificial Sequence
  dgRNA
  Dpysl3
cctatagtacatggg

SEQ ID NO: 24653 - DNA, 15 bp, Artificial Sequence
  dgRNA
  Dpysl3
ctatagtacatgggt

SEQ ID NO: 24654 - DNA, 15 bp, Artificial Sequence
  dgRNA
  Tap1
gtgtctagtgattcg

SEQ ID NO: 24655 - DNA, 15 bp, Artificial Sequence
  dgRNA
  Tap1
ctagtgattcgaggt

SEQ ID NO: 24656 - DNA, 15 bp, Artificial Sequence
  dgRNA
  Tap1
ttcgaggtcggcttt

SEQ ID NO: 24657 - DNA, 15 bp, Artificial Sequence
  dgRNA
  Tap1
ctccaccagctcgag

SEQ ID NO: 24658 - DNA, 15 bp, Artificial Sequence
  dgRNA
  Ubp1
gtacccgcttttctc

SEQ ID NO: 24659 - DNA, 15 bp, Artificial Sequence
  dgRNA
  Ubp1
cgcttttctctggag

SEQ ID NO: 24660 - DNA, 15 bp, Artificial Sequence
  dgRNA
  Ubp1
ttttctctggagcgg

SEQ ID NO: 24661 - DNA, 15 bp, Artificial Sequence
  dgRNA
  Ubp1
gcaaaagccgacgaa

SEQ ID NO: 24662 - DNA, 15 bp, Artificial Sequence
  dgRNA
  Kifc5b
cctagctccgcgctc

SEQ ID NO: 24663 - DNA, 15 bp, Artificial Sequence
  dgRNA
  Kifc5b
agctccgcgctccgg

SEQ ID NO: 24664 - DNA, 15 bp, Artificial Sequence
  dgRNA
  Kifc5b
gctccgcgctccgga

SEQ ID NO: 24665 - DNA, 15 bp, Artificial Sequence
  dgRNA
  Kifc5b
ctccgcgctccggag

SEQ ID NO: 24666 - DNA, 15 bp, Artificial Sequence
  dgRNA
  Pgp
gtccgttgcagctgt

SEQ ID NO: 24667 - DNA, 15 bp, Artificial Sequence
  dgRNA
  Pgp
aggcctcgctgctcg

SEQ ID NO: 24668 - DNA, 15 bp, Artificial Sequence
  dgRNA
  Pgp
ggcctcgctgctcgc

SEQ ID NO: 24669 - DNA, 15 bp, Artificial Sequence
  dgRNA
  Pgp
gctgctcgcgggaaa

SEQ ID NO: 24670 - DNA, 15 bp, Artificial Sequence
  dgRNA
  Olfr1097
ccaagtaaacttgct

SEQ ID NO: 24671 - DNA, 15 bp, Artificial Sequence
  dgRNA
  Olfr1097
tattatgctatcagc

SEQ ID NO: 24672 - DNA, 15 bp, Artificial Sequence
  dgRNA
  C1qc
gattctcaagcacgg

SEQ ID NO: 24673 - DNA, 15 bp, Artificial Sequence
  dgRNA
  C1qc
atcaccctgccccta

SEQ ID NO: 24674 - DNA, 15 bp, Artificial Sequence
  dgRNA
  C1qc
acatgacctagggcc

SEQ ID NO: 24675 - DNA, 15 bp, Artificial Sequence
  dgRNA
  C1qc
catgacctagggcca

SEQ ID NO: 24676 - DNA, 15 bp, Artificial Sequence
  dgRNA
  Cmtm8
gtggctcgagctaga

SEQ ID NO: 24677 - DNA, 15 bp, Artificial Sequence
  dgRNA
  Cmtm8
tcacccttagcgatc

SEQ ID NO: 24678 - DNA, 15 bp, Artificial Sequence
  dgRNA
  Cmtm8
ggtgctgtggccgcg

SEQ ID NO: 24679 - DNA, 15 bp, Artificial Sequence
  dgRNA
  Cmtm8
gctgtggccgcgcgg

SEQ ID NO: 24680 - DNA, 15 bp, Artificial Sequence
  dgRNA
  4933402E13Rik
agaagagcctaaaac

SEQ ID NO: 24681 - DNA, 15 bp, Artificial Sequence
  dgRNA
  4933402E13Rik
aactggtttcggact

SEQ ID NO: 24682 - DNA, 15 bp, Artificial Sequence
  dgRNA
  4933402E13Rik
ggttcatccttgagt

SEQ ID NO: 24683 - DNA, 15 bp, Artificial Sequence
  dgRNA
  4933402E13Rik
tttccctacgaaaag

SEQ ID NO: 24684 - DNA, 15 bp, Artificial Sequence
  dgRNA
  Fech
gcgccgcagacctag

SEQ ID NO: 24685 - DNA, 15 bp, Artificial Sequence
  dgRNA
  Fech
cgccgcagacctagc

SEQ ID NO: 24686 - DNA, 15 bp, Artificial Sequence
  dgRNA
  Fech
gacctagcgggaatc

SEQ ID NO: 24687 - DNA, 15 bp, Artificial Sequence
  dgRNA
  Fech
aggtgcgctgacccg

SEQ ID NO: 24688 - DNA, 15 bp, Artificial Sequence
  dgRNA
  Fosl1
cttggctagtctgaa

SEQ ID NO: 24689 - DNA, 15 bp, Artificial Sequence
  dgRNA
  Fosl1
tggctagtctgaacg

SEQ ID NO: 24690 - DNA, 15 bp, Artificial Sequence
  dgRNA
  Fosl1
ctagtctgaacgggg

SEQ ID NO: 24691 - DNA, 15 bp, Artificial Sequence
  dgRNA
  Fosl1
tagtctgaacggggc

SEQ ID NO: 24692 - DNA, 15 bp, Artificial Sequence
  dgRNA
  Adamts13
ttggtgctcttcaac

SEQ ID NO: 24693 - DNA, 15 bp, Artificial Sequence
  dgRNA
  Adamts13
accatgtcctgcacc

SEQ ID NO: 24694 - DNA, 15 bp, Artificial Sequence
  dgRNA
  Adamts13
gctgggcgggacatc

SEQ ID NO: 24695 - DNA, 15 bp, Artificial Sequence
  dgRNA
  Adamts13
gcaatgttcacttgc

SEQ ID NO: 24696 - DNA, 15 bp, Artificial Sequence
  dgRNA
  Dvl3
ttccgccagtcccac

SEQ ID NO: 24697 - DNA, 15 bp, Artificial Sequence
  dgRNA
  Dvl3
cgggctgagacttcc

SEQ ID NO: 24698 - DNA, 15 bp, Artificial Sequence
  dgRNA
  Dvl3
ctgaacccggagcac

SEQ ID NO: 24699 - DNA, 15 bp, Artificial Sequence
  dgRNA
  Dvl3
tgaacccggagcaca

SEQ ID NO: 24700 - DNA, 15 bp, Artificial Sequence
  dgRNA
  Mlst8
tgaagggtggcgtcg

SEQ ID NO: 24701 - DNA, 15 bp, Artificial Sequence
  dgRNA
  Mlst8
tggcgtcgcggctga

SEQ ID NO: 24702 - DNA, 15 bp, Artificial Sequence
  dgRNA
  Mlst8
gagcacgatcacttc

SEQ ID NO: 24703 - DNA, 15 bp, Artificial Sequence
  dgRNA
  Mlst8
cactccccggaccca

SEQ ID NO: 24704 - DNA, 15 bp, Artificial Sequence
  dgRNA
  Bdh2
aaaagcttacttaac

SEQ ID NO: 24705 - DNA, 15 bp, Artificial Sequence
  dgRNA
  Bdh2
acaggcattagcaaa

SEQ ID NO: 24706 - DNA, 15 bp, Artificial Sequence
  dgRNA
  Bdh2
agcaaaaggactcgg

SEQ ID NO: 24707 - DNA, 15 bp, Artificial Sequence
  dgRNA
  Bdh2
gcaaaaggactcgga

SEQ ID NO: 24708 - DNA, 15 bp, Artificial Sequence
  dgRNA
  Mettl5
caaagctggcgttcc

SEQ ID NO: 24709 - DNA, 15 bp, Artificial Sequence
  dgRNA
  Mettl5
aaagctggcgttccc

SEQ ID NO: 24710 - DNA, 15 bp, Artificial Sequence
  dgRNA
  Mettl5
tggcgttcccgggct

SEQ ID NO: 24711 - DNA, 15 bp, Artificial Sequence
  dgRNA
  Mettl5
cgttcccgggcttgg

SEQ ID NO: 24712 - DNA, 15 bp, Artificial Sequence
  dgRNA
  Trabd
aggccgtggtgcgga

SEQ ID NO: 24713 - DNA, 15 bp, Artificial Sequence
  dgRNA
  Trabd
acacagactcgcctg

SEQ ID NO: 24714 - DNA, 15 bp, Artificial Sequence
  dgRNA
  Trabd
acagactcgcctgtg

SEQ ID NO: 24715 - DNA, 15 bp, Artificial Sequence
  dgRNA
  Trabd
cagactcgcctgtgg

SEQ ID NO: 24716 - DNA, 15 bp, Artificial Sequence
  dgRNA
  Zdhhc4
ataataaaagtgcga

SEQ ID NO: 24717 - DNA, 15 bp, Artificial Sequence
  dgRNA
  Zdhhc4
gtacgaaaacacaat

SEQ ID NO: 24718 - DNA, 15 bp, Artificial Sequence
  dgRNA
  Zdhhc4
ggctcgcagaaccag

SEQ ID NO: 24719 - DNA, 15 bp, Artificial Sequence
  dgRNA
  Zdhhc4
ttttcgtaccgtcgt

SEQ ID NO: 24720 - DNA, 15 bp, Artificial Sequence
  dgRNA
  Fads2
aggaaggggaccgct

SEQ ID NO: 24721 - DNA, 15 bp, Artificial Sequence
  dgRNA
  Fads2
ggaaggggaccgctt

SEQ ID NO: 24722 - DNA, 15 bp, Artificial Sequence
  dgRNA
  Fads2
gaaggggaccgcttg

SEQ ID NO: 24723 - DNA, 15 bp, Artificial Sequence
  dgRNA
  Fads2
aaggggaccgcttgg

SEQ ID NO: 24724 - DNA, 15 bp, Artificial Sequence
  dgRNA
  Bre
cgcactaacctgacc

SEQ ID NO: 24725 - DNA, 15 bp, Artificial Sequence
  dgRNA
  Bre
ctaacctgaccaggt

SEQ ID NO: 24726 - DNA, 15 bp, Artificial Sequence
  dgRNA
  Bre
ccaggtcggtcatgc

SEQ ID NO: 24727 - DNA, 15 bp, Artificial Sequence
  dgRNA
  Bre
cctgaccccgtaacc

SEQ ID NO: 24728 - DNA, 15 bp, Artificial Sequence
  dgRNA
  Tmem154
gcaaacttgtcaaat

SEQ ID NO: 24729 - DNA, 15 bp, Artificial Sequence
  dgRNA
  Tmem154
aaatcggaacgtctg

SEQ ID NO: 24730 - DNA, 15 bp, Artificial Sequence
  dgRNA
  Tmem154
cggagtctgtttctc

SEQ ID NO: 24731 - DNA, 15 bp, Artificial Sequence
  dgRNA
  Tmem154
tgactgaatcagcgc

SEQ ID NO: 24732 - DNA, 15 bp, Artificial Sequence
  dgRNA
  Dmxl1
aaggggcggagcagt

SEQ ID NO: 24733 - DNA, 15 bp, Artificial Sequence
  dgRNA
  Dmxl1
ggtacgtttgcgcct

SEQ ID NO: 24734 - DNA, 15 bp, Artificial Sequence
  dgRNA
  Dmxl1
gtacgtttgcgcctc

SEQ ID NO: 24735 - DNA, 15 bp, Artificial Sequence
  dgRNA
  Dmxl1
tttgcgcctcgggat

SEQ ID NO: 24736 - DNA, 15 bp, Artificial Sequence
  dgRNA
  Esrrb
gccttcctactccac

SEQ ID NO: 24737 - DNA, 15 bp, Artificial Sequence
  dgRNA
  Esrrb
accttgcatgcccgc

SEQ ID NO: 24738 - DNA, 15 bp, Artificial Sequence
  dgRNA
  Esrrb
tccggcgggcatgca

SEQ ID NO: 24739 - DNA, 15 bp, Artificial Sequence
  dgRNA
  Esrrb
ataggacactccggc

SEQ ID NO: 24740 - DNA, 15 bp, Artificial Sequence
  dgRNA
  Tsga10
gtccctttacagtgc

SEQ ID NO: 24741 - DNA, 15 bp, Artificial Sequence
  dgRNA
  Tsga10
ttcatacactaccac

SEQ ID NO: 24742 - DNA, 15 bp, Artificial Sequence
  dgRNA
  Tsga10
gtaacactaagtcat

SEQ ID NO: 24743 - DNA, 15 bp, Artificial Sequence
  dgRNA
  Tsga10
gtgtatgaagacctc

SEQ ID NO: 24744 - DNA, 15 bp, Artificial Sequence
  dgRNA
  Dctd
aggacaaacctcact

SEQ ID NO: 24745 - DNA, 15 bp, Artificial Sequence
  dgRNA
  Dctd
cactgggaaccgtaa

SEQ ID NO: 24746 - DNA, 15 bp, Artificial Sequence
  dgRNA
  Dctd
gtcaccgcgacactg

SEQ ID NO: 24747 - DNA, 15 bp, Artificial Sequence
  dgRNA
  Dctd
ttacggttcccagtg

SEQ ID NO: 24748 - DNA, 15 bp, Artificial Sequence
  dgRNA
  Olfr1411
tctaagggtgcaaag

SEQ ID NO: 24749 - DNA, 15 bp, Artificial Sequence
  dgRNA
  Olfr1411
taggacgctggactg

SEQ ID NO: 24750 - DNA, 15 bp, Artificial Sequence
  dgRNA
  Olfr1411
gtctgtgtaggacgc

SEQ ID NO: 24751 - DNA, 15 bp, Artificial Sequence
  dgRNA
  Plcz1
tgagaaaacggtcca

SEQ ID NO: 24752 - DNA, 15 bp, Artificial Sequence
  dgRNA
  Plcz1
gagaaaacggtccat

SEQ ID NO: 24753 - DNA, 15 bp, Artificial Sequence
  dgRNA
  Plcz1
taccttgcccattca

SEQ ID NO: 24754 - DNA, 15 bp, Artificial Sequence
  dgRNA
  Plcz1
tttagagcagtatgc

SEQ ID NO: 24755 - DNA, 15 bp, Artificial Sequence
  dgRNA
  Fam221b
cgggctgcgctgaac

SEQ ID NO: 24756 - DNA, 15 bp, Artificial Sequence
  dgRNA
  Fam221b
gaaccggcgttaacc

SEQ ID NO: 24757 - DNA, 15 bp, Artificial Sequence
  dgRNA
  Fam221b
gttaaccaggccccg

SEQ ID NO: 24758 - DNA, 15 bp, Artificial Sequence
  dgRNA
  Fam221b
aaccaggccccgcgg

SEQ ID NO: 24759 - DNA, 15 bp, Artificial Sequence
  dgRNA
  A1bg
agggagcatctgcgg

SEQ ID NO: 24760 - DNA, 15 bp, Artificial Sequence
  dgRNA
  Stap1
acactacggagattt

SEQ ID NO: 24761 - DNA, 15 bp, Artificial Sequence
  dgRNA
  Stap1
ggcaactgttcaaag

SEQ ID NO: 24762 - DNA, 15 bp, Artificial Sequence
  dgRNA
  Stap1
ctccgtagtgttgag

SEQ ID NO: 24763 - DNA, 15 bp, Artificial Sequence
  dgRNA
  Lpl
ctataggggtcccta

SEQ ID NO: 24764 - DNA, 15 bp, Artificial Sequence
  dgRNA
  Lpl
cagattcctcccggt

SEQ ID NO: 24765 - DNA, 15 bp, Artificial Sequence
  dgRNA
  Lpl
tcccggtaggcaaac

SEQ ID NO: 24766 - DNA, 15 bp, Artificial Sequence
  dgRNA
  Lpl
tccccttcttctcgc

SEQ ID NO: 24767 - DNA, 15 bp, Artificial Sequence
  dgRNA
  Kir3dl1
atctgttggtgagcc

SEQ ID NO: 24768 - DNA, 15 bp, Artificial Sequence
  dgRNA
  Kir3dl1
aaaccacgggaagcc

SEQ ID NO: 24769 - DNA, 15 bp, Artificial Sequence
  dgRNA
  Kir3dl1
accggatgttctgag

SEQ ID NO: 24770 - DNA, 15 bp, Artificial Sequence
  dgRNA
  Eaf2
cgcccgtgtgagaat

SEQ ID NO: 24771 - DNA, 15 bp, Artificial Sequence
  dgRNA
  Eaf2
gagaattggaaagcg

SEQ ID NO: 24772 - DNA, 15 bp, Artificial Sequence
  dgRNA
  Eaf2
agaattggaaagcgg

SEQ ID NO: 24773 - DNA, 15 bp, Artificial Sequence
  dgRNA
  Eaf2
gaaagcgggggatga

SEQ ID NO: 24774 - DNA, 15 bp, Artificial Sequence
  dgRNA
  Rpl18a
gacgatggggcgtcc

SEQ ID NO: 24775 - DNA, 15 bp, Artificial Sequence
  dgRNA
  Rpl18a
acgatggggcgtccc

SEQ ID NO: 24776 - DNA, 15 bp, Artificial Sequence
  dgRNA
  Rpl18a
cgtcgcgctgctctc

SEQ ID NO: 24777 - DNA, 15 bp, Artificial Sequence
  dgRNA
  Rpl18a
gtcgcgctgctctct

SEQ ID NO: 24778 - DNA, 15 bp, Artificial Sequence
  dgRNA
  Slc27a2
agtaccactacctag

SEQ ID NO: 24779 - DNA, 15 bp, Artificial Sequence
  dgRNA
  Slc27a2
tagtggtactgtaca

SEQ ID NO: 24780 - DNA, 15 bp, Artificial Sequence
  dgRNA
  Slc27a2
aatgcccctaggtag

SEQ ID NO: 24781 - DNA, 15 bp, Artificial Sequence
  dgRNA
  Slc27a2
tgtattaatgcccct

SEQ ID NO: 24782 - DNA, 15 bp, Artificial Sequence
  dgRNA
  Gja10
agagactctacttgc

SEQ ID NO: 24783 - DNA, 15 bp, Artificial Sequence
  dgRNA
  Gja10
ggggcgcaccttttc

SEQ ID NO: 24784 - DNA, 15 bp, Artificial Sequence
  dgRNA
  Gja10
ccacaacagtcttct

SEQ ID NO: 24785 - DNA, 15 bp, Artificial Sequence
  dgRNA
  Gja10
ctcaatgagtggtag

SEQ ID NO: 24786 - DNA, 15 bp, Artificial Sequence
  dgRNA
  Bche
caaatgttaaagtcc

SEQ ID NO: 24787 - DNA, 15 bp, Artificial Sequence
  dgRNA
  Bche
ctaacgaaatggtat

SEQ ID NO: 24788 - DNA, 15 bp, Artificial Sequence
  dgRNA
  Bche
agtattctaacgaaa

SEQ ID NO: 24789 - DNA, 15 bp, Artificial Sequence
  dgRNA
  Bche
tttcgttctctatcg

SEQ ID NO: 24790 - DNA, 15 bp, Artificial Sequence
  dgRNA
  Atp11c
ctgcggcgggagcgc

SEQ ID NO: 24791 - DNA, 15 bp, Artificial Sequence
  dgRNA
  Atp11c
tgcggcgggagcgcg

SEQ ID NO: 24792 - DNA, 15 bp, Artificial Sequence
  dgRNA
  Atp11c
agcgcggggcggtgc

SEQ ID NO: 24793 - DNA, 15 bp, Artificial Sequence
  dgRNA
  Atp11c
gcgcggggcggtgct

SEQ ID NO: 24794 - DNA, 15 bp, Artificial Sequence
  dgRNA
  Dbnl
cacgccctgcagatg

SEQ ID NO: 24795 - DNA, 15 bp, Artificial Sequence
  dgRNA
  Dbnl
agatgcggacgaacg

SEQ ID NO: 24796 - DNA, 15 bp, Artificial Sequence
  dgRNA
  Dbnl
acgaacgaggaccta

SEQ ID NO: 24797 - DNA, 15 bp, Artificial Sequence
  dgRNA
  Dbnl
cgaacgaggacctac

SEQ ID NO: 24798 - DNA, 15 bp, Artificial Sequence
  dgRNA
  Xirp2
tcagttcctaaaaat

SEQ ID NO: 24799 - DNA, 15 bp, Artificial Sequence
  dgRNA
  Xirp2
ctaggttgcatcctt

SEQ ID NO: 24800 - DNA, 15 bp, Artificial Sequence
  dgRNA
  Xirp2
gagctctgtctaggt

SEQ ID NO: 24801 - DNA, 15 bp, Artificial Sequence
  dgRNA
  Xirp2
ctagcacctattttt

SEQ ID NO: 24802 - DNA, 15 bp, Artificial Sequence
  dgRNA
  Zfp426
tccgccctgacactg

SEQ ID NO: 24803 - DNA, 15 bp, Artificial Sequence
  dgRNA
  Zfp426
acaggaattcaaccg

SEQ ID NO: 24804 - DNA, 15 bp, Artificial Sequence
  dgRNA
  Zfp426
accgaggtagactcc

SEQ ID NO: 24805 - DNA, 15 bp, Artificial Sequence
  dgRNA
  Zfp426
ccgaggtagactccc

SEQ ID NO: 24806 - DNA, 15 bp, Artificial Sequence
  dgRNA
  Psrc1
gccccctaccctttt

SEQ ID NO: 24807 - DNA, 15 bp, Artificial Sequence
  dgRNA
  Psrc1
agggacaatcttctc

SEQ ID NO: 24808 - DNA, 15 bp, Artificial Sequence
  dgRNA
  Psrc1
cgtttgtggcgggac

SEQ ID NO: 24809 - DNA, 15 bp, Artificial Sequence
  dgRNA
  Psrc1
gtttgtggcgggact

SEQ ID NO: 24810 - DNA, 15 bp, Artificial Sequence
  dgRNA
  Triml1
acattaagtcacaat

SEQ ID NO: 24811 - DNA, 15 bp, Artificial Sequence
  dgRNA
  Triml1
caattggctttgtgc

SEQ ID NO: 24812 - DNA, 15 bp, Artificial Sequence
  dgRNA
  Triml1
agcgtatgtatcatt

SEQ ID NO: 24813 - DNA, 15 bp, Artificial Sequence
  dgRNA
  Triml1
tcatttggtgtaatc

SEQ ID NO: 24814 - DNA, 15 bp, Artificial Sequence
  dgRNA
  Ggnbp1
gtaaacaggagttta

SEQ ID NO: 24815 - DNA, 15 bp, Artificial Sequence
  dgRNA
  Ggnbp1
gcacacgctgagaac

SEQ ID NO: 24816 - DNA, 15 bp, Artificial Sequence
  dgRNA
  Ggnbp1
tagggcggccggggg

SEQ ID NO: 24817 - DNA, 15 bp, Artificial Sequence
  dgRNA
  Ggnbp1
atagggcggccgggg

SEQ ID NO: 24818 - DNA, 15 bp, Artificial Sequence
  dgRNA
  Spink7
gtcctatgctgactt

SEQ ID NO: 24819 - DNA, 15 bp, Artificial Sequence
  dgRNA
  Spink7
ccctcgctgagtaca

SEQ ID NO: 24820 - DNA, 15 bp, Artificial Sequence
  dgRNA
  Spink7
ctgtcagccaaattc

SEQ ID NO: 24821 - DNA, 15 bp, Artificial Sequence
  dgRNA
  Spink7
acgccacaccctgaa

SEQ ID NO: 24822 - DNA, 15 bp, Artificial Sequence
  dgRNA
  Bhlha15
tggccagatgcgatc

SEQ ID NO: 24823 - DNA, 15 bp, Artificial Sequence
  dgRNA
  Bhlha15
ggccagatgcgatcc

SEQ ID NO: 24824 - DNA, 15 bp, Artificial Sequence
  dgRNA
  Bhlha15
gaaggcgggtccgca

SEQ ID NO: 24825 - DNA, 15 bp, Artificial Sequence
  dgRNA
  Bhlha15
cgggtcctcagagcg

SEQ ID NO: 24826 - DNA, 15 bp, Artificial Sequence
  dgRNA
  Ndufaf5
agggaccggactata

SEQ ID NO: 24827 - DNA, 15 bp, Artificial Sequence
  dgRNA
  Ndufaf5
gggaccggactatag

SEQ ID NO: 24828 - DNA, 15 bp, Artificial Sequence
  dgRNA
  Ndufaf5
caaggagagcccgac

SEQ ID NO: 24829 - DNA, 15 bp, Artificial Sequence
  dgRNA
  Ndufaf5
gacgctccgtcttaa

SEQ ID NO: 24830 - DNA, 15 bp, Artificial Sequence
  dgRNA
  Rasa1
ctctttagcgtagcc

SEQ ID NO: 24831 - DNA, 15 bp, Artificial Sequence
  dgRNA
  Rasa1
cgtagccaggaagtt

SEQ ID NO: 24832 - DNA, 15 bp, Artificial Sequence
  dgRNA
  Rasa1
tgggtgtgcgcggcg

SEQ ID NO: 24833 - DNA, 15 bp, Artificial Sequence
  dgRNA
  Rasa1
gcctagcgtttctgc

SEQ ID NO: 24834 - DNA, 15 bp, Artificial Sequence
  dgRNA
  Ptpn21
ctgtagggctaacgc

SEQ ID NO: 24835 - DNA, 15 bp, Artificial Sequence
  dgRNA
  Ptpn21
ccctcctccgatcac

SEQ ID NO: 24836 - DNA, 15 bp, Artificial Sequence
  dgRNA
  Ptpn21
cctcctccgatcaca

SEQ ID NO: 24837 - DNA, 15 bp, Artificial Sequence
  dgRNA
  Ptpn21
ctcctccgatcacag

SEQ ID NO: 24838 - DNA, 15 bp, Artificial Sequence
  dgRNA
  Aqp8
cgcctttcctgttgc

SEQ ID NO: 24839 - DNA, 15 bp, Artificial Sequence
  dgRNA
  Aqp8
atcattgatcccacg

SEQ ID NO: 24840 - DNA, 15 bp, Artificial Sequence
  dgRNA
  Aqp8
ggccacctcccattc

SEQ ID NO: 24841 - DNA, 15 bp, Artificial Sequence
  dgRNA
  Aqp8
cttagtgccagcaac

SEQ ID NO: 24842 - DNA, 15 bp, Artificial Sequence
  dgRNA
  Lamtor2
ttgcgattgaccagt

SEQ ID NO: 24843 - DNA, 15 bp, Artificial Sequence
  dgRNA
  Lamtor2
aaggcgtccttcgcg

SEQ ID NO: 24844 - DNA, 15 bp, Artificial Sequence
  dgRNA
  Lamtor2
accacatggtcccac

SEQ ID NO: 24845 - DNA, 15 bp, Artificial Sequence
  dgRNA
  Lamtor2
tggaacgctgaacta

SEQ ID NO: 24846 - DNA, 15 bp, Artificial Sequence
  dgRNA
  Ell2
aaactcctgcgactt

SEQ ID NO: 24847 - DNA, 15 bp, Artificial Sequence
  dgRNA
  Ell2
aactcctgcgacttt

SEQ ID NO: 24848 - DNA, 15 bp, Artificial Sequence
  dgRNA
  Ell2
acagagtccagggcg

SEQ ID NO: 24849 - DNA, 15 bp, Artificial Sequence
  dgRNA
  Ell2
tccagggcggggtgc

SEQ ID NO: 24850 - DNA, 15 bp, Artificial Sequence
  dgRNA
  Mtmr10
agcgcgctctcaaga

SEQ ID NO: 24851 - DNA, 15 bp, Artificial Sequence
  dgRNA
  Mtmr10
cctctcgggtccccg

SEQ ID NO: 24852 - DNA, 15 bp, Artificial Sequence
  dgRNA
  Mtmr10
cgcgcgagtcgcttc

SEQ ID NO: 24853 - DNA, 15 bp, Artificial Sequence
  dgRNA
  Mtmr10
gcgcgagtcgcttcc

SEQ ID NO: 24854 - DNA, 15 bp, Artificial Sequence
  dgRNA
  Prkag1
catgaccctcgccgt

SEQ ID NO: 24855 - DNA, 15 bp, Artificial Sequence
  dgRNA
  Prkag1
gttggccagatctta

SEQ ID NO: 24856 - DNA, 15 bp, Artificial Sequence
  dgRNA
  Prkag1
gttacccaataaacc

SEQ ID NO: 24857 - DNA, 15 bp, Artificial Sequence
  dgRNA
  Prkag1
tcagccaccgccgga

SEQ ID NO: 24858 - DNA, 15 bp, Artificial Sequence
  dgRNA
  St3gal1
gatccccgtttgagc

SEQ ID NO: 24859 - DNA, 15 bp, Artificial Sequence
  dgRNA
  St3gal1
atccccgtttgagct

SEQ ID NO: 24860 - DNA, 15 bp, Artificial Sequence
  dgRNA
  St3gal1
tccccgtttgagctg

SEQ ID NO: 24861 - DNA, 15 bp, Artificial Sequence
  dgRNA
  St3gal1
gctgcttaccaatac

SEQ ID NO: 24862 - DNA, 15 bp, Artificial Sequence
  dgRNA
  Map2k7
ggcgttatgcacgcg

SEQ ID NO: 24863 - DNA, 15 bp, Artificial Sequence
  dgRNA
  Map2k7
ttatgcacgcgaggc

SEQ ID NO: 24864 - DNA, 15 bp, Artificial Sequence
  dgRNA
  Map2k7
tatgcacgcgaggca

SEQ ID NO: 24865 - DNA, 15 bp, Artificial Sequence
  dgRNA
  Map2k7
gcacgcgaggcaggg

SEQ ID NO: 24866 - DNA, 15 bp, Artificial Sequence
  dgRNA
  Mgmt
tccccgccccttttc

SEQ ID NO: 24867 - DNA, 15 bp, Artificial Sequence
  dgRNA
  Mgmt
cacgccccgcgtacc

SEQ ID NO: 24868 - DNA, 15 bp, Artificial Sequence
  dgRNA
  Mgmt
cccgctttacaccct

SEQ ID NO: 24869 - DNA, 15 bp, Artificial Sequence
  dgRNA
  Mgmt
ccgtgcacgcgcctg

SEQ ID NO: 24870 - DNA, 15 bp, Artificial Sequence
  dgRNA
  Cage1
gttcttgctccacca

SEQ ID NO: 24871 - DNA, 15 bp, Artificial Sequence
  dgRNA
  Cage1
ccaccatggcgttta

SEQ ID NO: 24872 - DNA, 15 bp, Artificial Sequence
  dgRNA
  Cage1
ggcgtttacggtcat

SEQ ID NO: 24873 - DNA, 15 bp, Artificial Sequence
  dgRNA
  Cage1
gacccaggtgcggtc

SEQ ID NO: 24874 - DNA, 15 bp, Artificial Sequence
  dgRNA
  Tex14
aaaaacccttgtagg

SEQ ID NO: 24875 - DNA, 15 bp, Artificial Sequence
  dgRNA
  Tex14
cttttcccgccctcg

SEQ ID NO: 24876 - DNA, 15 bp, Artificial Sequence
  dgRNA
  Tex14
ttttcccgccctcgc

SEQ ID NO: 24877 - DNA, 15 bp, Artificial Sequence
  dgRNA
  Tex14
tttcccgccctcgcg

SEQ ID NO: 24878 - DNA, 15 bp, Artificial Sequence
  dgRNA
  Zfp960
ccaatcacggcatga

SEQ ID NO: 24879 - DNA, 15 bp, Artificial Sequence
  dgRNA
  Zfp960
atcacggcatgaagg

SEQ ID NO: 24880 - DNA, 15 bp, Artificial Sequence
  dgRNA
  Zfp960
tgacagtcttagagg

SEQ ID NO: 24881 - DNA, 15 bp, Artificial Sequence
  dgRNA
  Zfp960
ggtggtttttccgga

SEQ ID NO: 24882 - DNA, 15 bp, Artificial Sequence
  dgRNA
  Clstn1
ccagcgggtccctcc

SEQ ID NO: 24883 - DNA, 15 bp, Artificial Sequence
  dgRNA
  Clstn1
cctcccggttgctcc

SEQ ID NO: 24884 - DNA, 15 bp, Artificial Sequence
  dgRNA
  Clstn1
ctcccggttgctccc

SEQ ID NO: 24885 - DNA, 15 bp, Artificial Sequence
  dgRNA
  Clstn1
cgggccaatcttcct

SEQ ID NO: 24886 - DNA, 15 bp, Artificial Sequence
  dgRNA
  Ube2i
atagtccaaattccc

SEQ ID NO: 24887 - DNA, 15 bp, Artificial Sequence
  dgRNA
  Ube2i
cttgttggctgcaac

SEQ ID NO: 24888 - DNA, 15 bp, Artificial Sequence
  dgRNA
  Ube2i
gcaactggccccgaa

SEQ ID NO: 24889 - DNA, 15 bp, Artificial Sequence
  dgRNA
  Ube2i
acgtgccaaaaaaaa

SEQ ID NO: 24890 - DNA, 15 bp, Artificial Sequence
  dgRNA
  Aurkc
gctgacctccgcaaa

SEQ ID NO: 24891 - DNA, 15 bp, Artificial Sequence
  dgRNA
  Aurkc
aagtaccatttgcgg

SEQ ID NO: 24892 - DNA, 15 bp, Artificial Sequence
  dgRNA
  Bcl2a1d
agaggtatatagacc

SEQ ID NO: 24893 - DNA, 15 bp, Artificial Sequence
  dgRNA
  Bcl2a1d
agtagtacacttgag

SEQ ID NO: 24894 - DNA, 15 bp, Artificial Sequence
  dgRNA
  Tchh
ttgaatactatattc

SEQ ID NO: 24895 - DNA, 15 bp, Artificial Sequence
  dgRNA
  Calm5
gagcttggtgtcaac

SEQ ID NO: 24896 - DNA, 15 bp, Artificial Sequence
  dgRNA
  Spag4
gggcgctctgtgacg

SEQ ID NO: 24897 - DNA, 15 bp, Artificial Sequence
  dgRNA
  Spag4
gcggctcctctgtga

SEQ ID NO: 24898 - DNA, 15 bp, Artificial Sequence
  dgRNA
  Spag4
gcccgtgacgtcact

SEQ ID NO: 24899 - DNA, 15 bp, Artificial Sequence
  dgRNA
  Spag4
ttgtcaccgtcacag

SEQ ID NO: 24900 - DNA, 15 bp, Artificial Sequence
  dgRNA
  Hnrnpk
agcgagacgcgacaa

SEQ ID NO: 24901 - DNA, 15 bp, Artificial Sequence
  dgRNA
  Hnrnpk
gcgagacgcgacaac

SEQ ID NO: 24902 - DNA, 15 bp, Artificial Sequence
  dgRNA
  Hnrnpk
gacaacgggtagctg

SEQ ID NO: 24903 - DNA, 15 bp, Artificial Sequence
  dgRNA
  Hnrnpk
ggtagctgcggaacc

SEQ ID NO: 24904 - DNA, 15 bp, Artificial Sequence
  dgRNA
  Rdh16
ggcctgtacgtcagc

SEQ ID NO: 24905 - DNA, 15 bp, Artificial Sequence
  dgRNA
  Rdh16
gcctgtacgtcagca

SEQ ID NO: 24906 - DNA, 15 bp, Artificial Sequence
  dgRNA
  Rdh16
tgtacgtcagcaggg

SEQ ID NO: 24907 - DNA, 15 bp, Artificial Sequence
  dgRNA
  Rdh16
gactttaacaggctt

SEQ ID NO: 24908 - DNA, 15 bp, Artificial Sequence
  dgRNA
  Dnah17
tgatgaccctgcacc

SEQ ID NO: 24909 - DNA, 15 bp, Artificial Sequence
  dgRNA
  Dnah17
gatgaccctgcacca

SEQ ID NO: 24910 - DNA, 15 bp, Artificial Sequence
  dgRNA
  Dnah17
gaggacggtggtgta

SEQ ID NO: 24911 - DNA, 15 bp, Artificial Sequence
  dgRNA
  Dnah17
cggtggtgtaaggaa

SEQ ID NO: 24912 - DNA, 15 bp, Artificial Sequence
  dgRNA
  Rgs4
tgcctactttgcgaa

SEQ ID NO: 24913 - DNA, 15 bp, Artificial Sequence
  dgRNA
  Rgs4
atggcttctctccgc

SEQ ID NO: 24914 - DNA, 15 bp, Artificial Sequence
  dgRNA
  Rgs4
tggcttctctccgct

SEQ ID NO: 24915 - DNA, 15 bp, Artificial Sequence
  dgRNA
  Rgs4
accctttctgagggc

SEQ ID NO: 24916 - DNA, 15 bp, Artificial Sequence
  dgRNA
  Rsrc1
tatctgtgacgataa

SEQ ID NO: 24917 - DNA, 15 bp, Artificial Sequence
  dgRNA
  Rsrc1
taacggcgaatacta

SEQ ID NO: 24918 - DNA, 15 bp, Artificial Sequence
  dgRNA
  Rsrc1
gacaatccactcgct

SEQ ID NO: 24919 - DNA, 15 bp, Artificial Sequence
  dgRNA
  Rsrc1
gctcggcattcctaa

SEQ ID NO: 24920 - DNA, 15 bp, Artificial Sequence
  dgRNA
  Olfr374
tggcccctaagaagc

SEQ ID NO: 24921 - DNA, 15 bp, Artificial Sequence
  dgRNA
  Olfr374
cctaacaagaccctg

SEQ ID NO: 24922 - DNA, 15 bp, Artificial Sequence
  dgRNA
  Olfr374
caagccagcttctta

SEQ ID NO: 24923 - DNA, 15 bp, Artificial Sequence
  dgRNA
  Olfr374
cttgttaggatcaac

SEQ ID NO: 24924 - DNA, 15 bp, Artificial Sequence
  dgRNA
  Shroom3
cctagacagggtgaa

SEQ ID NO: 24925 - DNA, 15 bp, Artificial Sequence
  dgRNA
  Shroom3
aggctttggcgcgtg

SEQ ID NO: 24926 - DNA, 15 bp, Artificial Sequence
  dgRNA
  Shroom3
ggctttggcgcgtgt

SEQ ID NO: 24927 - DNA, 15 bp, Artificial Sequence
  dgRNA
  Shroom3
gccgaaagcagtctg

SEQ ID NO: 24928 - DNA, 15 bp, Artificial Sequence
  dgRNA
  Btf3l4
taagcgcagacacaa

SEQ ID NO: 24929 - DNA, 15 bp, Artificial Sequence
  dgRNA
  Btf3l4
aagcgcagacacaat

SEQ ID NO: 24930 - DNA, 15 bp, Artificial Sequence
  dgRNA
  Btf3l4
cacaatgggacgcca

SEQ ID NO: 24931 - DNA, 15 bp, Artificial Sequence
  dgRNA
  Btf3l4
acaatgggacgccaa

SEQ ID NO: 24932 - DNA, 15 bp, Artificial Sequence
  dgRNA
  Sbp
gatgaaagggccctg

SEQ ID NO: 24933 - DNA, 15 bp, Artificial Sequence
  dgRNA
  Sbp
taaaacctgactact

SEQ ID NO: 24934 - DNA, 15 bp, Artificial Sequence
  dgRNA
  Sbp
aaaacctgactactt

SEQ ID NO: 24935 - DNA, 15 bp, Artificial Sequence
  dgRNA
  Map3k12
ggagttcaagtcgag

SEQ ID NO: 24936 - DNA, 15 bp, Artificial Sequence
  dgRNA
  Map3k12
gagttcaagtcgagt

SEQ ID NO: 24937 - DNA, 15 bp, Artificial Sequence
  dgRNA
  Map3k12
agttcaagtcgagtg

SEQ ID NO: 24938 - DNA, 15 bp, Artificial Sequence
  dgRNA
  Map3k12
caagtcgagtgggga

SEQ ID NO: 24939 - DNA, 15 bp, Artificial Sequence
  dgRNA
  H13
ctgaagaaatcgcct

SEQ ID NO: 24940 - DNA, 15 bp, Artificial Sequence
  dgRNA
  H13
aatcgcctaggacta

SEQ ID NO: 24941 - DNA, 15 bp, Artificial Sequence
  dgRNA
  H13
atcgcctaggactaa

SEQ ID NO: 24942 - DNA, 15 bp, Artificial Sequence
  dgRNA
  H13
cctaggactaaggga

SEQ ID NO: 24943 - DNA, 15 bp, Artificial Sequence
  dgRNA
  Sf1
tctccgccttggttc

SEQ ID NO: 24944 - DNA, 15 bp, Artificial Sequence
  dgRNA
  Sf1
ttctccattctcgag

SEQ ID NO: 24945 - DNA, 15 bp, Artificial Sequence
  dgRNA
  Sf1
ccattctcgagcggc

SEQ ID NO: 24946 - DNA, 15 bp, Artificial Sequence
  dgRNA
  Sf1
cgagcggctggctcc

SEQ ID NO: 24947 - DNA, 15 bp, Artificial Sequence
  dgRNA
  Ccdc177
agacctgcggtacct

SEQ ID NO: 24948 - DNA, 15 bp, Artificial Sequence
  dgRNA
  Ccdc177
cctgcggtaccttgg

SEQ ID NO: 24949 - DNA, 15 bp, Artificial Sequence
  dgRNA
  Ccdc177
gtaccttggcggtag

SEQ ID NO: 24950 - DNA, 15 bp, Artificial Sequence
  dgRNA
  Ccdc177
ccttggcggtagagg

SEQ ID NO: 24951 - DNA, 15 bp, Artificial Sequence
  dgRNA
  Strc
tcatgccgtctcctt

SEQ ID NO: 24952 - DNA, 15 bp, Artificial Sequence
  dgRNA
  Strc
ttgggtaatactctg

SEQ ID NO: 24953 - DNA, 15 bp, Artificial Sequence
  dgRNA
  Strc
tgggtaatactctga

SEQ ID NO: 24954 - DNA, 15 bp, Artificial Sequence
  dgRNA
  Strc
gagatcccctgtcat

SEQ ID NO: 24955 - DNA, 15 bp, Artificial Sequence
  dgRNA
  Trim15
cacccaagggaccga

SEQ ID NO: 24956 - DNA, 15 bp, Artificial Sequence
  dgRNA
  Trim15
gggaccgaaggcgac

SEQ ID NO: 24957 - DNA, 15 bp, Artificial Sequence
  dgRNA
  Trim15
cgaaggcgacaggag

SEQ ID NO: 24958 - DNA, 15 bp, Artificial Sequence
  dgRNA
  Trim15
gcccctgggaaacgc

SEQ ID NO: 24959 - DNA, 15 bp, Artificial Sequence
  dgRNA
  Mtif2
cccggtccccactgc

SEQ ID NO: 24960 - DNA, 15 bp, Artificial Sequence
  dgRNA
  Mtif2
ggaagctgcttccgg

SEQ ID NO: 24961 - DNA, 15 bp, Artificial Sequence
  dgRNA
  Mtif2
tgcttccggcggtac

SEQ ID NO: 24962 - DNA, 15 bp, Artificial Sequence
  dgRNA
  Mtif2
gtaccggaagcacga

SEQ ID NO: 24963 - DNA, 15 bp, Artificial Sequence
  dgRNA
  Btg4
gtttaaaattgccct

SEQ ID NO: 24964 - DNA, 15 bp, Artificial Sequence
  dgRNA
  Btg4
gtgtgattattctag

SEQ ID NO: 24965 - DNA, 15 bp, Artificial Sequence
  dgRNA
  Btg4
tggatagcacctgtg

SEQ ID NO: 24966 - DNA, 15 bp, Artificial Sequence
  dgRNA
  Btg4
ggatagcacctgtgt

SEQ ID NO: 24967 - DNA, 15 bp, Artificial Sequence
  dgRNA
  Tnni1
catatctgccctgcg

SEQ ID NO: 24968 - DNA, 15 bp, Artificial Sequence
  dgRNA
  Tnni1
ccctgcgaggtgtgc

SEQ ID NO: 24969 - DNA, 15 bp, Artificial Sequence
  dgRNA
  Tnni1
cctgcgaggtgtgca

SEQ ID NO: 24970 - DNA, 15 bp, Artificial Sequence
  dgRNA
  Tnni1
cgaggtgtgcagggt

SEQ ID NO: 24971 - DNA, 15 bp, Artificial Sequence
  dgRNA
  Ube2cbp
cctgtcctactagag

SEQ ID NO: 24972 - DNA, 15 bp, Artificial Sequence
  dgRNA
  Ube2cbp
tactagagcggccac

SEQ ID NO: 24973 - DNA, 15 bp, Artificial Sequence
  dgRNA
  Ube2cbp
actagagcggccact

SEQ ID NO: 24974 - DNA, 15 bp, Artificial Sequence
  dgRNA
  Ube2cbp
ctagagcggccactg

SEQ ID NO: 24975 - DNA, 15 bp, Artificial Sequence
  dgRNA
  Dcx
tctagctgttaatgc

SEQ ID NO: 24976 - DNA, 15 bp, Artificial Sequence
  dgRNA
  Dcx
gtaattaatcatagg

SEQ ID NO: 24977 - DNA, 15 bp, Artificial Sequence
  dgRNA
  Dcx
ctaagcttcagttac

SEQ ID NO: 24978 - DNA, 15 bp, Artificial Sequence
  dgRNA
  Dcx
taagcttcagttaca

SEQ ID NO: 24979 - DNA, 15 bp, Artificial Sequence
  dgRNA
  Morf4l2
tcgggggcgtggccc

SEQ ID NO: 24980 - DNA, 15 bp, Artificial Sequence
  dgRNA
  Morf4l2
cgggggcgtggcccc

SEQ ID NO: 24981 - DNA, 15 bp, Artificial Sequence
  dgRNA
  Morf4l2
cgctcttcccactcg

SEQ ID NO: 24982 - DNA, 15 bp, Artificial Sequence
  dgRNA
  Morf4l2
gctcttcccactcgc

SEQ ID NO: 24983 - DNA, 15 bp, Artificial Sequence
  dgRNA
  Ifi27
ctgagtggatttgtc

SEQ ID NO: 24984 - DNA, 15 bp, Artificial Sequence
  dgRNA
  Ifi27
agaaacctatcttat

SEQ ID NO: 24985 - DNA, 15 bp, Artificial Sequence
  dgRNA
  Ifi27
tatcttcaactagag

SEQ ID NO: 24986 - DNA, 15 bp, Artificial Sequence
  dgRNA
  Ifi27
ctagagtggatttgt

SEQ ID NO: 24987 - DNA, 15 bp, Artificial Sequence
  dgRNA
  Ccl20
ggaagttttccctgt

SEQ ID NO: 24988 - DNA, 15 bp, Artificial Sequence
  dgRNA
  Ccl20
ggcagattaatcaat

SEQ ID NO: 24989 - DNA, 15 bp, Artificial Sequence
  dgRNA
  Ccl20
gcagattaatcaatg

SEQ ID NO: 24990 - DNA, 15 bp, Artificial Sequence
  dgRNA
  Ccl20
cagattaatcaatgg

SEQ ID NO: 24991 - DNA, 15 bp, Artificial Sequence
  dgRNA
  Tmc8
aaaagcaggtcggcc

SEQ ID NO: 24992 - DNA, 15 bp, Artificial Sequence
  dgRNA
  Tmc8
tgcccgtgaccctcc

SEQ ID NO: 24993 - DNA, 15 bp, Artificial Sequence
  dgRNA
  Tmc8
cgtgaccctccaggt

SEQ ID NO: 24994 - DNA, 15 bp, Artificial Sequence
  dgRNA
  Tmc8
gtgaccctccaggtc

SEQ ID NO: 24995 - DNA, 15 bp, Artificial Sequence
  dgRNA
  Pxylp1
caaggcccgggatgc

SEQ ID NO: 24996 - DNA, 15 bp, Artificial Sequence
  dgRNA
  Pxylp1
gtcgccgcagcctgc

SEQ ID NO: 24997 - DNA, 15 bp, Artificial Sequence
  dgRNA
  Pxylp1
ccgcacggccgcctg

SEQ ID NO: 24998 - DNA, 15 bp, Artificial Sequence
  dgRNA
  Pxylp1
cgcacggccgcctgc

SEQ ID NO: 24999 - DNA, 15 bp, Artificial Sequence
  dgRNA
  Bpifb2
ccgtgcttgcatacg

SEQ ID NO: 25000 - DNA, 15 bp, Artificial Sequence
  dgRNA
  Bpifb2
caaggcgatgtttgc

SEQ ID NO: 25001 - DNA, 15 bp, Artificial Sequence
  dgRNA
  Bpifb2
aaggcgatgtttgca

SEQ ID NO: 25002 - DNA, 15 bp, Artificial Sequence
  dgRNA
  Bpifb2
aaactggccgctccc

SEQ ID NO: 25003 - DNA, 15 bp, Artificial Sequence
  dgRNA
  Foxp4
ctcggagtccggagc

SEQ ID NO: 25004 - DNA, 15 bp, Artificial Sequence
  dgRNA
  Foxp4
agccggtcgccccta

SEQ ID NO: 25005 - DNA, 15 bp, Artificial Sequence
  dgRNA
  Foxp4
gtcgcccctacggac

SEQ ID NO: 25006 - DNA, 15 bp, Artificial Sequence
  dgRNA
  Foxp4
ccccaacacgcgatc

SEQ ID NO: 25007 - DNA, 15 bp, Artificial Sequence
  dgRNA
  Smyd5
tccaagcacaaagtc

SEQ ID NO: 25008 - DNA, 15 bp, Artificial Sequence
  dgRNA
  Smyd5
gctagccacgtccca

SEQ ID NO: 25009 - DNA, 15 bp, Artificial Sequence
  dgRNA
  Smyd5
agccacgtcccaggg

SEQ ID NO: 25010 - DNA, 15 bp, Artificial Sequence
  dgRNA
  Smyd5
gccacgtcccagggc

SEQ ID NO: 25011 - DNA, 15 bp, Artificial Sequence
  dgRNA
  Tmem130
gggctccttgatcgt

SEQ ID NO: 25012 - DNA, 15 bp, Artificial Sequence
  dgRNA
  Tmem130
gtcggtctgttaact

SEQ ID NO: 25013 - DNA, 15 bp, Artificial Sequence
  dgRNA
  Tmem130
cggaagcacgatgct

SEQ ID NO: 25014 - DNA, 15 bp, Artificial Sequence
  dgRNA
  Tmem130
aagcacgatgcttgg

SEQ ID NO: 25015 - DNA, 15 bp, Artificial Sequence
  dgRNA
  Pou5f1
tggggtcccgtccta

SEQ ID NO: 25016 - DNA, 15 bp, Artificial Sequence
  dgRNA
  Pou5f1
ggggtcccgtcctaa

SEQ ID NO: 25017 - DNA, 15 bp, Artificial Sequence
  dgRNA
  Pou5f1
tccccaacctccgtc

SEQ ID NO: 25018 - DNA, 15 bp, Artificial Sequence
  dgRNA
  Pou5f1
ccgtctggaagacac

SEQ ID NO: 25019 - DNA, 15 bp, Artificial Sequence
  dgRNA
  Bre
ctcccgggaaccttc

SEQ ID NO: 25020 - DNA, 15 bp, Artificial Sequence
  dgRNA
  Bre
ccttcaggcgctacc

SEQ ID NO: 25021 - DNA, 15 bp, Artificial Sequence
  dgRNA
  Bre
tccggcttctcggcg

SEQ ID NO: 25022 - DNA, 15 bp, Artificial Sequence
  dgRNA
  Bre
ccggcttctcggcgc

SEQ ID NO: 25023 - DNA, 15 bp, Artificial Sequence
  dgRNA
  Aqp9
caaatagcaatgagc

SEQ ID NO: 25024 - DNA, 15 bp, Artificial Sequence
  dgRNA
  Aqp9
aaagagatgctacgt

SEQ ID NO: 25025 - DNA, 15 bp, Artificial Sequence
  dgRNA
  Tstd3
tctttctgccggtgc

SEQ ID NO: 25026 - DNA, 15 bp, Artificial Sequence
  dgRNA
  Tstd3
ccggtgctggctgcg

SEQ ID NO: 25027 - DNA, 15 bp, Artificial Sequence
  dgRNA
  Tstd3
tcaccacatatttac

SEQ ID NO: 25028 - DNA, 15 bp, Artificial Sequence
  dgRNA
  Tstd3
ggcaaggtttttggc

SEQ ID NO: 25029 - DNA, 15 bp, Artificial Sequence
  dgRNA
  Fra10ac1
acccccgagccattc

SEQ ID NO: 25030 - DNA, 15 bp, Artificial Sequence
  dgRNA
  Fra10ac1
acagagtcggcgcgc

SEQ ID NO: 25031 - DNA, 15 bp, Artificial Sequence
  dgRNA
  Fra10ac1
cggcgcgccggagaa

SEQ ID NO: 25032 - DNA, 15 bp, Artificial Sequence
  dgRNA
  Fra10ac1
gacacgcctctgagc

SEQ ID NO: 25033 - DNA, 15 bp, Artificial Sequence
  dgRNA
  Gramd4
gtccggttttgctgt

SEQ ID NO: 25034 - DNA, 15 bp, Artificial Sequence
  dgRNA
  Gramd4
aggaaccagcgagat

SEQ ID NO: 25035 - DNA, 15 bp, Artificial Sequence
  dgRNA
  Gramd4
ccagcgagattggtg

SEQ ID NO: 25036 - DNA, 15 bp, Artificial Sequence
  dgRNA
  Gramd4
agattggtgtggcat

SEQ ID NO: 25037 - DNA, 15 bp, Artificial Sequence
  dgRNA
  Metrn
acatcaaccctgcct

SEQ ID NO: 25038 - DNA, 15 bp, Artificial Sequence
  dgRNA
  Metrn
cgagggtgctgcaat

SEQ ID NO: 25039 - DNA, 15 bp, Artificial Sequence
  dgRNA
  Metrn
gggtgctgcaattgg

SEQ ID NO: 25040 - DNA, 15 bp, Artificial Sequence
  dgRNA
  Metrn
aagttctgcggcttg

SEQ ID NO: 25041 - DNA, 15 bp, Artificial Sequence
  dgRNA
  Pard3
ctcttacaatggtca

SEQ ID NO: 25042 - DNA, 15 bp, Artificial Sequence
  dgRNA
  Rpp30
cacactaactttggc

SEQ ID NO: 25043 - DNA, 15 bp, Artificial Sequence
  dgRNA
  Rpp30
tgagggacaacacgg

SEQ ID NO: 25044 - DNA, 15 bp, Artificial Sequence
  dgRNA
  Rpp30
ggcggctgcgcagac

SEQ ID NO: 25045 - DNA, 15 bp, Artificial Sequence
  dgRNA
  Rpp30
tttctcagtcgtctt

SEQ ID NO: 25046 - DNA, 15 bp, Artificial Sequence
  dgRNA
  Topors
cgagcaagcagctac

SEQ ID NO: 25047 - DNA, 15 bp, Artificial Sequence
  dgRNA
  Topors
aacccctgacgtcag

SEQ ID NO: 25048 - DNA, 15 bp, Artificial Sequence
  dgRNA
  Topors
aaaagcgtgtcctcc

SEQ ID NO: 25049 - DNA, 15 bp, Artificial Sequence
  dgRNA
  Topors
atcgtcttgctctct

SEQ ID NO: 25050 - DNA, 15 bp, Artificial Sequence
  dgRNA
  Slc37a3
ctccgctaacatttc

SEQ ID NO: 25051 - DNA, 15 bp, Artificial Sequence
  dgRNA
  Slc37a3
ctagtcccttcctgc

SEQ ID NO: 25052 - DNA, 15 bp, Artificial Sequence
  dgRNA
  Slc37a3
gactttacagctcgc

SEQ ID NO: 25053 - DNA, 15 bp, Artificial Sequence
  dgRNA
  Slc37a3
agctcgcaggtaaag

SEQ ID NO: 25054 - DNA, 15 bp, Artificial Sequence
  dgRNA
  Gatb
caactccccgctagg

SEQ ID NO: 25055 - DNA, 15 bp, Artificial Sequence
  dgRNA
  Gatb
tccctaacaaagttc

SEQ ID NO: 25056 - DNA, 15 bp, Artificial Sequence
  dgRNA
  Gatb
cggcagcctttgaat

SEQ ID NO: 25057 - DNA, 15 bp, Artificial Sequence
  dgRNA
  Gatb
tttgaattgggttgc

SEQ ID NO: 25058 - DNA, 15 bp, Artificial Sequence
  dgRNA
  Specc1
accaccattctgtgg

SEQ ID NO: 25059 - DNA, 15 bp, Artificial Sequence
  dgRNA
  Specc1
tttacacctctgaac

SEQ ID NO: 25060 - DNA, 15 bp, Artificial Sequence
  dgRNA
  N6amt1
acgatgctcaatatt

SEQ ID NO: 25061 - DNA, 15 bp, Artificial Sequence
  dgRNA
  N6amt1
cgatgctcaatatta

SEQ ID NO: 25062 - DNA, 15 bp, Artificial Sequence
  dgRNA
  N6amt1
gaaaacggatgttag

SEQ ID NO: 25063 - DNA, 15 bp, Artificial Sequence
  dgRNA
  N6amt1
ggtgaaagagcttgt

SEQ ID NO: 25064 - DNA, 15 bp, Artificial Sequence
  dgRNA
  Sfrp2
gccagcgagcgcgtg

SEQ ID NO: 25065 - DNA, 15 bp, Artificial Sequence
  dgRNA
  Sfrp2
ccagcgagcgcgtga

SEQ ID NO: 25066 - DNA, 15 bp, Artificial Sequence
  dgRNA
  Sfrp2
cagcgagcgcgtgag

SEQ ID NO: 25067 - DNA, 15 bp, Artificial Sequence
  dgRNA
  Sfrp2
agtgaccggcctcct

SEQ ID NO: 25068 - DNA, 15 bp, Artificial Sequence
  dgRNA
  B430306N03Rik
gagggtctaacctga

SEQ ID NO: 25069 - DNA, 15 bp, Artificial Sequence
  dgRNA
  B430306N03Rik
agtggcggaactggc

SEQ ID NO: 25070 - DNA, 15 bp, Artificial Sequence
  dgRNA
  B430306N03Rik
gtggcggaactggcc

SEQ ID NO: 25071 - DNA, 15 bp, Artificial Sequence
  dgRNA
  B430306N03Rik
tggcggaactggccg

SEQ ID NO: 25072 - DNA, 15 bp, Artificial Sequence
  dgRNA
  Phf8
ccgcctcgcctaaga

SEQ ID NO: 25073 - DNA, 15 bp, Artificial Sequence
  dgRNA
  Phf8
cctcgcctaagatgg

SEQ ID NO: 25074 - DNA, 15 bp, Artificial Sequence
  dgRNA
  Phf8
ccgcctatcagctca

SEQ ID NO: 25075 - DNA, 15 bp, Artificial Sequence
  dgRNA
  Phf8
ggtcttatgcgccat

SEQ ID NO: 25076 - DNA, 15 bp, Artificial Sequence
  dgRNA
  Pcdhga12
tgcattaacttgaac

SEQ ID NO: 25077 - DNA, 15 bp, Artificial Sequence
  dgRNA
  Pcdhga12
cacctttagagtaag

SEQ ID NO: 25078 - DNA, 15 bp, Artificial Sequence
  dgRNA
  Elk3
cggggcaccattagc

SEQ ID NO: 25079 - DNA, 15 bp, Artificial Sequence
  dgRNA
  Elk3
ggggcaccattagca

SEQ ID NO: 25080 - DNA, 15 bp, Artificial Sequence
  dgRNA
  Elk3
gcagggcacgaaccc

SEQ ID NO: 25081 - DNA, 15 bp, Artificial Sequence
  dgRNA
  Elk3
ggtgatgccaaactt

SEQ ID NO: 25082 - DNA, 15 bp, Artificial Sequence
  dgRNA
  Tiam1
cccagttgaaagacc

SEQ ID NO: 25083 - DNA, 15 bp, Artificial Sequence
  dgRNA
  Tiam1
cgaagttgcgctatc

SEQ ID NO: 25084 - DNA, 15 bp, Artificial Sequence
  dgRNA
  Tiam1
gaagttgcgctatct

SEQ ID NO: 25085 - DNA, 15 bp, Artificial Sequence
  dgRNA
  Tiam1
agagccacccgcatc

SEQ ID NO: 25086 - DNA, 15 bp, Artificial Sequence
  dgRNA
  S100a10
ctttgcccgtcccca

SEQ ID NO: 25087 - DNA, 15 bp, Artificial Sequence
  dgRNA
  S100a10
actttgcccgtcccc

SEQ ID NO: 25088 - DNA, 15 bp, Artificial Sequence
  dgRNA
  Clip3
tcccccgccagcgtc

SEQ ID NO: 25089 - DNA, 15 bp, Artificial Sequence
  dgRNA
  Clip3
cccccgccagcgtct

SEQ ID NO: 25090 - DNA, 15 bp, Artificial Sequence
  dgRNA
  Clip3
agatagtcccctgga

SEQ ID NO: 25091 - DNA, 15 bp, Artificial Sequence
  dgRNA
  Clip3
tgggagatagtcccc

SEQ ID NO: 25092 - DNA, 15 bp, Artificial Sequence
  dgRNA
  Olfm4
gggggcctgtatcta

SEQ ID NO: 25093 - DNA, 15 bp, Artificial Sequence
  dgRNA
  Olfm4
cctgtatctaagggc

SEQ ID NO: 25094 - DNA, 15 bp, Artificial Sequence
  dgRNA
  Olfm4
gtgcaaggtgtggac

SEQ ID NO: 25095 - DNA, 15 bp, Artificial Sequence
  dgRNA
  Olfm4
tgtcccgaccctcct

SEQ ID NO: 25096 - DNA, 15 bp, Artificial Sequence
  dgRNA
  Rgs3
cgggcttatctgcag

SEQ ID NO: 25097 - DNA, 15 bp, Artificial Sequence
  dgRNA
  Rgs3
tgcagataagcccga

SEQ ID NO: 25098 - DNA, 15 bp, Artificial Sequence
  dgRNA
  Cept1
aacctgccgagcgcc

SEQ ID NO: 25099 - DNA, 15 bp, Artificial Sequence
  dgRNA
  Cept1
gccgagcgccaggcc

SEQ ID NO: 25100 - DNA, 15 bp, Artificial Sequence
  dgRNA
  Cept1
gaacaggcccactgt

SEQ ID NO: 25101 - DNA, 15 bp, Artificial Sequence
  dgRNA
  Cept1
cgctcccgagtagct

SEQ ID NO: 25102 - DNA, 15 bp, Artificial Sequence
  dgRNA
  Zfp775
atgggaaggttacgt

SEQ ID NO: 25103 - DNA, 15 bp, Artificial Sequence
  dgRNA
  Zfp775
cctggggggtaagat

SEQ ID NO: 25104 - DNA, 15 bp, Artificial Sequence
  dgRNA
  Zfp775
acctggggggtaaga

SEQ ID NO: 25105 - DNA, 15 bp, Artificial Sequence
  dgRNA
  Prkag2
cggacggcgaagcac

SEQ ID NO: 25106 - DNA, 15 bp, Artificial Sequence
  dgRNA
  Prkag2
ggacggcgaagcact

SEQ ID NO: 25107 - DNA, 15 bp, Artificial Sequence
  dgRNA
  Prkag2
gacggcgaagcactg

SEQ ID NO: 25108 - DNA, 15 bp, Artificial Sequence
  dgRNA
  Prkag2
acgcttgcttgctcg

SEQ ID NO: 25109 - DNA, 15 bp, Artificial Sequence
  dgRNA
  Hapln3
agcagctactccccc

SEQ ID NO: 25110 - DNA, 15 bp, Artificial Sequence
  dgRNA
  Hapln3
gcagctactcccccg

SEQ ID NO: 25111 - DNA, 15 bp, Artificial Sequence
  dgRNA
  Hapln3
tactcccccggggcc

SEQ ID NO: 25112 - DNA, 15 bp, Artificial Sequence
  dgRNA
  Hapln3
ccggggccaggcctt

SEQ ID NO: 25113 - DNA, 15 bp, Artificial Sequence
  dgRNA
  Acvr1b
ccgcacgggtgcgcg

SEQ ID NO: 25114 - DNA, 15 bp, Artificial Sequence
  dgRNA
  Acvr1b
acgggtgcgcgaggt

SEQ ID NO: 25115 - DNA, 15 bp, Artificial Sequence
  dgRNA
  Acvr1b
gcgcgaggttggccg

SEQ ID NO: 25116 - DNA, 15 bp, Artificial Sequence
  dgRNA
  Acvr1b
ctccgcccctttaac

SEQ ID NO: 25117 - DNA, 15 bp, Artificial Sequence
  dgRNA
  Shfm1
aaatctttcacacgt

SEQ ID NO: 25118 - DNA, 15 bp, Artificial Sequence
  dgRNA
  Shfm1
acctactacaaccgc

SEQ ID NO: 25119 - DNA, 15 bp, Artificial Sequence
  dgRNA
  Shfm1
aaccgcaggacgctc

SEQ ID NO: 25120 - DNA, 15 bp, Artificial Sequence
  dgRNA
  Shfm1
accgcaggacgctct

SEQ ID NO: 25121 - DNA, 15 bp, Artificial Sequence
  dgRNA
  Mpi
catacgggtaaaaga

SEQ ID NO: 25122 - DNA, 15 bp, Artificial Sequence
  dgRNA
  Mpi
cgcgcgcagaaaaag

SEQ ID NO: 25123 - DNA, 15 bp, Artificial Sequence
  dgRNA
  Mpi
gcgcagaaaaagcgg

SEQ ID NO: 25124 - DNA, 15 bp, Artificial Sequence
  dgRNA
  Mpi
cgcgcggagcttcac

SEQ ID NO: 25125 - DNA, 15 bp, Artificial Sequence
  dgRNA
  Foxm1
cccctcgagccccgc

SEQ ID NO: 25126 - DNA, 15 bp, Artificial Sequence
  dgRNA
  Foxm1
cctcgagccccgccg

SEQ ID NO: 25127 - DNA, 15 bp, Artificial Sequence
  dgRNA
  Foxm1
ccttacccgccctcc

SEQ ID NO: 25128 - DNA, 15 bp, Artificial Sequence
  dgRNA
  Foxm1
cggccgccgctcctc

SEQ ID NO: 25129 - DNA, 15 bp, Artificial Sequence
  dgRNA
  Fam187a
ccattatctctcgga

SEQ ID NO: 25130 - DNA, 15 bp, Artificial Sequence
  dgRNA
  Fam187a
cattctagattcccc

SEQ ID NO: 25131 - DNA, 15 bp, Artificial Sequence
  dgRNA
  Fam187a
cccctggcccatttt

SEQ ID NO: 25132 - DNA, 15 bp, Artificial Sequence
  dgRNA
  Fam187a
ccctggcccattttt

SEQ ID NO: 25133 - DNA, 15 bp, Artificial Sequence
  dgRNA
  Cd209d
tgtgaccaaatttat

SEQ ID NO: 25134 - DNA, 15 bp, Artificial Sequence
  dgRNA
  Cd209d
tttagggcgaggtct

SEQ ID NO: 25135 - DNA, 15 bp, Artificial Sequence
  dgRNA
  Cd209d
ttttagggcgaggtc

SEQ ID NO: 25136 - DNA, 15 bp, Artificial Sequence
  dgRNA
  Cd209d
aatttttttagggcg

SEQ ID NO: 25137 - DNA, 15 bp, Artificial Sequence
  dgRNA
  Camk2a
gggtccacttgctcc

SEQ ID NO: 25138 - DNA, 15 bp, Artificial Sequence
  dgRNA
  Camk2a
ggtccacttgctcct

SEQ ID NO: 25139 - DNA, 15 bp, Artificial Sequence
  dgRNA
  Camk2a
gtgtatataaggcca

SEQ ID NO: 25140 - DNA, 15 bp, Artificial Sequence
  dgRNA
  Camk2a
gggaggcagttaccg

SEQ ID NO: 25141 - DNA, 15 bp, Artificial Sequence
  dgRNA
  Dazap2
gaagccgcgcaggga

SEQ ID NO: 25142 - DNA, 15 bp, Artificial Sequence
  dgRNA
  Dazap2
aagccgcgcagggag

SEQ ID NO: 25143 - DNA, 15 bp, Artificial Sequence
  dgRNA
  Dazap2
ccgcgcagggagggg

SEQ ID NO: 25144 - DNA, 15 bp, Artificial Sequence
  dgRNA
  Dazap2
cggggccgagcccag

SEQ ID NO: 25145 - DNA, 15 bp, Artificial Sequence
  dgRNA
  Hnrnpa3
caatatgggaccgag

SEQ ID NO: 25146 - DNA, 15 bp, Artificial Sequence
  dgRNA
  Prpsap2
tcccgcccactctgg

SEQ ID NO: 25147 - DNA, 15 bp, Artificial Sequence
  dgRNA
  Prpsap2
tagtcagttgccctc

SEQ ID NO: 25148 - DNA, 15 bp, Artificial Sequence
  dgRNA
  Prpsap2
gcgtggttggaagtg

SEQ ID NO: 25149 - DNA, 15 bp, Artificial Sequence
  dgRNA
  Prpsap2
tagagtgggcgtggt

SEQ ID NO: 25150 - DNA, 15 bp, Artificial Sequence
  dgRNA
  Rrbp1
gtagaccctcctttt

SEQ ID NO: 25151 - DNA, 15 bp, Artificial Sequence
  dgRNA
  Rrbp1
ctcctttttggccaa

SEQ ID NO: 25152 - DNA, 15 bp, Artificial Sequence
  dgRNA
  Rrbp1
caatggtcgccaccg

SEQ ID NO: 25153 - DNA, 15 bp, Artificial Sequence
  dgRNA
  Rrbp1
gtcgccaccgcggcg

SEQ ID NO: 25154 - DNA, 15 bp, Artificial Sequence
  dgRNA
  Accsl
cctccttcgaagagc

SEQ ID NO: 25155 - DNA, 15 bp, Artificial Sequence
  dgRNA
  Accsl
ctccttcgaagagca

SEQ ID NO: 25156 - DNA, 15 bp, Artificial Sequence
  dgRNA
  Accsl
tccttcgaagagcag

SEQ ID NO: 25157 - DNA, 15 bp, Artificial Sequence
  dgRNA
  Accsl
aggccatctagataa

SEQ ID NO: 25158 - DNA, 15 bp, Artificial Sequence
  dgRNA
  Rbms1
ttgccgccccagccc

SEQ ID NO: 25159 - DNA, 15 bp, Artificial Sequence
  dgRNA
  Rbms1
ccgggaggccgagcg

SEQ ID NO: 25160 - DNA, 15 bp, Artificial Sequence
  dgRNA
  Rbms1
cgggaggccgagcgc

SEQ ID NO: 25161 - DNA, 15 bp, Artificial Sequence
  dgRNA
  Rbms1
cgagcgcgggggccg

SEQ ID NO: 25162 - DNA, 15 bp, Artificial Sequence
  dgRNA
  Rhox8
gccagagcaatcagc

SEQ ID NO: 25163 - DNA, 15 bp, Artificial Sequence
  dgRNA
  Rhox8
gcctgctgattgctc

SEQ ID NO: 25164 - DNA, 15 bp, Artificial Sequence
  dgRNA
  Rhox8
tgggggtgtaacatt

SEQ ID NO: 25165 - DNA, 15 bp, Artificial Sequence
  dgRNA
  Rhox8
gtgggggtgtaacat

SEQ ID NO: 25166 - DNA, 15 bp, Artificial Sequence
  dgRNA
  G6pc
gcccaagttaataat

SEQ ID NO: 25167 - DNA, 15 bp, Artificial Sequence
  dgRNA
  G6pc
aattggctctgccaa

SEQ ID NO: 25168 - DNA, 15 bp, Artificial Sequence
  dgRNA
  G6pc
ctgccaatggcgatc

SEQ ID NO: 25169 - DNA, 15 bp, Artificial Sequence
  dgRNA
  G6pc
accatgactcttgca

SEQ ID NO: 25170 - DNA, 15 bp, Artificial Sequence
  dgRNA
  Cfap221
agtagatgagaagcg

SEQ ID NO: 25171 - DNA, 15 bp, Artificial Sequence
  dgRNA
  Cfap221
ggacggcctgagccg

SEQ ID NO: 25172 - DNA, 15 bp, Artificial Sequence
  dgRNA
  Cfap221
gtgcgtgatttctca

SEQ ID NO: 25173 - DNA, 15 bp, Artificial Sequence
  dgRNA
  Cfap221
tctcagggtaattcc

SEQ ID NO: 25174 - DNA, 15 bp, Artificial Sequence
  dgRNA
  A630033H20Rik
ccacaatatcctctg

SEQ ID NO: 25175 - DNA, 15 bp, Artificial Sequence
  dgRNA
  A630033H20Rik
tatcctctgaggcaa

SEQ ID NO: 25176 - DNA, 15 bp, Artificial Sequence
  dgRNA
  A630033H20Rik
tctacctcccattag

SEQ ID NO: 25177 - DNA, 15 bp, Artificial Sequence
  dgRNA
  A630033H20Rik
tttacctctaatggg

SEQ ID NO: 25178 - DNA, 15 bp, Artificial Sequence
  dgRNA
  Tbc1d9
gtggggagaattagt

SEQ ID NO: 25179 - DNA, 15 bp, Artificial Sequence
  dgRNA
  Tbc1d9
tagcttacgccctgt

SEQ ID NO: 25180 - DNA, 15 bp, Artificial Sequence
  dgRNA
  Tbc1d9
acgccctgtaggtca

SEQ ID NO: 25181 - DNA, 15 bp, Artificial Sequence
  dgRNA
  Tbc1d9
tgtaatgcatttagc

SEQ ID NO: 25182 - DNA, 15 bp, Artificial Sequence
  dgRNA
  Cyp4f16
ccgcccaacttgttt

SEQ ID NO: 25183 - DNA, 15 bp, Artificial Sequence
  dgRNA
  Cyp4f16
caggccaaaacaagt

SEQ ID NO: 25184 - DNA, 15 bp, Artificial Sequence
  dgRNA
  Ddit3
agccagagggcgcga

SEQ ID NO: 25185 - DNA, 15 bp, Artificial Sequence
  dgRNA
  Ddit3
gccagagggcgcgat

SEQ ID NO: 25186 - DNA, 15 bp, Artificial Sequence
  dgRNA
  Ddit3
ccagagggcgcgatg

SEQ ID NO: 25187 - DNA, 15 bp, Artificial Sequence
  dgRNA
  Ddit3
cagagggcgcgatgg

SEQ ID NO: 25188 - DNA, 15 bp, Artificial Sequence
  dgRNA
  Hspb11
aaagacgcgcaagtg

SEQ ID NO: 25189 - DNA, 15 bp, Artificial Sequence
  dgRNA
  Hspb11
gacgcgcaagtgagg

SEQ ID NO: 25190 - DNA, 15 bp, Artificial Sequence
  dgRNA
  Hspb11
tgaggtggcgcttct

SEQ ID NO: 25191 - DNA, 15 bp, Artificial Sequence
  dgRNA
  Hspb11
ggtggcgcttctagg

SEQ ID NO: 25192 - DNA, 15 bp, Artificial Sequence
  dgRNA
  Nr2e1
cgcttgcattttctt

SEQ ID NO: 25193 - DNA, 15 bp, Artificial Sequence
  dgRNA
  Nr2e1
tctttggaagccgct

SEQ ID NO: 25194 - DNA, 15 bp, Artificial Sequence
  dgRNA
  Nr2e1
ttggaagccgcttgg

SEQ ID NO: 25195 - DNA, 15 bp, Artificial Sequence
  dgRNA
  Nr2e1
tctcctccccgcaca

SEQ ID NO: 25196 - DNA, 15 bp, Artificial Sequence
  dgRNA
  Dqx1
cagggttttcactca

SEQ ID NO: 25197 - DNA, 15 bp, Artificial Sequence
  dgRNA
  Dqx1
gctcaattatagtgt

SEQ ID NO: 25198 - DNA, 15 bp, Artificial Sequence
  dgRNA
  Dqx1
tgtagtcttcaaccc

SEQ ID NO: 25199 - DNA, 15 bp, Artificial Sequence
  dgRNA
  Dqx1
cactataattgagct

SEQ ID NO: 25200 - DNA, 15 bp, Artificial Sequence
  dgRNA
  Aprt
acccatatatctttg

SEQ ID NO: 25201 - DNA, 15 bp, Artificial Sequence
  dgRNA
  Aprt
aagccccgcccatcg

SEQ ID NO: 25202 - DNA, 15 bp, Artificial Sequence
  dgRNA
  Aprt
acctcaaagatatat

SEQ ID NO: 25203 - DNA, 15 bp, Artificial Sequence
  dgRNA
  Aprt
tctgcgaggtgtgtg

SEQ ID NO: 25204 - DNA, 15 bp, Artificial Sequence
  dgRNA
  Nckap5
ttacccctcccaagg

SEQ ID NO: 25205 - DNA, 15 bp, Artificial Sequence
  dgRNA
  Nckap5
tacccctcccaagga

SEQ ID NO: 25206 - DNA, 15 bp, Artificial Sequence
  dgRNA
  Nckap5
gattggcggaaccat

SEQ ID NO: 25207 - DNA, 15 bp, Artificial Sequence
  dgRNA
  Nckap5
attggcggaaccatt

SEQ ID NO: 25208 - DNA, 15 bp, Artificial Sequence
  dgRNA
  Lor
gttggtcattagaga

SEQ ID NO: 25209 - DNA, 15 bp, Artificial Sequence
  dgRNA
  Lor
agtttggtgtatgac

SEQ ID NO: 25210 - DNA, 15 bp, Artificial Sequence
  dgRNA
  Tlk2
cggattagtagtgat

SEQ ID NO: 25211 - DNA, 15 bp, Artificial Sequence
  dgRNA
  Tlk2
cggatcggttcggtc

SEQ ID NO: 25212 - DNA, 15 bp, Artificial Sequence
  dgRNA
  Tlk2
taatccggatcggtt

SEQ ID NO: 25213 - DNA, 15 bp, Artificial Sequence
  dgRNA
  Htr3b
gaaatcatattagct

SEQ ID NO: 25214 - DNA, 15 bp, Artificial Sequence
  dgRNA
  Htr3b
aatttcctctcctcg

SEQ ID NO: 25215 - DNA, 15 bp, Artificial Sequence
  dgRNA
  Htr3b
atttcctctcctcgg

SEQ ID NO: 25216 - DNA, 15 bp, Artificial Sequence
  dgRNA
  Htr3b
cattattcacttagc

SEQ ID NO: 25217 - DNA, 15 bp, Artificial Sequence
  dgRNA
  1110065P20Rik
ggcccccggcagcgc

SEQ ID NO: 25218 - DNA, 15 bp, Artificial Sequence
  dgRNA
  1110065P20Rik
ccggcagcgccggag

SEQ ID NO: 25219 - DNA, 15 bp, Artificial Sequence
  dgRNA
  1110065P20Rik
cggcagcgccggagc

SEQ ID NO: 25220 - DNA, 15 bp, Artificial Sequence
  dgRNA
  1110065P20Rik
cgccggagcgggctc

SEQ ID NO: 25221 - DNA, 15 bp, Artificial Sequence
  dgRNA
  Baz1a
aatttaaatcggagc

SEQ ID NO: 25222 - DNA, 15 bp, Artificial Sequence
  dgRNA
  Baz1a
tttcaactcaatagc

SEQ ID NO: 25223 - DNA, 15 bp, Artificial Sequence
  dgRNA
  Baz1a
tcaatagctgggcgc

SEQ ID NO: 25224 - DNA, 15 bp, Artificial Sequence
  dgRNA
  Baz1a
cgataatctcaaaca

SEQ ID NO: 25225 - DNA, 15 bp, Artificial Sequence
  dgRNA
  Shroom4
gttcgagcagtagcc

SEQ ID NO: 25226 - DNA, 15 bp, Artificial Sequence
  dgRNA
  Shroom4
ttcgagcagtagcca

SEQ ID NO: 25227 - DNA, 15 bp, Artificial Sequence
  dgRNA
  Shroom4
tcgagcagtagccag

SEQ ID NO: 25228 - DNA, 15 bp, Artificial Sequence
  dgRNA
  Shroom4
gctcgaactcaggaa

SEQ ID NO: 25229 - DNA, 15 bp, Artificial Sequence
  dgRNA
  Spcs2
gcctcacgggaatct

SEQ ID NO: 25230 - DNA, 15 bp, Artificial Sequence
  dgRNA
  Spcs2
ctcggagtcgctcca

SEQ ID NO: 25231 - DNA, 15 bp, Artificial Sequence
  dgRNA
  Spcs2
ggagtcgctccacgg

SEQ ID NO: 25232 - DNA, 15 bp, Artificial Sequence
  dgRNA
  Spcs2
tccttagtaaccgcg

SEQ ID NO: 25233 - DNA, 15 bp, Artificial Sequence
  dgRNA
  Myadm
gggatctccctctgc

SEQ ID NO: 25234 - DNA, 15 bp, Artificial Sequence
  dgRNA
  Myadm
tgcaggctgcaaatc

SEQ ID NO: 25235 - DNA, 15 bp, Artificial Sequence
  dgRNA
  Myadm
cccctcgcgagcctg

SEQ ID NO: 25236 - DNA, 15 bp, Artificial Sequence
  dgRNA
  Myadm
ccctcgcgagcctga

SEQ ID NO: 25237 - DNA, 15 bp, Artificial Sequence
  dgRNA
  Ormdl1
cacggcctacttcgc

SEQ ID NO: 25238 - DNA, 15 bp, Artificial Sequence
  dgRNA
  Ormdl1
tcgctggacgtcctt

SEQ ID NO: 25239 - DNA, 15 bp, Artificial Sequence
  dgRNA
  Ormdl1
cttcggaccgaagca

SEQ ID NO: 25240 - DNA, 15 bp, Artificial Sequence
  dgRNA
  Ormdl1
acggctgcgctcagc

SEQ ID NO: 25241 - DNA, 15 bp, Artificial Sequence
  dgRNA
  E430018J23Rik
ccggtgacgtaacct

SEQ ID NO: 25242 - DNA, 15 bp, Artificial Sequence
  dgRNA
  E430018J23Rik
cggtgacgtaacctt

SEQ ID NO: 25243 - DNA, 15 bp, Artificial Sequence
  dgRNA
  E430018J23Rik
tgacgtaaccttggg

SEQ ID NO: 25244 - DNA, 15 bp, Artificial Sequence
  dgRNA
  E430018J23Rik
gacgtaaccttgggc

SEQ ID NO: 25245 - DNA, 15 bp, Artificial Sequence
  dgRNA
  Vmn1r205
tatcctagagaccgc

SEQ ID NO: 25246 - DNA, 15 bp, Artificial Sequence
  dgRNA
  Vmn1r205
tgtctaggattgcag

SEQ ID NO: 25247 - DNA, 15 bp, Artificial Sequence
  dgRNA
  Vmn1r205
ggataatttggtagc

SEQ ID NO: 25248 - DNA, 15 bp, Artificial Sequence
  dgRNA
  Vmn1r205
tttgagtacgcagac

SEQ ID NO: 25249 - DNA, 15 bp, Artificial Sequence
  dgRNA
  Ltv1
tgccctcaggtaagt

SEQ ID NO: 25250 - DNA, 15 bp, Artificial Sequence
  dgRNA
  Ltv1
cctcccggaagtccc

SEQ ID NO: 25251 - DNA, 15 bp, Artificial Sequence
  dgRNA
  Ltv1
ctcccggaagtcccc

SEQ ID NO: 25252 - DNA, 15 bp, Artificial Sequence
  dgRNA
  Ltv1
cggaagtccccggga

SEQ ID NO: 25253 - DNA, 15 bp, Artificial Sequence
  dgRNA
  Fam71d
agctgccctatatcc

SEQ ID NO: 25254 - DNA, 15 bp, Artificial Sequence
  dgRNA
  Celsr1
ccggtgtcctcgcca

SEQ ID NO: 25255 - DNA, 15 bp, Artificial Sequence
  dgRNA
  Celsr1
tcgccagggcccccg

SEQ ID NO: 25256 - DNA, 15 bp, Artificial Sequence
  dgRNA
  Celsr1
cgcgggccgccccga

SEQ ID NO: 25257 - DNA, 15 bp, Artificial Sequence
  dgRNA
  Celsr1
ccgagggcccggcgc

SEQ ID NO: 25258 - DNA, 15 bp, Artificial Sequence
  dgRNA
  Ophn1
ggattgttgtgcctg

SEQ ID NO: 25259 - DNA, 15 bp, Artificial Sequence
  dgRNA
  Ophn1
gcctggggccggctt

SEQ ID NO: 25260 - DNA, 15 bp, Artificial Sequence
  dgRNA
  Ophn1
cctggggccggctta

SEQ ID NO: 25261 - DNA, 15 bp, Artificial Sequence
  dgRNA
  Ophn1
gagcggccaccctgg

SEQ ID NO: 25262 - DNA, 15 bp, Artificial Sequence
  dgRNA
  Nav1
tcccctctttctcgc

SEQ ID NO: 25263 - DNA, 15 bp, Artificial Sequence
  dgRNA
  Nav1
cccctctttctcgct

SEQ ID NO: 25264 - DNA, 15 bp, Artificial Sequence
  dgRNA
  Nav1
agcctctccacgagc

SEQ ID NO: 25265 - DNA, 15 bp, Artificial Sequence
  dgRNA
  Nav1
tctccacgagctgga

SEQ ID NO: 25266 - DNA, 15 bp, Artificial Sequence
  dgRNA
  Ndufaf3
ggtctacttcacgtc

SEQ ID NO: 25267 - DNA, 15 bp, Artificial Sequence
  dgRNA
  Ndufaf3
acttcacgtctggtc

SEQ ID NO: 25268 - DNA, 15 bp, Artificial Sequence
  dgRNA
  Ndufaf3
acgtctggtccggtt

SEQ ID NO: 25269 - DNA, 15 bp, Artificial Sequence
  dgRNA
  Ndufaf3
ggcgtgcccttccgc

SEQ ID NO: 25270 - DNA, 15 bp, Artificial Sequence
  dgRNA
  Ttll3
gtgattgtaccttat

SEQ ID NO: 25271 - DNA, 15 bp, Artificial Sequence
  dgRNA
  Ttll3
ccttattggtcgctg

SEQ ID NO: 25272 - DNA, 15 bp, Artificial Sequence
  dgRNA
  Ttll3
ttggtcgctgtggtc

SEQ ID NO: 25273 - DNA, 15 bp, Artificial Sequence
  dgRNA
  Ttll3
tggtcgctgtggtct

SEQ ID NO: 25274 - DNA, 15 bp, Artificial Sequence
  dgRNA
  Pstk
tggcctagggtacta

SEQ ID NO: 25275 - DNA, 15 bp, Artificial Sequence
  dgRNA
  Pstk
cctcaacgtcgccag

SEQ ID NO: 25276 - DNA, 15 bp, Artificial Sequence
  dgRNA
  Pstk
ctcaacgtcgccaga

SEQ ID NO: 25277 - DNA, 15 bp, Artificial Sequence
  dgRNA
  Pstk
cgtcgccagagggcg

SEQ ID NO: 25278 - DNA, 15 bp, Artificial Sequence
  dgRNA
  Zp3r
ggtaattctgttcca

SEQ ID NO: 25279 - DNA, 15 bp, Artificial Sequence
  dgRNA
  Zp3r
tcatagttcttgtat

SEQ ID NO: 25280 - DNA, 15 bp, Artificial Sequence
  dgRNA
  Zp3r
gttggtagagcaagt

SEQ ID NO: 25281 - DNA, 15 bp, Artificial Sequence
  dgRNA
  Cyld
taaggttgtattgaa

SEQ ID NO: 25282 - DNA, 15 bp, Artificial Sequence
  dgRNA
  Cyld
tgtgtctactataac

SEQ ID NO: 25283 - DNA, 15 bp, Artificial Sequence
  dgRNA
  Yipf2
cttcaccgtgcccac

SEQ ID NO: 25284 - DNA, 15 bp, Artificial Sequence
  dgRNA
  Yipf2
cggaatgaaaaaggc

SEQ ID NO: 25285 - DNA, 15 bp, Artificial Sequence
  dgRNA
  Yipf2
gcaagcgcaagatac

SEQ ID NO: 25286 - DNA, 15 bp, Artificial Sequence
  dgRNA
  Yipf2
gtgccacgacggtgg

SEQ ID NO: 25287 - DNA, 15 bp, Artificial Sequence
  dgRNA
  Gm12695
ggtgccagtaggtct

SEQ ID NO: 25288 - DNA, 15 bp, Artificial Sequence
  dgRNA
  Gm12695
tataactacttggac

SEQ ID NO: 25289 - DNA, 15 bp, Artificial Sequence
  dgRNA
  Gm12695
aacgccaagacctac

SEQ ID NO: 25290 - DNA, 15 bp, Artificial Sequence
  dgRNA
  Zfp936
gaaaatggtcggccc

SEQ ID NO: 25291 - DNA, 15 bp, Artificial Sequence
  dgRNA
  Zfp936
aaaatggtcggccct

SEQ ID NO: 25292 - DNA, 15 bp, Artificial Sequence
  dgRNA
  Zfp936
cactaacattaaggg

SEQ ID NO: 25293 - DNA, 15 bp, Artificial Sequence
  dgRNA
  Zfp936
tcactcgaaacttgc

SEQ ID NO: 25294 - DNA, 15 bp, Artificial Sequence
  dgRNA
  Exoc1
catttccggctccac

SEQ ID NO: 25295 - DNA, 15 bp, Artificial Sequence
  dgRNA
  Exoc1
gcgtggaaaagacag

SEQ ID NO: 25296 - DNA, 15 bp, Artificial Sequence
  dgRNA
  Exoc1
gggcgtggaaaagac

SEQ ID NO: 25297 - DNA, 15 bp, Artificial Sequence
  dgRNA
  Exoc1
ggcggactgtgggcg

SEQ ID NO: 25298 - DNA, 15 bp, Artificial Sequence
  dgRNA
  BC048562
tgcacgtttgtacaa

SEQ ID NO: 25299 - DNA, 15 bp, Artificial Sequence
  dgRNA
  BC048562
tgtcatgattgactt

SEQ ID NO: 25300 - DNA, 15 bp, Artificial Sequence
  dgRNA
  BC048562
cttagtaacacaggg

SEQ ID NO: 25301 - DNA, 15 bp, Artificial Sequence
  dgRNA
  BC048562
gttgcttagtaacac

SEQ ID NO: 25302 - DNA, 15 bp, Artificial Sequence
  dgRNA
  Nrg1
taatggccttggact

SEQ ID NO: 25303 - DNA, 15 bp, Artificial Sequence
  dgRNA
  Nrg1
gtaagagagcttaag

SEQ ID NO: 25304 - DNA, 15 bp, Artificial Sequence
  dgRNA
  Nrg1
agggggaaatcgata

SEQ ID NO: 25305 - DNA, 15 bp, Artificial Sequence
  dgRNA
  Cd72
ggcgtcacagcgcaa

SEQ ID NO: 25306 - DNA, 15 bp, Artificial Sequence
  dgRNA
  Cd72
gcgtcacagcgcaaa

SEQ ID NO: 25307 - DNA, 15 bp, Artificial Sequence
  dgRNA
  Cd72
ccagagagggacgct

SEQ ID NO: 25308 - DNA, 15 bp, Artificial Sequence
  dgRNA
  Cd72
ctctgtgcgactgta

SEQ ID NO: 25309 - DNA, 15 bp, Artificial Sequence
  dgRNA
  Pcdhga11
taggatccacggaaa

SEQ ID NO: 25310 - DNA, 15 bp, Artificial Sequence
  dgRNA
  Pcdhga11
ctccgcaacagacac

SEQ ID NO: 25311 - DNA, 15 bp, Artificial Sequence
  dgRNA
  Pcdhga11
tccgcaacagacacc

SEQ ID NO: 25312 - DNA, 15 bp, Artificial Sequence
  dgRNA
  Pcdhga11
ttgcaataataagat

SEQ ID NO: 25313 - DNA, 15 bp, Artificial Sequence
  dgRNA
  Fam92b
gaacaccatattcaa

SEQ ID NO: 25314 - DNA, 15 bp, Artificial Sequence
  dgRNA
  Fam92b
agtggttaagcccca

SEQ ID NO: 25315 - DNA, 15 bp, Artificial Sequence
  dgRNA
  Fam92b
cctcctcaccccgca

SEQ ID NO: 25316 - DNA, 15 bp, Artificial Sequence
  dgRNA
  Fam92b
ctcaccccgcagggg

SEQ ID NO: 25317 - DNA, 15 bp, Artificial Sequence
  dgRNA
  Myo7a
gccttgcatccctgc

SEQ ID NO: 25318 - DNA, 15 bp, Artificial Sequence
  dgRNA
  Myo7a
acatccagaccttcg

SEQ ID NO: 25319 - DNA, 15 bp, Artificial Sequence
  dgRNA
  Myo7a
ccttcgaggccccca

SEQ ID NO: 25320 - DNA, 15 bp, Artificial Sequence
  dgRNA
  Myo7a
agggctccgcctcct

SEQ ID NO: 25321 - DNA, 15 bp, Artificial Sequence
  dgRNA
  Prr3
gagagtccgcgggtc

SEQ ID NO: 25322 - DNA, 15 bp, Artificial Sequence
  dgRNA
  Prr3
agagtccgcgggtcc

SEQ ID NO: 25323 - DNA, 15 bp, Artificial Sequence
  dgRNA
  Prr3
cgggtccgggatgca

SEQ ID NO: 25324 - DNA, 15 bp, Artificial Sequence
  dgRNA
  Prr3
ccgggatgcacggtg

SEQ ID NO: 25325 - DNA, 15 bp, Artificial Sequence
  dgRNA
  Tff2
ccagcccatgtccgg

SEQ ID NO: 25326 - DNA, 15 bp, Artificial Sequence
  dgRNA
  Tff2
cagcccatgtccgga

SEQ ID NO: 25327 - DNA, 15 bp, Artificial Sequence
  dgRNA
  Tff2
agcccatgtccggag

SEQ ID NO: 25328 - DNA, 15 bp, Artificial Sequence
  dgRNA
  Tff2
aacctaggaggcttg

SEQ ID NO: 25329 - DNA, 15 bp, Artificial Sequence
  dgRNA
  Runx2
gagatccgcgcctct

SEQ ID NO: 25330 - DNA, 15 bp, Artificial Sequence
  dgRNA
  Runx2
agatccgcgcctctc

SEQ ID NO: 25331 - DNA, 15 bp, Artificial Sequence
  dgRNA
  Runx2
taccccgactctgtc

SEQ ID NO: 25332 - DNA, 15 bp, Artificial Sequence
  dgRNA
  Runx2
ccggtctccagtcgc

SEQ ID NO: 25333 - DNA, 15 bp, Artificial Sequence
  dgRNA
  Nde1
taccgagccgccagc

SEQ ID NO: 25334 - DNA, 15 bp, Artificial Sequence
  dgRNA
  Nde1
tccacgcccgccttc

SEQ ID NO: 25335 - DNA, 15 bp, Artificial Sequence
  dgRNA
  Nde1
ccacgcccgccttcc

SEQ ID NO: 25336 - DNA, 15 bp, Artificial Sequence
  dgRNA
  Nde1
gcccccaccgaggct

SEQ ID NO: 25337 - DNA, 15 bp, Artificial Sequence
  dgRNA
  Frmpd4
agttccaggcttcgg

SEQ ID NO: 25338 - DNA, 15 bp, Artificial Sequence
  dgRNA
  Frmpd4
tttgtcagcgcaagc

SEQ ID NO: 25339 - DNA, 15 bp, Artificial Sequence
  dgRNA
  Frmpd4
gtcagcgcaagcagg

SEQ ID NO: 25340 - DNA, 15 bp, Artificial Sequence
  dgRNA
  Frmpd4
acagcctccgaagcc

SEQ ID NO: 25341 - DNA, 15 bp, Artificial Sequence
  dgRNA
  Uqcc2
cgttagctttgcccc

SEQ ID NO: 25342 - DNA, 15 bp, Artificial Sequence
  dgRNA
  Uqcc2
gttagctttgcccct

SEQ ID NO: 25343 - DNA, 15 bp, Artificial Sequence
  dgRNA
  Uqcc2
agacctcgctctcaa

SEQ ID NO: 25344 - DNA, 15 bp, Artificial Sequence
  dgRNA
  Uqcc2
agcagcgccgctgcc

SEQ ID NO: 25345 - DNA, 15 bp, Artificial Sequence
  dgRNA
  Ptbp1
ttccgtcttgactga

SEQ ID NO: 25346 - DNA, 15 bp, Artificial Sequence
  dgRNA
  Ptbp1
gatgcgtttcgccct

SEQ ID NO: 25347 - DNA, 15 bp, Artificial Sequence
  dgRNA
  Ptbp1
accaatagaaggccc

SEQ ID NO: 25348 - DNA, 15 bp, Artificial Sequence
  dgRNA
  Ptbp1
tagaaggccctggcg

SEQ ID NO: 25349 - DNA, 15 bp, Artificial Sequence
  dgRNA
  2010109A12Rik
cgtacgaaaaagcgc

SEQ ID NO: 25350 - DNA, 15 bp, Artificial Sequence
  dgRNA
  2010109A12Rik
ctagccccgccctcg

SEQ ID NO: 25351 - DNA, 15 bp, Artificial Sequence
  dgRNA
  2010109A12Rik
ctcgcggactgattt

SEQ ID NO: 25352 - DNA, 15 bp, Artificial Sequence
  dgRNA
  2010109A12Rik
cggaggcgtttccct

SEQ ID NO: 25353 - DNA, 15 bp, Artificial Sequence
  dgRNA
  Phldb3
ctccccagtcgcgag

SEQ ID NO: 25354 - DNA, 15 bp, Artificial Sequence
  dgRNA
  Phldb3
tccccagtcgcgagc

SEQ ID NO: 25355 - DNA, 15 bp, Artificial Sequence
  dgRNA
  Phldb3
cgcgagcgggtcccc

SEQ ID NO: 25356 - DNA, 15 bp, Artificial Sequence
  dgRNA
  Phldb3
ggaaatctacgcccg

SEQ ID NO: 25357 - DNA, 15 bp, Artificial Sequence
  dgRNA
  Fam213a
tccaaactagctccg

SEQ ID NO: 25358 - DNA, 15 bp, Artificial Sequence
  dgRNA
  Fam213a
cagtctggagctgcg

SEQ ID NO: 25359 - DNA, 15 bp, Artificial Sequence
  dgRNA
  Fam213a
tctgtcacgtgaaag

SEQ ID NO: 25360 - DNA, 15 bp, Artificial Sequence
  dgRNA
  Fam213a
cacgtgaaagtggcg

SEQ ID NO: 25361 - DNA, 15 bp, Artificial Sequence
  dgRNA
  Olfr102
taatggataaatacc

SEQ ID NO: 25362 - DNA, 15 bp, Artificial Sequence
  dgRNA
  Nupr1
gtctaactatgaccc

SEQ ID NO: 25363 - DNA, 15 bp, Artificial Sequence
  dgRNA
  Nupr1
ggactggcctatctg

SEQ ID NO: 25364 - DNA, 15 bp, Artificial Sequence
  dgRNA
  Nupr1
cgagagctttccacg

SEQ ID NO: 25365 - DNA, 15 bp, Artificial Sequence
  dgRNA
  Nupr1
tttgggatattggcc

SEQ ID NO: 25366 - DNA, 15 bp, Artificial Sequence
  dgRNA
  Tmem25
gcgcgcgcccagcaa

SEQ ID NO: 25367 - DNA, 15 bp, Artificial Sequence
  dgRNA
  Tmem25
cgcgcgcccagcaac

SEQ ID NO: 25368 - DNA, 15 bp, Artificial Sequence
  dgRNA
  Tmem25
aacgggcgctgagcg

SEQ ID NO: 25369 - DNA, 15 bp, Artificial Sequence
  dgRNA
  Tmem25
ggcgctgagcgtggc

SEQ ID NO: 25370 - DNA, 15 bp, Artificial Sequence
  dgRNA
  Dpp4
cacttaagaagcggt

SEQ ID NO: 25371 - DNA, 15 bp, Artificial Sequence
  dgRNA
  Dpp4
acttaagaagcggta

SEQ ID NO: 25372 - DNA, 15 bp, Artificial Sequence
  dgRNA
  Dpp4
gggttacttttttgc

SEQ ID NO: 25373 - DNA, 15 bp, Artificial Sequence
  dgRNA
  Dpp4
ggttacttttttgcg

SEQ ID NO: 25374 - DNA, 15 bp, Artificial Sequence
  dgRNA
  3110079O15Rik
cgggcacggtgtccc

SEQ ID NO: 25375 - DNA, 15 bp, Artificial Sequence
  dgRNA
  3110079O15Rik
gcacggtgtcccagg

SEQ ID NO: 25376 - DNA, 15 bp, Artificial Sequence
  dgRNA
  Col4a6
aacggttatgtgcag

SEQ ID NO: 25377 - DNA, 15 bp, Artificial Sequence
  dgRNA
  Col4a6
agcttcccaaggtag

SEQ ID NO: 25378 - DNA, 15 bp, Artificial Sequence
  dgRNA
  Col4a6
gcttcccaaggtagg

SEQ ID NO: 25379 - DNA, 15 bp, Artificial Sequence
  dgRNA
  Col4a6
gcactactactacat

SEQ ID NO: 25380 - DNA, 15 bp, Artificial Sequence
  dgRNA
  Cyp2b13
atacatgcgagaata

SEQ ID NO: 25381 - DNA, 15 bp, Artificial Sequence
  dgRNA
  Cyp2b13
gatacatgcgagaat

SEQ ID NO: 25382 - DNA, 15 bp, Artificial Sequence
  dgRNA
  Fam117b
cgccgcccgacccct

SEQ ID NO: 25383 - DNA, 15 bp, Artificial Sequence
  dgRNA
  Fam117b
gccgcccgacccctc

SEQ ID NO: 25384 - DNA, 15 bp, Artificial Sequence
  dgRNA
  Fam117b
ccgcccgacccctcg

SEQ ID NO: 25385 - DNA, 15 bp, Artificial Sequence
  dgRNA
  Fam117b
cgcccgacccctcgg

SEQ ID NO: 25386 - DNA, 15 bp, Artificial Sequence
  dgRNA
  Tnfaip6
ctaactgaaaagtgc

SEQ ID NO: 25387 - DNA, 15 bp, Artificial Sequence
  dgRNA
  Tnfaip6
ccccgccctccgttc

SEQ ID NO: 25388 - DNA, 15 bp, Artificial Sequence
  dgRNA
  Tnfaip6
ccagaacggagggcg

SEQ ID NO: 25389 - DNA, 15 bp, Artificial Sequence
  dgRNA
  Tnfaip6
accagaacggagggc

SEQ ID NO: 25390 - DNA, 15 bp, Artificial Sequence
  dgRNA
  Pkib
gctgggagtgttctt

SEQ ID NO: 25391 - DNA, 15 bp, Artificial Sequence
  dgRNA
  Pkib
gttcttgggaatagc

SEQ ID NO: 25392 - DNA, 15 bp, Artificial Sequence
  dgRNA
  Pkib
ctggggcagtcataa

SEQ ID NO: 25393 - DNA, 15 bp, Artificial Sequence
  dgRNA
  Pkib
gatgctaggggtacc

SEQ ID NO: 25394 - DNA, 15 bp, Artificial Sequence
  dgRNA
  Atp6v1d
ttagtcaaccaagag

SEQ ID NO: 25395 - DNA, 15 bp, Artificial Sequence
  dgRNA
  Atp6v1d
cgctgtgacgaatgg

SEQ ID NO: 25396 - DNA, 15 bp, Artificial Sequence
  dgRNA
  Atp6v1d
aatggcggaaagccg

SEQ ID NO: 25397 - DNA, 15 bp, Artificial Sequence
  dgRNA
  Atp6v1d
tccctcagagcgtgc

SEQ ID NO: 25398 - DNA, 15 bp, Artificial Sequence
  dgRNA
  Cyb5r2
cggcagtggccgctg

SEQ ID NO: 25399 - DNA, 15 bp, Artificial Sequence
  dgRNA
  Cyb5r2
tgaaacatccggcag

SEQ ID NO: 25400 - DNA, 15 bp, Artificial Sequence
  dgRNA
  Cyb5r2
ggatgatgaaacatc

SEQ ID NO: 25401 - DNA, 15 bp, Artificial Sequence
  dgRNA
  Gm6880
cccgctgcctgtgct

SEQ ID NO: 25402 - DNA, 15 bp, Artificial Sequence
  dgRNA
  Fbxo7
gccgaccgaagcttg

SEQ ID NO: 25403 - DNA, 15 bp, Artificial Sequence
  dgRNA
  Fbxo7
atgaagctgcgcgtg

SEQ ID NO: 25404 - DNA, 15 bp, Artificial Sequence
  dgRNA
  Fbxo7
gtgcggcttcagaag

SEQ ID NO: 25405 - DNA, 15 bp, Artificial Sequence
  dgRNA
  Fbxo7
ggacccagccgctcg

SEQ ID NO: 25406 - DNA, 15 bp, Artificial Sequence
  dgRNA
  Spock1
aatgaatcacgctcc

SEQ ID NO: 25407 - DNA, 15 bp, Artificial Sequence
  dgRNA
  Spock1
aatcacgctcccgga

SEQ ID NO: 25408 - DNA, 15 bp, Artificial Sequence
  dgRNA
  Spock1
atcacgctcccggat

SEQ ID NO: 25409 - DNA, 15 bp, Artificial Sequence
  dgRNA
  Spock1
cgccaagtagccgcc

SEQ ID NO: 25410 - DNA, 15 bp, Artificial Sequence
  dgRNA
  Cox5b
acaagaactactatg

SEQ ID NO: 25411 - DNA, 15 bp, Artificial Sequence
  dgRNA
  Cox5b
gaactactatgtggc

SEQ ID NO: 25412 - DNA, 15 bp, Artificial Sequence
  dgRNA
  Cox5b
gcgcgaacactcaag

SEQ ID NO: 25413 - DNA, 15 bp, Artificial Sequence
  dgRNA
  Cox5b
aacactcaagcggac

SEQ ID NO: 25414 - DNA, 15 bp, Artificial Sequence
  dgRNA
  Eif4e1b
cggttaccttctaac

SEQ ID NO: 25415 - DNA, 15 bp, Artificial Sequence
  dgRNA
  Eif4e1b
ggtaggttaaaagca

SEQ ID NO: 25416 - DNA, 15 bp, Artificial Sequence
  dgRNA
  Eif4e1b
cctcttagttgctgg

SEQ ID NO: 25417 - DNA, 15 bp, Artificial Sequence
  dgRNA
  Eif4e1b
gacttacctgttaga

SEQ ID NO: 25418 - DNA, 15 bp, Artificial Sequence
  dgRNA
  Vmn1r40
tgagttcggatgaca

SEQ ID NO: 25419 - DNA, 15 bp, Artificial Sequence
  dgRNA
  Vmn1r40
gatgaattgacatgt

SEQ ID NO: 25420 - DNA, 15 bp, Artificial Sequence
  dgRNA
  Zbtb40
gcgtgcacgtgatgc

SEQ ID NO: 25421 - DNA, 15 bp, Artificial Sequence
  dgRNA
  Zbtb40
cgtgcacgtgatgca

SEQ ID NO: 25422 - DNA, 15 bp, Artificial Sequence
  dgRNA
  Zbtb40
cccagcacgtgacta

SEQ ID NO: 25423 - DNA, 15 bp, Artificial Sequence
  dgRNA
  Zbtb40
cggcgtgcgcacatc

SEQ ID NO: 25424 - DNA, 15 bp, Artificial Sequence
  dgRNA
  Spert
tgaagataggtacta

SEQ ID NO: 25425 - DNA, 15 bp, Artificial Sequence
  dgRNA
  Spert
gctgctatgtcacaa

SEQ ID NO: 25426 - DNA, 15 bp, Artificial Sequence
  dgRNA
  Spert
agggcttaattcctt

SEQ ID NO: 25427 - DNA, 15 bp, Artificial Sequence
  dgRNA
  Spert
ggtttaaccactcac

SEQ ID NO: 25428 - DNA, 15 bp, Artificial Sequence
  dgRNA
  Lrrc51
ctcattggccccagt

SEQ ID NO: 25429 - DNA, 15 bp, Artificial Sequence
  dgRNA
  Lrrc51
tcggctgttgtttgc

SEQ ID NO: 25430 - DNA, 15 bp, Artificial Sequence
  dgRNA
  Lrrc51
cggctgttgtttgcc

SEQ ID NO: 25431 - DNA, 15 bp, Artificial Sequence
  dgRNA
  Lrrc51
tgccgggcactctag

SEQ ID NO: 25432 - DNA, 15 bp, Artificial Sequence
  dgRNA
  Zkscan5
ccgggattcctagag

SEQ ID NO: 25433 - DNA, 15 bp, Artificial Sequence
  dgRNA
  Zkscan5
ctgcggaagcgctct

SEQ ID NO: 25434 - DNA, 15 bp, Artificial Sequence
  dgRNA
  Zkscan5
tgcggaagcgctctt

SEQ ID NO: 25435 - DNA, 15 bp, Artificial Sequence
  dgRNA
  Zkscan5
gcggaagcgctcttg

SEQ ID NO: 25436 - DNA, 15 bp, Artificial Sequence
  dgRNA
  Prrc2c
gctttgtctccgaaa

SEQ ID NO: 25437 - DNA, 15 bp, Artificial Sequence
  dgRNA
  Prrc2c
gccgcagtcgagaag

SEQ ID NO: 25438 - DNA, 15 bp, Artificial Sequence
  dgRNA
  Prrc2c
gcagtcgagaagcgg

SEQ ID NO: 25439 - DNA, 15 bp, Artificial Sequence
  dgRNA
  Prrc2c
gtcgagaagcggcgg

SEQ ID NO: 25440 - DNA, 15 bp, Artificial Sequence
  dgRNA
  Rbm8a
ctcgcagagctccat

SEQ ID NO: 25441 - DNA, 15 bp, Artificial Sequence
  dgRNA
  Rbm8a
tcgcagagctccatc

SEQ ID NO: 25442 - DNA, 15 bp, Artificial Sequence
  dgRNA
  Rbm8a
cgcagagctccatcg

SEQ ID NO: 25443 - DNA, 15 bp, Artificial Sequence
  dgRNA
  Rbm8a
tctagcgcttcatag

SEQ ID NO: 25444 - DNA, 15 bp, Artificial Sequence
  dgRNA
  Clec2i
gttccagatctaggt

SEQ ID NO: 25445 - DNA, 15 bp, Artificial Sequence
  dgRNA
  Clec2i
taggcacccaatctc

SEQ ID NO: 25446 - DNA, 15 bp, Artificial Sequence
  dgRNA
  Clec2i
aactgcggcggggtg

SEQ ID NO: 25447 - DNA, 15 bp, Artificial Sequence
  dgRNA
  Clec2i
aaactgcggcggggt

SEQ ID NO: 25448 - DNA, 15 bp, Artificial Sequence
  dgRNA
  Rps19bp1
gtggcttctgcgctt

SEQ ID NO: 25449 - DNA, 15 bp, Artificial Sequence
  dgRNA
  Rps19bp1
ctccccgctcctccg

SEQ ID NO: 25450 - DNA, 15 bp, Artificial Sequence
  dgRNA
  Rps19bp1
ctcctccggggctat

SEQ ID NO: 25451 - DNA, 15 bp, Artificial Sequence
  dgRNA
  Rps19bp1
tgagcctgcgttcta

SEQ ID NO: 25452 - DNA, 15 bp, Artificial Sequence
  dgRNA
  Actl10
cgagagttaaagtgc

SEQ ID NO: 25453 - DNA, 15 bp, Artificial Sequence
  dgRNA
  Actl10
acagatccttaacat

SEQ ID NO: 25454 - DNA, 15 bp, Artificial Sequence
  dgRNA
  Actl10
ccattagcccacgca

SEQ ID NO: 25455 - DNA, 15 bp, Artificial Sequence
  dgRNA
  Actl10
cattagcccacgcaa

SEQ ID NO: 25456 - DNA, 15 bp, Artificial Sequence
  dgRNA
  Mzt2
atcaagctgcgcgtc

SEQ ID NO: 25457 - DNA, 15 bp, Artificial Sequence
  dgRNA
  Mzt2
agcggctcaacctcc

SEQ ID NO: 25458 - DNA, 15 bp, Artificial Sequence
  dgRNA
  Mzt2
gcggctcaacctccc

SEQ ID NO: 25459 - DNA, 15 bp, Artificial Sequence
  dgRNA
  Mzt2
acacgttagcttggc

SEQ ID NO: 25460 - DNA, 15 bp, Artificial Sequence
  dgRNA
  Magi1
ttgccccatttgcta

SEQ ID NO: 25461 - DNA, 15 bp, Artificial Sequence
  dgRNA
  Magi1
gaaaggcgggaaatc

SEQ ID NO: 25462 - DNA, 15 bp, Artificial Sequence
  dgRNA
  Baiap2
tcacctgcaatagcg

SEQ ID NO: 25463 - DNA, 15 bp, Artificial Sequence
  dgRNA
  Baiap2
cacctgcaatagcgc

SEQ ID NO: 25464 - DNA, 15 bp, Artificial Sequence
  dgRNA
  Baiap2
tagcgcgggagccac

SEQ ID NO: 25465 - DNA, 15 bp, Artificial Sequence
  dgRNA
  Baiap2
tgtcgcgcactcctg

SEQ ID NO: 25466 - DNA, 15 bp, Artificial Sequence
  dgRNA
  Igdcc3
cagtccgggtcggcg

SEQ ID NO: 25467 - DNA, 15 bp, Artificial Sequence
  dgRNA
  Igdcc3
tgcagttcaaagcgc

SEQ ID NO: 25468 - DNA, 15 bp, Artificial Sequence
  dgRNA
  Igdcc3
cagttcaaagcgcag

SEQ ID NO: 25469 - DNA, 15 bp, Artificial Sequence
  dgRNA
  Igdcc3
agttcaaagcgcagg

SEQ ID NO: 25470 - DNA, 15 bp, Artificial Sequence
  dgRNA
  Gramd2
tgctagttgactaga

SEQ ID NO: 25471 - DNA, 15 bp, Artificial Sequence
  dgRNA
  Gramd2
cattaaccgagcttt

SEQ ID NO: 25472 - DNA, 15 bp, Artificial Sequence
  dgRNA
  Gramd2
taggcagtgtggtgt

SEQ ID NO: 25473 - DNA, 15 bp, Artificial Sequence
  dgRNA
  Gramd2
ctagtccgggcagag

SEQ ID NO: 25474 - DNA, 15 bp, Artificial Sequence
  dgRNA
  Nelfcd
atgagagatcctaca

SEQ ID NO: 25475 - DNA, 15 bp, Artificial Sequence
  dgRNA
  Nelfcd
gtttccccgcccagc

SEQ ID NO: 25476 - DNA, 15 bp, Artificial Sequence
  dgRNA
  Nelfcd
ctctcatgagcaaga

SEQ ID NO: 25477 - DNA, 15 bp, Artificial Sequence
  dgRNA
  Nelfcd
ggggaaacaccttgt

SEQ ID NO: 25478 - DNA, 15 bp, Artificial Sequence
  dgRNA
  Mapre3
ttcccctcgttgcta

SEQ ID NO: 25479 - DNA, 15 bp, Artificial Sequence
  dgRNA
  Mapre3
gctatggcgatctag

SEQ ID NO: 25480 - DNA, 15 bp, Artificial Sequence
  dgRNA
  Mapre3
ctatggcgatctaga

SEQ ID NO: 25481 - DNA, 15 bp, Artificial Sequence
  dgRNA
  Mapre3
cccgccgccattgct

SEQ ID NO: 25482 - DNA, 15 bp, Artificial Sequence
  dgRNA
  Dock7
tcgtgcgcgcctcct

SEQ ID NO: 25483 - DNA, 15 bp, Artificial Sequence
  dgRNA
  Dock7
ctcctcggcgcatta

SEQ ID NO: 25484 - DNA, 15 bp, Artificial Sequence
  dgRNA
  Dock7
cgcattacggtaccc

SEQ ID NO: 25485 - DNA, 15 bp, Artificial Sequence
  dgRNA
  Dock7
ggttccgcgctccag

SEQ ID NO: 25486 - DNA, 15 bp, Artificial Sequence
  dgRNA
  Eef1d
aggggttcggcgtgt

SEQ ID NO: 25487 - DNA, 15 bp, Artificial Sequence
  dgRNA
  Eef1d
ggggttcggcgtgtt

SEQ ID NO: 25488 - DNA, 15 bp, Artificial Sequence
  dgRNA
  Eef1d
gcgtgttgggagatc

SEQ ID NO: 25489 - DNA, 15 bp, Artificial Sequence
  dgRNA
  Eef1d
tagcgacaactcttg

SEQ ID NO: 25490 - DNA, 15 bp, Artificial Sequence
  dgRNA
  Crebrf
tctggtgtcacgtga

SEQ ID NO: 25491 - DNA, 15 bp, Artificial Sequence
  dgRNA
  Crebrf
tgacgggcgctagcc

SEQ ID NO: 25492 - DNA, 15 bp, Artificial Sequence
  dgRNA
  Crebrf
ggccgagcctctgat

SEQ ID NO: 25493 - DNA, 15 bp, Artificial Sequence
  dgRNA
  Crebrf
gattggccagacttc

SEQ ID NO: 25494 - DNA, 15 bp, Artificial Sequence
  dgRNA
  Tra2a
ccaatctcccgcgct

SEQ ID NO: 25495 - DNA, 15 bp, Artificial Sequence
  dgRNA
  Tra2a
ccgcgctaggccagg

SEQ ID NO: 25496 - DNA, 15 bp, Artificial Sequence
  dgRNA
  Tra2a
acacaaagcctcccg

SEQ ID NO: 25497 - DNA, 15 bp, Artificial Sequence
  dgRNA
  Tra2a
agcctcccggggcgg

SEQ ID NO: 25498 - DNA, 15 bp, Artificial Sequence
  dgRNA
  Btbd11
cttccacctaggccg

SEQ ID NO: 25499 - DNA, 15 bp, Artificial Sequence
  dgRNA
  Btbd11
ggcgtgtctgagggg

SEQ ID NO: 25500 - DNA, 15 bp, Artificial Sequence
  dgRNA
  Btbd11
gcgtgtctgaggggc

SEQ ID NO: 25501 - DNA, 15 bp, Artificial Sequence
  dgRNA
  Btbd11
gcggggccgcatgga

SEQ ID NO: 25502 - DNA, 15 bp, Artificial Sequence
  dgRNA
  Hmx3
cgcagcctcctcccg

SEQ ID NO: 25503 - DNA, 15 bp, Artificial Sequence
  dgRNA
  Hmx3
agccgcagctcctac

SEQ ID NO: 25504 - DNA, 15 bp, Artificial Sequence
  dgRNA
  Hmx3
gctccctcggcgcag

SEQ ID NO: 25505 - DNA, 15 bp, Artificial Sequence
  dgRNA
  Hmx3
cctcggcgcagaggc

SEQ ID NO: 25506 - DNA, 15 bp, Artificial Sequence
  dgRNA
  Uaca
gttacgaagtttaaa

SEQ ID NO: 25507 - DNA, 15 bp, Artificial Sequence
  dgRNA
  Uaca
ttacgaagtttaaaa

SEQ ID NO: 25508 - DNA, 15 bp, Artificial Sequence
  dgRNA
  Uaca
ttcccggtttccgat

SEQ ID NO: 25509 - DNA, 15 bp, Artificial Sequence
  dgRNA
  Uaca
ggagacgggcccgat

SEQ ID NO: 25510 - DNA, 15 bp, Artificial Sequence
  dgRNA
  Oaz2
agtacgcctgcgccc

SEQ ID NO: 25511 - DNA, 15 bp, Artificial Sequence
  dgRNA
  Oaz2
acgcctgcgcccagg

SEQ ID NO: 25512 - DNA, 15 bp, Artificial Sequence
  dgRNA
  Oaz2
cgcctgcgcccaggc

SEQ ID NO: 25513 - DNA, 15 bp, Artificial Sequence
  dgRNA
  Oaz2
gcctgcgcccaggcg

SEQ ID NO: 25514 - DNA, 15 bp, Artificial Sequence
  dgRNA
  Mest
gattagagatctata

SEQ ID NO: 25515 - DNA, 15 bp, Artificial Sequence
  dgRNA
  Mest
gcgggtcaatacccc

SEQ ID NO: 25516 - DNA, 15 bp, Artificial Sequence
  dgRNA
  Mest
ggtcaatacccctgg

SEQ ID NO: 25517 - DNA, 15 bp, Artificial Sequence
  dgRNA
  Mest
ccctggaggcgccca

SEQ ID NO: 25518 - DNA, 15 bp, Artificial Sequence
  dgRNA
  Mc5r
tgactgcaaagttgc

SEQ ID NO: 25519 - DNA, 15 bp, Artificial Sequence
  dgRNA
  Mc5r
actctgaagtccgag

SEQ ID NO: 25520 - DNA, 15 bp, Artificial Sequence
  dgRNA
  Mc5r
ctgaagtccgagagg

SEQ ID NO: 25521 - DNA, 15 bp, Artificial Sequence
  dgRNA
  Mc5r
cgagaggcggcgata

SEQ ID NO: 25522 - DNA, 15 bp, Artificial Sequence
  dgRNA
  Stat6
atggatcagtgctaa

SEQ ID NO: 25523 - DNA, 15 bp, Artificial Sequence
  dgRNA
  Stat6
tccagtgtggttcaa

SEQ ID NO: 25524 - DNA, 15 bp, Artificial Sequence
  dgRNA
  Stat6
tacgtgcttccccac

SEQ ID NO: 25525 - DNA, 15 bp, Artificial Sequence
  dgRNA
  Stat6
acgtgcttccccacc

SEQ ID NO: 25526 - DNA, 15 bp, Artificial Sequence
  dgRNA
  Daam1
tagttcctgagcgtg

SEQ ID NO: 25527 - DNA, 15 bp, Artificial Sequence
  dgRNA
  Daam1
tcctgagcgtgagga

SEQ ID NO: 25528 - DNA, 15 bp, Artificial Sequence
  dgRNA
  Daam1
ttcggctctgtctgt

SEQ ID NO: 25529 - DNA, 15 bp, Artificial Sequence
  dgRNA
  Daam1
agcgtccatgcgcag

SEQ ID NO: 25530 - DNA, 15 bp, Artificial Sequence
  dgRNA
  Gpi1
aaggttcatcgcaag

SEQ ID NO: 25531 - DNA, 15 bp, Artificial Sequence
  dgRNA
  Gpi1
ctacagctgccggca

SEQ ID NO: 25532 - DNA, 15 bp, Artificial Sequence
  dgRNA
  Gpi1
ggcaaggtcgcctag

SEQ ID NO: 25533 - DNA, 15 bp, Artificial Sequence
  dgRNA
  Gpi1
gtcgcctagcggacg

SEQ ID NO: 25534 - DNA, 15 bp, Artificial Sequence
  dgRNA
  Prpf19
tgctcggttgcatgc

SEQ ID NO: 25535 - DNA, 15 bp, Artificial Sequence
  dgRNA
  Prpf19
gctcggttgcatgct

SEQ ID NO: 25536 - DNA, 15 bp, Artificial Sequence
  dgRNA
  Prpf19
tccgttagctgcaga

SEQ ID NO: 25537 - DNA, 15 bp, Artificial Sequence
  dgRNA
  Prpf19
gctgaggcgcgccac

SEQ ID NO: 25538 - DNA, 15 bp, Artificial Sequence
  dgRNA
  Mapkbp1
gcgctgacgagtagt

SEQ ID NO: 25539 - DNA, 15 bp, Artificial Sequence
  dgRNA
  Mapkbp1
cgctgacgagtagta

SEQ ID NO: 25540 - DNA, 15 bp, Artificial Sequence
  dgRNA
  Mapkbp1
ccaagactcgggtgc

SEQ ID NO: 25541 - DNA, 15 bp, Artificial Sequence
  dgRNA
  Mapkbp1
agactcgggtgcggg

SEQ ID NO: 25542 - DNA, 15 bp, Artificial Sequence
  dgRNA
  Prkdc
tccgcatggttagac

SEQ ID NO: 25543 - DNA, 15 bp, Artificial Sequence
  dgRNA
  Prkdc
acgctacagatctgc

SEQ ID NO: 25544 - DNA, 15 bp, Artificial Sequence
  dgRNA
  Prkdc
ccccgcgagagtata

SEQ ID NO: 25545 - DNA, 15 bp, Artificial Sequence
  dgRNA
  Prkdc
cccgcgagagtataa

SEQ ID NO: 25546 - DNA, 15 bp, Artificial Sequence
  dgRNA
  Wdr37
cccaaccctgattaa

SEQ ID NO: 25547 - DNA, 15 bp, Artificial Sequence
  dgRNA
  Wdr37
ccaaccctgattaac

SEQ ID NO: 25548 - DNA, 15 bp, Artificial Sequence
  dgRNA
  Wdr37
caaccctgattaacg

SEQ ID NO: 25549 - DNA, 15 bp, Artificial Sequence
  dgRNA
  Wdr37
attaacggggaaaag

SEQ ID NO: 25550 - DNA, 15 bp, Artificial Sequence
  dgRNA
  Olfr1449
ggagtctaattgtat

SEQ ID NO: 25551 - DNA, 15 bp, Artificial Sequence
  dgRNA
  Olfr1449
gagtctaattgtatt

SEQ ID NO: 25552 - DNA, 15 bp, Artificial Sequence
  dgRNA
  Olfr1449
ttgggaatgctgcat

SEQ ID NO: 25553 - DNA, 15 bp, Artificial Sequence
  dgRNA
  Olfr1449
gtaacatgagtgatt

SEQ ID NO: 25554 - DNA, 15 bp, Artificial Sequence
  dgRNA
  Krtap19-9b
actagtaaagcgtga

SEQ ID NO: 25555 - DNA, 15 bp, Artificial Sequence
  dgRNA
  Krtap19-9b
ataaaagtccgggtg

SEQ ID NO: 25556 - DNA, 15 bp, Artificial Sequence
  dgRNA
  Krtap19-9b
aagtccgggtgtgga

SEQ ID NO: 25557 - DNA, 15 bp, Artificial Sequence
  dgRNA
  Krtap19-9b
ttatgacctagagtt

SEQ ID NO: 25558 - DNA, 15 bp, Artificial Sequence
  dgRNA
  Fyco1
gcccggacaggcatc

SEQ ID NO: 25559 - DNA, 15 bp, Artificial Sequence
  dgRNA
  Fyco1
cccggacaggcatcg

SEQ ID NO: 25560 - DNA, 15 bp, Artificial Sequence
  dgRNA
  Fyco1
ggcatcggggacact

SEQ ID NO: 25561 - DNA, 15 bp, Artificial Sequence
  dgRNA
  Fyco1
gcatcggggacactg

SEQ ID NO: 25562 - DNA, 15 bp, Artificial Sequence
  dgRNA
  Rogdi
ggcggatagaaggcg

SEQ ID NO: 25563 - DNA, 15 bp, Artificial Sequence
  dgRNA
  Rogdi
atagaaggcgaggcg

SEQ ID NO: 25564 - DNA, 15 bp, Artificial Sequence
  dgRNA
  Rogdi
acagccagtcgcttg

SEQ ID NO: 25565 - DNA, 15 bp, Artificial Sequence
  dgRNA
  Rogdi
cgcttgaggcgtagc

SEQ ID NO: 25566 - DNA, 15 bp, Artificial Sequence
  dgRNA
  Zfp560
ttacgctccagccct

SEQ ID NO: 25567 - DNA, 15 bp, Artificial Sequence
  dgRNA
  Zfp560
acttgtatgagacgc

SEQ ID NO: 25568 - DNA, 15 bp, Artificial Sequence
  dgRNA
  Zfp560
aaacagcccgcgcag

SEQ ID NO: 25569 - DNA, 15 bp, Artificial Sequence
  dgRNA
  Zfp560
agcccgcgcagtggt

SEQ ID NO: 25570 - DNA, 15 bp, Artificial Sequence
  dgRNA
  Igfbp7
ggtcagcacgcatgg

SEQ ID NO: 25571 - DNA, 15 bp, Artificial Sequence
  dgRNA
  Igfbp7
cacgcatggtggacg

SEQ ID NO: 25572 - DNA, 15 bp, Artificial Sequence
  dgRNA
  Igfbp7
acgcatggtggacgt

SEQ ID NO: 25573 - DNA, 15 bp, Artificial Sequence
  dgRNA
  Igfbp7
tgggacgagctctcc

SEQ ID NO: 25574 - DNA, 15 bp, Artificial Sequence
  dgRNA
  Spata5
ccgcgcacgttgagc

SEQ ID NO: 25575 - DNA, 15 bp, Artificial Sequence
  dgRNA
  Spata5
aacgtgcgcggcacg

SEQ ID NO: 25576 - DNA, 15 bp, Artificial Sequence
  dgRNA
  Spata5
caacgtgcgcggcac

SEQ ID NO: 25577 - DNA, 15 bp, Artificial Sequence
  dgRNA
  Spata5
tcaacgtgcgcggca

SEQ ID NO: 25578 - DNA, 15 bp, Artificial Sequence
  dgRNA
  Cacna1g
cgccggcgacagcta

SEQ ID NO: 25579 - DNA, 15 bp, Artificial Sequence
  dgRNA
  Cacna1g
cgacagctacggcaa

SEQ ID NO: 25580 - DNA, 15 bp, Artificial Sequence
  dgRNA
  Cacna1g
cggcaacggcagcca

SEQ ID NO: 25581 - DNA, 15 bp, Artificial Sequence
  dgRNA
  Cacna1g
caacggcagccacgg

SEQ ID NO: 25582 - DNA, 15 bp, Artificial Sequence
  dgRNA
  Ndufs2
ctgagaagcggaatc

SEQ ID NO: 25583 - DNA, 15 bp, Artificial Sequence
  dgRNA
  Ndufs2
gccagcttccaagat

SEQ ID NO: 25584 - DNA, 15 bp, Artificial Sequence
  dgRNA
  Ndufs2
atggggactccgttg

SEQ ID NO: 25585 - DNA, 15 bp, Artificial Sequence
  dgRNA
  Ndufs2
gttgtggcgataaga

SEQ ID NO: 25586 - DNA, 15 bp, Artificial Sequence
  dgRNA
  Rora
cctcacgtcccctct

SEQ ID NO: 25587 - DNA, 15 bp, Artificial Sequence
  dgRNA
  Rora
gctcgcgctctcgcc

SEQ ID NO: 25588 - DNA, 15 bp, Artificial Sequence
  dgRNA
  Rora
cgctctcgcctggct

SEQ ID NO: 25589 - DNA, 15 bp, Artificial Sequence
  dgRNA
  Rora
ggcgggtttggccac

SEQ ID NO: 25590 - DNA, 15 bp, Artificial Sequence
  dgRNA
  Rnf135
catagcttaagttgt

SEQ ID NO: 25591 - DNA, 15 bp, Artificial Sequence
  dgRNA
  Rnf135
ggggttgcgtgtttg

SEQ ID NO: 25592 - DNA, 15 bp, Artificial Sequence
  dgRNA
  Rnf135
tgtggctaggcgagc

SEQ ID NO: 25593 - DNA, 15 bp, Artificial Sequence
  dgRNA
  Rnf135
gtagccagcaatgtc

SEQ ID NO: 25594 - DNA, 15 bp, Artificial Sequence
  dgRNA
  Spo11
gggggggcgcctcag

SEQ ID NO: 25595 - DNA, 15 bp, Artificial Sequence
  dgRNA
  Spo11
gcgcactctgctccg

SEQ ID NO: 25596 - DNA, 15 bp, Artificial Sequence
  dgRNA
  Spo11
cgcactctgctccgc

SEQ ID NO: 25597 - DNA, 15 bp, Artificial Sequence
  dgRNA
  Spo11
ccgcgggctgtcccg

SEQ ID NO: 25598 - DNA, 15 bp, Artificial Sequence
  dgRNA
  Prl2c1
gatattagctaatga

SEQ ID NO: 25599 - DNA, 15 bp, Artificial Sequence
  dgRNA
  Prl2c1
atattagctaatgat

SEQ ID NO: 25600 - DNA, 15 bp, Artificial Sequence
  dgRNA
  Prl2c1
atggtatcctcaact

SEQ ID NO: 25601 - DNA, 15 bp, Artificial Sequence
  dgRNA
  Prl2c1
tgtgctgcactatat

SEQ ID NO: 25602 - DNA, 15 bp, Artificial Sequence
  dgRNA
  Slit1
cgtgcttggggggga

SEQ ID NO: 25603 - DNA, 15 bp, Artificial Sequence
  dgRNA
  Slit1
gtgcttttcgattga

SEQ ID NO: 25604 - DNA, 15 bp, Artificial Sequence
  dgRNA
  Slit1
ttgatggatgactgc

SEQ ID NO: 25605 - DNA, 15 bp, Artificial Sequence
  dgRNA
  Slit1
tgtgagcgagcgtgc

SEQ ID NO: 25606 - DNA, 15 bp, Artificial Sequence
  dgRNA
  Stk3
tccctagccctgcta

SEQ ID NO: 25607 - DNA, 15 bp, Artificial Sequence
  dgRNA
  Stk3
cccgcccgccttcca

SEQ ID NO: 25608 - DNA, 15 bp, Artificial Sequence
  dgRNA
  Stk3
cctgttcactatccc

SEQ ID NO: 25609 - DNA, 15 bp, Artificial Sequence
  dgRNA
  Stk3
gcccgcccactcttc

SEQ ID NO: 25610 - DNA, 15 bp, Artificial Sequence
  dgRNA
  Col1a1
gggcggcagagttgc

SEQ ID NO: 25611 - DNA, 15 bp, Artificial Sequence
  dgRNA
  Col1a1
cggcagagttgcggg

SEQ ID NO: 25612 - DNA, 15 bp, Artificial Sequence
  dgRNA
  Col1a1
ctcttcgttccaaat

SEQ ID NO: 25613 - DNA, 15 bp, Artificial Sequence
  dgRNA
  Col1a1
tcttcgttccaaatt

SEQ ID NO: 25614 - DNA, 15 bp, Artificial Sequence
  dgRNA
  Tmc1
ccttatactcaaaat

SEQ ID NO: 25615 - DNA, 15 bp, Artificial Sequence
  dgRNA
  Tmc1
gggggcaaaacttgc

SEQ ID NO: 25616 - DNA, 15 bp, Artificial Sequence
  dgRNA
  Gnrhr
cgggccatctgctga

SEQ ID NO: 25617 - DNA, 15 bp, Artificial Sequence
  dgRNA
  Gnrhr
ggctacggttacact

SEQ ID NO: 25618 - DNA, 15 bp, Artificial Sequence
  dgRNA
  Gnrhr
gacgtttccatctaa

SEQ ID NO: 25619 - DNA, 15 bp, Artificial Sequence
  dgRNA
  Gnrhr
ccgtctttttatcgt

SEQ ID NO: 25620 - DNA, 15 bp, Artificial Sequence
  dgRNA
  Eps15
gacctgcctaaactc

SEQ ID NO: 25621 - DNA, 15 bp, Artificial Sequence
  dgRNA
  Eps15
gagccctatccgcac

SEQ ID NO: 25622 - DNA, 15 bp, Artificial Sequence
  dgRNA
  Eps15
agccctatccgcacc

SEQ ID NO: 25623 - DNA, 15 bp, Artificial Sequence
  dgRNA
  Eps15
cgcaccgggttttcc

SEQ ID NO: 25624 - DNA, 15 bp, Artificial Sequence
  dgRNA
  Btbd7
ccggcgcgccgacgt

SEQ ID NO: 25625 - DNA, 15 bp, Artificial Sequence
  dgRNA
  Btbd7
cggcgcgccgacgtc

SEQ ID NO: 25626 - DNA, 15 bp, Artificial Sequence
  dgRNA
  Btbd7
tcgggtcacgtgacg

SEQ ID NO: 25627 - DNA, 15 bp, Artificial Sequence
  dgRNA
  Btbd7
cgggtcacgtgacgt

SEQ ID NO: 25628 - DNA, 15 bp, Artificial Sequence
  dgRNA
  9030624J02Rik
actagagggcgcagg

SEQ ID NO: 25629 - DNA, 15 bp, Artificial Sequence
  dgRNA
  9030624J02Rik
taccccttacaagac

SEQ ID NO: 25630 - DNA, 15 bp, Artificial Sequence
  dgRNA
  9030624J02Rik
accccttacaagact

SEQ ID NO: 25631 - DNA, 15 bp, Artificial Sequence
  dgRNA
  9030624J02Rik
ccccttacaagactg

SEQ ID NO: 25632 - DNA, 15 bp, Artificial Sequence
  dgRNA
  Gpatch1
aatcttatctgcagt

SEQ ID NO: 25633 - DNA, 15 bp, Artificial Sequence
  dgRNA
  Gpatch1
cagtcggacttgcat

SEQ ID NO: 25634 - DNA, 15 bp, Artificial Sequence
  dgRNA
  Gpatch1
ggactatgatttgcg

SEQ ID NO: 25635 - DNA, 15 bp, Artificial Sequence
  dgRNA
  Gpatch1
ctatgatttgcgagg

SEQ ID NO: 25636 - DNA, 15 bp, Artificial Sequence
  dgRNA
  Timm21
acgccctcttcatcc

SEQ ID NO: 25637 - DNA, 15 bp, Artificial Sequence
  dgRNA
  Timm21
cgcacgcgcagcgat

SEQ ID NO: 25638 - DNA, 15 bp, Artificial Sequence
  dgRNA
  Timm21
gcgcagaagcgtctt

SEQ ID NO: 25639 - DNA, 15 bp, Artificial Sequence
  dgRNA
  Timm21
cgcagaagcgtctta

SEQ ID NO: 25640 - DNA, 15 bp, Artificial Sequence
  dgRNA
  Pacsin1
ccccgcatgagaagc

SEQ ID NO: 25641 - DNA, 15 bp, Artificial Sequence
  dgRNA
  Pacsin1
gtattaggagcgcgc

SEQ ID NO: 25642 - DNA, 15 bp, Artificial Sequence
  dgRNA
  Pacsin1
aaacacaccgagctg

SEQ ID NO: 25643 - DNA, 15 bp, Artificial Sequence
  dgRNA
  Pacsin1
ggcctccgggtaccg

SEQ ID NO: 25644 - DNA, 15 bp, Artificial Sequence
  dgRNA
  Ubb
cgggacgcggggttc

SEQ ID NO: 25645 - DNA, 15 bp, Artificial Sequence
  dgRNA
  Ubb
gcggggttccggacg

SEQ ID NO: 25646 - DNA, 15 bp, Artificial Sequence
  dgRNA
  Ubb
cggggttccggacgc

SEQ ID NO: 25647 - DNA, 15 bp, Artificial Sequence
  dgRNA
  Ubb
atcagtatttcgcta

SEQ ID NO: 25648 - DNA, 15 bp, Artificial Sequence
  dgRNA
  Nfat5
gcccgggatcagcag

SEQ ID NO: 25649 - DNA, 15 bp, Artificial Sequence
  dgRNA
  Nfat5
cggccgcagcagcga

SEQ ID NO: 25650 - DNA, 15 bp, Artificial Sequence
  dgRNA
  Nfat5
cgcagcagcgacggc

SEQ ID NO: 25651 - DNA, 15 bp, Artificial Sequence
  dgRNA
  Nfat5
gttgatgctgttccg

SEQ ID NO: 25652 - DNA, 15 bp, Artificial Sequence
  dgRNA
  Snapc2
cttcatgacgtagtt

SEQ ID NO: 25653 - DNA, 15 bp, Artificial Sequence
  dgRNA
  Snapc2
gtagttcggaaatat

SEQ ID NO: 25654 - DNA, 15 bp, Artificial Sequence
  dgRNA
  Snapc2
tagttcggaaatata

SEQ ID NO: 25655 - DNA, 15 bp, Artificial Sequence
  dgRNA
  Snapc2
cgcgagccacgcccc

SEQ ID NO: 25656 - DNA, 15 bp, Artificial Sequence
  dgRNA
  Hdhd2
cggccgcgcccctgc

SEQ ID NO: 25657 - DNA, 15 bp, Artificial Sequence
  dgRNA
  Hdhd2
ccgcgcccctgccgg

SEQ ID NO: 25658 - DNA, 15 bp, Artificial Sequence
  dgRNA
  Hdhd2
cgcccctgccggagg

SEQ ID NO: 25659 - DNA, 15 bp, Artificial Sequence
  dgRNA
  Hdhd2
ctcctgtgagcgggc

SEQ ID NO: 25660 - DNA, 15 bp, Artificial Sequence
  dgRNA
  Zbtb17
ggagccggaaaacaa

SEQ ID NO: 25661 - DNA, 15 bp, Artificial Sequence
  dgRNA
  Zbtb17
aagagcactaacttt

SEQ ID NO: 25662 - DNA, 15 bp, Artificial Sequence
  dgRNA
  Zbtb17
gcactaactttcggc

SEQ ID NO: 25663 - DNA, 15 bp, Artificial Sequence
  dgRNA
  Zbtb17
aactttcggctggca

SEQ ID NO: 25664 - DNA, 15 bp, Artificial Sequence
  dgRNA
  Wnk1
catcacggaagtagt

SEQ ID NO: 25665 - DNA, 15 bp, Artificial Sequence
  dgRNA
  Wnk1
taggcgcgttcctcc

SEQ ID NO: 25666 - DNA, 15 bp, Artificial Sequence
  dgRNA
  Wnk1
aggcgcgttcctccc

SEQ ID NO: 25667 - DNA, 15 bp, Artificial Sequence
  dgRNA
  Wnk1
atcgtgcctcgagct

SEQ ID NO: 25668 - DNA, 15 bp, Artificial Sequence
  dgRNA
  Shc2
cggtctgagcctgac

SEQ ID NO: 25669 - DNA, 15 bp, Artificial Sequence
  dgRNA
  Shc2
gactggacattccct

SEQ ID NO: 25670 - DNA, 15 bp, Artificial Sequence
  dgRNA
  Shc2
ctggacattccctcg

SEQ ID NO: 25671 - DNA, 15 bp, Artificial Sequence
  dgRNA
  Shc2
tccctcggggagccc

SEQ ID NO: 25672 - DNA, 15 bp, Artificial Sequence
  dgRNA
  Rchy1
tgcgttcttaagtcc

SEQ ID NO: 25673 - DNA, 15 bp, Artificial Sequence
  dgRNA
  Rchy1
gcgttcttaagtcct

SEQ ID NO: 25674 - DNA, 15 bp, Artificial Sequence
  dgRNA
  Rchy1
ttctaaagggggcgc

SEQ ID NO: 25675 - DNA, 15 bp, Artificial Sequence
  dgRNA
  Rchy1
tctaaagggggcgca

SEQ ID NO: 25676 - DNA, 15 bp, Artificial Sequence
  dgRNA
  Kctd1
ctataggtctatgca

SEQ ID NO: 25677 - DNA, 15 bp, Artificial Sequence
  dgRNA
  Kctd1
gatccttgccttgag

SEQ ID NO: 25678 - DNA, 15 bp, Artificial Sequence
  dgRNA
  Kctd1
aattaaccgatcaca

SEQ ID NO: 25679 - DNA, 15 bp, Artificial Sequence
  dgRNA
  Kctd1
aaattaaccgatcac

SEQ ID NO: 25680 - DNA, 15 bp, Artificial Sequence
  dgRNA
  Glra4
taaaaagcgggatgc

SEQ ID NO: 25681 - DNA, 15 bp, Artificial Sequence
  dgRNA
  Glra4
aaaaagcgggatgct

SEQ ID NO: 25682 - DNA, 15 bp, Artificial Sequence
  dgRNA
  Glra4
ggtacaggagtaaca

SEQ ID NO: 25683 - DNA, 15 bp, Artificial Sequence
  dgRNA
  Glra4
tggacctaacacccc

SEQ ID NO: 25684 - DNA, 15 bp, Artificial Sequence
  dgRNA
  Rgs20
gggaaggatgcgcct

SEQ ID NO: 25685 - DNA, 15 bp, Artificial Sequence
  dgRNA
  Rgs20
atgcgcctcggtctg

SEQ ID NO: 25686 - DNA, 15 bp, Artificial Sequence
  dgRNA
  Rgs20
ctcggtctgaggacc

SEQ ID NO: 25687 - DNA, 15 bp, Artificial Sequence
  dgRNA
  Rgs20
tcggtctgaggaccc

SEQ ID NO: 25688 - DNA, 15 bp, Artificial Sequence
  dgRNA
  Ptbp3
cgttcccgcgaacgc

SEQ ID NO: 25689 - DNA, 15 bp, Artificial Sequence
  dgRNA
  Ptbp3
cgcgcctgcgttcgc

SEQ ID NO: 25690 - DNA, 15 bp, Artificial Sequence
  dgRNA
  Gja3
cgcctggaagcaggc

SEQ ID NO: 25691 - DNA, 15 bp, Artificial Sequence
  dgRNA
  Gja3
atagcttgttgcccg

SEQ ID NO: 25692 - DNA, 15 bp, Artificial Sequence
  dgRNA
  Gja3
tagcttgttgcccgc

SEQ ID NO: 25693 - DNA, 15 bp, Artificial Sequence
  dgRNA
  Gja3
agcttgttgcccgcg

SEQ ID NO: 25694 - DNA, 15 bp, Artificial Sequence
  dgRNA
  Tecpr2
catgcggcggcccac

SEQ ID NO: 25695 - DNA, 15 bp, Artificial Sequence
  dgRNA
  Tecpr2
cccgcctgcgaactg

SEQ ID NO: 25696 - DNA, 15 bp, Artificial Sequence
  dgRNA
  Tecpr2
cgtcacttccgtcct

SEQ ID NO: 25697 - DNA, 15 bp, Artificial Sequence
  dgRNA
  Tecpr2
gtcacttccgtcctt

SEQ ID NO: 25698 - DNA, 15 bp, Artificial Sequence
  dgRNA
  C1qtnf3
atgaaccccaccaac

SEQ ID NO: 25699 - DNA, 15 bp, Artificial Sequence
  dgRNA
  C1qtnf3
tcttgcctgcggtgc

SEQ ID NO: 25700 - DNA, 15 bp, Artificial Sequence
  dgRNA
  C1qtnf3
gagccgctgtcactc

SEQ ID NO: 25701 - DNA, 15 bp, Artificial Sequence
  dgRNA
  C1qtnf3
ggcgtccagttggtg

SEQ ID NO: 25702 - DNA, 15 bp, Artificial Sequence
  dgRNA
  Colec11
ctccagcagattcgc

SEQ ID NO: 25703 - DNA, 15 bp, Artificial Sequence
  dgRNA
  Colec11
tccagcagattcgct

SEQ ID NO: 25704 - DNA, 15 bp, Artificial Sequence
  dgRNA
  Colec11
gccaaaggggtgtct

SEQ ID NO: 25705 - DNA, 15 bp, Artificial Sequence
  dgRNA
  Colec11
cccctgctgccaaag

SEQ ID NO: 25706 - DNA, 15 bp, Artificial Sequence
  dgRNA
  Fam179b
cgtcatttccgtcta

SEQ ID NO: 25707 - DNA, 15 bp, Artificial Sequence
  dgRNA
  Fam179b
cccgcctcttcattc

SEQ ID NO: 25708 - DNA, 15 bp, Artificial Sequence
  dgRNA
  Fam179b
acccagcatccaccg

SEQ ID NO: 25709 - DNA, 15 bp, Artificial Sequence
  dgRNA
  Fam179b
tccaccgcggcagat

SEQ ID NO: 25710 - DNA, 15 bp, Artificial Sequence
  dgRNA
  Myrf
gcggaggccgggcta

SEQ ID NO: 25711 - DNA, 15 bp, Artificial Sequence
  dgRNA
  Myrf
cgggctagggctgcg

SEQ ID NO: 25712 - DNA, 15 bp, Artificial Sequence
  dgRNA
  Myrf
cggggagcgagcgtg

SEQ ID NO: 25713 - DNA, 15 bp, Artificial Sequence
  dgRNA
  Myrf
ctggccggactgtac

SEQ ID NO: 25714 - DNA, 15 bp, Artificial Sequence
  dgRNA
  Ccnh
tgcccaggcgtcctc

SEQ ID NO: 25715 - DNA, 15 bp, Artificial Sequence
  dgRNA
  Ccnh
cgccctccctcgttg

SEQ ID NO: 25716 - DNA, 15 bp, Artificial Sequence
  dgRNA
  Ccnh
cggaacacctcccac

SEQ ID NO: 25717 - DNA, 15 bp, Artificial Sequence
  dgRNA
  Ccnh
acctcccaccggctc

SEQ ID NO: 25718 - DNA, 15 bp, Artificial Sequence
  dgRNA
  Csn2
atcacgtagacttct

SEQ ID NO: 25719 - DNA, 15 bp, Artificial Sequence
  dgRNA
  Csn2
agtgcagtatatata

SEQ ID NO: 25720 - DNA, 15 bp, Artificial Sequence
  dgRNA
  Csn2
tcccaagaaattcta

SEQ ID NO: 25721 - DNA, 15 bp, Artificial Sequence
  dgRNA
  Csn2
tacgtgattagaaaa

SEQ ID NO: 25722 - DNA, 15 bp, Artificial Sequence
  dgRNA
  Rdh5
atggcatagatggtc

SEQ ID NO: 25723 - DNA, 15 bp, Artificial Sequence
  dgRNA
  Rdh5
aacctaacttcagcc

SEQ ID NO: 25724 - DNA, 15 bp, Artificial Sequence
  dgRNA
  Rdh5
agggcagcgacaagg

SEQ ID NO: 25725 - DNA, 15 bp, Artificial Sequence
  dgRNA
  Rdh5
aaaagggcagcgaca

SEQ ID NO: 25726 - DNA, 15 bp, Artificial Sequence
  dgRNA
  mt-Nd2
cttatcctaatagta

SEQ ID NO: 25727 - DNA, 15 bp, Artificial Sequence
  dgRNA
  mt-Nd2
ataccccgaaaacgt

SEQ ID NO: 25728 - DNA, 15 bp, Artificial Sequence
  dgRNA
  mt-Nd2
acgttttcggggtat

SEQ ID NO: 25729 - DNA, 15 bp, Artificial Sequence
  dgRNA
  mt-Nd2
aacgttttcggggta

SEQ ID NO: 25730 - DNA, 15 bp, Artificial Sequence
  dgRNA
  Zfp273
agggtttataggtca

SEQ ID NO: 25731 - DNA, 15 bp, Artificial Sequence
  dgRNA
  Gxylt1
ggcctgcgccggatg

SEQ ID NO: 25732 - DNA, 15 bp, Artificial Sequence
  dgRNA
  Gxylt1
gcctgcgccggatgt

SEQ ID NO: 25733 - DNA, 15 bp, Artificial Sequence
  dgRNA
  Gxylt1
tgcgccggatgtggg

SEQ ID NO: 25734 - DNA, 15 bp, Artificial Sequence
  dgRNA
  Gxylt1
gcgccggatgtggga

SEQ ID NO: 25735 - DNA, 15 bp, Artificial Sequence
  dgRNA
  Nbeal2
gactccgcctgcgag

SEQ ID NO: 25736 - DNA, 15 bp, Artificial Sequence
  dgRNA
  Nbeal2
tccgcctgcgagagg

SEQ ID NO: 25737 - DNA, 15 bp, Artificial Sequence
  dgRNA
  Nbeal2
tccatgcgacctccc

SEQ ID NO: 25738 - DNA, 15 bp, Artificial Sequence
  dgRNA
  Nbeal2
ggccgccctgacccc

SEQ ID NO: 25739 - DNA, 15 bp, Artificial Sequence
  dgRNA
  Mgat4c
aggtcttagccttct

SEQ ID NO: 25740 - DNA, 15 bp, Artificial Sequence
  dgRNA
  Mgat4c
agaaataatagcgag

SEQ ID NO: 25741 - DNA, 15 bp, Artificial Sequence
  dgRNA
  Mgat4c
gaaataatagcgaga

SEQ ID NO: 25742 - DNA, 15 bp, Artificial Sequence
  dgRNA
  Mgat4c
aaataatagcgagag

SEQ ID NO: 25743 - DNA, 15 bp, Artificial Sequence
  dgRNA
  Epgn
tgtgcgagtgcccgc

SEQ ID NO: 25744 - DNA, 15 bp, Artificial Sequence
  dgRNA
  Epgn
ggagcacatagtttt

SEQ ID NO: 25745 - DNA, 15 bp, Artificial Sequence
  dgRNA
  Epgn
ttgtttaggatacct

SEQ ID NO: 25746 - DNA, 15 bp, Artificial Sequence
  dgRNA
  Epgn
ctcgcacacttgttt

SEQ ID NO: 25747 - DNA, 15 bp, Artificial Sequence
  dgRNA
  St7
tgtgtggagcacgcc

SEQ ID NO: 25748 - DNA, 15 bp, Artificial Sequence
  dgRNA
  St7
gagctgttacgtcag

SEQ ID NO: 25749 - DNA, 15 bp, Artificial Sequence
  dgRNA
  St7
agctgttacgtcagt

SEQ ID NO: 25750 - DNA, 15 bp, Artificial Sequence
  dgRNA
  St7
cgtcagtgggtccct

SEQ ID NO: 25751 - DNA, 15 bp, Artificial Sequence
  dgRNA
  Lfng
ctccggagggtgact

SEQ ID NO: 25752 - DNA, 15 bp, Artificial Sequence
  dgRNA
  Lfng
agggtgactcggcgc

SEQ ID NO: 25753 - DNA, 15 bp, Artificial Sequence
  dgRNA
  Lfng
gtgactcggcgcagg

SEQ ID NO: 25754 - DNA, 15 bp, Artificial Sequence
  dgRNA
  Lfng
tgactcggcgcaggc

SEQ ID NO: 25755 - DNA, 15 bp, Artificial Sequence
  dgRNA
  Vma21
agtcccggctcaacg

SEQ ID NO: 25756 - DNA, 15 bp, Artificial Sequence
  dgRNA
  Vma21
caacgtggagtggct

SEQ ID NO: 25757 - DNA, 15 bp, Artificial Sequence
  dgRNA
  Vma21
gctaggctactcgcc

SEQ ID NO: 25758 - DNA, 15 bp, Artificial Sequence
  dgRNA
  Vma21
tagagaatgatccgc

SEQ ID NO: 25759 - DNA, 15 bp, Artificial Sequence
  dgRNA
  Msn
gagtgggcactagtg

SEQ ID NO: 25760 - DNA, 15 bp, Artificial Sequence
  dgRNA
  Msn
ttttggccccgagcc

SEQ ID NO: 25761 - DNA, 15 bp, Artificial Sequence
  dgRNA
  Msn
gcctggccccccacg

SEQ ID NO: 25762 - DNA, 15 bp, Artificial Sequence
  dgRNA
  Msn
cgatgcccgaagccg

SEQ ID NO: 25763 - DNA, 15 bp, Artificial Sequence
  dgRNA
  Pacsin2
gttgtgtcatgggcc

SEQ ID NO: 25764 - DNA, 15 bp, Artificial Sequence
  dgRNA
  Pacsin2
atgggccaggcacgc

SEQ ID NO: 25765 - DNA, 15 bp, Artificial Sequence
  dgRNA
  Pacsin2
tggctccggcgtgcc

SEQ ID NO: 25766 - DNA, 15 bp, Artificial Sequence
  dgRNA
  Pacsin2
acagtaccaagctcc

SEQ ID NO: 25767 - DNA, 15 bp, Artificial Sequence
  dgRNA
  Sirpa
ccgcccccgtgcctc

SEQ ID NO: 25768 - DNA, 15 bp, Artificial Sequence
  dgRNA
  Sirpa
tgcgcctggctccct

SEQ ID NO: 25769 - DNA, 15 bp, Artificial Sequence
  dgRNA
  Sirpa
gctcccctttcccgc

SEQ ID NO: 25770 - DNA, 15 bp, Artificial Sequence
  dgRNA
  Sirpa
cctttcccgccggcc

SEQ ID NO: 25771 - DNA, 15 bp, Artificial Sequence
  dgRNA
  Adam22
ctccgcctggggatg

SEQ ID NO: 25772 - DNA, 15 bp, Artificial Sequence
  dgRNA
  Adam22
cacttagctacaggc

SEQ ID NO: 25773 - DNA, 15 bp, Artificial Sequence
  dgRNA
  Adam22
ggctggcgcccgaag

SEQ ID NO: 25774 - DNA, 15 bp, Artificial Sequence
  dgRNA
  Adam22
accgaagcgctcgcc

SEQ ID NO: 25775 - DNA, 15 bp, Artificial Sequence
  dgRNA
  Lyrm5
cgcactgtagtcttc

SEQ ID NO: 25776 - DNA, 15 bp, Artificial Sequence
  dgRNA
  Lyrm5
gcccaagtcgtagac

SEQ ID NO: 25777 - DNA, 15 bp, Artificial Sequence
  dgRNA
  Lyrm5
ggtacgcccacatcg

SEQ ID NO: 25778 - DNA, 15 bp, Artificial Sequence
  dgRNA
  Lyrm5
acagtgcgattgcgc

SEQ ID NO: 25779 - DNA, 15 bp, Artificial Sequence
  dgRNA
  Olfr1029
tgtagaactatgaag

SEQ ID NO: 25780 - DNA, 15 bp, Artificial Sequence
  dgRNA
  Olfr1029
gaaacatggtagtta

SEQ ID NO: 25781 - DNA, 15 bp, Artificial Sequence
  dgRNA
  Apol6
gtatacttcccagca

SEQ ID NO: 25782 - DNA, 15 bp, Artificial Sequence
  dgRNA
  Apol6
gcaaggtccctattc

SEQ ID NO: 25783 - DNA, 15 bp, Artificial Sequence
  dgRNA
  Apol6
caaggtccctattct

SEQ ID NO: 25784 - DNA, 15 bp, Artificial Sequence
  dgRNA
  Apol6
ttatggaatgattcg

SEQ ID NO: 25785 - DNA, 15 bp, Artificial Sequence
  dgRNA
  Rffl
tggctcggcctagac

SEQ ID NO: 25786 - DNA, 15 bp, Artificial Sequence
  dgRNA
  Rffl
ggctcggcctagact

SEQ ID NO: 25787 - DNA, 15 bp, Artificial Sequence
  dgRNA
  Rffl
gctcggcctagactg

SEQ ID NO: 25788 - DNA, 15 bp, Artificial Sequence
  dgRNA
  Rffl
actccacacctagcc

SEQ ID NO: 25789 - DNA, 15 bp, Artificial Sequence
  dgRNA
  Slc35f1
acagcatcctagacc

SEQ ID NO: 25790 - DNA, 15 bp, Artificial Sequence
  dgRNA
  Slc35f1
ctccggagcgccctc

SEQ ID NO: 25791 - DNA, 15 bp, Artificial Sequence
  dgRNA
  Slc35f1
ggagcgccctctggc

SEQ ID NO: 25792 - DNA, 15 bp, Artificial Sequence
  dgRNA
  Slc35f1
gagcgccctctggcg

SEQ ID NO: 25793 - DNA, 15 bp, Artificial Sequence
  dgRNA
  Slc25a20
ctcccatacatcatt

SEQ ID NO: 25794 - DNA, 15 bp, Artificial Sequence
  dgRNA
  Slc25a20
tcccatacatcatta

SEQ ID NO: 25795 - DNA, 15 bp, Artificial Sequence
  dgRNA
  Slc25a20
ccccgcccactaagg

SEQ ID NO: 25796 - DNA, 15 bp, Artificial Sequence
  dgRNA
  Slc25a20
ccggaagtagacttc

SEQ ID NO: 25797 - DNA, 15 bp, Artificial Sequence
  dgRNA
  Klhdc3
agactgacgcaagcg

SEQ ID NO: 25798 - DNA, 15 bp, Artificial Sequence
  dgRNA
  Klhdc3
gcgtgcgacgtgaac

SEQ ID NO: 25799 - DNA, 15 bp, Artificial Sequence
  dgRNA
  Klhdc3
cgcatgcgcacaaac

SEQ ID NO: 25800 - DNA, 15 bp, Artificial Sequence
  dgRNA
  Klhdc3
gtgaaggtgcgggtc

SEQ ID NO: 25801 - DNA, 15 bp, Artificial Sequence
  dgRNA
  Reps2
gttgcgttccttacc

SEQ ID NO: 25802 - DNA, 15 bp, Artificial Sequence
  dgRNA
  Reps2
ttccttacctggcga

SEQ ID NO: 25803 - DNA, 15 bp, Artificial Sequence
  dgRNA
  Reps2
tccttacctggcgaa

SEQ ID NO: 25804 - DNA, 15 bp, Artificial Sequence
  dgRNA
  Reps2
ccttacctggcgaag

SEQ ID NO: 25805 - DNA, 15 bp, Artificial Sequence
  dgRNA
  Tbc1d24
gcctctgattatacc

SEQ ID NO: 25806 - DNA, 15 bp, Artificial Sequence
  dgRNA
  Tbc1d24
cctctgattatacct

SEQ ID NO: 25807 - DNA, 15 bp, Artificial Sequence
  dgRNA
  Tbc1d24
ctctgattatacctg

SEQ ID NO: 25808 - DNA, 15 bp, Artificial Sequence
  dgRNA
  Tbc1d24
aggctctcttgaaag

SEQ ID NO: 25809 - DNA, 15 bp, Artificial Sequence
  dgRNA
  Chrna4
cccctcccggcatgt

SEQ ID NO: 25810 - DNA, 15 bp, Artificial Sequence
  dgRNA
  Chrna4
ccctcccggcatgtc

SEQ ID NO: 25811 - DNA, 15 bp, Artificial Sequence
  dgRNA
  Chrna4
catgtcgggagcctc

SEQ ID NO: 25812 - DNA, 15 bp, Artificial Sequence
  dgRNA
  Chrna4
gtcgggagcctcagg

SEQ ID NO: 25813 - DNA, 15 bp, Artificial Sequence
  dgRNA
  Ehd1
acgagccatccctcg

SEQ ID NO: 25814 - DNA, 15 bp, Artificial Sequence
  dgRNA
  Ehd1
cgagccatccctcga

SEQ ID NO: 25815 - DNA, 15 bp, Artificial Sequence
  dgRNA
  Ehd1
gagccatccctcgag

SEQ ID NO: 25816 - DNA, 15 bp, Artificial Sequence
  dgRNA
  Ehd1
ccatccctcgagggg

SEQ ID NO: 25817 - DNA, 15 bp, Artificial Sequence
  dgRNA
  Mrgprb5
ctaccccatatcata

SEQ ID NO: 25818 - DNA, 15 bp, Artificial Sequence
  dgRNA
  Mrgprb5
gcttacccctcttta

SEQ ID NO: 25819 - DNA, 15 bp, Artificial Sequence
  dgRNA
  Mrgprb5
cccctctttatggac

SEQ ID NO: 25820 - DNA, 15 bp, Artificial Sequence
  dgRNA
  Mrgprb5
tagatccatatgata

SEQ ID NO: 25821 - DNA, 15 bp, Artificial Sequence
  dgRNA
  Npy6r
cttcatgctccgcag

SEQ ID NO: 25822 - DNA, 15 bp, Artificial Sequence
  dgRNA
  Npy6r
tgataaaaatgcgtc

SEQ ID NO: 25823 - DNA, 15 bp, Artificial Sequence
  dgRNA
  Npy6r
gcggagcatgaaggg

SEQ ID NO: 25824 - DNA, 15 bp, Artificial Sequence
  dgRNA
  Npy6r
actgcggagcatgaa

SEQ ID NO: 25825 - DNA, 15 bp, Artificial Sequence
  dgRNA
  Fuca2
acaaaccgggcgtct

SEQ ID NO: 25826 - DNA, 15 bp, Artificial Sequence
  dgRNA
  Fuca2
gtaatgcaaccttct

SEQ ID NO: 25827 - DNA, 15 bp, Artificial Sequence
  dgRNA
  Fuca2
taatgcaaccttctt

SEQ ID NO: 25828 - DNA, 15 bp, Artificial Sequence
  dgRNA
  Fuca2
aatgcaaccttcttg

SEQ ID NO: 25829 - DNA, 15 bp, Artificial Sequence
  dgRNA
  Odf4
catctgatccacatt

SEQ ID NO: 25830 - DNA, 15 bp, Artificial Sequence
  dgRNA
  Odf4
atctgatccacatta

SEQ ID NO: 25831 - DNA, 15 bp, Artificial Sequence
  dgRNA
  Odf4
tctgatccacattag

SEQ ID NO: 25832 - DNA, 15 bp, Artificial Sequence
  dgRNA
  Odf4
atccacattaggggc

SEQ ID NO: 25833 - DNA, 15 bp, Artificial Sequence
  dgRNA
  Pla2g10
gacagtcactcctca

SEQ ID NO: 25834 - DNA, 15 bp, Artificial Sequence
  dgRNA
  Pla2g10
cttgactccgcccca

SEQ ID NO: 25835 - DNA, 15 bp, Artificial Sequence
  dgRNA
  Pla2g10
cgccccacggaaaga

SEQ ID NO: 25836 - DNA, 15 bp, Artificial Sequence
  dgRNA
  Pla2g10
gggggtcggcaggat

SEQ ID NO: 25837 - DNA, 15 bp, Artificial Sequence
  dgRNA
  Mroh1
ggcttagcgcagacc

SEQ ID NO: 25838 - DNA, 15 bp, Artificial Sequence
  dgRNA
  Mroh1
gcttagcgcagacct

SEQ ID NO: 25839 - DNA, 15 bp, Artificial Sequence
  dgRNA
  Mroh1
ggaagtcggagcttg

SEQ ID NO: 25840 - DNA, 15 bp, Artificial Sequence
  dgRNA
  Mroh1
gaagtcggagcttga

SEQ ID NO: 25841 - DNA, 15 bp, Artificial Sequence
  dgRNA
  1700020D05Rik
gataacatgccggaa

SEQ ID NO: 25842 - DNA, 15 bp, Artificial Sequence
  dgRNA
  1700020D05Rik
aatggtaattctgtc

SEQ ID NO: 25843 - DNA, 15 bp, Artificial Sequence
  dgRNA
  1700020D05Rik
tccaactaggaagca

SEQ ID NO: 25844 - DNA, 15 bp, Artificial Sequence
  dgRNA
  1700020D05Rik
ccccgtgcgcgagcg

SEQ ID NO: 25845 - DNA, 15 bp, Artificial Sequence
  dgRNA
  Tbcel
cggtctttggacctg

SEQ ID NO: 25846 - DNA, 15 bp, Artificial Sequence
  dgRNA
  Tbcel
attctgatccactct

SEQ ID NO: 25847 - DNA, 15 bp, Artificial Sequence
  dgRNA
  Tbcel
cattcccggttgcca

SEQ ID NO: 25848 - DNA, 15 bp, Artificial Sequence
  dgRNA
  Tbcel
gcagctcgctctgag

SEQ ID NO: 25849 - DNA, 15 bp, Artificial Sequence
  dgRNA
  Ankrd53
atccttccgtttccc

SEQ ID NO: 25850 - DNA, 15 bp, Artificial Sequence
  dgRNA
  Ankrd53
gagttgctctgcttt

SEQ ID NO: 25851 - DNA, 15 bp, Artificial Sequence
  dgRNA
  Ankrd53
acaggtacgtcacac

SEQ ID NO: 25852 - DNA, 15 bp, Artificial Sequence
  dgRNA
  Ankrd53
ttatgacgtcctcca

SEQ ID NO: 25853 - DNA, 15 bp, Artificial Sequence
  dgRNA
  Aaas
aaacagtagtcttac

SEQ ID NO: 25854 - DNA, 15 bp, Artificial Sequence
  dgRNA
  Aaas
cgctccttacgccac

SEQ ID NO: 25855 - DNA, 15 bp, Artificial Sequence
  dgRNA
  Aaas
ccttacgccacaggt

SEQ ID NO: 25856 - DNA, 15 bp, Artificial Sequence
  dgRNA
  Aaas
ccacaggtcggtcct

SEQ ID NO: 25857 - DNA, 15 bp, Artificial Sequence
  dgRNA
  Ube2c
ccaattggctagctg

SEQ ID NO: 25858 - DNA, 15 bp, Artificial Sequence
  dgRNA
  Ube2c
cccgccgtccaatcg

SEQ ID NO: 25859 - DNA, 15 bp, Artificial Sequence
  dgRNA
  Ube2c
atcgtggcgcgttac

SEQ ID NO: 25860 - DNA, 15 bp, Artificial Sequence
  dgRNA
  Ube2c
tcgtggcgcgttact

SEQ ID NO: 25861 - DNA, 15 bp, Artificial Sequence
  dgRNA
  Pcdhga8
tgcagcgcttcttat

SEQ ID NO: 25862 - DNA, 15 bp, Artificial Sequence
  dgRNA
  Pcdhga8
cgaccagcctgagat

SEQ ID NO: 25863 - DNA, 15 bp, Artificial Sequence
  dgRNA
  Pcdhga8
ggtcggtgacaacac

SEQ ID NO: 25864 - DNA, 15 bp, Artificial Sequence
  dgRNA
  Pcdhga8
ggtgacaacactggc

SEQ ID NO: 25865 - DNA, 15 bp, Artificial Sequence
  dgRNA
  Pdc
gggtcatcaatatcc

SEQ ID NO: 25866 - DNA, 15 bp, Artificial Sequence
  dgRNA
  Pdc
ctctgaacatgtaat

SEQ ID NO: 25867 - DNA, 15 bp, Artificial Sequence
  dgRNA
  Rbm34
gtattaagcatagcg

SEQ ID NO: 25868 - DNA, 15 bp, Artificial Sequence
  dgRNA
  Rbm34
cagccacgggctgaa

SEQ ID NO: 25869 - DNA, 15 bp, Artificial Sequence
  dgRNA
  Rbm34
agccacgggctgaat

SEQ ID NO: 25870 - DNA, 15 bp, Artificial Sequence
  dgRNA
  Rbm34
gccacgggctgaatg

SEQ ID NO: 25871 - DNA, 15 bp, Artificial Sequence
  dgRNA
  Cdc6
aagctccgcgaggtc

SEQ ID NO: 25872 - DNA, 15 bp, Artificial Sequence
  dgRNA
  Cdc6
aggctggtccgagca

SEQ ID NO: 25873 - DNA, 15 bp, Artificial Sequence
  dgRNA
  Cdc6
tggtccgagcaaggc

SEQ ID NO: 25874 - DNA, 15 bp, Artificial Sequence
  dgRNA
  Cdc6
tccgagcaaggccgg

SEQ ID NO: 25875 - DNA, 15 bp, Artificial Sequence
  dgRNA
  Irak1bp1
tgcgggtaagaccac

SEQ ID NO: 25876 - DNA, 15 bp, Artificial Sequence
  dgRNA
  Irak1bp1
cggcaccgtgaaatt

SEQ ID NO: 25877 - DNA, 15 bp, Artificial Sequence
  dgRNA
  Irak1bp1
ggcaccgtgaaattc

SEQ ID NO: 25878 - DNA, 15 bp, Artificial Sequence
  dgRNA
  Irak1bp1
cgggatcacacacgt

SEQ ID NO: 25879 - DNA, 15 bp, Artificial Sequence
  dgRNA
  Tcf21
gaaggaatccggtac

SEQ ID NO: 25880 - DNA, 15 bp, Artificial Sequence
  dgRNA
  Tcf21
gttgcaatcggttgc

SEQ ID NO: 25881 - DNA, 15 bp, Artificial Sequence
  dgRNA
  Tcf21
cggttgctggaaacc

SEQ ID NO: 25882 - DNA, 15 bp, Artificial Sequence
  dgRNA
  Tcf21
tctgttgggcctagc

SEQ ID NO: 25883 - DNA, 15 bp, Artificial Sequence
  dgRNA
  Cldnd1
tcctcgcgcgtcgtc

SEQ ID NO: 25884 - DNA, 15 bp, Artificial Sequence
  dgRNA
  Cldnd1
cctacaagtcccaca

SEQ ID NO: 25885 - DNA, 15 bp, Artificial Sequence
  dgRNA
  Cldnd1
gcgcgaggaattgtg

SEQ ID NO: 25886 - DNA, 15 bp, Artificial Sequence
  dgRNA
  Cldnd1
cgcgcgaggaattgt

SEQ ID NO: 25887 - DNA, 15 bp, Artificial Sequence
  dgRNA
  Nupl2
tatacagccaactag

SEQ ID NO: 25888 - DNA, 15 bp, Artificial Sequence
  dgRNA
  Nupl2
atacagccaactaga

SEQ ID NO: 25889 - DNA, 15 bp, Artificial Sequence
  dgRNA
  Nupl2
gttgtctgctatatc

SEQ ID NO: 25890 - DNA, 15 bp, Artificial Sequence
  dgRNA
  Nupl2
gtattctctagattc

SEQ ID NO: 25891 - DNA, 15 bp, Artificial Sequence
  dgRNA
  Hcfc1r1
actcacctgacccag

SEQ ID NO: 25892 - DNA, 15 bp, Artificial Sequence
  dgRNA
  Hcfc1r1
cagaggcaccgcgag

SEQ ID NO: 25893 - DNA, 15 bp, Artificial Sequence
  dgRNA
  Hcfc1r1
gcaccgcgagcggtg

SEQ ID NO: 25894 - DNA, 15 bp, Artificial Sequence
  dgRNA
  Hcfc1r1
tcataggtgatttgt

SEQ ID NO: 25895 - DNA, 15 bp, Artificial Sequence
  dgRNA
  Kcnq1
gcccagcccggaacg

SEQ ID NO: 25896 - DNA, 15 bp, Artificial Sequence
  dgRNA
  Kcnq1
ggagatagcctgact

SEQ ID NO: 25897 - DNA, 15 bp, Artificial Sequence
  dgRNA
  Kcnq1
tagcctgacttggct

SEQ ID NO: 25898 - DNA, 15 bp, Artificial Sequence
  dgRNA
  Kcnq1
ttggcttggcggagc

SEQ ID NO: 25899 - DNA, 15 bp, Artificial Sequence
  dgRNA
  Qpctl
tgatcgacttccgtg

SEQ ID NO: 25900 - DNA, 15 bp, Artificial Sequence
  dgRNA
  Qpctl
gatcgacttccgtga

SEQ ID NO: 25901 - DNA, 15 bp, Artificial Sequence
  dgRNA
  Qpctl
atcgacttccgtgag

SEQ ID NO: 25902 - DNA, 15 bp, Artificial Sequence
  dgRNA
  Qpctl
cgtgaccccgcgcct

SEQ ID NO: 25903 - DNA, 15 bp, Artificial Sequence
  dgRNA
  Lrrc7
gcagcgtcactgaac

SEQ ID NO: 25904 - DNA, 15 bp, Artificial Sequence
  dgRNA
  Lrrc7
gtcactgaactggtg

SEQ ID NO: 25905 - DNA, 15 bp, Artificial Sequence
  dgRNA
  Lrrc7
gagcacccagcgcac

SEQ ID NO: 25906 - DNA, 15 bp, Artificial Sequence
  dgRNA
  Lrrc7
ctggagccgcggtgc

SEQ ID NO: 25907 - DNA, 15 bp, Artificial Sequence
  dgRNA
  Col5a2
cagactccttctaat

SEQ ID NO: 25908 - DNA, 15 bp, Artificial Sequence
  dgRNA
  Vmn1r235
gcaattaaacttccc

SEQ ID NO: 25909 - DNA, 15 bp, Artificial Sequence
  dgRNA
  Fntb
ttgcataacgaaccg

SEQ ID NO: 25910 - DNA, 15 bp, Artificial Sequence
  dgRNA
  Fntb
agctcatctgtccga

SEQ ID NO: 25911 - DNA, 15 bp, Artificial Sequence
  dgRNA
  Fntb
gctcatctgtccgac

SEQ ID NO: 25912 - DNA, 15 bp, Artificial Sequence
  dgRNA
  Fntb
ctcatctgtccgacg

SEQ ID NO: 25913 - DNA, 15 bp, Artificial Sequence
  dgRNA
  Apbb1
cgaataactcatgct

SEQ ID NO: 25914 - DNA, 15 bp, Artificial Sequence
  dgRNA
  Apbb1
ataactcatgctagg

SEQ ID NO: 25915 - DNA, 15 bp, Artificial Sequence
  dgRNA
  Apbb1
taactcatgctaggt

SEQ ID NO: 25916 - DNA, 15 bp, Artificial Sequence
  dgRNA
  Apbb1
cctcttggaccagtc

SEQ ID NO: 25917 - DNA, 15 bp, Artificial Sequence
  dgRNA
  4930435E12Rik
cccacccaaagtacc

SEQ ID NO: 25918 - DNA, 15 bp, Artificial Sequence
  dgRNA
  4930435E12Rik
gtaggtggatgaatc

SEQ ID NO: 25919 - DNA, 15 bp, Artificial Sequence
  dgRNA
  4930435E12Rik
ccaggtactttgggt

SEQ ID NO: 25920 - DNA, 15 bp, Artificial Sequence
  dgRNA
  4930435E12Rik
gccaggtactttggg

SEQ ID NO: 25921 - DNA, 15 bp, Artificial Sequence
  dgRNA
  Adar
atagtgccctgctag

SEQ ID NO: 25922 - DNA, 15 bp, Artificial Sequence
  dgRNA
  Adar
gtgccctgctagtgg

SEQ ID NO: 25923 - DNA, 15 bp, Artificial Sequence
  dgRNA
  Adar
ggtgggcgtggacta

SEQ ID NO: 25924 - DNA, 15 bp, Artificial Sequence
  dgRNA
  Adar
gggcgtggactacgg

SEQ ID NO: 25925 - DNA, 15 bp, Artificial Sequence
  dgRNA
  Mapk3
actaaagtaccctag

SEQ ID NO: 25926 - DNA, 15 bp, Artificial Sequence
  dgRNA
  Mapk3
gtaccctagtggcca

SEQ ID NO: 25927 - DNA, 15 bp, Artificial Sequence
  dgRNA
  Mapk3
aggaacagcgtaact

SEQ ID NO: 25928 - DNA, 15 bp, Artificial Sequence
  dgRNA
  Mapk3
aacagcgtaactagg

SEQ ID NO: 25929 - DNA, 15 bp, Artificial Sequence
  dgRNA
  Flna
ggcggggggcgttgt

SEQ ID NO: 25930 - DNA, 15 bp, Artificial Sequence
  dgRNA
  Flna
gcggggggcgttgtg

SEQ ID NO: 25931 - DNA, 15 bp, Artificial Sequence
  dgRNA
  Flna
gggcattccaacggg

SEQ ID NO: 25932 - DNA, 15 bp, Artificial Sequence
  dgRNA
  Flna
ggcattccaacggga

SEQ ID NO: 25933 - DNA, 15 bp, Artificial Sequence
  dgRNA
  Fkbp15
actccacctcctcgg

SEQ ID NO: 25934 - DNA, 15 bp, Artificial Sequence
  dgRNA
  Fkbp15
ctccacctcctcgga

SEQ ID NO: 25935 - DNA, 15 bp, Artificial Sequence
  dgRNA
  Fkbp15
acctcctcggagggc

SEQ ID NO: 25936 - DNA, 15 bp, Artificial Sequence
  dgRNA
  Fkbp15
gaggccttgcgtcac

SEQ ID NO: 25937 - DNA, 15 bp, Artificial Sequence
  dgRNA
  Naa30
cccacccccggcacg

SEQ ID NO: 25938 - DNA, 15 bp, Artificial Sequence
  dgRNA
  Naa30
cggcacgcggcctcc

SEQ ID NO: 25939 - DNA, 15 bp, Artificial Sequence
  dgRNA
  Naa30
cctccggagacacct

SEQ ID NO: 25940 - DNA, 15 bp, Artificial Sequence
  dgRNA
  Naa30
ctccggagacacctc

SEQ ID NO: 25941 - DNA, 15 bp, Artificial Sequence
  dgRNA
  Serhl
ctgaaagtcccgggc

SEQ ID NO: 25942 - DNA, 15 bp, Artificial Sequence
  dgRNA
  Serhl
aaggcggggcctcgg

SEQ ID NO: 25943 - DNA, 15 bp, Artificial Sequence
  dgRNA
  Serhl
aggcggggcctcggt

SEQ ID NO: 25944 - DNA, 15 bp, Artificial Sequence
  dgRNA
  Serhl
ggcggtgtcgcttga

SEQ ID NO: 25945 - DNA, 15 bp, Artificial Sequence
  dgRNA
  Vstm2a
actctttgctatgag

SEQ ID NO: 25946 - DNA, 15 bp, Artificial Sequence
  dgRNA
  Vstm2a
gcagtatcgcgcccc

SEQ ID NO: 25947 - DNA, 15 bp, Artificial Sequence
  dgRNA
  Vstm2a
ctcccttggcatgat

SEQ ID NO: 25948 - DNA, 15 bp, Artificial Sequence
  dgRNA
  Vstm2a
tcccttggcatgatg

SEQ ID NO: 25949 - DNA, 15 bp, Artificial Sequence
  dgRNA
  Gbx1
gcataagcgagaagt

SEQ ID NO: 25950 - DNA, 15 bp, Artificial Sequence
  dgRNA
  Gbx1
agagaaccgagtccc

SEQ ID NO: 25951 - DNA, 15 bp, Artificial Sequence
  dgRNA
  Gbx1
agagtgcgaaggcac

SEQ ID NO: 25952 - DNA, 15 bp, Artificial Sequence
  dgRNA
  Gbx1
gagtgcgaaggcact

SEQ ID NO: 25953 - DNA, 15 bp, Artificial Sequence
  dgRNA
  Olfr130
ttcaagtctgtcaag

SEQ ID NO: 25954 - DNA, 15 bp, Artificial Sequence
  dgRNA
  Olfr130
gcgcgggtgtgaggg

SEQ ID NO: 25955 - DNA, 15 bp, Artificial Sequence
  dgRNA
  Olfr130
gcagcgcgggtgtga

SEQ ID NO: 25956 - DNA, 15 bp, Artificial Sequence
  dgRNA
  Olfr130
ggcagcgcgggtgtg

SEQ ID NO: 25957 - DNA, 15 bp, Artificial Sequence
  dgRNA
  Zfp661
agtgcaaccttgtgc

SEQ ID NO: 25958 - DNA, 15 bp, Artificial Sequence
  dgRNA
  Zfp661
ttacccgtcatctca

SEQ ID NO: 25959 - DNA, 15 bp, Artificial Sequence
  dgRNA
  Zfp661
catctcacggcgcgc

SEQ ID NO: 25960 - DNA, 15 bp, Artificial Sequence
  dgRNA
  Zfp661
ggctattgatgcttc

SEQ ID NO: 25961 - DNA, 15 bp, Artificial Sequence
  dgRNA
  Zmiz2
tttcactttcagcga

SEQ ID NO: 25962 - DNA, 15 bp, Artificial Sequence
  dgRNA
  Zmiz2
ttcactttcagcgat

SEQ ID NO: 25963 - DNA, 15 bp, Artificial Sequence
  dgRNA
  Zmiz2
ccatgaaagactcga

SEQ ID NO: 25964 - DNA, 15 bp, Artificial Sequence
  dgRNA
  Zmiz2
ctcgaaggttccaga

SEQ ID NO: 25965 - DNA, 15 bp, Artificial Sequence
  dgRNA
  Olfr711
atagacaatggttac

SEQ ID NO: 25966 - DNA, 15 bp, Artificial Sequence
  dgRNA
  Olfr711
aagcgagctggtctg

SEQ ID NO: 25967 - DNA, 15 bp, Artificial Sequence
  dgRNA
  Olfr711
tgtgagaaagcgagc

SEQ ID NO: 25968 - DNA, 15 bp, Artificial Sequence
  dgRNA
  Olfr983
ctaagctgtacatgc

SEQ ID NO: 25969 - DNA, 15 bp, Artificial Sequence
  dgRNA
  Olfr983
gtttcgagaaaaccc

SEQ ID NO: 25970 - DNA, 15 bp, Artificial Sequence
  dgRNA
  Olfr983
tttcgagaaaaccct

SEQ ID NO: 25971 - DNA, 15 bp, Artificial Sequence
  dgRNA
  Olfr983
ttcgagaaaaccctg

SEQ ID NO: 25972 - DNA, 15 bp, Artificial Sequence
  dgRNA
  Ccr6
agagtagccccgcag

SEQ ID NO: 25973 - DNA, 15 bp, Artificial Sequence
  dgRNA
  Ccr6
gagtagccccgcaga

SEQ ID NO: 25974 - DNA, 15 bp, Artificial Sequence
  dgRNA
  Ccr6
agtagccccgcagag

SEQ ID NO: 25975 - DNA, 15 bp, Artificial Sequence
  dgRNA
  Ccr6
aaaacaaacgcactc

SEQ ID NO: 25976 - DNA, 15 bp, Artificial Sequence
  dgRNA
  Ttc34
gccggggacgtggcg

SEQ ID NO: 25977 - DNA, 15 bp, Artificial Sequence
  dgRNA
  Ttc34
ccggggacgtggcgg

SEQ ID NO: 25978 - DNA, 15 bp, Artificial Sequence
  dgRNA
  Ttc34
cgcctcctccgtccc

SEQ ID NO: 25979 - DNA, 15 bp, Artificial Sequence
  dgRNA
  Ttc34
tccgtcccaggcgtc

SEQ ID NO: 25980 - DNA, 15 bp, Artificial Sequence
  dgRNA
  Stk32c
cgccccacaacctgg

SEQ ID NO: 25981 - DNA, 15 bp, Artificial Sequence
  dgRNA
  Stk32c
agtgcagccggctag

SEQ ID NO: 25982 - DNA, 15 bp, Artificial Sequence
  dgRNA
  Stk32c
tccgccctgacacgt

SEQ ID NO: 25983 - DNA, 15 bp, Artificial Sequence
  dgRNA
  Stk32c
agtagacgctgggtt

SEQ ID NO: 25984 - DNA, 15 bp, Artificial Sequence
  dgRNA
  Akt1
gctctggatctgcgg

SEQ ID NO: 25985 - DNA, 15 bp, Artificial Sequence
  dgRNA
  Akt1
tctggatctgcggcg

SEQ ID NO: 25986 - DNA, 15 bp, Artificial Sequence
  dgRNA
  Akt1
gctccgttacccgcg

SEQ ID NO: 25987 - DNA, 15 bp, Artificial Sequence
  dgRNA
  Akt1
ttacccgcgtggccc

SEQ ID NO: 25988 - DNA, 15 bp, Artificial Sequence
  dgRNA
  Nup93
cgacagccccgcctc

SEQ ID NO: 25989 - DNA, 15 bp, Artificial Sequence
  dgRNA
  Nup93
tccataaagttcatt

SEQ ID NO: 25990 - DNA, 15 bp, Artificial Sequence
  dgRNA
  Nup93
ggcggcgcaacgcgc

SEQ ID NO: 25991 - DNA, 15 bp, Artificial Sequence
  dgRNA
  Nup93
gcggcgcaacgcgca

SEQ ID NO: 25992 - DNA, 15 bp, Artificial Sequence
  dgRNA
  Olfr980
tagaattacatatca

SEQ ID NO: 25993 - DNA, 15 bp, Artificial Sequence
  dgRNA
  Olfr980
aggttttgctcaatt

SEQ ID NO: 25994 - DNA, 15 bp, Artificial Sequence
  dgRNA
  Adgb
tcgctgccagtctcc

SEQ ID NO: 25995 - DNA, 15 bp, Artificial Sequence
  dgRNA
  Adgb
acgctggaagtctcc

SEQ ID NO: 25996 - DNA, 15 bp, Artificial Sequence
  dgRNA
  Adgb
cgctggaagtctcct

SEQ ID NO: 25997 - DNA, 15 bp, Artificial Sequence
  dgRNA
  Adgb
ggggcgcgctctcag

SEQ ID NO: 25998 - DNA, 15 bp, Artificial Sequence
  dgRNA
  Htr1d
tttggcgcaaataga

SEQ ID NO: 25999 - DNA, 15 bp, Artificial Sequence
  dgRNA
  Htr1d
cttagcgcagatccc

SEQ ID NO: 26000 - DNA, 15 bp, Artificial Sequence
  dgRNA
  Asxl2
cctccgtcgtgcgca

SEQ ID NO: 26001 - DNA, 15 bp, Artificial Sequence
  dgRNA
  Asxl2
ctccgtcgtgcgcaa

SEQ ID NO: 26002 - DNA, 15 bp, Artificial Sequence
  dgRNA
  Asxl2
cgcaagggctcgatg

SEQ ID NO: 26003 - DNA, 15 bp, Artificial Sequence
  dgRNA
  Asxl2
agacaccggaagtgc

SEQ ID NO: 26004 - DNA, 15 bp, Artificial Sequence
  dgRNA
  Pcdh7
gccgttaggagtgcc

SEQ ID NO: 26005 - DNA, 15 bp, Artificial Sequence
  dgRNA
  Pcdh7
gtcgtgagctttcac

SEQ ID NO: 26006 - DNA, 15 bp, Artificial Sequence
  dgRNA
  Pcdh7
tcgtgagctttcacc

SEQ ID NO: 26007 - DNA, 15 bp, Artificial Sequence
  dgRNA
  Pcdh7
cgggccagtgtcgcg

SEQ ID NO: 26008 - DNA, 15 bp, Artificial Sequence
  dgRNA
  Zbed6
gcggccccggcctgc

SEQ ID NO: 26009 - DNA, 15 bp, Artificial Sequence
  dgRNA
  Zbed6
cggccccggcctgct

SEQ ID NO: 26010 - DNA, 15 bp, Artificial Sequence
  dgRNA
  Zbed6
ccggtgttcccgaac

SEQ ID NO: 26011 - DNA, 15 bp, Artificial Sequence
  dgRNA
  Zbed6
cggtgttcccgaacc

SEQ ID NO: 26012 - DNA, 15 bp, Artificial Sequence
  dgRNA
  Creb5
agcgctgagctaaaa

SEQ ID NO: 26013 - DNA, 15 bp, Artificial Sequence
  dgRNA
  Creb5
gcagggcgctaaaga

SEQ ID NO: 26014 - DNA, 15 bp, Artificial Sequence
  dgRNA
  Creb5
cagggcgctaaagaa

SEQ ID NO: 26015 - DNA, 15 bp, Artificial Sequence
  dgRNA
  Creb5
gtcactatttaaatc

SEQ ID NO: 26016 - DNA, 15 bp, Artificial Sequence
  dgRNA
  Ube3c
ggcatgacgcacgcg

SEQ ID NO: 26017 - DNA, 15 bp, Artificial Sequence
  dgRNA
  Ube3c
tgacgcacgcgcgga

SEQ ID NO: 26018 - DNA, 15 bp, Artificial Sequence
  dgRNA
  Ube3c
aggatgttgcacccg

SEQ ID NO: 26019 - DNA, 15 bp, Artificial Sequence
  dgRNA
  Ube3c
cggagccgcgcacgc

SEQ ID NO: 26020 - DNA, 15 bp, Artificial Sequence
  dgRNA
  Larp4b
acagatgccgcgaga

SEQ ID NO: 26021 - DNA, 15 bp, Artificial Sequence
  dgRNA
  Larp4b
cagatgccgcgagat

SEQ ID NO: 26022 - DNA, 15 bp, Artificial Sequence
  dgRNA
  Larp4b
tgggtgcgcgccgag

SEQ ID NO: 26023 - DNA, 15 bp, Artificial Sequence
  dgRNA
  Larp4b
gcgcgccgagaggcc

SEQ ID NO: 26024 - DNA, 15 bp, Artificial Sequence
  dgRNA
  Hat1
gggcatcctcacgtg

SEQ ID NO: 26025 - DNA, 15 bp, Artificial Sequence
  dgRNA
  Hat1
catcctcacgtgcgg

SEQ ID NO: 26026 - DNA, 15 bp, Artificial Sequence
  dgRNA
  Hat1
tcacgtgcggtggct

SEQ ID NO: 26027 - DNA, 15 bp, Artificial Sequence
  dgRNA
  Hat1
gtggctaggcaaccg

SEQ ID NO: 26028 - DNA, 15 bp, Artificial Sequence
  dgRNA
  Hist1h1b
aaccttgagtcgccg

SEQ ID NO: 26029 - DNA, 15 bp, Artificial Sequence
  dgRNA
  Hist1h1b
accttgagtcgccgc

SEQ ID NO: 26030 - DNA, 15 bp, Artificial Sequence
  dgRNA
  Hist1h1b
agtcgccgcgggcag

SEQ ID NO: 26031 - DNA, 15 bp, Artificial Sequence
  dgRNA
  Hist1h1b
gtcgccgcgggcaga

SEQ ID NO: 26032 - DNA, 15 bp, Artificial Sequence
  dgRNA
  Ccnb2
gcctggtggcctcgc

SEQ ID NO: 26033 - DNA, 15 bp, Artificial Sequence
  dgRNA
  Ccnb2
aatcaacgtgcagaa

SEQ ID NO: 26034 - DNA, 15 bp, Artificial Sequence
  dgRNA
  Ccnb2
ccaatagtgcgtcag

SEQ ID NO: 26035 - DNA, 15 bp, Artificial Sequence
  dgRNA
  Ccnb2
accagcgaggccacc

SEQ ID NO: 26036 - DNA, 15 bp, Artificial Sequence
  dgRNA
  Zscan21
aaacagatcacaacc

SEQ ID NO: 26037 - DNA, 15 bp, Artificial Sequence
  dgRNA
  Zscan21
gacagtcgcagcctc

SEQ ID NO: 26038 - DNA, 15 bp, Artificial Sequence
  dgRNA
  Zscan21
agcctccggtgaaac

SEQ ID NO: 26039 - DNA, 15 bp, Artificial Sequence
  dgRNA
  Zscan21
gataccgacaacgct

SEQ ID NO: 26040 - DNA, 15 bp, Artificial Sequence
  dgRNA
  Ttc39c
aaacatttagctacg

SEQ ID NO: 26041 - DNA, 15 bp, Artificial Sequence
  dgRNA
  Ttc39c
tagctacgtggcata

SEQ ID NO: 26042 - DNA, 15 bp, Artificial Sequence
  dgRNA
  Ttc39c
cctagcaagcggtcc

SEQ ID NO: 26043 - DNA, 15 bp, Artificial Sequence
  dgRNA
  Ttc39c
aagcggtccaggttc

SEQ ID NO: 26044 - DNA, 15 bp, Artificial Sequence
  dgRNA
  Myrfl
ttacatgtatcacca

SEQ ID NO: 26045 - DNA, 15 bp, Artificial Sequence
  dgRNA
  Myrfl
gcaaatctatctctc

SEQ ID NO: 26046 - DNA, 15 bp, Artificial Sequence
  dgRNA
  Myrfl
cgaagagggaagtaa

SEQ ID NO: 26047 - DNA, 15 bp, Artificial Sequence
  dgRNA
  Atp6v1f
gtctctaataacact

SEQ ID NO: 26048 - DNA, 15 bp, Artificial Sequence
  dgRNA
  Atp6v1f
aacactaggttcaaa

SEQ ID NO: 26049 - DNA, 15 bp, Artificial Sequence
  dgRNA
  Atp6v1f
tgacgctcagccttc

SEQ ID NO: 26050 - DNA, 15 bp, Artificial Sequence
  dgRNA
  Atp6v1f
gacgctcagccttct

SEQ ID NO: 26051 - DNA, 15 bp, Artificial Sequence
  dgRNA
  Olfr632
aaccgatgggtaaat

SEQ ID NO: 26052 - DNA, 15 bp, Artificial Sequence
  dgRNA
  Olfr632
gagtagttatttaag

SEQ ID NO: 26053 - DNA, 15 bp, Artificial Sequence
  dgRNA
  Olfr632
tttccagagtgtatc

SEQ ID NO: 26054 - DNA, 15 bp, Artificial Sequence
  dgRNA
  Olfr632
ttcctatttacccat

SEQ ID NO: 26055 - DNA, 15 bp, Artificial Sequence
  dgRNA
  Olfr804
tatatacctacacta

SEQ ID NO: 26056 - DNA, 15 bp, Artificial Sequence
  dgRNA
  Psip1
ccgcgtgcctctctc

SEQ ID NO: 26057 - DNA, 15 bp, Artificial Sequence
  dgRNA
  Psip1
cgcgtgcctctctcc

SEQ ID NO: 26058 - DNA, 15 bp, Artificial Sequence
  dgRNA
  Psip1
gcatctgcttgcaat

SEQ ID NO: 26059 - DNA, 15 bp, Artificial Sequence
  dgRNA
  Psip1
caattggtcgcaacc

SEQ ID NO: 26060 - DNA, 15 bp, Artificial Sequence
  dgRNA
  Gm14124
aaccactaggtacat

SEQ ID NO: 26061 - DNA, 15 bp, Artificial Sequence
  dgRNA
  Gm14124
ccgggcctgccaatc

SEQ ID NO: 26062 - DNA, 15 bp, Artificial Sequence
  dgRNA
  Gm14124
taccaatgtacctag

SEQ ID NO: 26063 - DNA, 15 bp, Artificial Sequence
  dgRNA
  Gm14124
attggcaggcccggc

SEQ ID NO: 26064 - DNA, 15 bp, Artificial Sequence
  dgRNA
  Pcgf2
acctattgaggtcca

SEQ ID NO: 26065 - DNA, 15 bp, Artificial Sequence
  dgRNA
  Pcgf2
ggtccacggttcttg

SEQ ID NO: 26066 - DNA, 15 bp, Artificial Sequence
  dgRNA
  Pcgf2
atcgattcgcttcct

SEQ ID NO: 26067 - DNA, 15 bp, Artificial Sequence
  dgRNA
  Pcgf2
ttcctactctgcccg

SEQ ID NO: 26068 - DNA, 15 bp, Artificial Sequence
  dgRNA
  Agbl5
ggggtcccggcaccg

SEQ ID NO: 26069 - DNA, 15 bp, Artificial Sequence
  dgRNA
  Agbl5
ggcaccgcggctctc

SEQ ID NO: 26070 - DNA, 15 bp, Artificial Sequence
  dgRNA
  Agbl5
gagagccgcggtgcc

SEQ ID NO: 26071 - DNA, 15 bp, Artificial Sequence
  dgRNA
  Agbl5
agagagccgcggtgc

SEQ ID NO: 26072 - DNA, 15 bp, Artificial Sequence
  dgRNA
  Dlg4
tcaccgaggttagcc

SEQ ID NO: 26073 - DNA, 15 bp, Artificial Sequence
  dgRNA
  Dlg4
ctccatgtttgccgt

SEQ ID NO: 26074 - DNA, 15 bp, Artificial Sequence
  dgRNA
  Dlg4
tccatgtttgccgta

SEQ ID NO: 26075 - DNA, 15 bp, Artificial Sequence
  dgRNA
  Dlg4
gcaccccccccattc

SEQ ID NO: 26076 - DNA, 15 bp, Artificial Sequence
  dgRNA
  Scn10a
tcagagtgtactttc

SEQ ID NO: 26077 - DNA, 15 bp, Artificial Sequence
  dgRNA
  Scn10a
gggtggaactcgtga

SEQ ID NO: 26078 - DNA, 15 bp, Artificial Sequence
  dgRNA
  Scn10a
actcgtgacgggaaa

SEQ ID NO: 26079 - DNA, 15 bp, Artificial Sequence
  dgRNA
  Scn10a
ctcgtgacgggaaat

SEQ ID NO: 26080 - DNA, 15 bp, Artificial Sequence
  dgRNA
  Tpd52l2
gatttgtcttaggtg

SEQ ID NO: 26081 - DNA, 15 bp, Artificial Sequence
  dgRNA
  Tpd52l2
agaagacgttcttat

SEQ ID NO: 26082 - DNA, 15 bp, Artificial Sequence
  dgRNA
  Tpd52l2
gacactacttcaccg

SEQ ID NO: 26083 - DNA, 15 bp, Artificial Sequence
  dgRNA
  Tpd52l2
acactacttcaccga

SEQ ID NO: 26084 - DNA, 15 bp, Artificial Sequence
  dgRNA
  Fam90a1a
gggggatattctctt

SEQ ID NO: 26085 - DNA, 15 bp, Artificial Sequence
  dgRNA
  Fam90a1a
ggggatattctcttg

SEQ ID NO: 26086 - DNA, 15 bp, Artificial Sequence
  dgRNA
  Fam90a1a
tcaggtgttcttaat

SEQ ID NO: 26087 - DNA, 15 bp, Artificial Sequence
  dgRNA
  Fam90a1a
gaacacctgatctta

SEQ ID NO: 26088 - DNA, 15 bp, Artificial Sequence
  dgRNA
  Fut1
agcgccccatccacc

SEQ ID NO: 26089 - DNA, 15 bp, Artificial Sequence
  dgRNA
  Fut1
gcgccccatccacct

SEQ ID NO: 26090 - DNA, 15 bp, Artificial Sequence
  dgRNA
  Fut1
catccacctgggcgg

SEQ ID NO: 26091 - DNA, 15 bp, Artificial Sequence
  dgRNA
  Fut1
agagggcgcagcgcc

SEQ ID NO: 26092 - DNA, 15 bp, Artificial Sequence
  dgRNA
  Tpra1
ttcccgaaacgcttt

SEQ ID NO: 26093 - DNA, 15 bp, Artificial Sequence
  dgRNA
  Tpra1
tcccgaaacgcttta

SEQ ID NO: 26094 - DNA, 15 bp, Artificial Sequence
  dgRNA
  Tpra1
cccgaaacgctttag

SEQ ID NO: 26095 - DNA, 15 bp, Artificial Sequence
  dgRNA
  Tpra1
cctttaagagctccg

SEQ ID NO: 26096 - DNA, 15 bp, Artificial Sequence
  dgRNA
  Zgpat
gtgtaccgggggcat

SEQ ID NO: 26097 - DNA, 15 bp, Artificial Sequence
  dgRNA
  Zgpat
tgcccgcttcatcag

SEQ ID NO: 26098 - DNA, 15 bp, Artificial Sequence
  dgRNA
  Zgpat
accacgtgctagacc

SEQ ID NO: 26099 - DNA, 15 bp, Artificial Sequence
  dgRNA
  Zgpat
ccacgtgctagacct

SEQ ID NO: 26100 - DNA, 15 bp, Artificial Sequence
  dgRNA
  Il13
tcctttagcggccac

SEQ ID NO: 26101 - DNA, 15 bp, Artificial Sequence
  dgRNA
  Il13
tgcttcaacaggcta

SEQ ID NO: 26102 - DNA, 15 bp, Artificial Sequence
  dgRNA
  Il13
ttattgagaagggtc

SEQ ID NO: 26103 - DNA, 15 bp, Artificial Sequence
  dgRNA
  Il13
tccagtggccgctaa

SEQ ID NO: 26104 - DNA, 15 bp, Artificial Sequence
  dgRNA
  Srd5a2
accagacgggagaaa

SEQ ID NO: 26105 - DNA, 15 bp, Artificial Sequence
  dgRNA
  Srd5a2
ccagacgggagaaat

SEQ ID NO: 26106 - DNA, 15 bp, Artificial Sequence
  dgRNA
  Srd5a2
gggcgggctgcgcca

SEQ ID NO: 26107 - DNA, 15 bp, Artificial Sequence
  dgRNA
  Srd5a2
cgggctgcgccaagg

SEQ ID NO: 26108 - DNA, 15 bp, Artificial Sequence
  dgRNA
  Mturn
ccctcgcgtttatag

SEQ ID NO: 26109 - DNA, 15 bp, Artificial Sequence
  dgRNA
  Mturn
aactggctccaaacc

SEQ ID NO: 26110 - DNA, 15 bp, Artificial Sequence
  dgRNA
  Mturn
tccaaaccaggggtc

SEQ ID NO: 26111 - DNA, 15 bp, Artificial Sequence
  dgRNA
  Mturn
ccgctataaacgcga

SEQ ID NO: 26112 - DNA, 15 bp, Artificial Sequence
  dgRNA
  Il20
gtgctggcatattcc

SEQ ID NO: 26113 - DNA, 15 bp, Artificial Sequence
  dgRNA
  Il20
ctggcatattcctgg

SEQ ID NO: 26114 - DNA, 15 bp, Artificial Sequence
  dgRNA
  Il20
ttgaattttcgcttc

SEQ ID NO: 26115 - DNA, 15 bp, Artificial Sequence
  dgRNA
  Il20
tcccatctagccacc

SEQ ID NO: 26116 - DNA, 15 bp, Artificial Sequence
  dgRNA
  Abcd4
ctcggaactaccagt

SEQ ID NO: 26117 - DNA, 15 bp, Artificial Sequence
  dgRNA
  Abcd4
ccacaggggacgctc

SEQ ID NO: 26118 - DNA, 15 bp, Artificial Sequence
  dgRNA
  Abcd4
aaaggctgcgcttcc

SEQ ID NO: 26119 - DNA, 15 bp, Artificial Sequence
  dgRNA
  Abcd4
ctgcgcttccgggaa

SEQ ID NO: 26120 - DNA, 15 bp, Artificial Sequence
  dgRNA
  Gfra4
tttggatccacctga

SEQ ID NO: 26121 - DNA, 15 bp, Artificial Sequence
  dgRNA
  Gfra4
gaaggtgctgtccgg

SEQ ID NO: 26122 - DNA, 15 bp, Artificial Sequence
  dgRNA
  Gfra4
ggtgctgtccggggg

SEQ ID NO: 26123 - DNA, 15 bp, Artificial Sequence
  dgRNA
  Gfra4
agtgcacctgtcagc

SEQ ID NO: 26124 - DNA, 15 bp, Artificial Sequence
  dgRNA
  Lsm10
ctcagcaggacatta

SEQ ID NO: 26125 - DNA, 15 bp, Artificial Sequence
  dgRNA
  Lsm10
agccggagcctacaa

SEQ ID NO: 26126 - DNA, 15 bp, Artificial Sequence
  dgRNA
  Lsm10
cggagcctacaaagg

SEQ ID NO: 26127 - DNA, 15 bp, Artificial Sequence
  dgRNA
  Lsm10
ggagcctacaaaggt

SEQ ID NO: 26128 - DNA, 15 bp, Artificial Sequence
  dgRNA
  Actr5
gagattagcttaaca

SEQ ID NO: 26129 - DNA, 15 bp, Artificial Sequence
  dgRNA
  Actr5
acggtcacaaaacta

SEQ ID NO: 26130 - DNA, 15 bp, Artificial Sequence
  dgRNA
  Actr5
cggtcacaaaactaa

SEQ ID NO: 26131 - DNA, 15 bp, Artificial Sequence
  dgRNA
  Actr5
agggctagatctgca

SEQ ID NO: 26132 - DNA, 15 bp, Artificial Sequence
  dgRNA
  Cers1
catcttgaccgcaga

SEQ ID NO: 26133 - DNA, 15 bp, Artificial Sequence
  dgRNA
  Cers1
cgcagacttgagtag

SEQ ID NO: 26134 - DNA, 15 bp, Artificial Sequence
  dgRNA
  Cers1
tggtgctctgcataa

SEQ ID NO: 26135 - DNA, 15 bp, Artificial Sequence
  dgRNA
  Cers1
ggtgctctgcataac

SEQ ID NO: 26136 - DNA, 15 bp, Artificial Sequence
  dgRNA
  Atg4a
tcgcatttcctgttc

SEQ ID NO: 26137 - DNA, 15 bp, Artificial Sequence
  dgRNA
  Atg4a
gccccgcccatagcc

SEQ ID NO: 26138 - DNA, 15 bp, Artificial Sequence
  dgRNA
  Atg4a
gcctggaggcgtctt

SEQ ID NO: 26139 - DNA, 15 bp, Artificial Sequence
  dgRNA
  Atg4a
gaagtcactcagttc

SEQ ID NO: 26140 - DNA, 15 bp, Artificial Sequence
  dgRNA
  Hist1h2aa
ttggacagtaagtgc

SEQ ID NO: 26141 - DNA, 15 bp, Artificial Sequence
  dgRNA
  Hist1h2aa
cattagactataaat

SEQ ID NO: 26142 - DNA, 15 bp, Artificial Sequence
  dgRNA
  Hist1h2aa
gactataaataggcg

SEQ ID NO: 26143 - DNA, 15 bp, Artificial Sequence
  dgRNA
  Hist1h2aa
aaataggcgtggtca

SEQ ID NO: 26144 - DNA, 15 bp, Artificial Sequence
  dgRNA
  Cmtm3
tggactacatctgag

SEQ ID NO: 26145 - DNA, 15 bp, Artificial Sequence
  dgRNA
  Cmtm3
gcaggacgtaggcag

SEQ ID NO: 26146 - DNA, 15 bp, Artificial Sequence
  dgRNA
  Cmtm3
atccacaggacggat

SEQ ID NO: 26147 - DNA, 15 bp, Artificial Sequence
  dgRNA
  Cmtm3
caggacggatgggta

SEQ ID NO: 26148 - DNA, 15 bp, Artificial Sequence
  dgRNA
  Tbc1d20
agcaaaactacgacc

SEQ ID NO: 26149 - DNA, 15 bp, Artificial Sequence
  dgRNA
  Tbc1d20
gcatgcgcgtacaag

SEQ ID NO: 26150 - DNA, 15 bp, Artificial Sequence
  dgRNA
  Tbc1d20
ccaaccccgaaacgt

SEQ ID NO: 26151 - DNA, 15 bp, Artificial Sequence
  dgRNA
  Tbc1d20
acgcgcatgcgtgcc

SEQ ID NO: 26152 - DNA, 15 bp, Artificial Sequence
  dgRNA
  Aar2
cgttatttataattc

SEQ ID NO: 26153 - DNA, 15 bp, Artificial Sequence
  dgRNA
  Aar2
gaagtgcttatcgtg

SEQ ID NO: 26154 - DNA, 15 bp, Artificial Sequence
  dgRNA
  Aar2
ttatcgtgaggaacc

SEQ ID NO: 26155 - DNA, 15 bp, Artificial Sequence
  dgRNA
  Aar2
gactcggggctccgc

SEQ ID NO: 26156 - DNA, 15 bp, Artificial Sequence
  dgRNA
  Gm11937
caatgcccttctaga

SEQ ID NO: 26157 - DNA, 15 bp, Artificial Sequence
  dgRNA
  Gm11937
aatgcccttctagaa

SEQ ID NO: 26158 - DNA, 15 bp, Artificial Sequence
  dgRNA
  Gm11937
aattgtcctcagtcc

SEQ ID NO: 26159 - DNA, 15 bp, Artificial Sequence
  dgRNA
  Gm11937
tgcccaggtatataa

SEQ ID NO: 26160 - DNA, 15 bp, Artificial Sequence
  dgRNA
  Ccdc65
ctgactgcggtcctc

SEQ ID NO: 26161 - DNA, 15 bp, Artificial Sequence
  dgRNA
  Ccdc65
ggtcctccggcatgc

SEQ ID NO: 26162 - DNA, 15 bp, Artificial Sequence
  dgRNA
  Ccdc65
gtcctccggcatgca

SEQ ID NO: 26163 - DNA, 15 bp, Artificial Sequence
  dgRNA
  Ccdc65
tcctccggcatgcag

SEQ ID NO: 26164 - DNA, 15 bp, Artificial Sequence
  dgRNA
  Ccdc38
caaacttgcgctgac

SEQ ID NO: 26165 - DNA, 15 bp, Artificial Sequence
  dgRNA
  Ccdc38
gcgctgacaggcgac

SEQ ID NO: 26166 - DNA, 15 bp, Artificial Sequence
  dgRNA
  Ccdc38
cgctgacaggcgaca

SEQ ID NO: 26167 - DNA, 15 bp, Artificial Sequence
  dgRNA
  Ccdc38
gctgacaggcgacag

SEQ ID NO: 26168 - DNA, 15 bp, Artificial Sequence
  dgRNA
  Zfp954
ttggtcttgtcaagc

SEQ ID NO: 26169 - DNA, 15 bp, Artificial Sequence
  dgRNA
  Zfp954
gacggcgagaaccgt

SEQ ID NO: 26170 - DNA, 15 bp, Artificial Sequence
  dgRNA
  Zfp954
acggcgagaaccgtt

SEQ ID NO: 26171 - DNA, 15 bp, Artificial Sequence
  dgRNA
  Zfp954
gcgagaaccgttggg

SEQ ID NO: 26172 - DNA, 15 bp, Artificial Sequence
  dgRNA
  Tars2
ggaagaagcggtgat

SEQ ID NO: 26173 - DNA, 15 bp, Artificial Sequence
  dgRNA
  Scoc
aaaagatgctcagcg

SEQ ID NO: 26174 - DNA, 15 bp, Artificial Sequence
  dgRNA
  Scoc
gaggaccgctttctt

SEQ ID NO: 26175 - DNA, 15 bp, Artificial Sequence
  dgRNA
  Scoc
cttctgcgccgtgat

SEQ ID NO: 26176 - DNA, 15 bp, Artificial Sequence
  dgRNA
  Scoc
ggtcgctgctttttt

SEQ ID NO: 26177 - DNA, 15 bp, Artificial Sequence
  dgRNA
  Klrd1
agcaggaagctacgg

SEQ ID NO: 26178 - DNA, 15 bp, Artificial Sequence
  dgRNA
  Klrd1
acggtgtggaccaca

SEQ ID NO: 26179 - DNA, 15 bp, Artificial Sequence
  dgRNA
  Klrd1
aacggtgtggaccac

SEQ ID NO: 26180 - DNA, 15 bp, Artificial Sequence
  dgRNA
  Sfta2
ctcaagaacctctaa

SEQ ID NO: 26181 - DNA, 15 bp, Artificial Sequence
  dgRNA
  Sfta2
ccagatacctgcagg

SEQ ID NO: 26182 - DNA, 15 bp, Artificial Sequence
  dgRNA
  Sfta2
ccctccaaattgccc

SEQ ID NO: 26183 - DNA, 15 bp, Artificial Sequence
  dgRNA
  Sfta2
gtgatcattcctgac

SEQ ID NO: 26184 - DNA, 15 bp, Artificial Sequence
  dgRNA
  Olfr243
aattagactggcagc

SEQ ID NO: 26185 - DNA, 15 bp, Artificial Sequence
  dgRNA
  Olfr243
gcttctcaattagac

SEQ ID NO: 26186 - DNA, 15 bp, Artificial Sequence
  dgRNA
  Olfr243
cagcctgtagacata

SEQ ID NO: 26187 - DNA, 15 bp, Artificial Sequence
  dgRNA
  Stap2
ctactgtgatttccc

SEQ ID NO: 26188 - DNA, 15 bp, Artificial Sequence
  dgRNA
  Stap2
gccgtgctccctaac

SEQ ID NO: 26189 - DNA, 15 bp, Artificial Sequence
  dgRNA
  Stap2
taccgggatttccgc

SEQ ID NO: 26190 - DNA, 15 bp, Artificial Sequence
  dgRNA
  Stap2
cataattgcaagatc

SEQ ID NO: 26191 - DNA, 15 bp, Artificial Sequence
  dgRNA
  Ptchd2
gacagcagcgcgcgg

SEQ ID NO: 26192 - DNA, 15 bp, Artificial Sequence
  dgRNA
  Ptchd2
caagcctaagccgga

SEQ ID NO: 26193 - DNA, 15 bp, Artificial Sequence
  dgRNA
  Ptchd2
tgacgcagagcccgc

SEQ ID NO: 26194 - DNA, 15 bp, Artificial Sequence
  dgRNA
  Ptchd2
cgcaggcgctgatgc

SEQ ID NO: 26195 - DNA, 15 bp, Artificial Sequence
  dgRNA
  4930415F15Rik
tgtcatgtgaactat

SEQ ID NO: 26196 - DNA, 15 bp, Artificial Sequence
  dgRNA
  4930415F15Rik
aatccttactgtatc

SEQ ID NO: 26197 - DNA, 15 bp, Artificial Sequence
  dgRNA
  4930415F15Rik
accttctctagacta

SEQ ID NO: 26198 - DNA, 15 bp, Artificial Sequence
  dgRNA
  4930415F15Rik
tttaatagtcagcag

SEQ ID NO: 26199 - DNA, 15 bp, Artificial Sequence
  dgRNA
  Kiss1r
cctggtctccccgct

SEQ ID NO: 26200 - DNA, 15 bp, Artificial Sequence
  dgRNA
  Kiss1r
tggtctccccgctcg

SEQ ID NO: 26201 - DNA, 15 bp, Artificial Sequence
  dgRNA
  Kiss1r
gctcggggtagcctc

SEQ ID NO: 26202 - DNA, 15 bp, Artificial Sequence
  dgRNA
  Kiss1r
ctcggggtagcctcc

SEQ ID NO: 26203 - DNA, 15 bp, Artificial Sequence
  dgRNA
  Alg5
ttgacttgccgcact

SEQ ID NO: 26204 - DNA, 15 bp, Artificial Sequence
  dgRNA
  Alg5
gccgcactcggtgac

SEQ ID NO: 26205 - DNA, 15 bp, Artificial Sequence
  dgRNA
  Alg5
gcctgcagtcctcgg

SEQ ID NO: 26206 - DNA, 15 bp, Artificial Sequence
  dgRNA
  Alg5
ctcggcggagccgcg

SEQ ID NO: 26207 - DNA, 15 bp, Artificial Sequence
  dgRNA
  Pkd1l2
gctttgaacaattgc

SEQ ID NO: 26208 - DNA, 15 bp, Artificial Sequence
  dgRNA
  Pkd1l2
ctttgaacaattgcc

SEQ ID NO: 26209 - DNA, 15 bp, Artificial Sequence
  dgRNA
  Pkd1l2
tatttggtgcaaaat

SEQ ID NO: 26210 - DNA, 15 bp, Artificial Sequence
  dgRNA
  Pkd1l2
ggtgcaaaattggaa

SEQ ID NO: 26211 - DNA, 15 bp, Artificial Sequence
  dgRNA
  Dlat
gcattactgtcagcc

SEQ ID NO: 26212 - DNA, 15 bp, Artificial Sequence
  dgRNA
  Dlat
cattactgtcagccc

SEQ ID NO: 26213 - DNA, 15 bp, Artificial Sequence
  dgRNA
  Dlat
ggcggtcgttccctt

SEQ ID NO: 26214 - DNA, 15 bp, Artificial Sequence
  dgRNA
  Dlat
agccggtccgactct

SEQ ID NO: 26215 - DNA, 15 bp, Artificial Sequence
  dgRNA
  Olfr518
ctccaaattgacaat

SEQ ID NO: 26216 - DNA, 15 bp, Artificial Sequence
  dgRNA
  Olfr518
ggggtgaatgcaggc

SEQ ID NO: 26217 - DNA, 15 bp, Artificial Sequence
  dgRNA
  Olfr518
gcagactataacaaa

SEQ ID NO: 26218 - DNA, 15 bp, Artificial Sequence
  dgRNA
  Olfr518
gcctgcattcacccc

SEQ ID NO: 26219 - DNA, 15 bp, Artificial Sequence
  dgRNA
  Brca2
agcgcgggcttttcg

SEQ ID NO: 26220 - DNA, 15 bp, Artificial Sequence
  dgRNA
  Brca2
gcgcgggcttttcgc

SEQ ID NO: 26221 - DNA, 15 bp, Artificial Sequence
  dgRNA
  Brca2
ggcttttcgcgggag

SEQ ID NO: 26222 - DNA, 15 bp, Artificial Sequence
  dgRNA
  Brca2
gcttttcgcgggagc

SEQ ID NO: 26223 - DNA, 15 bp, Artificial Sequence
  dgRNA
  Mill2
tcgtcacttagctga

SEQ ID NO: 26224 - DNA, 15 bp, Artificial Sequence
  dgRNA
  Mill2
cgtcacttagctgat

SEQ ID NO: 26225 - DNA, 15 bp, Artificial Sequence
  dgRNA
  Mill2
cacttagctgatggg

SEQ ID NO: 26226 - DNA, 15 bp, Artificial Sequence
  dgRNA
  Mill2
acgagaacacagtcc

SEQ ID NO: 26227 - DNA, 15 bp, Artificial Sequence
  dgRNA
  Bcl11a
tcgacgaaagctgga

SEQ ID NO: 26228 - DNA, 15 bp, Artificial Sequence
  dgRNA
  Bcl11a
ttctgcatttgtcga

SEQ ID NO: 26229 - DNA, 15 bp, Artificial Sequence
  dgRNA
  Bcl11a
tgcatttgtcgaggg

SEQ ID NO: 26230 - DNA, 15 bp, Artificial Sequence
  dgRNA
  Bcl11a
gcatttgtcgaggga

SEQ ID NO: 26231 - DNA, 15 bp, Artificial Sequence
  dgRNA
  Cadps2
gcaaactgcgcgctc

SEQ ID NO: 26232 - DNA, 15 bp, Artificial Sequence
  dgRNA
  Cadps2
caaactgcgcgctcc

SEQ ID NO: 26233 - DNA, 15 bp, Artificial Sequence
  dgRNA
  Cadps2
aaactgcgcgctccg

SEQ ID NO: 26234 - DNA, 15 bp, Artificial Sequence
  dgRNA
  Cadps2
gcgctccggggcgcc

SEQ ID NO: 26235 - DNA, 15 bp, Artificial Sequence
  dgRNA
  Scgb2b20
aggtatgtttgcgga

SEQ ID NO: 26236 - DNA, 15 bp, Artificial Sequence
  dgRNA
  Scgb2b20
ggtatgtttgcggat

SEQ ID NO: 26237 - DNA, 15 bp, Artificial Sequence
  dgRNA
  Scgb2b20
gacgtcatcagtttc

SEQ ID NO: 26238 - DNA, 15 bp, Artificial Sequence
  dgRNA
  Scgb2b20
cgcaaacataccttc

SEQ ID NO: 26239 - DNA, 15 bp, Artificial Sequence
  dgRNA
  Nov
ggaagtagcggtgtc

SEQ ID NO: 26240 - DNA, 15 bp, Artificial Sequence
  dgRNA
  Nov
gaagtagcggtgtca

SEQ ID NO: 26241 - DNA, 15 bp, Artificial Sequence
  dgRNA
  Nov
aagtagcggtgtcag

SEQ ID NO: 26242 - DNA, 15 bp, Artificial Sequence
  dgRNA
  Nov
agtagcggtgtcagg

SEQ ID NO: 26243 - DNA, 15 bp, Artificial Sequence
  dgRNA
  Eya2
gcgctgctgactctc

SEQ ID NO: 26244 - DNA, 15 bp, Artificial Sequence
  dgRNA
  Eya2
cgctgctgactctct

SEQ ID NO: 26245 - DNA, 15 bp, Artificial Sequence
  dgRNA
  Eya2
ctctggggccgcgcc

SEQ ID NO: 26246 - DNA, 15 bp, Artificial Sequence
  dgRNA
  Eya2
ggccgcgcctggcca

SEQ ID NO: 26247 - DNA, 15 bp, Artificial Sequence
  dgRNA
  Ppig
tttgaagcgctttcc

SEQ ID NO: 26248 - DNA, 15 bp, Artificial Sequence
  dgRNA
  Ppig
agcgctttccaggac

SEQ ID NO: 26249 - DNA, 15 bp, Artificial Sequence
  dgRNA
  Ppig
gcgctttccaggacc

SEQ ID NO: 26250 - DNA, 15 bp, Artificial Sequence
  dgRNA
  Ppig
tttccaggaccgggc

SEQ ID NO: 26251 - DNA, 15 bp, Artificial Sequence
  dgRNA
  Samd8
gtttgccccttcaaa

SEQ ID NO: 26252 - DNA, 15 bp, Artificial Sequence
  dgRNA
  Samd8
ttgatgaattatgct

SEQ ID NO: 26253 - DNA, 15 bp, Artificial Sequence
  dgRNA
  Samd8
ctcctcttccggttt

SEQ ID NO: 26254 - DNA, 15 bp, Artificial Sequence
  dgRNA
  Samd8
ttgtgggttgttgac

SEQ ID NO: 26255 - DNA, 15 bp, Artificial Sequence
  dgRNA
  Fbxo18
tggcgaaagcacaga

SEQ ID NO: 26256 - DNA, 15 bp, Artificial Sequence
  dgRNA
  Fbxo18
ggcgaaagcacagac

SEQ ID NO: 26257 - DNA, 15 bp, Artificial Sequence
  dgRNA
  Fbxo18
gcgaaagcacagacg

SEQ ID NO: 26258 - DNA, 15 bp, Artificial Sequence
  dgRNA
  Fbxo18
agcacagacggggcg

SEQ ID NO: 26259 - DNA, 15 bp, Artificial Sequence
  dgRNA
  Sh3d19
acccgcagcctcagc

SEQ ID NO: 26260 - DNA, 15 bp, Artificial Sequence
  dgRNA
  Sh3d19
tcgaagtcagcttac

SEQ ID NO: 26261 - DNA, 15 bp, Artificial Sequence
  dgRNA
  Sh3d19
gattaggtttccatt

SEQ ID NO: 26262 - DNA, 15 bp, Artificial Sequence
  dgRNA
  Sh3d19
gcctgtagtgctgac

SEQ ID NO: 26263 - DNA, 15 bp, Artificial Sequence
  dgRNA
  Tgfb1i1
gactcgctgccgctg

SEQ ID NO: 26264 - DNA, 15 bp, Artificial Sequence
  dgRNA
  Tgfb1i1
ctgccgctgaggcaa

SEQ ID NO: 26265 - DNA, 15 bp, Artificial Sequence
  dgRNA
  Tgfb1i1
gccacaaagctggat

SEQ ID NO: 26266 - DNA, 15 bp, Artificial Sequence
  dgRNA
  Tgfb1i1
cccaatccagctttg

SEQ ID NO: 26267 - DNA, 15 bp, Artificial Sequence
  dgRNA
  Gabra5
tggtctttcccgaag

SEQ ID NO: 26268 - DNA, 15 bp, Artificial Sequence
  dgRNA
  Gabra5
ggtctttcccgaagc

SEQ ID NO: 26269 - DNA, 15 bp, Artificial Sequence
  dgRNA
  Gabra5
ccatgcccgcttcct

SEQ ID NO: 26270 - DNA, 15 bp, Artificial Sequence
  dgRNA
  Gabra5
tcctgggctgagcgg

SEQ ID NO: 26271 - DNA, 15 bp, Artificial Sequence
  dgRNA
  Fam134b
ttccccgtgactcaa

SEQ ID NO: 26272 - DNA, 15 bp, Artificial Sequence
  dgRNA
  Fam134b
cccgtgactcaaagg

SEQ ID NO: 26273 - DNA, 15 bp, Artificial Sequence
  dgRNA
  Fam134b
tcgatagctggagtg

SEQ ID NO: 26274 - DNA, 15 bp, Artificial Sequence
  dgRNA
  Fam134b
gtttcaacctgtccg

SEQ ID NO: 26275 - DNA, 15 bp, Artificial Sequence
  dgRNA
  Tmco6
cgtgcgcttgttgag

SEQ ID NO: 26276 - DNA, 15 bp, Artificial Sequence
  dgRNA
  Tmco6
cgcttgttgagtgga

SEQ ID NO: 26277 - DNA, 15 bp, Artificial Sequence
  dgRNA
  Tmco6
tgacagcgcaggcct

SEQ ID NO: 26278 - DNA, 15 bp, Artificial Sequence
  dgRNA
  Tmco6
gacagcgcaggcctg

SEQ ID NO: 26279 - DNA, 15 bp, Artificial Sequence
  dgRNA
  Tmed6
gcactgcaccaacgg

SEQ ID NO: 26280 - DNA, 15 bp, Artificial Sequence
  dgRNA
  Tmed6
cactgcaccaacgga

SEQ ID NO: 26281 - DNA, 15 bp, Artificial Sequence
  dgRNA
  Tmed6
actgcaccaacggag

SEQ ID NO: 26282 - DNA, 15 bp, Artificial Sequence
  dgRNA
  Tmed6
tgcaccaacggaggg

SEQ ID NO: 26283 - DNA, 15 bp, Artificial Sequence
  dgRNA
  Syncrip
ggacagggcggctag

SEQ ID NO: 26284 - DNA, 15 bp, Artificial Sequence
  dgRNA
  Syncrip
gcggctagcggccgg

SEQ ID NO: 26285 - DNA, 15 bp, Artificial Sequence
  dgRNA
  Syncrip
gctagcggccggcgg

SEQ ID NO: 26286 - DNA, 15 bp, Artificial Sequence
  dgRNA
  Syncrip
ccggcggaggtggcg

SEQ ID NO: 26287 - DNA, 15 bp, Artificial Sequence
  dgRNA
  Dpcd
taggttagaatctcc

SEQ ID NO: 26288 - DNA, 15 bp, Artificial Sequence
  dgRNA
  Dpcd
ccaatgaaaacggat

SEQ ID NO: 26289 - DNA, 15 bp, Artificial Sequence
  dgRNA
  Dpcd
caatgaaaacggatt

SEQ ID NO: 26290 - DNA, 15 bp, Artificial Sequence
  dgRNA
  Dpcd
aatgaaaacggattg

SEQ ID NO: 26291 - DNA, 15 bp, Artificial Sequence
  dgRNA
  Rps6kc1
cgaagctagtgcacc

SEQ ID NO: 26292 - DNA, 15 bp, Artificial Sequence
  dgRNA
  Rps6kc1
accaggagacttagt

SEQ ID NO: 26293 - DNA, 15 bp, Artificial Sequence
  dgRNA
  Rps6kc1
tagtagggacgcctc

SEQ ID NO: 26294 - DNA, 15 bp, Artificial Sequence
  dgRNA
  Rps6kc1
cgcctccggtatcca

SEQ ID NO: 26295 - DNA, 15 bp, Artificial Sequence
  dgRNA
  Fam216a
ttcgcgcgacagcca

SEQ ID NO: 26296 - DNA, 15 bp, Artificial Sequence
  dgRNA
  Fam216a
acagccacggcgttc

SEQ ID NO: 26297 - DNA, 15 bp, Artificial Sequence
  dgRNA
  Fam216a
cagccacggcgttcc

SEQ ID NO: 26298 - DNA, 15 bp, Artificial Sequence
  dgRNA
  Fam216a
agccacggcgttccg

SEQ ID NO: 26299 - DNA, 15 bp, Artificial Sequence
  dgRNA
  Asap1
gccctgaagtgtgcc

SEQ ID NO: 26300 - DNA, 15 bp, Artificial Sequence
  dgRNA
  Asap1
ctgaagtgtgcccgg

SEQ ID NO: 26301 - DNA, 15 bp, Artificial Sequence
  dgRNA
  Asap1
tgaagtgtgcccggc

SEQ ID NO: 26302 - DNA, 15 bp, Artificial Sequence
  dgRNA
  Asap1
tgcccggcgggccaa

SEQ ID NO: 26303 - DNA, 15 bp, Artificial Sequence
  dgRNA
  Hoxb2
atggtatccaggtcg

SEQ ID NO: 26304 - DNA, 15 bp, Artificial Sequence
  dgRNA
  Hoxb2
caggtcgtggtcctc

SEQ ID NO: 26305 - DNA, 15 bp, Artificial Sequence
  dgRNA
  Hoxb2
gcctagactagcgat

SEQ ID NO: 26306 - DNA, 15 bp, Artificial Sequence
  dgRNA
  Hoxb2
tagactagcgattgg

SEQ ID NO: 26307 - DNA, 15 bp, Artificial Sequence
  dgRNA
  Wipi2
gcatgcgcagtcgac

SEQ ID NO: 26308 - DNA, 15 bp, Artificial Sequence
  dgRNA
  Wipi2
gaccggaaacacccg

SEQ ID NO: 26309 - DNA, 15 bp, Artificial Sequence
  dgRNA
  Wipi2
acccgcggatgcctg

SEQ ID NO: 26310 - DNA, 15 bp, Artificial Sequence
  dgRNA
  Wipi2
atgcctgcggcgaag

SEQ ID NO: 26311 - DNA, 15 bp, Artificial Sequence
  dgRNA
  Npepps
cctccatgcccttcg

SEQ ID NO: 26312 - DNA, 15 bp, Artificial Sequence
  dgRNA
  Npepps
ccaccggccgacgac

SEQ ID NO: 26313 - DNA, 15 bp, Artificial Sequence
  dgRNA
  Npepps
cccgttcgccgaccg

SEQ ID NO: 26314 - DNA, 15 bp, Artificial Sequence
  dgRNA
  Npepps
ggcgcgcgccctcag

SEQ ID NO: 26315 - DNA, 15 bp, Artificial Sequence
  dgRNA
  Lrrc9
tcctaaaagaccagt

SEQ ID NO: 26316 - DNA, 15 bp, Artificial Sequence
  dgRNA
  Lrrc9
cctaaaagaccagtg

SEQ ID NO: 26317 - DNA, 15 bp, Artificial Sequence
  dgRNA
  Lrrc9
ctaaaagaccagtgg

SEQ ID NO: 26318 - DNA, 15 bp, Artificial Sequence
  dgRNA
  Lrrc9
tgggggtcgattgct

SEQ ID NO: 26319 - DNA, 15 bp, Artificial Sequence
  dgRNA
  1700001O22Rik
aggaaaggcggtctt

SEQ ID NO: 26320 - DNA, 15 bp, Artificial Sequence
  dgRNA
  1700001O22Rik
cggtcttaggccagc

SEQ ID NO: 26321 - DNA, 15 bp, Artificial Sequence
  dgRNA
  1700001O22Rik
tcacagccgccccaa

SEQ ID NO: 26322 - DNA, 15 bp, Artificial Sequence
  dgRNA
  1700001O22Rik
cacagccgccccaaa

SEQ ID NO: 26323 - DNA, 15 bp, Artificial Sequence
  dgRNA
  Erich1
gtctgccttccgcgc

SEQ ID NO: 26324 - DNA, 15 bp, Artificial Sequence
  dgRNA
  Erich1
agtttaagccacgcc

SEQ ID NO: 26325 - DNA, 15 bp, Artificial Sequence
  dgRNA
  Erich1
gtttaagccacgccc

SEQ ID NO: 26326 - DNA, 15 bp, Artificial Sequence
  dgRNA
  Erich1
atccgcccccgaata

SEQ ID NO: 26327 - DNA, 15 bp, Artificial Sequence
  dgRNA
  Tnfsf10
tagatctcagagcgc

SEQ ID NO: 26328 - DNA, 15 bp, Artificial Sequence
  dgRNA
  Tnfsf10
gcgagctctcctagc

SEQ ID NO: 26329 - DNA, 15 bp, Artificial Sequence
  dgRNA
  Tnfsf10
gacaaagggaccggg

SEQ ID NO: 26330 - DNA, 15 bp, Artificial Sequence
  dgRNA
  Tnfsf10
tcgccctgatggtgc

SEQ ID NO: 26331 - DNA, 15 bp, Artificial Sequence
  dgRNA
  Lcorl
cccgcctctccccga

SEQ ID NO: 26332 - DNA, 15 bp, Artificial Sequence
  dgRNA
  Lcorl
ctctccccgagggag

SEQ ID NO: 26333 - DNA, 15 bp, Artificial Sequence
  dgRNA
  Lcorl
tccccgagggagcgg

SEQ ID NO: 26334 - DNA, 15 bp, Artificial Sequence
  dgRNA
  Lcorl
caatcaacccccctc

SEQ ID NO: 26335 - DNA, 15 bp, Artificial Sequence
  dgRNA
  Lbx2
tgccagtacacctat

SEQ ID NO: 26336 - DNA, 15 bp, Artificial Sequence
  dgRNA
  Lbx2
gcacccgattcactg

SEQ ID NO: 26337 - DNA, 15 bp, Artificial Sequence
  dgRNA
  Lbx2
caactgagctctagg

SEQ ID NO: 26338 - DNA, 15 bp, Artificial Sequence
  dgRNA
  Lbx2
tagggggcgggtccg

SEQ ID NO: 26339 - DNA, 15 bp, Artificial Sequence
  dgRNA
  Klhdc7b
caaggcctaagaata

SEQ ID NO: 26340 - DNA, 15 bp, Artificial Sequence
  dgRNA
  Klhdc7b
ggtaatgttagagat

SEQ ID NO: 26341 - DNA, 15 bp, Artificial Sequence
  dgRNA
  Klhdc7b
gctgtaaccggggct

SEQ ID NO: 26342 - DNA, 15 bp, Artificial Sequence
  dgRNA
  Klhdc7b
ggctgtaaccggggc

SEQ ID NO: 26343 - DNA, 15 bp, Artificial Sequence
  dgRNA
  Try5
gtaaggctctgtatg

SEQ ID NO: 26344 - DNA, 15 bp, Artificial Sequence
  dgRNA
  Try5
taaggctctgtatga

SEQ ID NO: 26345 - DNA, 15 bp, Artificial Sequence
  dgRNA
  Try5
ttagggtataaagac

SEQ ID NO: 26346 - DNA, 15 bp, Artificial Sequence
  dgRNA
  Try5
tgaggtacatgtgat

SEQ ID NO: 26347 - DNA, 15 bp, Artificial Sequence
  dgRNA
  Cdc42se2
ccgtagcccacccag

SEQ ID NO: 26348 - DNA, 15 bp, Artificial Sequence
  dgRNA
  Cdc42se2
cgcctagcatcccct

SEQ ID NO: 26349 - DNA, 15 bp, Artificial Sequence
  dgRNA
  Cdc42se2
tcgccactccctcac

SEQ ID NO: 26350 - DNA, 15 bp, Artificial Sequence
  dgRNA
  Cdc42se2
ctccctcactgggcg

SEQ ID NO: 26351 - DNA, 15 bp, Artificial Sequence
  dgRNA
  C5ar2
tctgcttatgtcaac

SEQ ID NO: 26352 - DNA, 15 bp, Artificial Sequence
  dgRNA
  C5ar2
ctgcttatgtcaaca

SEQ ID NO: 26353 - DNA, 15 bp, Artificial Sequence
  dgRNA
  C5ar2
ttatgtcaacagggt

SEQ ID NO: 26354 - DNA, 15 bp, Artificial Sequence
  dgRNA
  C5ar2
gccttctggaccctt

SEQ ID NO: 26355 - DNA, 15 bp, Artificial Sequence
  dgRNA
  Cacnb3
tctcgattctccacc

SEQ ID NO: 26356 - DNA, 15 bp, Artificial Sequence
  dgRNA
  Cacnb3
caccgggctcgcgtc

SEQ ID NO: 26357 - DNA, 15 bp, Artificial Sequence
  dgRNA
  Cacnb3
gctcgcgtctggttg

SEQ ID NO: 26358 - DNA, 15 bp, Artificial Sequence
  dgRNA
  Cacnb3
cggcggagcagttcc

SEQ ID NO: 26359 - DNA, 15 bp, Artificial Sequence
  dgRNA
  Brinp3
tctctacacaccttc

SEQ ID NO: 26360 - DNA, 15 bp, Artificial Sequence
  dgRNA
  Brinp3
gtgatggtcaatccg

SEQ ID NO: 26361 - DNA, 15 bp, Artificial Sequence
  dgRNA
  Brinp3
gttataagctcaaac

SEQ ID NO: 26362 - DNA, 15 bp, Artificial Sequence
  dgRNA
  Brinp3
gtccttagttagccc

SEQ ID NO: 26363 - DNA, 15 bp, Artificial Sequence
  dgRNA
  4-Mar
tcacggccgctcggg

SEQ ID NO: 26364 - DNA, 15 bp, Artificial Sequence
  dgRNA
  4-Mar
cacggccgctcgggt

SEQ ID NO: 26365 - DNA, 15 bp, Artificial Sequence
  dgRNA
  4-Mar
tcgggtgggagtagc

SEQ ID NO: 26366 - DNA, 15 bp, Artificial Sequence
  dgRNA
  4-Mar
cgggtgggagtagct

SEQ ID NO: 26367 - DNA, 15 bp, Artificial Sequence
  dgRNA
  Npdc1
cagacgcctgacaaa

SEQ ID NO: 26368 - DNA, 15 bp, Artificial Sequence
  dgRNA
  Npdc1
agacgcctgacaaaa

SEQ ID NO: 26369 - DNA, 15 bp, Artificial Sequence
  dgRNA
  Npdc1
gacgcctgacaaaag

SEQ ID NO: 26370 - DNA, 15 bp, Artificial Sequence
  dgRNA
  Npdc1
aggggaccccccaac

SEQ ID NO: 26371 - DNA, 15 bp, Artificial Sequence
  dgRNA
  Prr16
ccgagcgcctcgtct

SEQ ID NO: 26372 - DNA, 15 bp, Artificial Sequence
  dgRNA
  Prr16
cgagcgcctcgtctc

SEQ ID NO: 26373 - DNA, 15 bp, Artificial Sequence
  dgRNA
  Prr16
gagcgcctcgtctcg

SEQ ID NO: 26374 - DNA, 15 bp, Artificial Sequence
  dgRNA
  Prr16
gtctcggggagttga

SEQ ID NO: 26375 - DNA, 15 bp, Artificial Sequence
  dgRNA
  Lsp1
gcccccacgggctgg

SEQ ID NO: 26376 - DNA, 15 bp, Artificial Sequence
  dgRNA
  Lsp1
cccccacgggctgga

SEQ ID NO: 26377 - DNA, 15 bp, Artificial Sequence
  dgRNA
  Lsp1
ccctccagcccgtgg

SEQ ID NO: 26378 - DNA, 15 bp, Artificial Sequence
  dgRNA
  Iqcf4
cttatagcccaactt

SEQ ID NO: 26379 - DNA, 15 bp, Artificial Sequence
  dgRNA
  Iqcf4
ttcggaaatttccgt

SEQ ID NO: 26380 - DNA, 15 bp, Artificial Sequence
  dgRNA
  Iqcf4
aaatttccgtaggca

SEQ ID NO: 26381 - DNA, 15 bp, Artificial Sequence
  dgRNA
  Iqcf4
ttccgtaggcatgga

SEQ ID NO: 26382 - DNA, 15 bp, Artificial Sequence
  dgRNA
  Dhrs7b
cctccggaagattta

SEQ ID NO: 26383 - DNA, 15 bp, Artificial Sequence
  dgRNA
  Dhrs7b
gaagatttacggtat

SEQ ID NO: 26384 - DNA, 15 bp, Artificial Sequence
  dgRNA
  Dhrs7b
tcatttagaccgcaa

SEQ ID NO: 26385 - DNA, 15 bp, Artificial Sequence
  dgRNA
  Dhrs7b
gagtttgatggcata

SEQ ID NO: 26386 - DNA, 15 bp, Artificial Sequence
  dgRNA
  Vps39
gatgtgaactcgggt

SEQ ID NO: 26387 - DNA, 15 bp, Artificial Sequence
  dgRNA
  Vps39
atgtgaactcgggtt

SEQ ID NO: 26388 - DNA, 15 bp, Artificial Sequence
  dgRNA
  Vps39
tgtgaactcgggttg

SEQ ID NO: 26389 - DNA, 15 bp, Artificial Sequence
  dgRNA
  Vps39
gtgaactcgggttgg

SEQ ID NO: 26390 - DNA, 15 bp, Artificial Sequence
  dgRNA
  Tcf7l2
tcgcacgctgagcac

SEQ ID NO: 26391 - DNA, 15 bp, Artificial Sequence
  dgRNA
  Tcf7l2
cccgcgcgcctcccg

SEQ ID NO: 26392 - DNA, 15 bp, Artificial Sequence
  dgRNA
  Tcf7l2
tctcccggcgcccaa

SEQ ID NO: 26393 - DNA, 15 bp, Artificial Sequence
  dgRNA
  Tcf7l2
ttatgcacacgtcac

SEQ ID NO: 26394 - DNA, 15 bp, Artificial Sequence
  dgRNA
  Gcnt2
agtttagatggactg

SEQ ID NO: 26395 - DNA, 15 bp, Artificial Sequence
  dgRNA
  Gcnt2
gtttagatggactga

SEQ ID NO: 26396 - DNA, 15 bp, Artificial Sequence
  dgRNA
  Gcnt2
gagactgtccgctcc

SEQ ID NO: 26397 - DNA, 15 bp, Artificial Sequence
  dgRNA
  Gcnt2
tgtccgctcccggtc

SEQ ID NO: 26398 - DNA, 15 bp, Artificial Sequence
  dgRNA
  Asf1a
ccggcggcctccgcg

SEQ ID NO: 26399 - DNA, 15 bp, Artificial Sequence
  dgRNA
  Asf1a
cggcggcctccgcgc

SEQ ID NO: 26400 - DNA, 15 bp, Artificial Sequence
  dgRNA
  Asf1a
tctgcgcctttgtcc

SEQ ID NO: 26401 - DNA, 15 bp, Artificial Sequence
  dgRNA
  Asf1a
ctggtccgcaccagc

SEQ ID NO: 26402 - DNA, 15 bp, Artificial Sequence
  dgRNA
  Gyg
tggaaggaacgcccg

SEQ ID NO: 26403 - DNA, 15 bp, Artificial Sequence
  dgRNA
  Gyg
ggcgcagtccccaac

SEQ ID NO: 26404 - DNA, 15 bp, Artificial Sequence
  dgRNA
  Gyg
caacaggtgtcccct

SEQ ID NO: 26405 - DNA, 15 bp, Artificial Sequence
  dgRNA
  Gyg
agcctgcgggtcccc

SEQ ID NO: 26406 - DNA, 15 bp, Artificial Sequence
  dgRNA
  Armc9
cgccacacgcctgta

SEQ ID NO: 26407 - DNA, 15 bp, Artificial Sequence
  dgRNA
  Armc9
gtacggcctcacttc

SEQ ID NO: 26408 - DNA, 15 bp, Artificial Sequence
  dgRNA
  Armc9
ggtactcaccacgta

SEQ ID NO: 26409 - DNA, 15 bp, Artificial Sequence
  dgRNA
  Armc9
ttcgcccagcaagat

SEQ ID NO: 26410 - DNA, 15 bp, Artificial Sequence
  dgRNA
  Cgn
gcccctcccgtccac

SEQ ID NO: 26411 - DNA, 15 bp, Artificial Sequence
  dgRNA
  Cgn
cccctcccgtccacc

SEQ ID NO: 26412 - DNA, 15 bp, Artificial Sequence
  dgRNA
  Cgn
tcccgtccaccgggc

SEQ ID NO: 26413 - DNA, 15 bp, Artificial Sequence
  dgRNA
  Cgn
cccgtccaccgggct

SEQ ID NO: 26414 - DNA, 15 bp, Artificial Sequence
  dgRNA
  Fhit
acacagtggattacc

SEQ ID NO: 26415 - DNA, 15 bp, Artificial Sequence
  dgRNA
  Fhit
aatcctccgcgagag

SEQ ID NO: 26416 - DNA, 15 bp, Artificial Sequence
  dgRNA
  Fhit
tgatgctatgcagga

SEQ ID NO: 26417 - DNA, 15 bp, Artificial Sequence
  dgRNA
  Fhit
aaaccgctctcgcgg

SEQ ID NO: 26418 - DNA, 15 bp, Artificial Sequence
  dgRNA
  Cops5
cggccgactccttcc

SEQ ID NO: 26419 - DNA, 15 bp, Artificial Sequence
  dgRNA
  Cops5
cgactccttcctggc

SEQ ID NO: 26420 - DNA, 15 bp, Artificial Sequence
  dgRNA
  Cops5
aatagtcccgccttc

SEQ ID NO: 26421 - DNA, 15 bp, Artificial Sequence
  dgRNA
  Cops5
gccttccggcgcgaa

SEQ ID NO: 26422 - DNA, 15 bp, Artificial Sequence
  dgRNA
  Bcl11b
gaaagagccgaacca

SEQ ID NO: 26423 - DNA, 15 bp, Artificial Sequence
  dgRNA
  Bcl11b
ggttcggctctttct

SEQ ID NO: 26424 - DNA, 15 bp, Artificial Sequence
  dgRNA
  Bcl11b
tggttcggctctttc

SEQ ID NO: 26425 - DNA, 15 bp, Artificial Sequence
  dgRNA
  Bcl11b
tccacccaaggggag

SEQ ID NO: 26426 - DNA, 15 bp, Artificial Sequence
  dgRNA
  1700001P01Rik
cgggttgtagcagct

SEQ ID NO: 26427 - DNA, 15 bp, Artificial Sequence
  dgRNA
  1700001P01Rik
tttcctactatgccc

SEQ ID NO: 26428 - DNA, 15 bp, Artificial Sequence
  dgRNA
  1700001P01Rik
agcatcacgataaga

SEQ ID NO: 26429 - DNA, 15 bp, Artificial Sequence
  dgRNA
  1700001P01Rik
gcatcacgataagat

SEQ ID NO: 26430 - DNA, 15 bp, Artificial Sequence
  dgRNA
  Usf1
ggggcacctttgctt

SEQ ID NO: 26431 - DNA, 15 bp, Artificial Sequence
  dgRNA
  Usf1
tggctggcgtttccc

SEQ ID NO: 26432 - DNA, 15 bp, Artificial Sequence
  dgRNA
  Usf1
ggcgtttcccaggcc

SEQ ID NO: 26433 - DNA, 15 bp, Artificial Sequence
  dgRNA
  Usf1
acggagcctttgttt

SEQ ID NO: 26434 - DNA, 15 bp, Artificial Sequence
  dgRNA
  Otud6a
gggcgtagccccgag

SEQ ID NO: 26435 - DNA, 15 bp, Artificial Sequence
  dgRNA
  Otud6a
ggcgtagccccgaga

SEQ ID NO: 26436 - DNA, 15 bp, Artificial Sequence
  dgRNA
  Otud6a
tgggaataaaattcg

SEQ ID NO: 26437 - DNA, 15 bp, Artificial Sequence
  dgRNA
  Otud6a
ggccaccaacgtctg

SEQ ID NO: 26438 - DNA, 15 bp, Artificial Sequence
  dgRNA
  Art5
tctaccccggccctt

SEQ ID NO: 26439 - DNA, 15 bp, Artificial Sequence
  dgRNA
  Art5
ccggcccttcggacc

SEQ ID NO: 26440 - DNA, 15 bp, Artificial Sequence
  dgRNA
  Art5
cggcccttcggacca

SEQ ID NO: 26441 - DNA, 15 bp, Artificial Sequence
  dgRNA
  Art5
ccttcggaccagggt

SEQ ID NO: 26442 - DNA, 15 bp, Artificial Sequence
  dgRNA
  Ttc25
agccttaatcctact

SEQ ID NO: 26443 - DNA, 15 bp, Artificial Sequence
  dgRNA
  Ttc25
cttgctttgtctgcg

SEQ ID NO: 26444 - DNA, 15 bp, Artificial Sequence
  dgRNA
  Ttc25
gcgaggctttccacg

SEQ ID NO: 26445 - DNA, 15 bp, Artificial Sequence
  dgRNA
  Ttc25
tttccacgtggcaac

SEQ ID NO: 26446 - DNA, 15 bp, Artificial Sequence
  dgRNA
  Arl4a
ctcgtttcccactca

SEQ ID NO: 26447 - DNA, 15 bp, Artificial Sequence
  dgRNA
  Arl4a
aacaggtggtgccgg

SEQ ID NO: 26448 - DNA, 15 bp, Artificial Sequence
  dgRNA
  Arl4a
acaggtggtgccgga

SEQ ID NO: 26449 - DNA, 15 bp, Artificial Sequence
  dgRNA
  Arl4a
gccgagagcgagccc

SEQ ID NO: 26450 - DNA, 15 bp, Artificial Sequence
  dgRNA
  Ak2
ccaattctgcccaat

SEQ ID NO: 26451 - DNA, 15 bp, Artificial Sequence
  dgRNA
  Ak2
gtctcgtcgtacgat

SEQ ID NO: 26452 - DNA, 15 bp, Artificial Sequence
  dgRNA
  Ak2
agtgcccgtcaagtt

SEQ ID NO: 26453 - DNA, 15 bp, Artificial Sequence
  dgRNA
  Ak2
gtgcccgtcaagttc

SEQ ID NO: 26454 - DNA, 15 bp, Artificial Sequence
  dgRNA
  Gapt
gttccacctacaaag

SEQ ID NO: 26455 - DNA, 15 bp, Artificial Sequence
  dgRNA
  Gapt
acttcctcacgaacc

SEQ ID NO: 26456 - DNA, 15 bp, Artificial Sequence
  dgRNA
  Gapt
gtttcctggttcgtg

SEQ ID NO: 26457 - DNA, 15 bp, Artificial Sequence
  dgRNA
  Wls
gatgttagctgttgc

SEQ ID NO: 26458 - DNA, 15 bp, Artificial Sequence
  dgRNA
  Wls
atgttagctgttgcc

SEQ ID NO: 26459 - DNA, 15 bp, Artificial Sequence
  dgRNA
  Wls
tgttagctgttgccg

SEQ ID NO: 26460 - DNA, 15 bp, Artificial Sequence
  dgRNA
  Wls
gccggggcaagctgc

SEQ ID NO: 26461 - DNA, 15 bp, Artificial Sequence
  dgRNA
  Fbxl17
gcatgtagcccgcgt

SEQ ID NO: 26462 - DNA, 15 bp, Artificial Sequence
  dgRNA
  Fbxl17
catgtagcccgcgtc

SEQ ID NO: 26463 - DNA, 15 bp, Artificial Sequence
  dgRNA
  Fbxl17
cccgcgtcgggcacc

SEQ ID NO: 26464 - DNA, 15 bp, Artificial Sequence
  dgRNA
  Fbxl17
ccgcgtcgggcaccc

SEQ ID NO: 26465 - DNA, 15 bp, Artificial Sequence
  dgRNA
  Fam181a
ggtgacaatttgtga

SEQ ID NO: 26466 - DNA, 15 bp, Artificial Sequence
  dgRNA
  Fam181a
tgacggcaaagaatg

SEQ ID NO: 26467 - DNA, 15 bp, Artificial Sequence
  dgRNA
  Fam181a
aagaatgtgggaccg

SEQ ID NO: 26468 - DNA, 15 bp, Artificial Sequence
  dgRNA
  Fam181a
gctccgccgcctgat

SEQ ID NO: 26469 - DNA, 15 bp, Artificial Sequence
  dgRNA
  Mrgpra9
gcaagtgcgagtgta

SEQ ID NO: 26470 - DNA, 15 bp, Artificial Sequence
  dgRNA
  Mrgpra9
ggcaagtgcgagtgt

SEQ ID NO: 26471 - DNA, 15 bp, Artificial Sequence
  dgRNA
  Cd86
tttaaacaattcagg

SEQ ID NO: 26472 - DNA, 15 bp, Artificial Sequence
  dgRNA
  Cd86
cggtttcagtcttga

SEQ ID NO: 26473 - DNA, 15 bp, Artificial Sequence
  dgRNA
  Cd86
tcggtttcagtcttg

SEQ ID NO: 26474 - DNA, 15 bp, Artificial Sequence
  dgRNA
  Cd86
tagattattcgagtt

SEQ ID NO: 26475 - DNA, 15 bp, Artificial Sequence
  dgRNA
  Yaf2
ggcgcggccgctggt

SEQ ID NO: 26476 - DNA, 15 bp, Artificial Sequence
  dgRNA
  Yaf2
cggccgctggttggc

SEQ ID NO: 26477 - DNA, 15 bp, Artificial Sequence
  dgRNA
  Yaf2
gctggttggccggcg

SEQ ID NO: 26478 - DNA, 15 bp, Artificial Sequence
  dgRNA
  Yaf2
ctggttggccggcgc

SEQ ID NO: 26479 - DNA, 15 bp, Artificial Sequence
  dgRNA
  Sgtb
cgagagcgggcagag

SEQ ID NO: 26480 - DNA, 15 bp, Artificial Sequence
  dgRNA
  Sgtb
cccacgcctacgccg

SEQ ID NO: 26481 - DNA, 15 bp, Artificial Sequence
  dgRNA
  Sgtb
ccgctctcggcttcc

SEQ ID NO: 26482 - DNA, 15 bp, Artificial Sequence
  dgRNA
  Sgtb
cccgctctcggcttc

SEQ ID NO: 26483 - DNA, 15 bp, Artificial Sequence
  dgRNA
  Mgrn1
acgctcgaaattctg

SEQ ID NO: 26484 - DNA, 15 bp, Artificial Sequence
  dgRNA
  Mgrn1
cgctcgaaattctga

SEQ ID NO: 26485 - DNA, 15 bp, Artificial Sequence
  dgRNA
  Mgrn1
gtttcagtatccagc

SEQ ID NO: 26486 - DNA, 15 bp, Artificial Sequence
  dgRNA
  Mgrn1
gttagcgtcgtgtga

SEQ ID NO: 26487 - DNA, 15 bp, Artificial Sequence
  dgRNA
  Amn1
agtaactggcaatag

SEQ ID NO: 26488 - DNA, 15 bp, Artificial Sequence
  dgRNA
  Amn1
gtaactggcaatagc

SEQ ID NO: 26489 - DNA, 15 bp, Artificial Sequence
  dgRNA
  Amn1
ctggcaatagcgggc

SEQ ID NO: 26490 - DNA, 15 bp, Artificial Sequence
  dgRNA
  Amn1
gctttgctcccgctt

SEQ ID NO: 26491 - DNA, 15 bp, Artificial Sequence
  dgRNA
  Nynrin
cggcgggaatccgct

SEQ ID NO: 26492 - DNA, 15 bp, Artificial Sequence
  dgRNA
  Nynrin
gctacaacccttagc

SEQ ID NO: 26493 - DNA, 15 bp, Artificial Sequence
  dgRNA
  Nynrin
caacccttagcagga

SEQ ID NO: 26494 - DNA, 15 bp, Artificial Sequence
  dgRNA
  Nynrin
tctcccgtgctgcgg

SEQ ID NO: 26495 - DNA, 15 bp, Artificial Sequence
  dgRNA
  Senp6
cccggtaggcgcctg

SEQ ID NO: 26496 - DNA, 15 bp, Artificial Sequence
  dgRNA
  Senp6
tcgccgcctcccgtc

SEQ ID NO: 26497 - DNA, 15 bp, Artificial Sequence
  dgRNA
  Senp6
aggcccgcttttgtg

SEQ ID NO: 26498 - DNA, 15 bp, Artificial Sequence
  dgRNA
  Senp6
ggcccgcttttgtgt

SEQ ID NO: 26499 - DNA, 15 bp, Artificial Sequence
  dgRNA
  Gpsm1
actgtgctaaaggat

SEQ ID NO: 26500 - DNA, 15 bp, Artificial Sequence
  dgRNA
  Gpsm1
atccacattatatcc

SEQ ID NO: 26501 - DNA, 15 bp, Artificial Sequence
  dgRNA
  Gpsm1
tataatgtggatcaa

SEQ ID NO: 26502 - DNA, 15 bp, Artificial Sequence
  dgRNA
  Flrt3
ctgcgcgcagtcaac

SEQ ID NO: 26503 - DNA, 15 bp, Artificial Sequence
  dgRNA
  Flrt3
cgcagtcctcagcgc

SEQ ID NO: 26504 - DNA, 15 bp, Artificial Sequence
  dgRNA
  Flrt3
tgccaacgctagagg

SEQ ID NO: 26505 - DNA, 15 bp, Artificial Sequence
  dgRNA
  Flrt3
ttgccaacgctagag

SEQ ID NO: 26506 - DNA, 15 bp, Artificial Sequence
  dgRNA
  Pgbd1
aggaaaaccacgacc

SEQ ID NO: 26507 - DNA, 15 bp, Artificial Sequence
  dgRNA
  Pgbd1
acgacctggctccac

SEQ ID NO: 26508 - DNA, 15 bp, Artificial Sequence
  dgRNA
  Pgbd1
gagcacaacgcttgc

SEQ ID NO: 26509 - DNA, 15 bp, Artificial Sequence
  dgRNA
  Pgbd1
gacccgcacctctcc

SEQ ID NO: 26510 - DNA, 15 bp, Artificial Sequence
  dgRNA
  Gnal
cccggcacttatgat

SEQ ID NO: 26511 - DNA, 15 bp, Artificial Sequence
  dgRNA
  Gnal
ttatgataggcagcc

SEQ ID NO: 26512 - DNA, 15 bp, Artificial Sequence
  dgRNA
  Gnal
accaatacttgccac

SEQ ID NO: 26513 - DNA, 15 bp, Artificial Sequence
  dgRNA
  Gnal
agtatttacggtaac

SEQ ID NO: 26514 - DNA, 15 bp, Artificial Sequence
  dgRNA
  Csta1
ttaacatattgatgc

SEQ ID NO: 26515 - DNA, 15 bp, Artificial Sequence
  dgRNA
  Csta1
ctcttatgacacaac

SEQ ID NO: 26516 - DNA, 15 bp, Artificial Sequence
  dgRNA
  Csta1
accatacctgagtcc

SEQ ID NO: 26517 - DNA, 15 bp, Artificial Sequence
  dgRNA
  Csta1
tggacttgatcaaga

SEQ ID NO: 26518 - DNA, 15 bp, Artificial Sequence
  dgRNA
  Sorbs2
tcgctcaacttaacc

SEQ ID NO: 26519 - DNA, 15 bp, Artificial Sequence
  dgRNA
  Sorbs2
cacagattccctaat

SEQ ID NO: 26520 - DNA, 15 bp, Artificial Sequence
  dgRNA
  Sorbs2
ctgactgtatcccta

SEQ ID NO: 26521 - DNA, 15 bp, Artificial Sequence
  dgRNA
  Sorbs2
tgactgtatccctag

SEQ ID NO: 26522 - DNA, 15 bp, Artificial Sequence
  dgRNA
  Arl6ip5
acctttagtttaggt

SEQ ID NO: 26523 - DNA, 15 bp, Artificial Sequence
  dgRNA
  Arl6ip5
cctttagtttaggta

SEQ ID NO: 26524 - DNA, 15 bp, Artificial Sequence
  dgRNA
  Arl6ip5
ctttagtttaggtag

SEQ ID NO: 26525 - DNA, 15 bp, Artificial Sequence
  dgRNA
  Arl6ip5
tacctaaactaaagg

SEQ ID NO: 26526 - DNA, 15 bp, Artificial Sequence
  dgRNA
  Ccdc120
tagatatccgcagtg

SEQ ID NO: 26527 - DNA, 15 bp, Artificial Sequence
  dgRNA
  Ccdc120
tctccttgaccatat

SEQ ID NO: 26528 - DNA, 15 bp, Artificial Sequence
  dgRNA
  Ccdc120
ctccttgaccatatt

SEQ ID NO: 26529 - DNA, 15 bp, Artificial Sequence
  dgRNA
  Ccdc120
atattgggctccccg

SEQ ID NO: 26530 - DNA, 15 bp, Artificial Sequence
  dgRNA
  Fbxl22
aagccgaaccacaga

SEQ ID NO: 26531 - DNA, 15 bp, Artificial Sequence
  dgRNA
  Fbxl22
ggcttcgagtaagtc

SEQ ID NO: 26532 - DNA, 15 bp, Artificial Sequence
  dgRNA
  Fbxl22
ccaccagtcctgatc

SEQ ID NO: 26533 - DNA, 15 bp, Artificial Sequence
  dgRNA
  Fbxl22
caccagtcctgatct

SEQ ID NO: 26534 - DNA, 15 bp, Artificial Sequence
  dgRNA
  1700001L19Rik
actacaacaaactgc

SEQ ID NO: 26535 - DNA, 15 bp, Artificial Sequence
  dgRNA
  1700001L19Rik
ctggcagttcctacc

SEQ ID NO: 26536 - DNA, 15 bp, Artificial Sequence
  dgRNA
  1700001L19Rik
tagaaggaggcgtca

SEQ ID NO: 26537 - DNA, 15 bp, Artificial Sequence
  dgRNA
  1700001L19Rik
gtaggaactgccagg

SEQ ID NO: 26538 - DNA, 15 bp, Artificial Sequence
  dgRNA
  Nucks1
gggcctatccgggag

SEQ ID NO: 26539 - DNA, 15 bp, Artificial Sequence
  dgRNA
  Nucks1
ggcctatccgggagt

SEQ ID NO: 26540 - DNA, 15 bp, Artificial Sequence
  dgRNA
  Nucks1
gcctatccgggagtg

SEQ ID NO: 26541 - DNA, 15 bp, Artificial Sequence
  dgRNA
  Nucks1
tatccgggagtgggg

SEQ ID NO: 26542 - DNA, 15 bp, Artificial Sequence
  dgRNA
  Prrt1
cccacccgccttgcc

SEQ ID NO: 26543 - DNA, 15 bp, Artificial Sequence
  dgRNA
  Prrt1
aagggagctaaactg

SEQ ID NO: 26544 - DNA, 15 bp, Artificial Sequence
  dgRNA
  Prrt1
agggagctaaactgg

SEQ ID NO: 26545 - DNA, 15 bp, Artificial Sequence
  dgRNA
  Prrt1
gggggcttgactgcc

SEQ ID NO: 26546 - DNA, 15 bp, Artificial Sequence
  dgRNA
  Ube2h
tcgatgaagtgtgtg

SEQ ID NO: 26547 - DNA, 15 bp, Artificial Sequence
  dgRNA
  Ube2h
ggagggaatgcacga

SEQ ID NO: 26548 - DNA, 15 bp, Artificial Sequence
  dgRNA
  Ube2h
ggaatgcacgatggc

SEQ ID NO: 26549 - DNA, 15 bp, Artificial Sequence
  dgRNA
  Ube2h
acggcgcctagagcg

SEQ ID NO: 26550 - DNA, 15 bp, Artificial Sequence
  dgRNA
  Kif5c
gtcctgcagttcccg

SEQ ID NO: 26551 - DNA, 15 bp, Artificial Sequence
  dgRNA
  Kif5c
tcctgcagttcccgg

SEQ ID NO: 26552 - DNA, 15 bp, Artificial Sequence
  dgRNA
  Kif5c
ggcgactacaagtcc

SEQ ID NO: 26553 - DNA, 15 bp, Artificial Sequence
  dgRNA
  Kif5c
gcgactacaagtccc

SEQ ID NO: 26554 - DNA, 15 bp, Artificial Sequence
  dgRNA
  Tbc1d2
acgcttaaagcgcct

SEQ ID NO: 26555 - DNA, 15 bp, Artificial Sequence
  dgRNA
  Tbc1d2
cgcccgcacgcgccg

SEQ ID NO: 26556 - DNA, 15 bp, Artificial Sequence
  dgRNA
  Tbc1d2
gcccgcacgcgccgc

SEQ ID NO: 26557 - DNA, 15 bp, Artificial Sequence
  dgRNA
  Tbc1d2
gcgaacgaagcaaca

SEQ ID NO: 26558 - DNA, 15 bp, Artificial Sequence
  dgRNA
  Smc1a
gcttcccgtcctagt

SEQ ID NO: 26559 - DNA, 15 bp, Artificial Sequence
  dgRNA
  Smc1a
tcccgtcctagttgg

SEQ ID NO: 26560 - DNA, 15 bp, Artificial Sequence
  dgRNA
  Smc1a
cacttcaacagttgc

SEQ ID NO: 26561 - DNA, 15 bp, Artificial Sequence
  dgRNA
  Smc1a
acttcaacagttgct

SEQ ID NO: 26562 - DNA, 15 bp, Artificial Sequence
  dgRNA
  Zfp458
tcagtattgaacttc

SEQ ID NO: 26563 - DNA, 15 bp, Artificial Sequence
  dgRNA
  Zfp458
ttctcccccaaagtt

SEQ ID NO: 26564 - DNA, 15 bp, Artificial Sequence
  dgRNA
  Zfp458
tctcccccaaagtta

SEQ ID NO: 26565 - DNA, 15 bp, Artificial Sequence
  dgRNA
  Zfp458
ctcccccaaagttag

SEQ ID NO: 26566 - DNA, 15 bp, Artificial Sequence
  dgRNA
  Palld
gccacttagtataga

SEQ ID NO: 26567 - DNA, 15 bp, Artificial Sequence
  dgRNA
  Palld
ctactcggctatatt

SEQ ID NO: 26568 - DNA, 15 bp, Artificial Sequence
  dgRNA
  Palld
gtagtgagacaactg

SEQ ID NO: 26569 - DNA, 15 bp, Artificial Sequence
  dgRNA
  Olfr156
tcagttggctaccag

SEQ ID NO: 26570 - DNA, 15 bp, Artificial Sequence
  dgRNA
  Olfr156
gcgtcctgatctctc

SEQ ID NO: 26571 - DNA, 15 bp, Artificial Sequence
  dgRNA
  Olfr156
gccaactgagataga

SEQ ID NO: 26572 - DNA, 15 bp, Artificial Sequence
  dgRNA
  Olfr156
cgcattggttcaagc

SEQ ID NO: 26573 - DNA, 15 bp, Artificial Sequence
  dgRNA
  Lrrc18
aagaacatgtggacc

SEQ ID NO: 26574 - DNA, 15 bp, Artificial Sequence
  dgRNA
  Lrrc18
ctagaactctgccca

SEQ ID NO: 26575 - DNA, 15 bp, Artificial Sequence
  dgRNA
  Lrrc18
acattcagggctatc

SEQ ID NO: 26576 - DNA, 15 bp, Artificial Sequence
  dgRNA
  Lrrc18
aggtccacatgttct

SEQ ID NO: 26577 - DNA, 15 bp, Artificial Sequence
  dgRNA
  Klrb1a
tcagagtgttttgcg

SEQ ID NO: 26578 - DNA, 15 bp, Artificial Sequence
  dgRNA
  Klrb1a
cagagtgttttgcgt

SEQ ID NO: 26579 - DNA, 15 bp, Artificial Sequence
  dgRNA
  Klrb1a
gtcagtcggtaacca

SEQ ID NO: 26580 - DNA, 15 bp, Artificial Sequence
  dgRNA
  Arhgap26
attgggttagagtcg

SEQ ID NO: 26581 - DNA, 15 bp, Artificial Sequence
  dgRNA
  Arhgap26
ggttagagtcgcgga

SEQ ID NO: 26582 - DNA, 15 bp, Artificial Sequence
  dgRNA
  Arhgap26
gttagagtcgcggaa

SEQ ID NO: 26583 - DNA, 15 bp, Artificial Sequence
  dgRNA
  Arhgap26
gagtcgcggaagggc

SEQ ID NO: 26584 - DNA, 15 bp, Artificial Sequence
  dgRNA
  Loxl1
actgatctgtgggac

SEQ ID NO: 26585 - DNA, 15 bp, Artificial Sequence
  dgRNA
  Loxl1
cacatagctaaaacc

SEQ ID NO: 26586 - DNA, 15 bp, Artificial Sequence
  dgRNA
  Loxl1
atagctaaaacccgg

SEQ ID NO: 26587 - DNA, 15 bp, Artificial Sequence
  dgRNA
  Loxl1
tagctaaaacccggc

SEQ ID NO: 26588 - DNA, 15 bp, Artificial Sequence
  dgRNA
  Ttll9
agtgtacccccacgc

SEQ ID NO: 26589 - DNA, 15 bp, Artificial Sequence
  dgRNA
  Ttll9
ggcgccaagagagaa

SEQ ID NO: 26590 - DNA, 15 bp, Artificial Sequence
  dgRNA
  Ttll9
agcaatcgactgacg

SEQ ID NO: 26591 - DNA, 15 bp, Artificial Sequence
  dgRNA
  Ttll9
gcaatcgactgacgt

SEQ ID NO: 26592 - DNA, 15 bp, Artificial Sequence
  dgRNA
  Pop5
cggctggcccggatc

SEQ ID NO: 26593 - DNA, 15 bp, Artificial Sequence
  dgRNA
  Pop5
ggctggcccggatca

SEQ ID NO: 26594 - DNA, 15 bp, Artificial Sequence
  dgRNA
  Pop5
ataatcggaactaga

SEQ ID NO: 26595 - DNA, 15 bp, Artificial Sequence
  dgRNA
  Pop5
tttggagacgcggtg

SEQ ID NO: 26596 - DNA, 15 bp, Artificial Sequence
  dgRNA
  Rpl7
ctctagtgagcctaa

SEQ ID NO: 26597 - DNA, 15 bp, Artificial Sequence
  dgRNA
  Rpl7
tctagtgagcctaat

SEQ ID NO: 26598 - DNA, 15 bp, Artificial Sequence
  dgRNA
  Rpl7
gaatcaccgccgcga

SEQ ID NO: 26599 - DNA, 15 bp, Artificial Sequence
  dgRNA
  Rpl7
tgcagcgacgcatgc

SEQ ID NO: 26600 - DNA, 15 bp, Artificial Sequence
  dgRNA
  Polh
gcgctgcgcatgcgc

SEQ ID NO: 26601 - DNA, 15 bp, Artificial Sequence
  dgRNA
  Polh
gcgccggagccgcca

SEQ ID NO: 26602 - DNA, 15 bp, Artificial Sequence
  dgRNA
  Polh
atgcgcgcgcggaag

SEQ ID NO: 26603 - DNA, 15 bp, Artificial Sequence
  dgRNA
  Polh
cggaagtggccgctt

SEQ ID NO: 26604 - DNA, 15 bp, Artificial Sequence
  dgRNA
  Acot8
tcacccaatcacacg

SEQ ID NO: 26605 - DNA, 15 bp, Artificial Sequence
  dgRNA
  Acot8
ctgcgtctcgctccc

SEQ ID NO: 26606 - DNA, 15 bp, Artificial Sequence
  dgRNA
  Acot8
gggatttccggcccc

SEQ ID NO: 26607 - DNA, 15 bp, Artificial Sequence
  dgRNA
  Acot8
gaatcagcgaggggg

SEQ ID NO: 26608 - DNA, 15 bp, Artificial Sequence
  dgRNA
  Coq10a
aagctcgaatcaatg

SEQ ID NO: 26609 - DNA, 15 bp, Artificial Sequence
  dgRNA
  Coq10a
agctcgaatcaatgt

SEQ ID NO: 26610 - DNA, 15 bp, Artificial Sequence
  dgRNA
  Coq10a
gctcgaatcaatgtg

SEQ ID NO: 26611 - DNA, 15 bp, Artificial Sequence
  dgRNA
  Coq10a
gctttaacccagcgt

SEQ ID NO: 26612 - DNA, 15 bp, Artificial Sequence
  dgRNA
  Gal3st1
ggtaaatgagctacc

SEQ ID NO: 26613 - DNA, 15 bp, Artificial Sequence
  dgRNA
  Gal3st1
tgttggggtctaaag

SEQ ID NO: 26614 - DNA, 15 bp, Artificial Sequence
  dgRNA
  Gal3st1
gttggggtctaaaga

SEQ ID NO: 26615 - DNA, 15 bp, Artificial Sequence
  dgRNA
  Gal3st1
gggagcgggtcaccc

SEQ ID NO: 26616 - DNA, 15 bp, Artificial Sequence
  dgRNA
  Prom2
tccgggcgggcgacc

SEQ ID NO: 26617 - DNA, 15 bp, Artificial Sequence
  dgRNA
  Prom2
gcgacctggtagctc

SEQ ID NO: 26618 - DNA, 15 bp, Artificial Sequence
  dgRNA
  Prom2
ccaaacctgtcgggc

SEQ ID NO: 26619 - DNA, 15 bp, Artificial Sequence
  dgRNA
  Prom2
ggtttgtagagccac

SEQ ID NO: 26620 - DNA, 15 bp, Artificial Sequence
  dgRNA
  Pramel5
tccaacacccttata

SEQ ID NO: 26621 - DNA, 15 bp, Artificial Sequence
  dgRNA
  Pink1
gtaaagggcctggat

SEQ ID NO: 26622 - DNA, 15 bp, Artificial Sequence
  dgRNA
  Pink1
cgtctcatcttaacc

SEQ ID NO: 26623 - DNA, 15 bp, Artificial Sequence
  dgRNA
  Pink1
cacaacccctcgacc

SEQ ID NO: 26624 - DNA, 15 bp, Artificial Sequence
  dgRNA
  Pink1
acaacccctcgacct

SEQ ID NO: 26625 - DNA, 15 bp, Artificial Sequence
  dgRNA
  Syne4
agtagcctcggactt

SEQ ID NO: 26626 - DNA, 15 bp, Artificial Sequence
  dgRNA
  Syne4
ctactgaggggccca

SEQ ID NO: 26627 - DNA, 15 bp, Artificial Sequence
  dgRNA
  Syne4
gctactgaggggccc

SEQ ID NO: 26628 - DNA, 15 bp, Artificial Sequence
  dgRNA
  Syne4
tccgaggctactgag

SEQ ID NO: 26629 - DNA, 15 bp, Artificial Sequence
  dgRNA
  C9
gacactttgtcaata

SEQ ID NO: 26630 - DNA, 15 bp, Artificial Sequence
  dgRNA
  C9
ttaggctaagtgtca

SEQ ID NO: 26631 - DNA, 15 bp, Artificial Sequence
  dgRNA
  Clrn1
aaactcatcaatacg

SEQ ID NO: 26632 - DNA, 15 bp, Artificial Sequence
  dgRNA
  Clrn1
ttactgtcggagcca

SEQ ID NO: 26633 - DNA, 15 bp, Artificial Sequence
  dgRNA
  Clrn1
acccaatcagacaac

SEQ ID NO: 26634 - DNA, 15 bp, Artificial Sequence
  dgRNA
  Clrn1
tctcaagttacacgg

SEQ ID NO: 26635 - DNA, 15 bp, Artificial Sequence
  dgRNA
  Icmt
cgcccagttgtctct

SEQ ID NO: 26636 - DNA, 15 bp, Artificial Sequence
  dgRNA
  Icmt
ttctgcagagcgccg

SEQ ID NO: 26637 - DNA, 15 bp, Artificial Sequence
  dgRNA
  Icmt
cgccgaggccacttc

SEQ ID NO: 26638 - DNA, 15 bp, Artificial Sequence
  dgRNA
  Icmt
gccgaggccacttcc

SEQ ID NO: 26639 - DNA, 15 bp, Artificial Sequence
  dgRNA
  Kifc3
tatcttagacgaaga

SEQ ID NO: 26640 - DNA, 15 bp, Artificial Sequence
  dgRNA
  Kifc3
gaagacggtctattg

SEQ ID NO: 26641 - DNA, 15 bp, Artificial Sequence
  dgRNA
  Kifc3
agctaggttgtagac

SEQ ID NO: 26642 - DNA, 15 bp, Artificial Sequence
  dgRNA
  Kifc3
gttgtagacaggcca

SEQ ID NO: 26643 - DNA, 15 bp, Artificial Sequence
  dgRNA
  Rbl2
cgtgctcagacctac

SEQ ID NO: 26644 - DNA, 15 bp, Artificial Sequence
  dgRNA
  Rbl2
ctacgggtgcccgca

SEQ ID NO: 26645 - DNA, 15 bp, Artificial Sequence
  dgRNA
  Rbl2
tacgggtgcccgcat

SEQ ID NO: 26646 - DNA, 15 bp, Artificial Sequence
  dgRNA
  Rbl2
gtgagaccattcaga

SEQ ID NO: 26647 - DNA, 15 bp, Artificial Sequence
  dgRNA
  Lpp
ctacagtagctttgt

SEQ ID NO: 26648 - DNA, 15 bp, Artificial Sequence
  dgRNA
  Lpp
gaaaggactagctac

SEQ ID NO: 26649 - DNA, 15 bp, Artificial Sequence
  dgRNA
  Lpp
ctacaggttatatcc

SEQ ID NO: 26650 - DNA, 15 bp, Artificial Sequence
  dgRNA
  Lpp
caggttatatcctgg

SEQ ID NO: 26651 - DNA, 15 bp, Artificial Sequence
  dgRNA
  Idh1
ccgcctaccacctca

SEQ ID NO: 26652 - DNA, 15 bp, Artificial Sequence
  dgRNA
  Idh1
taaccaatcatcaac

SEQ ID NO: 26653 - DNA, 15 bp, Artificial Sequence
  dgRNA
  Idh1
catcaaccggctcca

SEQ ID NO: 26654 - DNA, 15 bp, Artificial Sequence
  dgRNA
  Idh1
atcaaccggctccaa

SEQ ID NO: 26655 - DNA, 15 bp, Artificial Sequence
  dgRNA
  Nt5c1a
catttgcttcagacc

SEQ ID NO: 26656 - DNA, 15 bp, Artificial Sequence
  dgRNA
  Nt5c1a
gcttcagacccgggt

SEQ ID NO: 26657 - DNA, 15 bp, Artificial Sequence
  dgRNA
  Nt5c1a
gacccgggtcggtcg

SEQ ID NO: 26658 - DNA, 15 bp, Artificial Sequence
  dgRNA
  Nt5c1a
cccctaaatgccaag

SEQ ID NO: 26659 - DNA, 15 bp, Artificial Sequence
  dgRNA
  Fhl4
acctcccgcgcccac

SEQ ID NO: 26660 - DNA, 15 bp, Artificial Sequence
  dgRNA
  Fhl4
cgcccaccggtcgct

SEQ ID NO: 26661 - DNA, 15 bp, Artificial Sequence
  dgRNA
  Fhl4
cgcgcgcgcctcatc

SEQ ID NO: 26662 - DNA, 15 bp, Artificial Sequence
  dgRNA
  Fhl4
gcgcgcctcatccgg

SEQ ID NO: 26663 - DNA, 15 bp, Artificial Sequence
  dgRNA
  Plekhm1
ccagagtagcgagag

SEQ ID NO: 26664 - DNA, 15 bp, Artificial Sequence
  dgRNA
  Plekhm1
agtagcgagagcggc

SEQ ID NO: 26665 - DNA, 15 bp, Artificial Sequence
  dgRNA
  Plekhm1
agaagccctgcaatc

SEQ ID NO: 26666 - DNA, 15 bp, Artificial Sequence
  dgRNA
  Plekhm1
aagccctgcaatccg

SEQ ID NO: 26667 - DNA, 15 bp, Artificial Sequence
  dgRNA
  Tm4sf4
gtcataacattaatc

SEQ ID NO: 26668 - DNA, 15 bp, Artificial Sequence
  dgRNA
  Tm4sf4
gtggattattaacag

SEQ ID NO: 26669 - DNA, 15 bp, Artificial Sequence
  dgRNA
  Tm4sf4
actaagtgatctgct

SEQ ID NO: 26670 - DNA, 15 bp, Artificial Sequence
  dgRNA
  Tm4sf4
taaagaagtattccc

SEQ ID NO: 26671 - DNA, 15 bp, Artificial Sequence
  dgRNA
  Sec24d
tgccaccggctccgg

SEQ ID NO: 26672 - DNA, 15 bp, Artificial Sequence
  dgRNA
  Sec24d
ggcggggcctcgcga

SEQ ID NO: 26673 - DNA, 15 bp, Artificial Sequence
  dgRNA
  Sec24d
aaaagacccggaaag

SEQ ID NO: 26674 - DNA, 15 bp, Artificial Sequence
  dgRNA
  Sec24d
ggcgcgagaccgcag

SEQ ID NO: 26675 - DNA, 15 bp, Artificial Sequence
  dgRNA
  Lrrtm4
ccggggaagtttaca

SEQ ID NO: 26676 - DNA, 15 bp, Artificial Sequence
  dgRNA
  Lrrtm4
cggggaagtttacat

SEQ ID NO: 26677 - DNA, 15 bp, Artificial Sequence
  dgRNA
  Lrrtm4
ctacgggctcacatg

SEQ ID NO: 26678 - DNA, 15 bp, Artificial Sequence
  dgRNA
  Lrrtm4
tacgggctcacatgc

SEQ ID NO: 26679 - DNA, 15 bp, Artificial Sequence
  dgRNA
  Apex2
tcgtttgatcaagcc

SEQ ID NO: 26680 - DNA, 15 bp, Artificial Sequence
  dgRNA
  Apex2
cttgcgtcctgccgt

SEQ ID NO: 26681 - DNA, 15 bp, Artificial Sequence
  dgRNA
  Apex2
gcgtcctgccgtcgg

SEQ ID NO: 26682 - DNA, 15 bp, Artificial Sequence
  dgRNA
  Apex2
cgtcctgccgtcgga

SEQ ID NO: 26683 - DNA, 15 bp, Artificial Sequence
  dgRNA
  Lrp1b
gtcatattaaagcag

SEQ ID NO: 26684 - DNA, 15 bp, Artificial Sequence
  dgRNA
  Lrp1b
ggtcatattaaagca

SEQ ID NO: 26685 - DNA, 15 bp, Artificial Sequence
  dgRNA
  Lrp1b
aggtcatattaaagc

SEQ ID NO: 26686 - DNA, 15 bp, Artificial Sequence
  dgRNA
  Kcnip1
tctgcggtccccagg

SEQ ID NO: 26687 - DNA, 15 bp, Artificial Sequence
  dgRNA
  Kcnip1
accatcccccgcgcc

SEQ ID NO: 26688 - DNA, 15 bp, Artificial Sequence
  dgRNA
  Kcnip1
gaccgcagaggggcg

SEQ ID NO: 26689 - DNA, 15 bp, Artificial Sequence
  dgRNA
  Kcnip1
ggcggaggccgcctg

SEQ ID NO: 26690 - DNA, 15 bp, Artificial Sequence
  dgRNA
  0610007P14Rik
aagaggctcaggcgg

SEQ ID NO: 26691 - DNA, 15 bp, Artificial Sequence
  dgRNA
  0610007P14Rik
gcggcaactgctgat

SEQ ID NO: 26692 - DNA, 15 bp, Artificial Sequence
  dgRNA
  0610007P14Rik
tagccaatcagaacg

SEQ ID NO: 26693 - DNA, 15 bp, Artificial Sequence
  dgRNA
  0610007P14Rik
ggcccaggtggactt

SEQ ID NO: 26694 - DNA, 15 bp, Artificial Sequence
  dgRNA
  Zfp146
ggccaggtttgtgcg

SEQ ID NO: 26695 - DNA, 15 bp, Artificial Sequence
  dgRNA
  Zfp146
gccaggtttgtgcgt

SEQ ID NO: 26696 - DNA, 15 bp, Artificial Sequence
  dgRNA
  Zfp146
tttgtgcgtgggaga

SEQ ID NO: 26697 - DNA, 15 bp, Artificial Sequence
  dgRNA
  Zfp146
acccgcagtgccttg

SEQ ID NO: 26698 - DNA, 15 bp, Artificial Sequence
  dgRNA
  Cd22
tgctgtgcaaggtat

SEQ ID NO: 26699 - DNA, 15 bp, Artificial Sequence
  dgRNA
  Cd22
aggtatgggaaacct

SEQ ID NO: 26700 - DNA, 15 bp, Artificial Sequence
  dgRNA
  Cd22
tctgctctcggacac

SEQ ID NO: 26701 - DNA, 15 bp, Artificial Sequence
  dgRNA
  Cd22
atcctgcaagatccc

SEQ ID NO: 26702 - DNA, 15 bp, Artificial Sequence
  dgRNA
  Vps13a
cttcactctcgctcc

SEQ ID NO: 26703 - DNA, 15 bp, Artificial Sequence
  dgRNA
  Vps13a
cctccagttccgcgt

SEQ ID NO: 26704 - DNA, 15 bp, Artificial Sequence
  dgRNA
  Vps13a
cgagctgcgcacgcg

SEQ ID NO: 26705 - DNA, 15 bp, Artificial Sequence
  dgRNA
  Vps13a
cacgcgtggtgcgag

SEQ ID NO: 26706 - DNA, 15 bp, Artificial Sequence
  dgRNA
  Pdhb
gtcgaaactagccgt

SEQ ID NO: 26707 - DNA, 15 bp, Artificial Sequence
  dgRNA
  Pdhb
tggctacgcatgcag

SEQ ID NO: 26708 - DNA, 15 bp, Artificial Sequence
  dgRNA
  Pdhb
ctacgcatgcagagg

SEQ ID NO: 26709 - DNA, 15 bp, Artificial Sequence
  dgRNA
  Pdhb
tacgcatgcagaggc

SEQ ID NO: 26710 - DNA, 15 bp, Artificial Sequence
  dgRNA
  Tln2
atacattgcttaatg

SEQ ID NO: 26711 - DNA, 15 bp, Artificial Sequence
  dgRNA
  Tln2
atgtattagttagcc

SEQ ID NO: 26712 - DNA, 15 bp, Artificial Sequence
  dgRNA
  Dusp15
agcctacagcggcag

SEQ ID NO: 26713 - DNA, 15 bp, Artificial Sequence
  dgRNA
  Dusp15
ctacagcggcagcgg

SEQ ID NO: 26714 - DNA, 15 bp, Artificial Sequence
  dgRNA
  Dusp15
catcacttccctccg

SEQ ID NO: 26715 - DNA, 15 bp, Artificial Sequence
  dgRNA
  Dusp15
acttccctccggggc

SEQ ID NO: 26716 - DNA, 15 bp, Artificial Sequence
  dgRNA
  Synrg
gcattagtgcagatc

SEQ ID NO: 26717 - DNA, 15 bp, Artificial Sequence
  dgRNA
  Synrg
cattagtgcagatcc

SEQ ID NO: 26718 - DNA, 15 bp, Artificial Sequence
  dgRNA
  Synrg
tgcagaatgccaccg

SEQ ID NO: 26719 - DNA, 15 bp, Artificial Sequence
  dgRNA
  Synrg
cgccgctcgtgcccg

SEQ ID NO: 26720 - DNA, 15 bp, Artificial Sequence
  dgRNA
  Myo1a
gacccttctagtcag

SEQ ID NO: 26721 - DNA, 15 bp, Artificial Sequence
  dgRNA
  Myo1a
acccttctagtcaga

SEQ ID NO: 26722 - DNA, 15 bp, Artificial Sequence
  dgRNA
  Myo1a
cagaattgtgcttaa

SEQ ID NO: 26723 - DNA, 15 bp, Artificial Sequence
  dgRNA
  Myo1a
ggaacccggggtaga

SEQ ID NO: 26724 - DNA, 15 bp, Artificial Sequence
  dgRNA
  Zfy1
ggcgtgctgcgtgtc

SEQ ID NO: 26725 - DNA, 15 bp, Artificial Sequence
  dgRNA
  Zfy1
gcgtgctgcgtgtca

SEQ ID NO: 26726 - DNA, 15 bp, Artificial Sequence
  dgRNA
  Dmrtc1a
tcagctccaatcgcc

SEQ ID NO: 26727 - DNA, 15 bp, Artificial Sequence
  dgRNA
  Dmrtc1a
gaggaaccaggcgat

SEQ ID NO: 26728 - DNA, 15 bp, Artificial Sequence
  dgRNA
  Ppp1r1b
acgatgatgactgac

SEQ ID NO: 26729 - DNA, 15 bp, Artificial Sequence
  dgRNA
  Ppp1r1b
tcacactcgctttct

SEQ ID NO: 26730 - DNA, 15 bp, Artificial Sequence
  dgRNA
  Ppp1r1b
cacagcgtgacatgc

SEQ ID NO: 26731 - DNA, 15 bp, Artificial Sequence
  dgRNA
  Ppp1r1b
ctcttctcgacctca

SEQ ID NO: 26732 - DNA, 15 bp, Artificial Sequence
  dgRNA
  Herc4
ttagcgtcttagagc

SEQ ID NO: 26733 - DNA, 15 bp, Artificial Sequence
  dgRNA
  Herc4
tagcgtcttagagca

SEQ ID NO: 26734 - DNA, 15 bp, Artificial Sequence
  dgRNA
  Herc4
accgcaacactgcgc

SEQ ID NO: 26735 - DNA, 15 bp, Artificial Sequence
  dgRNA
  Herc4
ggatcagacgaaccc

SEQ ID NO: 26736 - DNA, 15 bp, Artificial Sequence
  dgRNA
  Parp4
cccagattcgaattt

SEQ ID NO: 26737 - DNA, 15 bp, Artificial Sequence
  dgRNA
  Parp4
ccagattcgaatttt

SEQ ID NO: 26738 - DNA, 15 bp, Artificial Sequence
  dgRNA
  Parp4
tgggtttactcctac

SEQ ID NO: 26739 - DNA, 15 bp, Artificial Sequence
  dgRNA
  Parp4
aaagtcctgaacgct

SEQ ID NO: 26740 - DNA, 15 bp, Artificial Sequence
  dgRNA
  Snx5
aggtcggtcagcggc

SEQ ID NO: 26741 - DNA, 15 bp, Artificial Sequence
  dgRNA
  Snx5
ggtcggtcagcggca

SEQ ID NO: 26742 - DNA, 15 bp, Artificial Sequence
  dgRNA
  Snx5
cgcaaacaaccctct

SEQ ID NO: 26743 - DNA, 15 bp, Artificial Sequence
  dgRNA
  Snx5
gcaaacaaccctctc

SEQ ID NO: 26744 - DNA, 15 bp, Artificial Sequence
  dgRNA
  Rpl34
aaaagcgagtgacag

SEQ ID NO: 26745 - DNA, 15 bp, Artificial Sequence
  dgRNA
  Aldh7a1
gcaactttacccaga

SEQ ID NO: 26746 - DNA, 15 bp, Artificial Sequence
  dgRNA
  Aldh7a1
tttacccagagggta

SEQ ID NO: 26747 - DNA, 15 bp, Artificial Sequence
  dgRNA
  Aldh7a1
cgcggacgaccccag

SEQ ID NO: 26748 - DNA, 15 bp, Artificial Sequence
  dgRNA
  Aldh7a1
cgaccccagcgggag

SEQ ID NO: 26749 - DNA, 15 bp, Artificial Sequence
  dgRNA
  Fam89b
gaggacacattgtat

SEQ ID NO: 26750 - DNA, 15 bp, Artificial Sequence
  dgRNA
  Fam89b
cgtttctgacccttt

SEQ ID NO: 26751 - DNA, 15 bp, Artificial Sequence
  dgRNA
  Fam89b
tgggtttttcgctcc

SEQ ID NO: 26752 - DNA, 15 bp, Artificial Sequence
  dgRNA
  Fam89b
gggtttttcgctcca

SEQ ID NO: 26753 - DNA, 15 bp, Artificial Sequence
  dgRNA
  Twsg1
gctgaaccgaaccgc

SEQ ID NO: 26754 - DNA, 15 bp, Artificial Sequence
  dgRNA
  Twsg1
ctgaaccgaaccgca

SEQ ID NO: 26755 - DNA, 15 bp, Artificial Sequence
  dgRNA
  Twsg1
ggtaagccgcccaac

SEQ ID NO: 26756 - DNA, 15 bp, Artificial Sequence
  dgRNA
  Twsg1
aagccgcccaacagg

SEQ ID NO: 26757 - DNA, 15 bp, Artificial Sequence
  dgRNA
  Hjurp
ttcaggaccgttatt

SEQ ID NO: 26758 - DNA, 15 bp, Artificial Sequence
  dgRNA
  Hjurp
accgttatttggatc

SEQ ID NO: 26759 - DNA, 15 bp, Artificial Sequence
  dgRNA
  Hjurp
ttggtagatccagga

SEQ ID NO: 26760 - DNA, 15 bp, Artificial Sequence
  dgRNA
  Hjurp
agcctctaggggacg

SEQ ID NO: 26761 - DNA, 15 bp, Artificial Sequence
  dgRNA
  Atp13a5
gtgattttagtacgg

SEQ ID NO: 26762 - DNA, 15 bp, Artificial Sequence
  dgRNA
  Atp13a5
tggcagggactacca

SEQ ID NO: 26763 - DNA, 15 bp, Artificial Sequence
  dgRNA
  Atp13a5
ggcagggactaccat

SEQ ID NO: 26764 - DNA, 15 bp, Artificial Sequence
  dgRNA
  Atp13a5
gtgcctccagaccaa

SEQ ID NO: 26765 - DNA, 15 bp, Artificial Sequence
  dgRNA
  Zc3h8
cactaaggaacgaat

SEQ ID NO: 26766 - DNA, 15 bp, Artificial Sequence
  dgRNA
  Zc3h8
gcgcgtgcgcagctc

SEQ ID NO: 26767 - DNA, 15 bp, Artificial Sequence
  dgRNA
  Zc3h8
agaactgcgcatgcg

SEQ ID NO: 26768 - DNA, 15 bp, Artificial Sequence
  dgRNA
  Zc3h8
ctgcgcatgcgtggt

SEQ ID NO: 26769 - DNA, 15 bp, Artificial Sequence
  dgRNA
  Grik4
agctaaagaccccgc

SEQ ID NO: 26770 - DNA, 15 bp, Artificial Sequence
  dgRNA
  Grik4
gaccccgccggcgag

SEQ ID NO: 26771 - DNA, 15 bp, Artificial Sequence
  dgRNA
  Grik4
ggcgagcggagactc

SEQ ID NO: 26772 - DNA, 15 bp, Artificial Sequence
  dgRNA
  Grik4
gagcggagactccgg

SEQ ID NO: 26773 - DNA, 15 bp, Artificial Sequence
  dgRNA
  Pde1b
agggggccctggccg

SEQ ID NO: 26774 - DNA, 15 bp, Artificial Sequence
  dgRNA
  Pde1b
gggggccctggccgg

SEQ ID NO: 26775 - DNA, 15 bp, Artificial Sequence
  dgRNA
  Pde1b
tgtggcagcgcacgg

SEQ ID NO: 26776 - DNA, 15 bp, Artificial Sequence
  dgRNA
  Pde1b
agcgcacggcggcgg

SEQ ID NO: 26777 - DNA, 15 bp, Artificial Sequence
  dgRNA
  Pcdhgb1
gacgctgttgaccaa

SEQ ID NO: 26778 - DNA, 15 bp, Artificial Sequence
  dgRNA
  Pcdhgb1
acgctgttgaccaaa

SEQ ID NO: 26779 - DNA, 15 bp, Artificial Sequence
  dgRNA
  Pcdhgb1
aacagcgtcgcctaa

SEQ ID NO: 26780 - DNA, 15 bp, Artificial Sequence
  dgRNA
  Skor1
tgcgcgactgagcag

SEQ ID NO: 26781 - DNA, 15 bp, Artificial Sequence
  dgRNA
  Skor1
gcgcgactgagcaga

SEQ ID NO: 26782 - DNA, 15 bp, Artificial Sequence
  dgRNA
  Skor1
cgcgactgagcagag

SEQ ID NO: 26783 - DNA, 15 bp, Artificial Sequence
  dgRNA
  Skor1
tgaagtccgggcttc

SEQ ID NO: 26784 - DNA, 15 bp, Artificial Sequence
  dgRNA
  Prmt10
gcagccgcactctcc

SEQ ID NO: 26785 - DNA, 15 bp, Artificial Sequence
  dgRNA
  Prmt10
gccgcactctccagg

SEQ ID NO: 26786 - DNA, 15 bp, Artificial Sequence
  dgRNA
  Prmt10
actccaagaccatag

SEQ ID NO: 26787 - DNA, 15 bp, Artificial Sequence
  dgRNA
  Prmt10
ctccaagaccatagt

SEQ ID NO: 26788 - DNA, 15 bp, Artificial Sequence
  dgRNA
  Ankrd13b
gctccctccgccgag

SEQ ID NO: 26789 - DNA, 15 bp, Artificial Sequence
  dgRNA
  Ankrd13b
aggcgtctttgtgtg

SEQ ID NO: 26790 - DNA, 15 bp, Artificial Sequence
  dgRNA
  Ankrd13b
ggcgtctttgtgtgc

SEQ ID NO: 26791 - DNA, 15 bp, Artificial Sequence
  dgRNA
  Ankrd13b
gcgtctttgtgtgcg

SEQ ID NO: 26792 - DNA, 15 bp, Artificial Sequence
  dgRNA
  Eva1b
ctagcaaagcaagcg

SEQ ID NO: 26793 - DNA, 15 bp, Artificial Sequence
  dgRNA
  Eva1b
tgttccctagcgccg

SEQ ID NO: 26794 - DNA, 15 bp, Artificial Sequence
  dgRNA
  Eva1b
cgccgaggcccccgc

SEQ ID NO: 26795 - DNA, 15 bp, Artificial Sequence
  dgRNA
  Eva1b
gccgaggcccccgct

SEQ ID NO: 26796 - DNA, 15 bp, Artificial Sequence
  dgRNA
  Tbck
ctcactcgctacatt

SEQ ID NO: 26797 - DNA, 15 bp, Artificial Sequence
  dgRNA
  Tbck
caagggacaggcggc

SEQ ID NO: 26798 - DNA, 15 bp, Artificial Sequence
  dgRNA
  Tbck
ggcggccggaagttt

SEQ ID NO: 26799 - DNA, 15 bp, Artificial Sequence
  dgRNA
  Tbck
gcggccggaagtttt

SEQ ID NO: 26800 - DNA, 15 bp, Artificial Sequence
  dgRNA
  Nt5c1b
cacatcaattcctac

SEQ ID NO: 26801 - DNA, 15 bp, Artificial Sequence
  dgRNA
  Nt5c1b
atcagttagttacca

SEQ ID NO: 26802 - DNA, 15 bp, Artificial Sequence
  dgRNA
  Nt5c1b
atctcttgcacctgt

SEQ ID NO: 26803 - DNA, 15 bp, Artificial Sequence
  dgRNA
  St18
gatatatgggcggtt

SEQ ID NO: 26804 - DNA, 15 bp, Artificial Sequence
  dgRNA
  St18
tatgggcggtttgga

SEQ ID NO: 26805 - DNA, 15 bp, Artificial Sequence
  dgRNA
  St18
aaggtctgaataggg

SEQ ID NO: 26806 - DNA, 15 bp, Artificial Sequence
  dgRNA
  St18
gggaggtgtgacgta

SEQ ID NO: 26807 - DNA, 15 bp, Artificial Sequence
  dgRNA
  6330403A02Rik
attgctggtgaacca

SEQ ID NO: 26808 - DNA, 15 bp, Artificial Sequence
  dgRNA
  6330403A02Rik
ttgctggtgaaccaa

SEQ ID NO: 26809 - DNA, 15 bp, Artificial Sequence
  dgRNA
  6330403A02Rik
ctcccgccctccgcc

SEQ ID NO: 26810 - DNA, 15 bp, Artificial Sequence
  dgRNA
  6330403A02Rik
gccctccgcccggag

SEQ ID NO: 26811 - DNA, 15 bp, Artificial Sequence
  dgRNA
  Scgn
acaacttaaacggaa

SEQ ID NO: 26812 - DNA, 15 bp, Artificial Sequence
  dgRNA
  Scgn
cagtgagccgtgaac

SEQ ID NO: 26813 - DNA, 15 bp, Artificial Sequence
  dgRNA
  Scgn
ccccctacagctaac

SEQ ID NO: 26814 - DNA, 15 bp, Artificial Sequence
  dgRNA
  Scgn
ctacagctaacaggc

SEQ ID NO: 26815 - DNA, 15 bp, Artificial Sequence
  dgRNA
  Ahctf1
cgcctatctgctcct

SEQ ID NO: 26816 - DNA, 15 bp, Artificial Sequence
  dgRNA
  Ahctf1
ctatctgctcctagg

SEQ ID NO: 26817 - DNA, 15 bp, Artificial Sequence
  dgRNA
  Ahctf1
ttcccggcgtcgtct

SEQ ID NO: 26818 - DNA, 15 bp, Artificial Sequence
  dgRNA
  Ahctf1
ttctccctttgcgaa

SEQ ID NO: 26819 - DNA, 15 bp, Artificial Sequence
  dgRNA
  Rfesd
gcctgatggagggac

SEQ ID NO: 26820 - DNA, 15 bp, Artificial Sequence
  dgRNA
  Rfesd
aaactcgcgtcgcgc

SEQ ID NO: 26821 - DNA, 15 bp, Artificial Sequence
  dgRNA
  Rfesd
tcaaagaacgataat

SEQ ID NO: 26822 - DNA, 15 bp, Artificial Sequence
  dgRNA
  Rfesd
tcccgtccctccatc

SEQ ID NO: 26823 - DNA, 15 bp, Artificial Sequence
  dgRNA
  Sox5
tagccagaccgctgc

SEQ ID NO: 26824 - DNA, 15 bp, Artificial Sequence
  dgRNA
  Sox5
acccctttaagagaa

SEQ ID NO: 26825 - DNA, 15 bp, Artificial Sequence
  dgRNA
  Sox5
cttccagcagcggtc

SEQ ID NO: 26826 - DNA, 15 bp, Artificial Sequence
  dgRNA
  Sox5
gtacacttccagcag

SEQ ID NO: 26827 - DNA, 15 bp, Artificial Sequence
  dgRNA
  Fbxl7
cgggggtgccaggag

SEQ ID NO: 26828 - DNA, 15 bp, Artificial Sequence
  dgRNA
  Fbxl7
ggtcgcagagcactg

SEQ ID NO: 26829 - DNA, 15 bp, Artificial Sequence
  dgRNA
  Fbxl7
cccccaagcccaaat

SEQ ID NO: 26830 - DNA, 15 bp, Artificial Sequence
  dgRNA
  Fbxl7
gcccaaatcggccct

SEQ ID NO: 26831 - DNA, 15 bp, Artificial Sequence
  dgRNA
  App
accccatcgggagcg

SEQ ID NO: 26832 - DNA, 15 bp, Artificial Sequence
  dgRNA
  App
aagacgccgcacctg

SEQ ID NO: 26833 - DNA, 15 bp, Artificial Sequence
  dgRNA
  App
agacgccgcacctgt

SEQ ID NO: 26834 - DNA, 15 bp, Artificial Sequence
  dgRNA
  App
cgcacctgtgggctc

SEQ ID NO: 26835 - DNA, 15 bp, Artificial Sequence
  dgRNA
  M6pr
agcccagccgactga

SEQ ID NO: 26836 - DNA, 15 bp, Artificial Sequence
  dgRNA
  M6pr
agagagcttcgggcg

SEQ ID NO: 26837 - DNA, 15 bp, Artificial Sequence
  dgRNA
  M6pr
gagagcttcgggcga

SEQ ID NO: 26838 - DNA, 15 bp, Artificial Sequence
  dgRNA
  M6pr
agccatcagtcggct

SEQ ID NO: 26839 - DNA, 15 bp, Artificial Sequence
  dgRNA
  Ttc36
ccaggtcagtaaccc

SEQ ID NO: 26840 - DNA, 15 bp, Artificial Sequence
  dgRNA
  Ttc36
cctattaaacgagtt

SEQ ID NO: 26841 - DNA, 15 bp, Artificial Sequence
  dgRNA
  Ttc36
gtttcagctttaagg

SEQ ID NO: 26842 - DNA, 15 bp, Artificial Sequence
  dgRNA
  Ttc36
cctgtttcagcttta

SEQ ID NO: 26843 - DNA, 15 bp, Artificial Sequence
  dgRNA
  Olfr463
gccccgcatgcttat

SEQ ID NO: 26844 - DNA, 15 bp, Artificial Sequence
  dgRNA
  Olfr463
ccccgcatgcttata

SEQ ID NO: 26845 - DNA, 15 bp, Artificial Sequence
  dgRNA
  Olfr463
gcatgcttatagggc

SEQ ID NO: 26846 - DNA, 15 bp, Artificial Sequence
  dgRNA
  Olfr463
cgggtaaatggatat

SEQ ID NO: 26847 - DNA, 15 bp, Artificial Sequence
  dgRNA
  Pcdhga10
gctgaaatattatag

SEQ ID NO: 26848 - DNA, 15 bp, Artificial Sequence
  dgRNA
  Pcdhga10
cgctgttcacctacg

SEQ ID NO: 26849 - DNA, 15 bp, Artificial Sequence
  dgRNA
  Pcdhga10
caccggagcacagtt

SEQ ID NO: 26850 - DNA, 15 bp, Artificial Sequence
  dgRNA
  Pcdhga10
gcttcacatttacgt

SEQ ID NO: 26851 - DNA, 15 bp, Artificial Sequence
  dgRNA
  Plet1
ttggtagaggatcgt

SEQ ID NO: 26852 - DNA, 15 bp, Artificial Sequence
  dgRNA
  Plet1
cgttggtcacaaaag

SEQ ID NO: 26853 - DNA, 15 bp, Artificial Sequence
  dgRNA
  Plet1
tggtcacaaaagtgg

SEQ ID NO: 26854 - DNA, 15 bp, Artificial Sequence
  dgRNA
  Plet1
ggcaatgttttcagg

SEQ ID NO: 26855 - DNA, 15 bp, Artificial Sequence
  dgRNA
  Tbcb
gggcctcaccattcc

SEQ ID NO: 26856 - DNA, 15 bp, Artificial Sequence
  dgRNA
  Tbcb
aatacccacgaagcc

SEQ ID NO: 26857 - DNA, 15 bp, Artificial Sequence
  dgRNA
  Tbcb
gctcgtacgtcccgt

SEQ ID NO: 26858 - DNA, 15 bp, Artificial Sequence
  dgRNA
  Tbcb
ctcgtacgtcccgtc

SEQ ID NO: 26859 - DNA, 15 bp, Artificial Sequence
  dgRNA
  Slc26a9
aaagggctgttcatt

SEQ ID NO: 26860 - DNA, 15 bp, Artificial Sequence
  dgRNA
  Slc26a9
ccttaggcttagctc

SEQ ID NO: 26861 - DNA, 15 bp, Artificial Sequence
  dgRNA
  Slc26a9
gccaatcagaagccg

SEQ ID NO: 26862 - DNA, 15 bp, Artificial Sequence
  dgRNA
  Slc26a9
gccggggctcactgg

SEQ ID NO: 26863 - DNA, 15 bp, Artificial Sequence
  dgRNA
  Lipa
tgggctgaatctttt

SEQ ID NO: 26864 - DNA, 15 bp, Artificial Sequence
  dgRNA
  Lipa
ttttgggcgaacaga

SEQ ID NO: 26865 - DNA, 15 bp, Artificial Sequence
  dgRNA
  Lipa
gagtccgcttcccca

SEQ ID NO: 26866 - DNA, 15 bp, Artificial Sequence
  dgRNA
  Lipa
ccagggctaggccga

SEQ ID NO: 26867 - DNA, 15 bp, Artificial Sequence
  dgRNA
  Pank1
agacggctggtgtag

SEQ ID NO: 26868 - DNA, 15 bp, Artificial Sequence
  dgRNA
  Pank1
gacggctggtgtaga

SEQ ID NO: 26869 - DNA, 15 bp, Artificial Sequence
  dgRNA
  Pank1
tgacaccatgtgggc

SEQ ID NO: 26870 - DNA, 15 bp, Artificial Sequence
  dgRNA
  Pank1
ccatgtgggccggaa

SEQ ID NO: 26871 - DNA, 15 bp, Artificial Sequence
  dgRNA
  Rabep1
cggaggtcggcgctc

SEQ ID NO: 26872 - DNA, 15 bp, Artificial Sequence
  dgRNA
  Rabep1
gtccgtctctgcccg

SEQ ID NO: 26873 - DNA, 15 bp, Artificial Sequence
  dgRNA
  Rabep1
cggctccagccttag

SEQ ID NO: 26874 - DNA, 15 bp, Artificial Sequence
  dgRNA
  Rabep1
ttagcggttcctccc

SEQ ID NO: 26875 - DNA, 15 bp, Artificial Sequence
  dgRNA
  Eme2
gagctgcgaatctcg

SEQ ID NO: 26876 - DNA, 15 bp, Artificial Sequence
  dgRNA
  Eme2
tgcgaatctcgcggc

SEQ ID NO: 26877 - DNA, 15 bp, Artificial Sequence
  dgRNA
  Eme2
tccgctgctcgcgca

SEQ ID NO: 26878 - DNA, 15 bp, Artificial Sequence
  dgRNA
  Eme2
cgcaaggcgcgcacg

SEQ ID NO: 26879 - DNA, 15 bp, Artificial Sequence
  dgRNA
  Eif1a
cagcgagcacctacg

SEQ ID NO: 26880 - DNA, 15 bp, Artificial Sequence
  dgRNA
  Eif1a
gagcacctacgcgga

SEQ ID NO: 26881 - DNA, 15 bp, Artificial Sequence
  dgRNA
  Eif1a
agcacctacgcggaa

SEQ ID NO: 26882 - DNA, 15 bp, Artificial Sequence
  dgRNA
  Eif1a
gcacctacgcggaag

SEQ ID NO: 26883 - DNA, 15 bp, Artificial Sequence
  dgRNA
  Shisa9
ctgagccgagcgcag

SEQ ID NO: 26884 - DNA, 15 bp, Artificial Sequence
  dgRNA
  Shisa9
tgcatgtgcggccag

SEQ ID NO: 26885 - DNA, 15 bp, Artificial Sequence
  dgRNA
  Shisa9
atgtgcggccagcgg

SEQ ID NO: 26886 - DNA, 15 bp, Artificial Sequence
  dgRNA
  Shisa9
cggccgcgcgtccag

SEQ ID NO: 26887 - DNA, 15 bp, Artificial Sequence
  dgRNA
  Pmp22
gggatcactctatcc

SEQ ID NO: 26888 - DNA, 15 bp, Artificial Sequence
  dgRNA
  Pmp22
gacatatcccagcat

SEQ ID NO: 26889 - DNA, 15 bp, Artificial Sequence
  dgRNA
  Pmp22
agcccctgaataaac

SEQ ID NO: 26890 - DNA, 15 bp, Artificial Sequence
  dgRNA
  Pmp22
actggaaagacgcct

SEQ ID NO: 26891 - DNA, 15 bp, Artificial Sequence
  dgRNA
  Fkbp9
gatccgctgccacgt

SEQ ID NO: 26892 - DNA, 15 bp, Artificial Sequence
  dgRNA
  Fkbp9
ctccatatcgtctct

SEQ ID NO: 26893 - DNA, 15 bp, Artificial Sequence
  dgRNA
  Fkbp9
tccatatcgtctctt

SEQ ID NO: 26894 - DNA, 15 bp, Artificial Sequence
  dgRNA
  Fkbp9
ggatccgcagtgctc

SEQ ID NO: 26895 - DNA, 15 bp, Artificial Sequence
  dgRNA
  Abhd13
ctccgaaatgtgttc

SEQ ID NO: 26896 - DNA, 15 bp, Artificial Sequence
  dgRNA
  Abhd13
tgtatcttgccccta

SEQ ID NO: 26897 - DNA, 15 bp, Artificial Sequence
  dgRNA
  Abhd13
gtatcttgcccctac

SEQ ID NO: 26898 - DNA, 15 bp, Artificial Sequence
  dgRNA
  Abhd13
acatttcggagaaca

SEQ ID NO: 26899 - DNA, 15 bp, Artificial Sequence
  dgRNA
  Ttyh1
acccttcacctgcac

SEQ ID NO: 26900 - DNA, 15 bp, Artificial Sequence
  dgRNA
  Ttyh1
agagggcggagcaac

SEQ ID NO: 26901 - DNA, 15 bp, Artificial Sequence
  dgRNA
  Ttyh1
acgccgcattgcctc

SEQ ID NO: 26902 - DNA, 15 bp, Artificial Sequence
  dgRNA
  Ttyh1
tccggtgaccgccag

SEQ ID NO: 26903 - DNA, 15 bp, Artificial Sequence
  dgRNA
  Nat14
ggctaaatgcttctc

SEQ ID NO: 26904 - DNA, 15 bp, Artificial Sequence
  dgRNA
  Nat14
ctaaatgcttctccg

SEQ ID NO: 26905 - DNA, 15 bp, Artificial Sequence
  dgRNA
  Nat14
aatgcttctccgggg

SEQ ID NO: 26906 - DNA, 15 bp, Artificial Sequence
  dgRNA
  Nat14
atgcttctccggggt

SEQ ID NO: 26907 - DNA, 15 bp, Artificial Sequence
  dgRNA
  Ube2d2a
acgtcatcccctctg

SEQ ID NO: 26908 - DNA, 15 bp, Artificial Sequence
  dgRNA
  Ube2d2a
cggctgtgcttgcgc

SEQ ID NO: 26909 - DNA, 15 bp, Artificial Sequence
  dgRNA
  Ube2d2a
cgccggcgcctgcgc

SEQ ID NO: 26910 - DNA, 15 bp, Artificial Sequence
  dgRNA
  Ube2d2a
cctgcgccggcgcgt

SEQ ID NO: 26911 - DNA, 15 bp, Artificial Sequence
  dgRNA
  Tsr2
tattaggatttactg

SEQ ID NO: 26912 - DNA, 15 bp, Artificial Sequence
  dgRNA
  Tsr2
agcatctaccactga

SEQ ID NO: 26913 - DNA, 15 bp, Artificial Sequence
  dgRNA
  Tsr2
cgtttcccactgttc

SEQ ID NO: 26914 - DNA, 15 bp, Artificial Sequence
  dgRNA
  Tsr2
ccacgttctgagaat

SEQ ID NO: 26915 - DNA, 15 bp, Artificial Sequence
  dgRNA
  Mitf
cacgttgtctctccc

SEQ ID NO: 26916 - DNA, 15 bp, Artificial Sequence
  dgRNA
  Mitf
cccggtttgaccttc

SEQ ID NO: 26917 - DNA, 15 bp, Artificial Sequence
  dgRNA
  Mitf
ccggtttgaccttct

SEQ ID NO: 26918 - DNA, 15 bp, Artificial Sequence
  dgRNA
  Mitf
cggaagctgatatcc

SEQ ID NO: 26919 - DNA, 15 bp, Artificial Sequence
  dgRNA
  Tmem108
tagcaaccgaacccc

SEQ ID NO: 26920 - DNA, 15 bp, Artificial Sequence
  dgRNA
  Tmem108
agcaaccgaaccccc

SEQ ID NO: 26921 - DNA, 15 bp, Artificial Sequence
  dgRNA
  Tmem108
gcaaccgaacccccg

SEQ ID NO: 26922 - DNA, 15 bp, Artificial Sequence
  dgRNA
  Tmem108
aacccccggggacat

SEQ ID NO: 26923 - DNA, 15 bp, Artificial Sequence
  dgRNA
  Rab39b
taataggagagtggt

SEQ ID NO: 26924 - DNA, 15 bp, Artificial Sequence
  dgRNA
  Rab39b
cacacaaaaacggac

SEQ ID NO: 26925 - DNA, 15 bp, Artificial Sequence
  dgRNA
  Agr3
tcttaatttagagcg

SEQ ID NO: 26926 - DNA, 15 bp, Artificial Sequence
  dgRNA
  Papd5
gcactcgcgacccag

SEQ ID NO: 26927 - DNA, 15 bp, Artificial Sequence
  dgRNA
  Papd5
ccgctgagaccgctc

SEQ ID NO: 26928 - DNA, 15 bp, Artificial Sequence
  dgRNA
  Papd5
agccgcgtgctaacc

SEQ ID NO: 26929 - DNA, 15 bp, Artificial Sequence
  dgRNA
  Papd5
aacccggcccttgag

SEQ ID NO: 26930 - DNA, 15 bp, Artificial Sequence
  dgRNA
  Exosc7
cgccagcgtccgcga

SEQ ID NO: 26931 - DNA, 15 bp, Artificial Sequence
  dgRNA
  Exosc7
gcgtccgcgatggca

SEQ ID NO: 26932 - DNA, 15 bp, Artificial Sequence
  dgRNA
  Exosc7
cgtccgcgatggcac

SEQ ID NO: 26933 - DNA, 15 bp, Artificial Sequence
  dgRNA
  Exosc7
gatggcacgggcacc

SEQ ID NO: 26934 - DNA, 15 bp, Artificial Sequence
  dgRNA
  Antxr1
attccgccccagcca

SEQ ID NO: 26935 - DNA, 15 bp, Artificial Sequence
  dgRNA
  Antxr1
cccagccaaggtcta

SEQ ID NO: 26936 - DNA, 15 bp, Artificial Sequence
  dgRNA
  Antxr1
ccagccaaggtctag

SEQ ID NO: 26937 - DNA, 15 bp, Artificial Sequence
  dgRNA
  Antxr1
cattttcgccgccct

SEQ ID NO: 26938 - DNA, 15 bp, Artificial Sequence
  dgRNA
  Fubp3
cagcgggggactata

SEQ ID NO: 26939 - DNA, 15 bp, Artificial Sequence
  dgRNA
  Fubp3
gccgcacctgcgccg

SEQ ID NO: 26940 - DNA, 15 bp, Artificial Sequence
  dgRNA
  Fubp3
cctgcgccgcggtgg

SEQ ID NO: 26941 - DNA, 15 bp, Artificial Sequence
  dgRNA
  Fubp3
tcccacgcttgctaa

SEQ ID NO: 26942 - DNA, 15 bp, Artificial Sequence
  dgRNA
  Spp1
gagacatcagatagt

SEQ ID NO: 26943 - DNA, 15 bp, Artificial Sequence
  dgRNA
  Spp1
gacatcagatagtgg

SEQ ID NO: 26944 - DNA, 15 bp, Artificial Sequence
  dgRNA
  Spp1
tccagacgtaaagtt

SEQ ID NO: 26945 - DNA, 15 bp, Artificial Sequence
  dgRNA
  Spp1
tccaaactttacgtc

SEQ ID NO: 26946 - DNA, 15 bp, Artificial Sequence
  dgRNA
  Pcp2
gcctggtctcaatct

SEQ ID NO: 26947 - DNA, 15 bp, Artificial Sequence
  dgRNA
  Pcp2
gtgaaattgtgctgc

SEQ ID NO: 26948 - DNA, 15 bp, Artificial Sequence
  dgRNA
  Pcp2
cctactatctcttgg

SEQ ID NO: 26949 - DNA, 15 bp, Artificial Sequence
  dgRNA
  Pcp2
tacctactatctctt

SEQ ID NO: 26950 - DNA, 15 bp, Artificial Sequence
  dgRNA
  Olfr707
catattgtgaaagac

SEQ ID NO: 26951 - DNA, 15 bp, Artificial Sequence
  dgRNA
  Gab3
cgtcgctcagcaact

SEQ ID NO: 26952 - DNA, 15 bp, Artificial Sequence
  dgRNA
  Gab3
gtcgctcagcaactt

SEQ ID NO: 26953 - DNA, 15 bp, Artificial Sequence
  dgRNA
  Gab3
tcgctcagcaacttg

SEQ ID NO: 26954 - DNA, 15 bp, Artificial Sequence
  dgRNA
  Gab3
ggggcggcgctatgt

SEQ ID NO: 26955 - DNA, 15 bp, Artificial Sequence
  dgRNA
  Setx
gcggacgttggggag

SEQ ID NO: 26956 - DNA, 15 bp, Artificial Sequence
  dgRNA
  Setx
agcggaagagcccaa

SEQ ID NO: 26957 - DNA, 15 bp, Artificial Sequence
  dgRNA
  Setx
gcggaagagcccaaa

SEQ ID NO: 26958 - DNA, 15 bp, Artificial Sequence
  dgRNA
  Setx
agcatctccccgaag

SEQ ID NO: 26959 - DNA, 15 bp, Artificial Sequence
  dgRNA
  Cntnap2
ctcggttctttcctg

SEQ ID NO: 26960 - DNA, 15 bp, Artificial Sequence
  dgRNA
  Cntnap2
cacacacgcgtcctt

SEQ ID NO: 26961 - DNA, 15 bp, Artificial Sequence
  dgRNA
  Cntnap2
cccctggcatttcac

SEQ ID NO: 26962 - DNA, 15 bp, Artificial Sequence
  dgRNA
  Cntnap2
cgagagcgatgggtc

SEQ ID NO: 26963 - DNA, 15 bp, Artificial Sequence
  dgRNA
  Cyp2b23
tgtgggcaatagaat

SEQ ID NO: 26964 - DNA, 15 bp, Artificial Sequence
  dgRNA
  Cyp2b23
cccaaacacgaagta

SEQ ID NO: 26965 - DNA, 15 bp, Artificial Sequence
  dgRNA
  Cyp2b23
cggggccagcataaa

SEQ ID NO: 26966 - DNA, 15 bp, Artificial Sequence
  dgRNA
  Cyp2b23
cataaaaggttctgc

SEQ ID NO: 26967 - DNA, 15 bp, Artificial Sequence
  dgRNA
  Mmp15
agataggagctaagc

SEQ ID NO: 26968 - DNA, 15 bp, Artificial Sequence
  dgRNA
  Mmp15
taagcaggctaggag

SEQ ID NO: 26969 - DNA, 15 bp, Artificial Sequence
  dgRNA
  Mmp15
aggtttactgccatc

SEQ ID NO: 26970 - DNA, 15 bp, Artificial Sequence
  dgRNA
  Mmp15
ctgccgggtcaccgc

SEQ ID NO: 26971 - DNA, 15 bp, Artificial Sequence
  dgRNA
  Glyatl3
cctcattaggtgcag

SEQ ID NO: 26972 - DNA, 15 bp, Artificial Sequence
  dgRNA
  Glyatl3
aactatatggacatg

SEQ ID NO: 26973 - DNA, 15 bp, Artificial Sequence
  dgRNA
  Glyatl3
caactatatggacat

SEQ ID NO: 26974 - DNA, 15 bp, Artificial Sequence
  dgRNA
  Glyatl3
gcaactatatggaca

SEQ ID NO: 26975 - DNA, 15 bp, Artificial Sequence
  dgRNA
  Cstf2
cggggccgagccgcc

SEQ ID NO: 26976 - DNA, 15 bp, Artificial Sequence
  dgRNA
  Cstf2
ggccgagccgcctgg

SEQ ID NO: 26977 - DNA, 15 bp, Artificial Sequence
  dgRNA
  Cstf2
gccgagccgcctggc

SEQ ID NO: 26978 - DNA, 15 bp, Artificial Sequence
  dgRNA
  Cstf2
tcggccccgggggag

SEQ ID NO: 26979 - DNA, 15 bp, Artificial Sequence
  dgRNA
  Ccdc116
ctatacttagctggc

SEQ ID NO: 26980 - DNA, 15 bp, Artificial Sequence
  dgRNA
  Ccdc116
aaaaaatccaacggg

SEQ ID NO: 26981 - DNA, 15 bp, Artificial Sequence
  dgRNA
  Ccdc116
aaaaatccaacgggt

SEQ ID NO: 26982 - DNA, 15 bp, Artificial Sequence
  dgRNA
  Ccdc116
aaaatccaacgggtg

SEQ ID NO: 26983 - DNA, 15 bp, Artificial Sequence
  dgRNA
  Txndc11
gagtcgctacaagag

SEQ ID NO: 26984 - DNA, 15 bp, Artificial Sequence
  dgRNA
  Txndc11
caagagaggcgggac

SEQ ID NO: 26985 - DNA, 15 bp, Artificial Sequence
  dgRNA
  Txndc11
gagaggcgggaccgg

SEQ ID NO: 26986 - DNA, 15 bp, Artificial Sequence
  dgRNA
  Txndc11
ggcgggaccggtgga

SEQ ID NO: 26987 - DNA, 15 bp, Artificial Sequence
  dgRNA
  Filip1l
ctcatgtgcgtatcc

SEQ ID NO: 26988 - DNA, 15 bp, Artificial Sequence
  dgRNA
  Filip1l
tgctctccagattaa

SEQ ID NO: 26989 - DNA, 15 bp, Artificial Sequence
  dgRNA
  Filip1l
gcaggtaatcgctct

SEQ ID NO: 26990 - DNA, 15 bp, Artificial Sequence
  dgRNA
  Cnn2
tcccgcaactacaaa

SEQ ID NO: 26991 - DNA, 15 bp, Artificial Sequence
  dgRNA
  Cnn2
cccgcaactacaaac

SEQ ID NO: 26992 - DNA, 15 bp, Artificial Sequence
  dgRNA
  Cnn2
ctacaaacgggacgg

SEQ ID NO: 26993 - DNA, 15 bp, Artificial Sequence
  dgRNA
  Cnn2
tacaaacgggacggc

SEQ ID NO: 26994 - DNA, 15 bp, Artificial Sequence
  dgRNA
  Klk10
acccacgttataatt

SEQ ID NO: 26995 - DNA, 15 bp, Artificial Sequence
  dgRNA
  Klk10
cccacgttataatta

SEQ ID NO: 26996 - DNA, 15 bp, Artificial Sequence
  dgRNA
  Klk10
gttataattagggag

SEQ ID NO: 26997 - DNA, 15 bp, Artificial Sequence
  dgRNA
  Klk10
ggggccctggaatac

SEQ ID NO: 26998 - DNA, 15 bp, Artificial Sequence
  dgRNA
  Ska1
cccactgaaagcgcc

SEQ ID NO: 26999 - DNA, 15 bp, Artificial Sequence
  dgRNA
  Ska1
gagccaatcaagccc

SEQ ID NO: 27000 - DNA, 15 bp, Artificial Sequence
  dgRNA
  Ska1
ccgcccacgaccccg

SEQ ID NO: 27001 - DNA, 15 bp, Artificial Sequence
  dgRNA
  Ska1
gagcagctcaaaaag

SEQ ID NO: 27002 - DNA, 15 bp, Artificial Sequence
  dgRNA
  Svs2
acactttgtttgcaa

SEQ ID NO: 27003 - DNA, 15 bp, Artificial Sequence
  dgRNA
  Svs2
atgcgataaagtcag

SEQ ID NO: 27004 - DNA, 15 bp, Artificial Sequence
  dgRNA
  Svs2
gataaagatctactg

SEQ ID NO: 27005 - DNA, 15 bp, Artificial Sequence
  dgRNA
  Svs2
atctactgaggctta

SEQ ID NO: 27006 - DNA, 15 bp, Artificial Sequence
  dgRNA
  Caprin1
cctctcgttctcgca

SEQ ID NO: 27007 - DNA, 15 bp, Artificial Sequence
  dgRNA
  Caprin1
gttctcgcaaggcaa

SEQ ID NO: 27008 - DNA, 15 bp, Artificial Sequence
  dgRNA
  Caprin1
ttctcgcaaggcaac

SEQ ID NO: 27009 - DNA, 15 bp, Artificial Sequence
  dgRNA
  Caprin1
tgccacttgccccga

SEQ ID NO: 27010 - DNA, 15 bp, Artificial Sequence
  dgRNA
  Jmy
cgcagccacagactc

SEQ ID NO: 27011 - DNA, 15 bp, Artificial Sequence
  dgRNA
  Jmy
ccacagactccgggc

SEQ ID NO: 27012 - DNA, 15 bp, Artificial Sequence
  dgRNA
  Jmy
cacagactccgggcc

SEQ ID NO: 27013 - DNA, 15 bp, Artificial Sequence
  dgRNA
  Jmy
tccgggccgggaaaa

SEQ ID NO: 27014 - DNA, 15 bp, Artificial Sequence
  dgRNA
  Meaf6
gtagtgaatgtctgt

SEQ ID NO: 27015 - DNA, 15 bp, Artificial Sequence
  dgRNA
  Meaf6
gtctgttaagctcag

SEQ ID NO: 27016 - DNA, 15 bp, Artificial Sequence
  dgRNA
  Meaf6
agcgcctctccgcgc

SEQ ID NO: 27017 - DNA, 15 bp, Artificial Sequence
  dgRNA
  Meaf6
tttcgcgcgctgagc

SEQ ID NO: 27018 - DNA, 15 bp, Artificial Sequence
  dgRNA
  Sccpdh
tggccagattgatgc

SEQ ID NO: 27019 - DNA, 15 bp, Artificial Sequence
  dgRNA
  Sccpdh
attgatgcgggtagc

SEQ ID NO: 27020 - DNA, 15 bp, Artificial Sequence
  dgRNA
  Sccpdh
ttgatgcgggtagcc

SEQ ID NO: 27021 - DNA, 15 bp, Artificial Sequence
  dgRNA
  Sccpdh
atgcgggtagccggg

SEQ ID NO: 27022 - DNA, 15 bp, Artificial Sequence
  dgRNA
  Cxx1b
aacacgcctgcgcat

SEQ ID NO: 27023 - DNA, 15 bp, Artificial Sequence
  dgRNA
  Cxx1b
acacgcctgcgcatt

SEQ ID NO: 27024 - DNA, 15 bp, Artificial Sequence
  dgRNA
  Cxx1b
cattgggtagcacta

SEQ ID NO: 27025 - DNA, 15 bp, Artificial Sequence
  dgRNA
  Cxx1b
tctcccacgcacttc

SEQ ID NO: 27026 - DNA, 15 bp, Artificial Sequence
  dgRNA
  Tmem27
tcgtaaataactgac

SEQ ID NO: 27027 - DNA, 15 bp, Artificial Sequence
  dgRNA
  Tmem27
cgtaaataactgaca

SEQ ID NO: 27028 - DNA, 15 bp, Artificial Sequence
  dgRNA
  Tmem27
gtaaataactgacag

SEQ ID NO: 27029 - DNA, 15 bp, Artificial Sequence
  dgRNA
  Tmem27
gatggttcgcttcta

SEQ ID NO: 27030 - DNA, 15 bp, Artificial Sequence
  dgRNA
  Top1
taccacgtggccgcc

SEQ ID NO: 27031 - DNA, 15 bp, Artificial Sequence
  dgRNA
  Top1
accacgtggccgccc

SEQ ID NO: 27032 - DNA, 15 bp, Artificial Sequence
  dgRNA
  Top1
ccgcccgggtgtcca

SEQ ID NO: 27033 - DNA, 15 bp, Artificial Sequence
  dgRNA
  Top1
gcgtgctgctagagc

SEQ ID NO: 27034 - DNA, 15 bp, Artificial Sequence
  dgRNA
  Gorab
tggaacgtgtagcag

SEQ ID NO: 27035 - DNA, 15 bp, Artificial Sequence
  dgRNA
  Gorab
tgtgagtggaagcga

SEQ ID NO: 27036 - DNA, 15 bp, Artificial Sequence
  dgRNA
  Gorab
gtagtccaccgagtc

SEQ ID NO: 27037 - DNA, 15 bp, Artificial Sequence
  dgRNA
  Gorab
ctttcaggcatcgct

SEQ ID NO: 27038 - DNA, 15 bp, Artificial Sequence
  dgRNA
  Sipa1
tgactgggctaggac

SEQ ID NO: 27039 - DNA, 15 bp, Artificial Sequence
  dgRNA
  Sipa1
acttcaggctgtccg

SEQ ID NO: 27040 - DNA, 15 bp, Artificial Sequence
  dgRNA
  Sipa1
ctaggttcctgtcgg

SEQ ID NO: 27041 - DNA, 15 bp, Artificial Sequence
  dgRNA
  Sipa1
gccttagacagctcc

SEQ ID NO: 27042 - DNA, 15 bp, Artificial Sequence
  dgRNA
  Olfm5
ggtgacttcaaacat

SEQ ID NO: 27043 - DNA, 15 bp, Artificial Sequence
  dgRNA
  Olfm5
gtaaagggtcttgaa

SEQ ID NO: 27044 - DNA, 15 bp, Artificial Sequence
  dgRNA
  Olfm5
gctaagatatgtaaa

SEQ ID NO: 27045 - DNA, 15 bp, Artificial Sequence
  dgRNA
  Olfm5
ggctaagatatgtaa

SEQ ID NO: 27046 - DNA, 15 bp, Artificial Sequence
  dgRNA
  Wdfy3
ctgcgcgcctgtcca

SEQ ID NO: 27047 - DNA, 15 bp, Artificial Sequence
  dgRNA
  Wdfy3
agggtgccggcaagc

SEQ ID NO: 27048 - DNA, 15 bp, Artificial Sequence
  dgRNA
  Wdfy3
gcaggagccgcggcg

SEQ ID NO: 27049 - DNA, 15 bp, Artificial Sequence
  dgRNA
  Wdfy3
caggagccgcggcga

SEQ ID NO: 27050 - DNA, 15 bp, Artificial Sequence
  dgRNA
  Tanc1
agggggcgaaggcgc

SEQ ID NO: 27051 - DNA, 15 bp, Artificial Sequence
  dgRNA
  Tanc1
gggggcgaaggcgcc

SEQ ID NO: 27052 - DNA, 15 bp, Artificial Sequence
  dgRNA
  Tanc1
ggcgaaggcgccggg

SEQ ID NO: 27053 - DNA, 15 bp, Artificial Sequence
  dgRNA
  Tanc1
cgccgggaggaaagt

SEQ ID NO: 27054 - DNA, 15 bp, Artificial Sequence
  dgRNA
  Syn1
gaagaggttgcggcg

SEQ ID NO: 27055 - DNA, 15 bp, Artificial Sequence
  dgRNA
  Syn1
tcggattcagcaccg

SEQ ID NO: 27056 - DNA, 15 bp, Artificial Sequence
  dgRNA
  Syn1
cttcgcctccgctgc

SEQ ID NO: 27057 - DNA, 15 bp, Artificial Sequence
  dgRNA
  Syn1
ccttcctcgccgcct

SEQ ID NO: 27058 - DNA, 15 bp, Artificial Sequence
  dgRNA
  Pde4a
gtttgctgctccaaa

SEQ ID NO: 27059 - DNA, 15 bp, Artificial Sequence
  dgRNA
  Pde4a
gagattggcgcgcgt

SEQ ID NO: 27060 - DNA, 15 bp, Artificial Sequence
  dgRNA
  Pde4a
ttggcgccccctccc

SEQ ID NO: 27061 - DNA, 15 bp, Artificial Sequence
  dgRNA
  Pde4a
cctccccggcgggaa

SEQ ID NO: 27062 - DNA, 15 bp, Artificial Sequence
  dgRNA
  Psmg3
cgagatcctggagct

SEQ ID NO: 27063 - DNA, 15 bp, Artificial Sequence
  dgRNA
  Psmg3
tcctggagctcggag

SEQ ID NO: 27064 - DNA, 15 bp, Artificial Sequence
  dgRNA
  Psmg3
ctttaacacgaagcc

SEQ ID NO: 27065 - DNA, 15 bp, Artificial Sequence
  dgRNA
  Psmg3
aacacgaagcctgga

SEQ ID NO: 27066 - DNA, 15 bp, Artificial Sequence
  dgRNA
  Iqsec3
tctcctacgcccccg

SEQ ID NO: 27067 - DNA, 15 bp, Artificial Sequence
  dgRNA
  Iqsec3
ctcctacgcccccgc

SEQ ID NO: 27068 - DNA, 15 bp, Artificial Sequence
  dgRNA
  Iqsec3
cccccgcgggaagca

SEQ ID NO: 27069 - DNA, 15 bp, Artificial Sequence
  dgRNA
  Iqsec3
cctcacgaagcccag

SEQ ID NO: 27070 - DNA, 15 bp, Artificial Sequence
  dgRNA
  Zmat5
accatttcctgcgtt

SEQ ID NO: 27071 - DNA, 15 bp, Artificial Sequence
  dgRNA
  Zmat5
cgtattccgccttct

SEQ ID NO: 27072 - DNA, 15 bp, Artificial Sequence
  dgRNA
  Zmat5
ccttctcggtacctt

SEQ ID NO: 27073 - DNA, 15 bp, Artificial Sequence
  dgRNA
  Zmat5
ctcggtaccttagga

SEQ ID NO: 27074 - DNA, 15 bp, Artificial Sequence
  dgRNA
  Myf5
agaaggccaccgagc

SEQ ID NO: 27075 - DNA, 15 bp, Artificial Sequence
  dgRNA
  Myf5
gccaccgagcaggtt

SEQ ID NO: 27076 - DNA, 15 bp, Artificial Sequence
  dgRNA
  Myf5
aatcattagcgtcaa

SEQ ID NO: 27077 - DNA, 15 bp, Artificial Sequence
  dgRNA
  Myf5
atcattagcgtcaaa

SEQ ID NO: 27078 - DNA, 15 bp, Artificial Sequence
  dgRNA
  Corin
agcacacaggtcgcg

SEQ ID NO: 27079 - DNA, 15 bp, Artificial Sequence
  dgRNA
  Corin
gcgtggcctgagtcc

SEQ ID NO: 27080 - DNA, 15 bp, Artificial Sequence
  dgRNA
  Corin
ctccttcccgtccgt

SEQ ID NO: 27081 - DNA, 15 bp, Artificial Sequence
  dgRNA
  Corin
cggagcaagggcggg

SEQ ID NO: 27082 - DNA, 15 bp, Artificial Sequence
  dgRNA
  Aqp7
cttggcatgtagtac

SEQ ID NO: 27083 - DNA, 15 bp, Artificial Sequence
  dgRNA
  Zscan20
tcaccgcagaaccaa

SEQ ID NO: 27084 - DNA, 15 bp, Artificial Sequence
  dgRNA
  Zscan20
gagctacaccccccc

SEQ ID NO: 27085 - DNA, 15 bp, Artificial Sequence
  dgRNA
  Zscan20
cacccccccaggcat

SEQ ID NO: 27086 - DNA, 15 bp, Artificial Sequence
  dgRNA
  Zscan20
ctgcaagatttgttc

SEQ ID NO: 27087 - DNA, 15 bp, Artificial Sequence
  dgRNA
  Tceal5
tcctgtcacgtgatc

SEQ ID NO: 27088 - DNA, 15 bp, Artificial Sequence
  dgRNA
  Tceal5
acaagaaagtgcgtc

SEQ ID NO: 27089 - DNA, 15 bp, Artificial Sequence
  dgRNA
  Tceal5
aggaacgtcaccagt

SEQ ID NO: 27090 - DNA, 15 bp, Artificial Sequence
  dgRNA
  Tnfaip8
gaccccttctaaacg

SEQ ID NO: 27091 - DNA, 15 bp, Artificial Sequence
  dgRNA
  Tnfaip8
caggaccggcctcta

SEQ ID NO: 27092 - DNA, 15 bp, Artificial Sequence
  dgRNA
  Tnfaip8
aacttcaccagcgcc

SEQ ID NO: 27093 - DNA, 15 bp, Artificial Sequence
  dgRNA
  Tnfaip8
agccgcgtttagaag

SEQ ID NO: 27094 - DNA, 15 bp, Artificial Sequence
  dgRNA
  Cnot7
gactcgtcggctgga

SEQ ID NO: 27095 - DNA, 15 bp, Artificial Sequence
  dgRNA
  Cnot7
ggctggacggaaccc

SEQ ID NO: 27096 - DNA, 15 bp, Artificial Sequence
  dgRNA
  Cnot7
aaccccggtgtgctc

SEQ ID NO: 27097 - DNA, 15 bp, Artificial Sequence
  dgRNA
  Cnot7
accccggtgtgctcc

SEQ ID NO: 27098 - DNA, 15 bp, Artificial Sequence
  dgRNA
  Csnk2a1
tgatataaagccagt

SEQ ID NO: 27099 - DNA, 15 bp, Artificial Sequence
  dgRNA
  Csnk2a1
ataaagccagtcggc

SEQ ID NO: 27100 - DNA, 15 bp, Artificial Sequence
  dgRNA
  Csnk2a1
taaagccagtcggcg

SEQ ID NO: 27101 - DNA, 15 bp, Artificial Sequence
  dgRNA
  Csnk2a1
aaagccagtcggcgg

SEQ ID NO: 27102 - DNA, 15 bp, Artificial Sequence
  dgRNA
  Dlk2
gcgctggggggtgcc

SEQ ID NO: 27103 - DNA, 15 bp, Artificial Sequence
  dgRNA
  Dlk2
cgctggggggtgcca

SEQ ID NO: 27104 - DNA, 15 bp, Artificial Sequence
  dgRNA
  Dlk2
ccgagtggcagcgcg

SEQ ID NO: 27105 - DNA, 15 bp, Artificial Sequence
  dgRNA
  Dlk2
tggcagcgcgaggtg

SEQ ID NO: 27106 - DNA, 15 bp, Artificial Sequence
  dgRNA
  Dnajb4
attgttccctcgcct

SEQ ID NO: 27107 - DNA, 15 bp, Artificial Sequence
  dgRNA
  Dnajb4
gttccctcgcctcgg

SEQ ID NO: 27108 - DNA, 15 bp, Artificial Sequence
  dgRNA
  Dnajb4
tcgcctcggcggctg

SEQ ID NO: 27109 - DNA, 15 bp, Artificial Sequence
  dgRNA
  Dnajb4
gaggcagtggcgccc

SEQ ID NO: 27110 - DNA, 15 bp, Artificial Sequence
  dgRNA
  Plekhg6
gggctgagaatcctt

SEQ ID NO: 27111 - DNA, 15 bp, Artificial Sequence
  dgRNA
  Plekhg6
tcagggtaacggtct

SEQ ID NO: 27112 - DNA, 15 bp, Artificial Sequence
  dgRNA
  Plekhg6
gtaacggtctaggac

SEQ ID NO: 27113 - DNA, 15 bp, Artificial Sequence
  dgRNA
  Plekhg6
atgtgtacctgccac

SEQ ID NO: 27114 - DNA, 15 bp, Artificial Sequence
  dgRNA
  Samm50
agcccccatacaacg

SEQ ID NO: 27115 - DNA, 15 bp, Artificial Sequence
  dgRNA
  Samm50
tccgttgccttttca

SEQ ID NO: 27116 - DNA, 15 bp, Artificial Sequence
  dgRNA
  Samm50
ccgttgccttttcac

SEQ ID NO: 27117 - DNA, 15 bp, Artificial Sequence
  dgRNA
  Samm50
ataaccgcagctttc

SEQ ID NO: 27118 - DNA, 15 bp, Artificial Sequence
  dgRNA
  Hydin
ggctaaggaaggcgt

SEQ ID NO: 27119 - DNA, 15 bp, Artificial Sequence
  dgRNA
  Hydin
gctaaggaaggcgtt

SEQ ID NO: 27120 - DNA, 15 bp, Artificial Sequence
  dgRNA
  Hydin
ctaaggaaggcgttg

SEQ ID NO: 27121 - DNA, 15 bp, Artificial Sequence
  dgRNA
  Hydin
acctggcggttgcta

SEQ ID NO: 27122 - DNA, 15 bp, Artificial Sequence
  dgRNA
  Lrrcc1
gcctccatatggcag

SEQ ID NO: 27123 - DNA, 15 bp, Artificial Sequence
  dgRNA
  Lrrcc1
cctccatatggcagt

SEQ ID NO: 27124 - DNA, 15 bp, Artificial Sequence
  dgRNA
  Lrrcc1
caagccctctttgag

SEQ ID NO: 27125 - DNA, 15 bp, Artificial Sequence
  dgRNA
  Lrrcc1
cgttgtcctgctttg

SEQ ID NO: 27126 - DNA, 15 bp, Artificial Sequence
  dgRNA
  Zfyve9
aatattaagaccttc

SEQ ID NO: 27127 - DNA, 15 bp, Artificial Sequence
  dgRNA
  Zfyve9
gatcatgggtataca

SEQ ID NO: 27128 - DNA, 15 bp, Artificial Sequence
  dgRNA
  Dtwd1
cgtccccagttgcgc

SEQ ID NO: 27129 - DNA, 15 bp, Artificial Sequence
  dgRNA
  Dtwd1
gtccccagttgcgct

SEQ ID NO: 27130 - DNA, 15 bp, Artificial Sequence
  dgRNA
  Dtwd1
ccccagttgcgctgg

SEQ ID NO: 27131 - DNA, 15 bp, Artificial Sequence
  dgRNA
  Dtwd1
gctgggggcccacaa

SEQ ID NO: 27132 - DNA, 15 bp, Artificial Sequence
  dgRNA
  Psg19
agttgttgttctcgg

SEQ ID NO: 27133 - DNA, 15 bp, Artificial Sequence
  dgRNA
  Psg19
gttgttgttctcgga

SEQ ID NO: 27134 - DNA, 15 bp, Artificial Sequence
  dgRNA
  Psg19
gctaagcacccagtc

SEQ ID NO: 27135 - DNA, 15 bp, Artificial Sequence
  dgRNA
  Kcnk10
catccctcccacgcc

SEQ ID NO: 27136 - DNA, 15 bp, Artificial Sequence
  dgRNA
  Kcnk10
tagcgttaaagagtg

SEQ ID NO: 27137 - DNA, 15 bp, Artificial Sequence
  dgRNA
  Kcnk10
tactcttgagctgca

SEQ ID NO: 27138 - DNA, 15 bp, Artificial Sequence
  dgRNA
  Kcnk10
actgcgagcgaatgc

SEQ ID NO: 27139 - DNA, 15 bp, Artificial Sequence
  dgRNA
  Prkcz
cccagccggggctga

SEQ ID NO: 27140 - DNA, 15 bp, Artificial Sequence
  dgRNA
  Prkcz
ccagccggggctgat

SEQ ID NO: 27141 - DNA, 15 bp, Artificial Sequence
  dgRNA
  Prkcz
ggaccctagccgcct

SEQ ID NO: 27142 - DNA, 15 bp, Artificial Sequence
  dgRNA
  Prkcz
gaccctagccgccta

SEQ ID NO: 27143 - DNA, 15 bp, Artificial Sequence
  dgRNA
  Dgat2
tgaaccgtacagttc

SEQ ID NO: 27144 - DNA, 15 bp, Artificial Sequence
  dgRNA
  Dgat2
tgcatagtttatcgc

SEQ ID NO: 27145 - DNA, 15 bp, Artificial Sequence
  dgRNA
  Dgat2
gcatagtttatcgcc

SEQ ID NO: 27146 - DNA, 15 bp, Artificial Sequence
  dgRNA
  Dgat2
acatggcacagtccg

SEQ ID NO: 27147 - DNA, 15 bp, Artificial Sequence
  dgRNA
  Psmc1
tcaacttcgcccgtg

SEQ ID NO: 27148 - DNA, 15 bp, Artificial Sequence
  dgRNA
  Psmc1
cgcccgtgaggaagt

SEQ ID NO: 27149 - DNA, 15 bp, Artificial Sequence
  dgRNA
  Psmc1
gaagttggtcccgat

SEQ ID NO: 27150 - DNA, 15 bp, Artificial Sequence
  dgRNA
  Psmc1
tacttccgttctgtc

SEQ ID NO: 27151 - DNA, 15 bp, Artificial Sequence
  dgRNA
  Abhd11
attacgtaatgatgc

SEQ ID NO: 27152 - DNA, 15 bp, Artificial Sequence
  dgRNA
  Abhd11
acgtaatgatgcagg

SEQ ID NO: 27153 - DNA, 15 bp, Artificial Sequence
  dgRNA
  Abhd11
cccggtggctccgca

SEQ ID NO: 27154 - DNA, 15 bp, Artificial Sequence
  dgRNA
  Abhd11
tggctccgcaaggtg

SEQ ID NO: 27155 - DNA, 15 bp, Artificial Sequence
  dgRNA
  Srpx
atgtaataggtttct

SEQ ID NO: 27156 - DNA, 15 bp, Artificial Sequence
  dgRNA
  Srpx
tctagggcctctagc

SEQ ID NO: 27157 - DNA, 15 bp, Artificial Sequence
  dgRNA
  Srpx
gctggagacctccga

SEQ ID NO: 27158 - DNA, 15 bp, Artificial Sequence
  dgRNA
  Srpx
tggagacctccgagg

SEQ ID NO: 27159 - DNA, 15 bp, Artificial Sequence
  dgRNA
  Esr1
ccctcccctattatc

SEQ ID NO: 27160 - DNA, 15 bp, Artificial Sequence
  dgRNA
  Esr1
atcccagtcaagtgg

SEQ ID NO: 27161 - DNA, 15 bp, Artificial Sequence
  dgRNA
  Esr1
ccggataatagggga

SEQ ID NO: 27162 - DNA, 15 bp, Artificial Sequence
  dgRNA
  Esr1
tgctccggataatag

SEQ ID NO: 27163 - DNA, 15 bp, Artificial Sequence
  dgRNA
  Pgap2
tccaccgtcagagat

SEQ ID NO: 27164 - DNA, 15 bp, Artificial Sequence
  dgRNA
  Pgap2
gtcagagatcggctc

SEQ ID NO: 27165 - DNA, 15 bp, Artificial Sequence
  dgRNA
  Pgap2
cggccgctccgccct

SEQ ID NO: 27166 - DNA, 15 bp, Artificial Sequence
  dgRNA
  Pgap2
ccgctccgcccttgg

SEQ ID NO: 27167 - DNA, 15 bp, Artificial Sequence
  dgRNA
  Rrp9
aagcgccacaggccc

SEQ ID NO: 27168 - DNA, 15 bp, Artificial Sequence
  dgRNA
  Rrp9
ggcgccggagcctat

SEQ ID NO: 27169 - DNA, 15 bp, Artificial Sequence
  dgRNA
  Rrp9
tataggagctcttga

SEQ ID NO: 27170 - DNA, 15 bp, Artificial Sequence
  dgRNA
  Rrp9
cgtgtccagctgcgt

SEQ ID NO: 27171 - DNA, 15 bp, Artificial Sequence
  dgRNA
  Sdhd
gcgccttctgctgtt

SEQ ID NO: 27172 - DNA, 15 bp, Artificial Sequence
  dgRNA
  Sdhd
ccttctgctgttcgg

SEQ ID NO: 27173 - DNA, 15 bp, Artificial Sequence
  dgRNA
  Sdhd
tgttcggcggccacc

SEQ ID NO: 27174 - DNA, 15 bp, Artificial Sequence
  dgRNA
  Sdhd
ccgcttcaccaagct

SEQ ID NO: 27175 - DNA, 15 bp, Artificial Sequence
  dgRNA
  Gemin6
ttcttgagacgttca

SEQ ID NO: 27176 - DNA, 15 bp, Artificial Sequence
  dgRNA
  Gemin6
ttgagacgttcacgg

SEQ ID NO: 27177 - DNA, 15 bp, Artificial Sequence
  dgRNA
  Gemin6
acgttcacggtggcc

SEQ ID NO: 27178 - DNA, 15 bp, Artificial Sequence
  dgRNA
  Gemin6
cctgcagtgcaagaa

SEQ ID NO: 27179 - DNA, 15 bp, Artificial Sequence
  dgRNA
  Zcchc16
tggccaaagcctagc

SEQ ID NO: 27180 - DNA, 15 bp, Artificial Sequence
  dgRNA
  Zcchc16
ctaggctttggccag

SEQ ID NO: 27181 - DNA, 15 bp, Artificial Sequence
  dgRNA
  Zcchc16
gctaggctttggcca

SEQ ID NO: 27182 - DNA, 15 bp, Artificial Sequence
  dgRNA
  Zcchc16
cggccagctaggctt

SEQ ID NO: 27183 - DNA, 15 bp, Artificial Sequence
  dgRNA
  Ccdc130
caattggaccactcc

SEQ ID NO: 27184 - DNA, 15 bp, Artificial Sequence
  dgRNA
  Ccdc130
ttggaccactcccgg

SEQ ID NO: 27185 - DNA, 15 bp, Artificial Sequence
  dgRNA
  Ccdc130
tggaccactcccggt

SEQ ID NO: 27186 - DNA, 15 bp, Artificial Sequence
  dgRNA
  Ccdc130
accactcccggtggg

SEQ ID NO: 27187 - DNA, 15 bp, Artificial Sequence
  dgRNA
  Gopc
tgccggtcgtcaaaa

SEQ ID NO: 27188 - DNA, 15 bp, Artificial Sequence
  dgRNA
  Gopc
aaaatggtcgcagac

SEQ ID NO: 27189 - DNA, 15 bp, Artificial Sequence
  dgRNA
  Gopc
tcgcagacaggcttg

SEQ ID NO: 27190 - DNA, 15 bp, Artificial Sequence
  dgRNA
  Gopc
ggcttgtggaggcga

SEQ ID NO: 27191 - DNA, 15 bp, Artificial Sequence
  dgRNA
  Cenpc1
gtggcgactggtgaa

SEQ ID NO: 27192 - DNA, 15 bp, Artificial Sequence
  dgRNA
  Cenpc1
gactggtgaaaggcg

SEQ ID NO: 27193 - DNA, 15 bp, Artificial Sequence
  dgRNA
  Cenpc1
tgaaaggcgtggcga

SEQ ID NO: 27194 - DNA, 15 bp, Artificial Sequence
  dgRNA
  Cenpc1
gaaaggcgtggcgac

SEQ ID NO: 27195 - DNA, 15 bp, Artificial Sequence
  dgRNA
  Zfp185
tccattgggcggagc

SEQ ID NO: 27196 - DNA, 15 bp, Artificial Sequence
  dgRNA
  Zfp185
accgaggacaccggc

SEQ ID NO: 27197 - DNA, 15 bp, Artificial Sequence
  dgRNA
  Zfp185
tgtgcggaatgtgcc

SEQ ID NO: 27198 - DNA, 15 bp, Artificial Sequence
  dgRNA
  Zfp185
aagggggccggccga

SEQ ID NO: 27199 - DNA, 15 bp, Artificial Sequence
  dgRNA
  Epc1
agcaccgcgcagggc

SEQ ID NO: 27200 - DNA, 15 bp, Artificial Sequence
  dgRNA
  Epc1
gggaagcgaggcggc

SEQ ID NO: 27201 - DNA, 15 bp, Artificial Sequence
  dgRNA
  Epc1
ggaagcgaggcggcc

SEQ ID NO: 27202 - DNA, 15 bp, Artificial Sequence
  dgRNA
  Epc1
agcgaggcggccggg

SEQ ID NO: 27203 - DNA, 15 bp, Artificial Sequence
  dgRNA
  Hist1h2bp
aagagcctacgcgat

SEQ ID NO: 27204 - DNA, 15 bp, Artificial Sequence
  dgRNA
  Hist1h2bp
gcctacgcgattggc

SEQ ID NO: 27205 - DNA, 15 bp, Artificial Sequence
  dgRNA
  Hist1h2bp
tttcgtctagaccaa

SEQ ID NO: 27206 - DNA, 15 bp, Artificial Sequence
  dgRNA
  Hist1h2bp
ttcgtctagaccaat

SEQ ID NO: 27207 - DNA, 15 bp, Artificial Sequence
  dgRNA
  Spryd4
tcgcaccacgtgctc

SEQ ID NO: 27208 - DNA, 15 bp, Artificial Sequence
  dgRNA
  Spryd4
cgcaccacgtgctcc

SEQ ID NO: 27209 - DNA, 15 bp, Artificial Sequence
  dgRNA
  Spryd4
cacgtgctccgggcg

SEQ ID NO: 27210 - DNA, 15 bp, Artificial Sequence
  dgRNA
  Spryd4
gcgcggaccagtcat

SEQ ID NO: 27211 - DNA, 15 bp, Artificial Sequence
  dgRNA
  Zfp872
tgcaaagatgctacc

SEQ ID NO: 27212 - DNA, 15 bp, Artificial Sequence
  dgRNA
  Zfp872
ggaacaaactcgggc

SEQ ID NO: 27213 - DNA, 15 bp, Artificial Sequence
  dgRNA
  Zfp872
ggcaggaccaatccg

SEQ ID NO: 27214 - DNA, 15 bp, Artificial Sequence
  dgRNA
  Zfp872
atccgaggagtgtcc

SEQ ID NO: 27215 - DNA, 15 bp, Artificial Sequence
  dgRNA
  Hmgn1
cggggtcgcgcccgc

SEQ ID NO: 27216 - DNA, 15 bp, Artificial Sequence
  dgRNA
  Hmgn1
ggggtcgcgcccgca

SEQ ID NO: 27217 - DNA, 15 bp, Artificial Sequence
  dgRNA
  Hmgn1
gggtcgcgcccgcag

SEQ ID NO: 27218 - DNA, 15 bp, Artificial Sequence
  dgRNA
  Hmgn1
tcgcgcccgcagggg

SEQ ID NO: 27219 - DNA, 15 bp, Artificial Sequence
  dgRNA
  Prickle2
tctcaatttgggaac

SEQ ID NO: 27220 - DNA, 15 bp, Artificial Sequence
  dgRNA
  Prickle2
gaacaggcttatgat

SEQ ID NO: 27221 - DNA, 15 bp, Artificial Sequence
  dgRNA
  Prickle2
tgattggcccgcagc

SEQ ID NO: 27222 - DNA, 15 bp, Artificial Sequence
  dgRNA
  Prickle2
ccaatgagcgtctgt

SEQ ID NO: 27223 - DNA, 15 bp, Artificial Sequence
  dgRNA
  Sulf1
gcgaatgaattattc

SEQ ID NO: 27224 - DNA, 15 bp, Artificial Sequence
  dgRNA
  Grb7
gatccgagctgaaga

SEQ ID NO: 27225 - DNA, 15 bp, Artificial Sequence
  dgRNA
  Grb7
gaccatcattggaat

SEQ ID NO: 27226 - DNA, 15 bp, Artificial Sequence
  dgRNA
  Grb7
tggaatgggacgagt

SEQ ID NO: 27227 - DNA, 15 bp, Artificial Sequence
  dgRNA
  Grb7
gggacgagtaggagt

SEQ ID NO: 27228 - DNA, 15 bp, Artificial Sequence
  dgRNA
  Capza1
gccacgcaagagtcg

SEQ ID NO: 27229 - DNA, 15 bp, Artificial Sequence
  dgRNA
  Capza1
gcactccaggacgaa

SEQ ID NO: 27230 - DNA, 15 bp, Artificial Sequence
  dgRNA
  Capza1
cactccaggacgaat

SEQ ID NO: 27231 - DNA, 15 bp, Artificial Sequence
  dgRNA
  Capza1
aagtgaccggaactc

SEQ ID NO: 27232 - DNA, 15 bp, Artificial Sequence
  dgRNA
  Ldlrap1
tatctagaaggccat

SEQ ID NO: 27233 - DNA, 15 bp, Artificial Sequence
  dgRNA
  Ldlrap1
cccgtagctagagaa

SEQ ID NO: 27234 - DNA, 15 bp, Artificial Sequence
  dgRNA
  Ldlrap1
ccgtagctagagaac

SEQ ID NO: 27235 - DNA, 15 bp, Artificial Sequence
  dgRNA
  Ldlrap1
cgtagctagagaacg

SEQ ID NO: 27236 - DNA, 15 bp, Artificial Sequence
  dgRNA
  Taf5
tcccactgccgtaaa

SEQ ID NO: 27237 - DNA, 15 bp, Artificial Sequence
  dgRNA
  Taf5
gtaaatggcctgccc

SEQ ID NO: 27238 - DNA, 15 bp, Artificial Sequence
  dgRNA
  Taf5
cgcagtcacgcttga

SEQ ID NO: 27239 - DNA, 15 bp, Artificial Sequence
  dgRNA
  Taf5
aaccgagcgaaaggc

SEQ ID NO: 27240 - DNA, 15 bp, Artificial Sequence
  dgRNA
  Faap20
acccctgcaaactgg

SEQ ID NO: 27241 - DNA, 15 bp, Artificial Sequence
  dgRNA
  Faap20
cccctgcaaactgga

SEQ ID NO: 27242 - DNA, 15 bp, Artificial Sequence
  dgRNA
  Faap20
gcctcgtgttcccaa

SEQ ID NO: 27243 - DNA, 15 bp, Artificial Sequence
  dgRNA
  Faap20
cgtgttcccaacggt

SEQ ID NO: 27244 - DNA, 15 bp, Artificial Sequence
  dgRNA
  Fignl2
acttgccgggagtga

SEQ ID NO: 27245 - DNA, 15 bp, Artificial Sequence
  dgRNA
  Fignl2
aggtctaaagggtct

SEQ ID NO: 27246 - DNA, 15 bp, Artificial Sequence
  dgRNA
  Fignl2
cgggtagcctgtcat

SEQ ID NO: 27247 - DNA, 15 bp, Artificial Sequence
  dgRNA
  Fignl2
taaccaagctgtcag

SEQ ID NO: 27248 - DNA, 15 bp, Artificial Sequence
  dgRNA
  Scamp3
tagttcatgcctgct

SEQ ID NO: 27249 - DNA, 15 bp, Artificial Sequence
  dgRNA
  Scamp3
tgctaggaagtcacg

SEQ ID NO: 27250 - DNA, 15 bp, Artificial Sequence
  dgRNA
  Scamp3
taggaagtcacgtgg

SEQ ID NO: 27251 - DNA, 15 bp, Artificial Sequence
  dgRNA
  Scamp3
tgcggagactggctt

SEQ ID NO: 27252 - DNA, 15 bp, Artificial Sequence
  dgRNA
  Lman1l
cctaagccaaagaac

SEQ ID NO: 27253 - DNA, 15 bp, Artificial Sequence
  dgRNA
  Lman1l
gggcaaagctcaagt

SEQ ID NO: 27254 - DNA, 15 bp, Artificial Sequence
  dgRNA
  Lman1l
gttggctaggagccc

SEQ ID NO: 27255 - DNA, 15 bp, Artificial Sequence
  dgRNA
  Lman1l
gccttggctatcccc

SEQ ID NO: 27256 - DNA, 15 bp, Artificial Sequence
  dgRNA
  Imp4
cggtgaagccgcaga

SEQ ID NO: 27257 - DNA, 15 bp, Artificial Sequence
  dgRNA
  Imp4
acggactaactaatc

SEQ ID NO: 27258 - DNA, 15 bp, Artificial Sequence
  dgRNA
  Imp4
actaactaatcagga

SEQ ID NO: 27259 - DNA, 15 bp, Artificial Sequence
  dgRNA
  Imp4
tgacatcccaaatcc

SEQ ID NO: 27260 - DNA, 15 bp, Artificial Sequence
  dgRNA
  Slc25a44
caggactcgtttgcg

SEQ ID NO: 27261 - DNA, 15 bp, Artificial Sequence
  dgRNA
  Slc25a44
actcgtttgcgtggt

SEQ ID NO: 27262 - DNA, 15 bp, Artificial Sequence
  dgRNA
  Slc25a44
tgcgtggttggcttg

SEQ ID NO: 27263 - DNA, 15 bp, Artificial Sequence
  dgRNA
  Slc25a44
gcgtggttggcttga

SEQ ID NO: 27264 - DNA, 15 bp, Artificial Sequence
  dgRNA
  Srsf2
cgccgcgcggtgcgc

SEQ ID NO: 27265 - DNA, 15 bp, Artificial Sequence
  dgRNA
  Srsf2
gtgcgcaggcgcacc

SEQ ID NO: 27266 - DNA, 15 bp, Artificial Sequence
  dgRNA
  Srsf2
tgcgcaggcgcacct

SEQ ID NO: 27267 - DNA, 15 bp, Artificial Sequence
  dgRNA
  Srsf2
gcaggcgcacctggg

SEQ ID NO: 27268 - DNA, 15 bp, Artificial Sequence
  dgRNA
  Tcf7l2
actactccgttcctc

SEQ ID NO: 27269 - DNA, 15 bp, Artificial Sequence
  dgRNA
  Tcf7l2
tattgacagggcgag

SEQ ID NO: 27270 - DNA, 15 bp, Artificial Sequence
  dgRNA
  Tcf7l2
cggagattattgaca

SEQ ID NO: 27271 - DNA, 15 bp, Artificial Sequence
  dgRNA
  Tcf7l2
gcggagattattgac

SEQ ID NO: 27272 - DNA, 15 bp, Artificial Sequence
  dgRNA
  Ikbkg
tctgctggccgacgc

SEQ ID NO: 27273 - DNA, 15 bp, Artificial Sequence
  dgRNA
  Ikbkg
ctggccgacgcaggc

SEQ ID NO: 27274 - DNA, 15 bp, Artificial Sequence
  dgRNA
  Ikbkg
cagagtatggcactt

SEQ ID NO: 27275 - DNA, 15 bp, Artificial Sequence
  dgRNA
  Ikbkg
agagtatggcacttt

SEQ ID NO: 27276 - DNA, 15 bp, Artificial Sequence
  dgRNA
  Apbb2
aggcaaggggcgcca

SEQ ID NO: 27277 - DNA, 15 bp, Artificial Sequence
  dgRNA
  Apbb2
gaggcaaggggcgcc

SEQ ID NO: 27278 - DNA, 15 bp, Artificial Sequence
  dgRNA
  Pdyn
gtctcactcgggccc

SEQ ID NO: 27279 - DNA, 15 bp, Artificial Sequence
  dgRNA
  Pdyn
tctcactcgggccca

SEQ ID NO: 27280 - DNA, 15 bp, Artificial Sequence
  dgRNA
  Pdyn
gagtggaaggacccg

SEQ ID NO: 27281 - DNA, 15 bp, Artificial Sequence
  dgRNA
  Pdyn
agtggaaggacccgg

SEQ ID NO: 27282 - DNA, 15 bp, Artificial Sequence
  dgRNA
  Cftr
cgcggggcgcgctgg

SEQ ID NO: 27283 - DNA, 15 bp, Artificial Sequence
  dgRNA
  Cftr
gggcgcgctggagga

SEQ ID NO: 27284 - DNA, 15 bp, Artificial Sequence
  dgRNA
  Cftr
agcgcaaggagcgcg

SEQ ID NO: 27285 - DNA, 15 bp, Artificial Sequence
  dgRNA
  Cftr
gcgcaaggagcgcgc

SEQ ID NO: 27286 - DNA, 15 bp, Artificial Sequence
  dgRNA
  Mast2
ccgacgcgggcgcgc

SEQ ID NO: 27287 - DNA, 15 bp, Artificial Sequence
  dgRNA
  Mast2
cgacgcgggcgcgcc

SEQ ID NO: 27288 - DNA, 15 bp, Artificial Sequence
  dgRNA
  Mast2
ccgcttcagagcgcg

SEQ ID NO: 27289 - DNA, 15 bp, Artificial Sequence
  dgRNA
  Mast2
tcagagcgcgcggcg

SEQ ID NO: 27290 - DNA, 15 bp, Artificial Sequence
  dgRNA
  Gpr83
aagctggtgagcgtg

SEQ ID NO: 27291 - DNA, 15 bp, Artificial Sequence
  dgRNA
  Gpr83
agctggtgagcgtga

SEQ ID NO: 27292 - DNA, 15 bp, Artificial Sequence
  dgRNA
  Gpr83
gccgggtagcagagc

SEQ ID NO: 27293 - DNA, 15 bp, Artificial Sequence
  dgRNA
  Gpr83
cggtgtgagctgcgc

SEQ ID NO: 27294 - DNA, 15 bp, Artificial Sequence
  dgRNA
  Ubxn8
gaccgtcccagccga

SEQ ID NO: 27295 - DNA, 15 bp, Artificial Sequence
  dgRNA
  Ubxn8
tgagcaatcgcatcc

SEQ ID NO: 27296 - DNA, 15 bp, Artificial Sequence
  dgRNA
  Ubxn8
cgcgccccagcctca

SEQ ID NO: 27297 - DNA, 15 bp, Artificial Sequence
  dgRNA
  Ubxn8
attcctcccagcccg

SEQ ID NO: 27298 - DNA, 15 bp, Artificial Sequence
  dgRNA
  Zfp963
ctcctgaccatatgc

SEQ ID NO: 27299 - DNA, 15 bp, Artificial Sequence
  dgRNA
  Zfp963
atatgctggagtaaa

SEQ ID NO: 27300 - DNA, 15 bp, Artificial Sequence
  dgRNA
  Zfp963
tcaatcagcagtcgc

SEQ ID NO: 27301 - DNA, 15 bp, Artificial Sequence
  dgRNA
  Zfp963
caatcagcagtcgct

SEQ ID NO: 27302 - DNA, 15 bp, Artificial Sequence
  dgRNA
  Dgki
cgatccattgcctgc

SEQ ID NO: 27303 - DNA, 15 bp, Artificial Sequence
  dgRNA
  Dgki
tcccggcttttgctc

SEQ ID NO: 27304 - DNA, 15 bp, Artificial Sequence
  dgRNA
  Dgki
ttggagggagccggc

SEQ ID NO: 27305 - DNA, 15 bp, Artificial Sequence
  dgRNA
  Dgki
agggagccggctggt

SEQ ID NO: 27306 - DNA, 15 bp, Artificial Sequence
  dgRNA
  Mgat4a
acaccgatgcaaaaa

SEQ ID NO: 27307 - DNA, 15 bp, Artificial Sequence
  dgRNA
  Mgat4a
caccgatgcaaaaag

SEQ ID NO: 27308 - DNA, 15 bp, Artificial Sequence
  dgRNA
  Mgat4a
atgcaaaaaggggct

SEQ ID NO: 27309 - DNA, 15 bp, Artificial Sequence
  dgRNA
  Mgat4a
gcgccgttgagtgac

SEQ ID NO: 27310 - DNA, 15 bp, Artificial Sequence
  dgRNA
  Vmn1r216
tccaagagcaaaatt

SEQ ID NO: 27311 - DNA, 15 bp, Artificial Sequence
  dgRNA
  Vmn1r216
gacgacgacgacaat

SEQ ID NO: 27312 - DNA, 15 bp, Artificial Sequence
  dgRNA
  Vmn1r216
ttggttctactcaca

SEQ ID NO: 27313 - DNA, 15 bp, Artificial Sequence
  dgRNA
  Trak2
caccccagcggggtc

SEQ ID NO: 27314 - DNA, 15 bp, Artificial Sequence
  dgRNA
  Trak2
accccagcggggtcg

SEQ ID NO: 27315 - DNA, 15 bp, Artificial Sequence
  dgRNA
  Trak2
gggccctcgagctgt

SEQ ID NO: 27316 - DNA, 15 bp, Artificial Sequence
  dgRNA
  Trak2
ccctcgagctgtagg

SEQ ID NO: 27317 - DNA, 15 bp, Artificial Sequence
  dgRNA
  Pex14
aactgcaagataacc

SEQ ID NO: 27318 - DNA, 15 bp, Artificial Sequence
  dgRNA
  Pex14
ctcaatcctttttgc

SEQ ID NO: 27319 - DNA, 15 bp, Artificial Sequence
  dgRNA
  Pex14
tcaatcctttttgcc

SEQ ID NO: 27320 - DNA, 15 bp, Artificial Sequence
  dgRNA
  Pex14
ccccatcgacatgct

SEQ ID NO: 27321 - DNA, 15 bp, Artificial Sequence
  dgRNA
  Actl7b
gaggcccggtgtgtt

SEQ ID NO: 27322 - DNA, 15 bp, Artificial Sequence
  dgRNA
  Actl7b
aggcccggtgtgttt

SEQ ID NO: 27323 - DNA, 15 bp, Artificial Sequence
  dgRNA
  Actl7b
caactcccatctaaa

SEQ ID NO: 27324 - DNA, 15 bp, Artificial Sequence
  dgRNA
  Actl7b
taaatggaccattcc

SEQ ID NO: 27325 - DNA, 15 bp, Artificial Sequence
  dgRNA
  Smchd1
cgccccacggcctgc

SEQ ID NO: 27326 - DNA, 15 bp, Artificial Sequence
  dgRNA
  Smchd1
gcctgctggactagc

SEQ ID NO: 27327 - DNA, 15 bp, Artificial Sequence
  dgRNA
  Smchd1
cctgctggactagcc

SEQ ID NO: 27328 - DNA, 15 bp, Artificial Sequence
  dgRNA
  Smchd1
gcgcagcagccacgg

SEQ ID NO: 27329 - DNA, 15 bp, Artificial Sequence
  dgRNA
  Slc5a11
gccccctgccaggta

SEQ ID NO: 27330 - DNA, 15 bp, Artificial Sequence
  dgRNA
  Slc5a11
ggccaaggcccaatg

SEQ ID NO: 27331 - DNA, 15 bp, Artificial Sequence
  dgRNA
  Slc5a11
gccaaggcccaatga

SEQ ID NO: 27332 - DNA, 15 bp, Artificial Sequence
  dgRNA
  Slc5a11
aggcccaatgagggc

SEQ ID NO: 27333 - DNA, 15 bp, Artificial Sequence
  dgRNA
  Asphd2
cttcccggaactgct

SEQ ID NO: 27334 - DNA, 15 bp, Artificial Sequence
  dgRNA
  Asphd2
cacgttgctgctctc

SEQ ID NO: 27335 - DNA, 15 bp, Artificial Sequence
  dgRNA
  Asphd2
gcagttccgggaaga

SEQ ID NO: 27336 - DNA, 15 bp, Artificial Sequence
  dgRNA
  Asphd2
aggcctagcagttcc

SEQ ID NO: 27337 - DNA, 15 bp, Artificial Sequence
  dgRNA
  Mki67
tgtcgccctcgccat

SEQ ID NO: 27338 - DNA, 15 bp, Artificial Sequence
  dgRNA
  Mki67
ctcgccattggtctc

SEQ ID NO: 27339 - DNA, 15 bp, Artificial Sequence
  dgRNA
  Mki67
tttgaaccgccgttt

SEQ ID NO: 27340 - DNA, 15 bp, Artificial Sequence
  dgRNA
  Mki67
ttggtttgaatcggg

SEQ ID NO: 27341 - DNA, 15 bp, Artificial Sequence
  dgRNA
  Prph2
attcttgagctgagc

SEQ ID NO: 27342 - DNA, 15 bp, Artificial Sequence
  dgRNA
  Prph2
atagctttgtctaat

SEQ ID NO: 27343 - DNA, 15 bp, Artificial Sequence
  dgRNA
  Prph2
ctaatgggatgaccc

SEQ ID NO: 27344 - DNA, 15 bp, Artificial Sequence
  dgRNA
  Prph2
ttagtgactgcgttg

SEQ ID NO: 27345 - DNA, 15 bp, Artificial Sequence
  dgRNA
  Upp2
tgtatgagttcaaat

SEQ ID NO: 27346 - DNA, 15 bp, Artificial Sequence
  dgRNA
  Upp2
ctgaggtcttgacat

SEQ ID NO: 27347 - DNA, 15 bp, Artificial Sequence
  dgRNA
  Upp2
agtcctcacgagtgc

SEQ ID NO: 27348 - DNA, 15 bp, Artificial Sequence
  dgRNA
  Upp2
ggcacatttctgatg

SEQ ID NO: 27349 - DNA, 15 bp, Artificial Sequence
  dgRNA
  Grik2
ccggaattctctccc

SEQ ID NO: 27350 - DNA, 15 bp, Artificial Sequence
  dgRNA
  Grik2
agtgcaccgtgctct

SEQ ID NO: 27351 - DNA, 15 bp, Artificial Sequence
  dgRNA
  Grik2
gtgcaccgtgctctt

SEQ ID NO: 27352 - DNA, 15 bp, Artificial Sequence
  dgRNA
  Grik2
caccgtgctcttggg

SEQ ID NO: 27353 - DNA, 15 bp, Artificial Sequence
  dgRNA
  Cdc45
tcaacaccggcaaca

SEQ ID NO: 27354 - DNA, 15 bp, Artificial Sequence
  dgRNA
  Cdc45
tttttgagggacggg

SEQ ID NO: 27355 - DNA, 15 bp, Artificial Sequence
  dgRNA
  Cdc45
ttttgagggacgggc

SEQ ID NO: 27356 - DNA, 15 bp, Artificial Sequence
  dgRNA
  Cdc45
tattggctgctggcg

SEQ ID NO: 27357 - DNA, 15 bp, Artificial Sequence
  dgRNA
  Inhbb
ccgggacgcccgagt

SEQ ID NO: 27358 - DNA, 15 bp, Artificial Sequence
  dgRNA
  Inhbb
cgggacgcccgagta

SEQ ID NO: 27359 - DNA, 15 bp, Artificial Sequence
  dgRNA
  Inhbb
gacgcccgagtaggg

SEQ ID NO: 27360 - DNA, 15 bp, Artificial Sequence
  dgRNA
  Inhbb
ccgagtagggaggcg

SEQ ID NO: 27361 - DNA, 15 bp, Artificial Sequence
  dgRNA
  Rpl24
aatcctgcgaaatgc

SEQ ID NO: 27362 - DNA, 15 bp, Artificial Sequence
  dgRNA
  Rpl24
tctagaacactagcc

SEQ ID NO: 27363 - DNA, 15 bp, Artificial Sequence
  dgRNA
  Rpl24
ccccgccaatgctgt

SEQ ID NO: 27364 - DNA, 15 bp, Artificial Sequence
  dgRNA
  Rpl24
tgaggtgttcgttta

SEQ ID NO: 27365 - DNA, 15 bp, Artificial Sequence
  dgRNA
  Rhbdd1
aggattagctgacgg

SEQ ID NO: 27366 - DNA, 15 bp, Artificial Sequence
  dgRNA
  Rhbdd1
ttagctgacggtggc

SEQ ID NO: 27367 - DNA, 15 bp, Artificial Sequence
  dgRNA
  Rhbdd1
tagctgacggtggct

SEQ ID NO: 27368 - DNA, 15 bp, Artificial Sequence
  dgRNA
  Rhbdd1
acggtggctgggacc

SEQ ID NO: 27369 - DNA, 15 bp, Artificial Sequence
  dgRNA
  Fam50a
ctggtgatttcgcat

SEQ ID NO: 27370 - DNA, 15 bp, Artificial Sequence
  dgRNA
  Fam50a
tggtgatttcgcatt

SEQ ID NO: 27371 - DNA, 15 bp, Artificial Sequence
  dgRNA
  Fam50a
atttcgcattgggta

SEQ ID NO: 27372 - DNA, 15 bp, Artificial Sequence
  dgRNA
  Fam50a
tttcgcattgggtat

SEQ ID NO: 27373 - DNA, 15 bp, Artificial Sequence
  dgRNA
  1700013F07Rik
agcgttttccaacag

SEQ ID NO: 27374 - DNA, 15 bp, Artificial Sequence
  dgRNA
  1700013F07Rik
ccagagtgcgtatcc

SEQ ID NO: 27375 - DNA, 15 bp, Artificial Sequence
  dgRNA
  1700013F07Rik
cttagttgaaccgcc

SEQ ID NO: 27376 - DNA, 15 bp, Artificial Sequence
  dgRNA
  1700013F07Rik
agttgaaccgccagg

SEQ ID NO: 27377 - DNA, 15 bp, Artificial Sequence
  dgRNA
  Naa50
tagagagtgtcgcaa

SEQ ID NO: 27378 - DNA, 15 bp, Artificial Sequence
  dgRNA
  Naa50
agagagtgtcgcaaa

SEQ ID NO: 27379 - DNA, 15 bp, Artificial Sequence
  dgRNA
  Naa50
gagtgtcgcaaaggg

SEQ ID NO: 27380 - DNA, 15 bp, Artificial Sequence
  dgRNA
  Naa50
agtgtcgcaaagggt

SEQ ID NO: 27381 - DNA, 15 bp, Artificial Sequence
  dgRNA
  Sft2d2
gggtaagtttgcgaa

SEQ ID NO: 27382 - DNA, 15 bp, Artificial Sequence
  dgRNA
  Sft2d2
ggcctgcgttgttcc

SEQ ID NO: 27383 - DNA, 15 bp, Artificial Sequence
  dgRNA
  Sft2d2
cgttgttccaggccc

SEQ ID NO: 27384 - DNA, 15 bp, Artificial Sequence
  dgRNA
  Sft2d2
cgaatccgtgaagcc

SEQ ID NO: 27385 - DNA, 15 bp, Artificial Sequence
  dgRNA
  Mllt3
ctgttactttaagcg

SEQ ID NO: 27386 - DNA, 15 bp, Artificial Sequence
  dgRNA
  Mllt3
cgaggcgttccagtg

SEQ ID NO: 27387 - DNA, 15 bp, Artificial Sequence
  dgRNA
  Mllt3
gcgctgcgggccgcc

SEQ ID NO: 27388 - DNA, 15 bp, Artificial Sequence
  dgRNA
  Mllt3
ggccgccggggtttc

SEQ ID NO: 27389 - DNA, 15 bp, Artificial Sequence
  dgRNA
  Hsd17b14
tcagtttgggtaccc

SEQ ID NO: 27390 - DNA, 15 bp, Artificial Sequence
  dgRNA
  Hsd17b14
ctaggaaggcacacc

SEQ ID NO: 27391 - DNA, 15 bp, Artificial Sequence
  dgRNA
  Hsd17b14
tggaaccagatatac

SEQ ID NO: 27392 - DNA, 15 bp, Artificial Sequence
  dgRNA
  Erich3
agatttgtctcgatc

SEQ ID NO: 27393 - DNA, 15 bp, Artificial Sequence
  dgRNA
  Erich3
gatttgtctcgatca

SEQ ID NO: 27394 - DNA, 15 bp, Artificial Sequence
  dgRNA
  Erich3
gttggcagagccgcc

SEQ ID NO: 27395 - DNA, 15 bp, Artificial Sequence
  dgRNA
  Erich3
ttggcagagccgcct

SEQ ID NO: 27396 - DNA, 15 bp, Artificial Sequence
  dgRNA
  Ephb3
gccccaggacgccga

SEQ ID NO: 27397 - DNA, 15 bp, Artificial Sequence
  dgRNA
  Ephb3
ccaggacgccgaggg

SEQ ID NO: 27398 - DNA, 15 bp, Artificial Sequence
  dgRNA
  Ephb3
caggacgccgagggt

SEQ ID NO: 27399 - DNA, 15 bp, Artificial Sequence
  dgRNA
  Ephb3
cgccgagggtgggct

SEQ ID NO: 27400 - DNA, 15 bp, Artificial Sequence
  dgRNA
  Flcn
ctttcctcttcggta

SEQ ID NO: 27401 - DNA, 15 bp, Artificial Sequence
  dgRNA
  Flcn
ctcttcggtagggac

SEQ ID NO: 27402 - DNA, 15 bp, Artificial Sequence
  dgRNA
  Flcn
tcttcggtagggaca

SEQ ID NO: 27403 - DNA, 15 bp, Artificial Sequence
  dgRNA
  Flcn
aatggcttctctcgg

SEQ ID NO: 27404 - DNA, 15 bp, Artificial Sequence
  dgRNA
  Asb9
gcctgctaggtggag

SEQ ID NO: 27405 - DNA, 15 bp, Artificial Sequence
  dgRNA
  Asb9
accactccacctagc

SEQ ID NO: 27406 - DNA, 15 bp, Artificial Sequence
  dgRNA
  Skida1
cgataatagctgtat

SEQ ID NO: 27407 - DNA, 15 bp, Artificial Sequence
  dgRNA
  Skida1
ctattatcgtttcaa

SEQ ID NO: 27408 - DNA, 15 bp, Artificial Sequence
  dgRNA
  Ppa2
aggtccttgtcttga

SEQ ID NO: 27409 - DNA, 15 bp, Artificial Sequence
  dgRNA
  Ppa2
gtcttcggcctctga

SEQ ID NO: 27410 - DNA, 15 bp, Artificial Sequence
  dgRNA
  Ppa2
acttgatgccacttg

SEQ ID NO: 27411 - DNA, 15 bp, Artificial Sequence
  dgRNA
  Ppa2
acttgaggccgaccg

SEQ ID NO: 27412 - DNA, 15 bp, Artificial Sequence
  dgRNA
  Ccdc182
gcgcagtaaatctgt

SEQ ID NO: 27413 - DNA, 15 bp, Artificial Sequence
  dgRNA
  Ccdc182
tgcaaaatagtgaac

SEQ ID NO: 27414 - DNA, 15 bp, Artificial Sequence
  dgRNA
  Ccdc182
gcaaaatagtgaact

SEQ ID NO: 27415 - DNA, 15 bp, Artificial Sequence
  dgRNA
  Ccdc182
tcacccagtcagaac

SEQ ID NO: 27416 - DNA, 15 bp, Artificial Sequence
  dgRNA
  Tsen34
cccatttgtgcagac

SEQ ID NO: 27417 - DNA, 15 bp, Artificial Sequence
  dgRNA
  Tsen34
ttgtgcagaccggag

SEQ ID NO: 27418 - DNA, 15 bp, Artificial Sequence
  dgRNA
  Tsen34
accggagtggcagtg

SEQ ID NO: 27419 - DNA, 15 bp, Artificial Sequence
  dgRNA
  Tsen34
ccggagtggcagtga

SEQ ID NO: 27420 - DNA, 15 bp, Artificial Sequence
  dgRNA
  Mob3c
ccaggcggtcctttg

SEQ ID NO: 27421 - DNA, 15 bp, Artificial Sequence
  dgRNA
  Mob3c
ggcggtcctttgggg

SEQ ID NO: 27422 - DNA, 15 bp, Artificial Sequence
  dgRNA
  Mob3c
agtcctttgccctcg

SEQ ID NO: 27423 - DNA, 15 bp, Artificial Sequence
  dgRNA
  Mob3c
gacagcgagcccgat

SEQ ID NO: 27424 - DNA, 15 bp, Artificial Sequence
  dgRNA
  Chrm2
cggagcccccttcaa

SEQ ID NO: 27425 - DNA, 15 bp, Artificial Sequence
  dgRNA
  Chrm2
caaacgcacaaatag

SEQ ID NO: 27426 - DNA, 15 bp, Artificial Sequence
  dgRNA
  Chrm2
tacacacagcgggtg

SEQ ID NO: 27427 - DNA, 15 bp, Artificial Sequence
  dgRNA
  Chrm2
gatttggcggttctt

SEQ ID NO: 27428 - DNA, 15 bp, Artificial Sequence
  dgRNA
  Eif3k
ccggaagagaggtgt

SEQ ID NO: 27429 - DNA, 15 bp, Artificial Sequence
  dgRNA
  Phactr1
tggggacctaaggtg

SEQ ID NO: 27430 - DNA, 15 bp, Artificial Sequence
  dgRNA
  Phactr1
ggggacctaaggtga

SEQ ID NO: 27431 - DNA, 15 bp, Artificial Sequence
  dgRNA
  Phactr1
acgctccctcacctt

SEQ ID NO: 27432 - DNA, 15 bp, Artificial Sequence
  dgRNA
  Phactr1
atcacccgactctcc

SEQ ID NO: 27433 - DNA, 15 bp, Artificial Sequence
  dgRNA
  Fut8
tgggatctggtcccc

SEQ ID NO: 27434 - DNA, 15 bp, Artificial Sequence
  dgRNA
  Fut8
ggaagagttcggcac

SEQ ID NO: 27435 - DNA, 15 bp, Artificial Sequence
  dgRNA
  Fut8
ttccggccctctgat

SEQ ID NO: 27436 - DNA, 15 bp, Artificial Sequence
  dgRNA
  Fut8
tcgcactccactcac

SEQ ID NO: 27437 - DNA, 15 bp, Artificial Sequence
  dgRNA
  Krt23
cctccgggttaccac

SEQ ID NO: 27438 - DNA, 15 bp, Artificial Sequence
  dgRNA
  Krt23
ctccgggttaccact

SEQ ID NO: 27439 - DNA, 15 bp, Artificial Sequence
  dgRNA
  Krt23
cgggttaccactggg

SEQ ID NO: 27440 - DNA, 15 bp, Artificial Sequence
  dgRNA
  Krt23
actggcatattcacg

SEQ ID NO: 27441 - DNA, 15 bp, Artificial Sequence
  dgRNA
  Rabgef1
acagacacgtcagcg

SEQ ID NO: 27442 - DNA, 15 bp, Artificial Sequence
  dgRNA
  Rabgef1
cagacacgtcagcga

SEQ ID NO: 27443 - DNA, 15 bp, Artificial Sequence
  dgRNA
  Rabgef1
tcagcgagggcctca

SEQ ID NO: 27444 - DNA, 15 bp, Artificial Sequence
  dgRNA
  Rabgef1
ggcctcacggtcact

SEQ ID NO: 27445 - DNA, 15 bp, Artificial Sequence
  dgRNA
  Tcf19
ccggccaatcagaag

SEQ ID NO: 27446 - DNA, 15 bp, Artificial Sequence
  dgRNA
  Tcf19
ctcccccctgcgcat

SEQ ID NO: 27447 - DNA, 15 bp, Artificial Sequence
  dgRNA
  Tcf19
ggccaatagagcaaa

SEQ ID NO: 27448 - DNA, 15 bp, Artificial Sequence
  dgRNA
  Tcf19
gccaatagagcaaat

SEQ ID NO: 27449 - DNA, 15 bp, Artificial Sequence
  dgRNA
  Cd300e
gcaggtgtactagac

SEQ ID NO: 27450 - DNA, 15 bp, Artificial Sequence
  dgRNA
  Cd300e
ctttcctgaagcgtc

SEQ ID NO: 27451 - DNA, 15 bp, Artificial Sequence
  dgRNA
  Cd300e
tgcaggcccgtgcaa

SEQ ID NO: 27452 - DNA, 15 bp, Artificial Sequence
  dgRNA
  Cd300e
acagcctgacgcttc

SEQ ID NO: 27453 - DNA, 15 bp, Artificial Sequence
  dgRNA
  Gabre
gcagcgccgcagtgc

SEQ ID NO: 27454 - DNA, 15 bp, Artificial Sequence
  dgRNA
  Gabre
gcgccgcagtgctgg

SEQ ID NO: 27455 - DNA, 15 bp, Artificial Sequence
  dgRNA
  Gabre
gggggccttggcgac

SEQ ID NO: 27456 - DNA, 15 bp, Artificial Sequence
  dgRNA
  Gabre
ggggccttggcgaca

SEQ ID NO: 27457 - DNA, 15 bp, Artificial Sequence
  dgRNA
  Nol12
ttgagcgcttgttcg

SEQ ID NO: 27458 - DNA, 15 bp, Artificial Sequence
  dgRNA
  Nol12
gcgcttgttcgaggc

SEQ ID NO: 27459 - DNA, 15 bp, Artificial Sequence
  dgRNA
  Nol12
cagatgatggaatcg

SEQ ID NO: 27460 - DNA, 15 bp, Artificial Sequence
  dgRNA
  Nol12
tcaccgaagccattc

SEQ ID NO: 27461 - DNA, 15 bp, Artificial Sequence
  dgRNA
  Elovl3
gatttggggcaaact

SEQ ID NO: 27462 - DNA, 15 bp, Artificial Sequence
  dgRNA
  Elovl3
cttggttcttagggg

SEQ ID NO: 27463 - DNA, 15 bp, Artificial Sequence
  dgRNA
  Elovl3
actgatcagtcagag

SEQ ID NO: 27464 - DNA, 15 bp, Artificial Sequence
  dgRNA
  Elovl3
tcccttggctaagat

SEQ ID NO: 27465 - DNA, 15 bp, Artificial Sequence
  dgRNA
  Usp17lc
ctcccaatttgggtg

SEQ ID NO: 27466 - DNA, 15 bp, Artificial Sequence
  dgRNA
  Usp17lc
agcttctcccaattt

SEQ ID NO: 27467 - DNA, 15 bp, Artificial Sequence
  dgRNA
  Usp17lc
aagcttctcccaatt

SEQ ID NO: 27468 - DNA, 15 bp, Artificial Sequence
  dgRNA
  Fosl2
cccgccttcctcgcg

SEQ ID NO: 27469 - DNA, 15 bp, Artificial Sequence
  dgRNA
  Fosl2
cgccttcctcgcgcg

SEQ ID NO: 27470 - DNA, 15 bp, Artificial Sequence
  dgRNA
  Fosl2
cgcggggtctgtggc

SEQ ID NO: 27471 - DNA, 15 bp, Artificial Sequence
  dgRNA
  Fosl2
gcgcgaccgcgagcg

SEQ ID NO: 27472 - DNA, 15 bp, Artificial Sequence
  dgRNA
  Magi3
tcagcatgcccgccg

SEQ ID NO: 27473 - DNA, 15 bp, Artificial Sequence
  dgRNA
  Magi3
cagcatgcccgccga

SEQ ID NO: 27474 - DNA, 15 bp, Artificial Sequence
  dgRNA
  Magi3
acccaatccacggtg

SEQ ID NO: 27475 - DNA, 15 bp, Artificial Sequence
  dgRNA
  Magi3
tgcggagccgagaac

SEQ ID NO: 27476 - DNA, 15 bp, Artificial Sequence
  dgRNA
  Rhoh
aattgttactaatac

SEQ ID NO: 27477 - DNA, 15 bp, Artificial Sequence
  dgRNA
  Rhoh
ccgactgtctcctgc

SEQ ID NO: 27478 - DNA, 15 bp, Artificial Sequence
  dgRNA
  Rhoh
cgactgtctcctgct

SEQ ID NO: 27479 - DNA, 15 bp, Artificial Sequence
  dgRNA
  Rhoh
agtcggtgggttctc

SEQ ID NO: 27480 - DNA, 15 bp, Artificial Sequence
  dgRNA
  Prame
ctaacccaaaggtag

SEQ ID NO: 27481 - DNA, 15 bp, Artificial Sequence
  dgRNA
  Prame
tgatattgcgccaac

SEQ ID NO: 27482 - DNA, 15 bp, Artificial Sequence
  dgRNA
  Prame
gcgccaacaggtcat

SEQ ID NO: 27483 - DNA, 15 bp, Artificial Sequence
  dgRNA
  Prame
aggtcattggtctcg

SEQ ID NO: 27484 - DNA, 15 bp, Artificial Sequence
  dgRNA
  Ehmt2
cgggagcccgcgcga

SEQ ID NO: 27485 - DNA, 15 bp, Artificial Sequence
  dgRNA
  Ehmt2
gcgcgaggggcgcga

SEQ ID NO: 27486 - DNA, 15 bp, Artificial Sequence
  dgRNA
  Ehmt2
cgcgaggggcgcgag

SEQ ID NO: 27487 - DNA, 15 bp, Artificial Sequence
  dgRNA
  Ehmt2
cgaggggccgtccgc

SEQ ID NO: 27488 - DNA, 15 bp, Artificial Sequence
  dgRNA
  Gclm
tccagggccgcagcg

SEQ ID NO: 27489 - DNA, 15 bp, Artificial Sequence
  dgRNA
  Gclm
ccagggccgcagcgc

SEQ ID NO: 27490 - DNA, 15 bp, Artificial Sequence
  dgRNA
  Gclm
gggccgcagcgcggg

SEQ ID NO: 27491 - DNA, 15 bp, Artificial Sequence
  dgRNA
  Gclm
agcgcgggcggccat

SEQ ID NO: 27492 - DNA, 15 bp, Artificial Sequence
  dgRNA
  Slx4ip
cactgtataacattt

SEQ ID NO: 27493 - DNA, 15 bp, Artificial Sequence
  dgRNA
  Creb3l4
attactcccagatgc

SEQ ID NO: 27494 - DNA, 15 bp, Artificial Sequence
  dgRNA
  Creb3l4
tgcaggtcccgacag

SEQ ID NO: 27495 - DNA, 15 bp, Artificial Sequence
  dgRNA
  Creb3l4
cccgacagtggttcc

SEQ ID NO: 27496 - DNA, 15 bp, Artificial Sequence
  dgRNA
  Creb3l4
ccacggacagcgtag

SEQ ID NO: 27497 - DNA, 15 bp, Artificial Sequence
  dgRNA
  Rad17
caccaggaactccgc

SEQ ID NO: 27498 - DNA, 15 bp, Artificial Sequence
  dgRNA
  Rad17
gaactccgctggcct

SEQ ID NO: 27499 - DNA, 15 bp, Artificial Sequence
  dgRNA
  Rad17
aactccgctggcctc

SEQ ID NO: 27500 - DNA, 15 bp, Artificial Sequence
  dgRNA
  Rad17
tacgcttccatctaa

SEQ ID NO: 27501 - DNA, 15 bp, Artificial Sequence
  dgRNA
  Olfr1183
gcttcttcatgacta

SEQ ID NO: 27502 - DNA, 15 bp, Artificial Sequence
  dgRNA
  Olfr1183
gtgagtctaacatga

SEQ ID NO: 27503 - DNA, 15 bp, Artificial Sequence
  dgRNA
  Olfr1183
gatggtgtagaacca

SEQ ID NO: 27504 - DNA, 15 bp, Artificial Sequence
  dgRNA
  Olfr1183
gctgtaataggtagg

SEQ ID NO: 27505 - DNA, 15 bp, Artificial Sequence
  dgRNA
  Loxl4
cccgccatgcgtctc

SEQ ID NO: 27506 - DNA, 15 bp, Artificial Sequence
  dgRNA
  Loxl4
ccgccatgcgtctcc

SEQ ID NO: 27507 - DNA, 15 bp, Artificial Sequence
  dgRNA
  Loxl4
gctccccgcagcgcc

SEQ ID NO: 27508 - DNA, 15 bp, Artificial Sequence
  dgRNA
  Loxl4
ctccccgcagcgcct

SEQ ID NO: 27509 - DNA, 15 bp, Artificial Sequence
  dgRNA
  Serac1
gggtcaagccctcag

SEQ ID NO: 27510 - DNA, 15 bp, Artificial Sequence
  dgRNA
  Serac1
gtgaccccgcctctg

SEQ ID NO: 27511 - DNA, 15 bp, Artificial Sequence
  dgRNA
  Med22
agatatcgcgagagc

SEQ ID NO: 27512 - DNA, 15 bp, Artificial Sequence
  dgRNA
  Med22
gagcaggcgccctcg

SEQ ID NO: 27513 - DNA, 15 bp, Artificial Sequence
  dgRNA
  Med22
agcaggcgccctcgc

SEQ ID NO: 27514 - DNA, 15 bp, Artificial Sequence
  dgRNA
  Med22
gccctcgcgggattt

SEQ ID NO: 27515 - DNA, 15 bp, Artificial Sequence
  dgRNA
  Nnat
atgccgcagccccgg

SEQ ID NO: 27516 - DNA, 15 bp, Artificial Sequence
  dgRNA
  Nnat
gcaatgccgcagccc

SEQ ID NO: 27517 - DNA, 15 bp, Artificial Sequence
  dgRNA
  3110062M04Rik
gccgctaagaaccaa

SEQ ID NO: 27518 - DNA, 15 bp, Artificial Sequence
  dgRNA
  3110062M04Rik
tgcggatgtgacccg

SEQ ID NO: 27519 - DNA, 15 bp, Artificial Sequence
  dgRNA
  3110062M04Rik
tgacccgcggtctgc

SEQ ID NO: 27520 - DNA, 15 bp, Artificial Sequence
  dgRNA
  3110062M04Rik
gacccgcggtctgca

SEQ ID NO: 27521 - DNA, 15 bp, Artificial Sequence
  dgRNA
  Adra1a
gatcagtatcaagcg

SEQ ID NO: 27522 - DNA, 15 bp, Artificial Sequence
  dgRNA
  Adra1a
cagtatcaagcgtgg

SEQ ID NO: 27523 - DNA, 15 bp, Artificial Sequence
  dgRNA
  Adra1a
agtatcaagcgtgga

SEQ ID NO: 27524 - DNA, 15 bp, Artificial Sequence
  dgRNA
  Adra1a
aagtagagatcgaaa

SEQ ID NO: 27525 - DNA, 15 bp, Artificial Sequence
  dgRNA
  Atic
cgcggccccacctcc

SEQ ID NO: 27526 - DNA, 15 bp, Artificial Sequence
  dgRNA
  Atic
tctgggttcggaaag

SEQ ID NO: 27527 - DNA, 15 bp, Artificial Sequence
  dgRNA
  Atic
gcggctacagatccc

SEQ ID NO: 27528 - DNA, 15 bp, Artificial Sequence
  dgRNA
  Atic
agccgccccgcccag

SEQ ID NO: 27529 - DNA, 15 bp, Artificial Sequence
  dgRNA
  Otor
ttggccccttcctat

SEQ ID NO: 27530 - DNA, 15 bp, Artificial Sequence
  dgRNA
  Otor
tataatgtgtgcaac

SEQ ID NO: 27531 - DNA, 15 bp, Artificial Sequence
  dgRNA
  Otor
aaatacccagccaat

SEQ ID NO: 27532 - DNA, 15 bp, Artificial Sequence
  dgRNA
  Otor
ctttgcctgattcaa

SEQ ID NO: 27533 - DNA, 15 bp, Artificial Sequence
  dgRNA
  Scgb1b2
gacaggatattgacc

SEQ ID NO: 27534 - DNA, 15 bp, Artificial Sequence
  dgRNA
  Scgb1b2
gtcctggtaggggcc

SEQ ID NO: 27535 - DNA, 15 bp, Artificial Sequence
  dgRNA
  Sft2d1
ggacagtcatgcaac

SEQ ID NO: 27536 - DNA, 15 bp, Artificial Sequence
  dgRNA
  Sft2d1
ggctgaacgatcttg

SEQ ID NO: 27537 - DNA, 15 bp, Artificial Sequence
  dgRNA
  Sft2d1
ccctgcgggcacccg

SEQ ID NO: 27538 - DNA, 15 bp, Artificial Sequence
  dgRNA
  Sft2d1
cctgcgggcacccgt

SEQ ID NO: 27539 - DNA, 15 bp, Artificial Sequence
  dgRNA
  Arrdc4
tgtgcacgtgcacta

SEQ ID NO: 27540 - DNA, 15 bp, Artificial Sequence
  dgRNA
  Arrdc4
atggtgtctcccgat

SEQ ID NO: 27541 - DNA, 15 bp, Artificial Sequence
  dgRNA
  Arrdc4
ccgtcctgctcagcc

SEQ ID NO: 27542 - DNA, 15 bp, Artificial Sequence
  dgRNA
  Arrdc4
ccatgtacagccaat

SEQ ID NO: 27543 - DNA, 15 bp, Artificial Sequence
  dgRNA
  Rbm39
atcattgcgcgagat

SEQ ID NO: 27544 - DNA, 15 bp, Artificial Sequence
  dgRNA
  Rbm39
tcattgcgcgagatt

SEQ ID NO: 27545 - DNA, 15 bp, Artificial Sequence
  dgRNA
  Rbm39
cgcgagattgggcca

SEQ ID NO: 27546 - DNA, 15 bp, Artificial Sequence
  dgRNA
  Rbm39
ttgggccacggtcgc

SEQ ID NO: 27547 - DNA, 15 bp, Artificial Sequence
  dgRNA
  Galk2
agacatcttggccgg

SEQ ID NO: 27548 - DNA, 15 bp, Artificial Sequence
  dgRNA
  Galk2
gacatcttggccgga

SEQ ID NO: 27549 - DNA, 15 bp, Artificial Sequence
  dgRNA
  Galk2
acatcttggccggag

SEQ ID NO: 27550 - DNA, 15 bp, Artificial Sequence
  dgRNA
  Galk2
catcttggccggagg

SEQ ID NO: 27551 - DNA, 15 bp, Artificial Sequence
  dgRNA
  Cers5
ggagaaactagcctg

SEQ ID NO: 27552 - DNA, 15 bp, Artificial Sequence
  dgRNA
  Cers5
aaactagcctgaggt

SEQ ID NO: 27553 - DNA, 15 bp, Artificial Sequence
  dgRNA
  Cers5
gtgaggggcgtgacc

SEQ ID NO: 27554 - DNA, 15 bp, Artificial Sequence
  dgRNA
  Cers5
gggcgtgaccaggac

SEQ ID NO: 27555 - DNA, 15 bp, Artificial Sequence
  dgRNA
  Wnt8a
gcgtggtctccttga

SEQ ID NO: 27556 - DNA, 15 bp, Artificial Sequence
  dgRNA
  Wnt8a
tctttgatccccgtt

SEQ ID NO: 27557 - DNA, 15 bp, Artificial Sequence
  dgRNA
  Wnt8a
tccccgttaggtcag

SEQ ID NO: 27558 - DNA, 15 bp, Artificial Sequence
  dgRNA
  Wnt8a
gttctgccaatgaga

SEQ ID NO: 27559 - DNA, 15 bp, Artificial Sequence
  dgRNA
  P2ry10
aaaacattcgagttg

SEQ ID NO: 27560 - DNA, 15 bp, Artificial Sequence
  dgRNA
  P2ry10
tcgagttgtggtaga

SEQ ID NO: 27561 - DNA, 15 bp, Artificial Sequence
  dgRNA
  P2ry10
aacgtcatctgctca

SEQ ID NO: 27562 - DNA, 15 bp, Artificial Sequence
  dgRNA
  P2ry10
acgtcatctgctcaa

SEQ ID NO: 27563 - DNA, 15 bp, Artificial Sequence
  dgRNA
  Wdr18
acgcatgcgcacgtt

SEQ ID NO: 27564 - DNA, 15 bp, Artificial Sequence
  dgRNA
  Wdr18
cgcatgcgcacgtta

SEQ ID NO: 27565 - DNA, 15 bp, Artificial Sequence
  dgRNA
  Wdr18
gcacgttagggctcc

SEQ ID NO: 27566 - DNA, 15 bp, Artificial Sequence
  dgRNA
  Wdr18
aacccgtaaagcacc

SEQ ID NO: 27567 - DNA, 15 bp, Artificial Sequence
  dgRNA
  Fancd2
ctgagagttcgctgc

SEQ ID NO: 27568 - DNA, 15 bp, Artificial Sequence
  dgRNA
  Fancd2
gagttcgctgcgggt

SEQ ID NO: 27569 - DNA, 15 bp, Artificial Sequence
  dgRNA
  Fancd2
agttcgctgcgggtc

SEQ ID NO: 27570 - DNA, 15 bp, Artificial Sequence
  dgRNA
  Fancd2
tcgctgcgggtcggg

SEQ ID NO: 27571 - DNA, 15 bp, Artificial Sequence
  dgRNA
  Ints4
aagtaaaacgaactt

SEQ ID NO: 27572 - DNA, 15 bp, Artificial Sequence
  dgRNA
  Ints4
agtaaaacgaacttc

SEQ ID NO: 27573 - DNA, 15 bp, Artificial Sequence
  dgRNA
  Ints4
gtaaaacgaacttcg

SEQ ID NO: 27574 - DNA, 15 bp, Artificial Sequence
  dgRNA
  Ints4
aaacgaacttcgggg

SEQ ID NO: 27575 - DNA, 15 bp, Artificial Sequence
  dgRNA
  Olfr642
ttctggatcgttcca

SEQ ID NO: 27576 - DNA, 15 bp, Artificial Sequence
  dgRNA
  Olfr642
tcgttccatggcatt

SEQ ID NO: 27577 - DNA, 15 bp, Artificial Sequence
  dgRNA
  Olfr642
tcttgagactcttgc

SEQ ID NO: 27578 - DNA, 15 bp, Artificial Sequence
  dgRNA
  Olfr642
gagtctcaagatagg

SEQ ID NO: 27579 - DNA, 15 bp, Artificial Sequence
  dgRNA
  Rbp4
ataggcgacgtggga

SEQ ID NO: 27580 - DNA, 15 bp, Artificial Sequence
  dgRNA
  Rbp4
cgacgtgggacggca

SEQ ID NO: 27581 - DNA, 15 bp, Artificial Sequence
  dgRNA
  Rbp4
ggacggcaaggctga

SEQ ID NO: 27582 - DNA, 15 bp, Artificial Sequence
  dgRNA
  Rbp4
cggcaaggctgacgg

SEQ ID NO: 27583 - DNA, 15 bp, Artificial Sequence
  dgRNA
  Gramd4
gctcggttgtgcccg

SEQ ID NO: 27584 - DNA, 15 bp, Artificial Sequence
  dgRNA
  Gramd4
gcccgtggctgcgac

SEQ ID NO: 27585 - DNA, 15 bp, Artificial Sequence
  dgRNA
  Gramd4
gtggctgcgactggc

SEQ ID NO: 27586 - DNA, 15 bp, Artificial Sequence
  dgRNA
  Gramd4
gctgcgactggcagg

SEQ ID NO: 27587 - DNA, 15 bp, Artificial Sequence
  dgRNA
  Icosl
tgctcagcagccgat

SEQ ID NO: 27588 - DNA, 15 bp, Artificial Sequence
  dgRNA
  Icosl
gctcagcagccgatt

SEQ ID NO: 27589 - DNA, 15 bp, Artificial Sequence
  dgRNA
  Icosl
cgattgggttacttt

SEQ ID NO: 27590 - DNA, 15 bp, Artificial Sequence
  dgRNA
  Icosl
gattgggttactttc

SEQ ID NO: 27591 - DNA, 15 bp, Artificial Sequence
  dgRNA
  Fem1a
gatcgcactaaccat

SEQ ID NO: 27592 - DNA, 15 bp, Artificial Sequence
  dgRNA
  Fem1a
ttgccgtcctgtcac

SEQ ID NO: 27593 - DNA, 15 bp, Artificial Sequence
  dgRNA
  Fem1a
cccccctatcccttt

SEQ ID NO: 27594 - DNA, 15 bp, Artificial Sequence
  dgRNA
  Fem1a
gattccagtatcatt

SEQ ID NO: 27595 - DNA, 15 bp, Artificial Sequence
  dgRNA
  Brms1
accgaccacaatgct

SEQ ID NO: 27596 - DNA, 15 bp, Artificial Sequence
  dgRNA
  Brms1
ccacaatgctaggac

SEQ ID NO: 27597 - DNA, 15 bp, Artificial Sequence
  dgRNA
  Brms1
gggggccagttgcta

SEQ ID NO: 27598 - DNA, 15 bp, Artificial Sequence
  dgRNA
  Brms1
ccgtccgccgtatcc

SEQ ID NO: 27599 - DNA, 15 bp, Artificial Sequence
  dgRNA
  Hist1h4h
actcgttaaaatggc

SEQ ID NO: 27600 - DNA, 15 bp, Artificial Sequence
  dgRNA
  Hist1h4h
ctcgttaaaatggcc

SEQ ID NO: 27601 - DNA, 15 bp, Artificial Sequence
  dgRNA
  Hist1h4h
aatggccgggaagtc

SEQ ID NO: 27602 - DNA, 15 bp, Artificial Sequence
  dgRNA
  Hist1h4h
cgggaagtccggaat

SEQ ID NO: 27603 - DNA, 15 bp, Artificial Sequence
  dgRNA
  Mtg1
acctcacataagctc

SEQ ID NO: 27604 - DNA, 15 bp, Artificial Sequence
  dgRNA
  Mtg1
gaatggagcactacc

SEQ ID NO: 27605 - DNA, 15 bp, Artificial Sequence
  dgRNA
  Mtg1
cagagtgctcgagtc

SEQ ID NO: 27606 - DNA, 15 bp, Artificial Sequence
  dgRNA
  Mtg1
ggcacggggttggcc

SEQ ID NO: 27607 - DNA, 15 bp, Artificial Sequence
  dgRNA
  Top2b
atgacgttttcccct

SEQ ID NO: 27608 - DNA, 15 bp, Artificial Sequence
  dgRNA
  Top2b
gggtcccgcccccct

SEQ ID NO: 27609 - DNA, 15 bp, Artificial Sequence
  dgRNA
  Top2b
ggtcccgccccccta

SEQ ID NO: 27610 - DNA, 15 bp, Artificial Sequence
  dgRNA
  Top2b
gtcccgcccccctag

SEQ ID NO: 27611 - DNA, 15 bp, Artificial Sequence
  dgRNA
  Gm9047
gtttcctccgtggct

SEQ ID NO: 27612 - DNA, 15 bp, Artificial Sequence
  dgRNA
  Gm9047
ggtgtgacactatat

SEQ ID NO: 27613 - DNA, 15 bp, Artificial Sequence
  dgRNA
  Gm9047
tggtgtgacactata

SEQ ID NO: 27614 - DNA, 15 bp, Artificial Sequence
  dgRNA
  Tacc2
ctgaccaacattgcg

SEQ ID NO: 27615 - DNA, 15 bp, Artificial Sequence
  dgRNA
  Tacc2
tgaccaacattgcga

SEQ ID NO: 27616 - DNA, 15 bp, Artificial Sequence
  dgRNA
  Tacc2
cattgcgagggacgc

SEQ ID NO: 27617 - DNA, 15 bp, Artificial Sequence
  dgRNA
  Tacc2
attgcgagggacgct

SEQ ID NO: 27618 - DNA, 15 bp, Artificial Sequence
  dgRNA
  Klk9
cgaagcctgaggcca

SEQ ID NO: 27619 - DNA, 15 bp, Artificial Sequence
  dgRNA
  Klk9
aactccaccctcgta

SEQ ID NO: 27620 - DNA, 15 bp, Artificial Sequence
  dgRNA
  Klk9
agctaggaggccccg

SEQ ID NO: 27621 - DNA, 15 bp, Artificial Sequence
  dgRNA
  Klk9
gaggaccctgtcata

SEQ ID NO: 27622 - DNA, 15 bp, Artificial Sequence
  dgRNA
  Trem2
ccgcaaggctggcat

SEQ ID NO: 27623 - DNA, 15 bp, Artificial Sequence
  dgRNA
  Trem2
gctttcccgcaaggc

SEQ ID NO: 27624 - DNA, 15 bp, Artificial Sequence
  dgRNA
  Trem2
aggcttctacagtaa

SEQ ID NO: 27625 - DNA, 15 bp, Artificial Sequence
  dgRNA
  Trem2
cgctgtgattcaagg

SEQ ID NO: 27626 - DNA, 15 bp, Artificial Sequence
  dgRNA
  Olfr385
gggtctaactcatag

SEQ ID NO: 27627 - DNA, 15 bp, Artificial Sequence
  dgRNA
  Trpm4
aaccgaccccatcac

SEQ ID NO: 27628 - DNA, 15 bp, Artificial Sequence
  dgRNA
  Trpm4
tcccgtgacgtgtcc

SEQ ID NO: 27629 - DNA, 15 bp, Artificial Sequence
  dgRNA
  Trpm4
cccgtgacgtgtccc

SEQ ID NO: 27630 - DNA, 15 bp, Artificial Sequence
  dgRNA
  Trpm4
cgggactccccgccc

SEQ ID NO: 27631 - DNA, 15 bp, Artificial Sequence
  dgRNA
  Ms4a7
aatcacgagtacttc

SEQ ID NO: 27632 - DNA, 15 bp, Artificial Sequence
  dgRNA
  Ms4a7
atcacgagtacttcc

SEQ ID NO: 27633 - DNA, 15 bp, Artificial Sequence
  dgRNA
  Ms4a7
tcacgagtacttccg

SEQ ID NO: 27634 - DNA, 15 bp, Artificial Sequence
  dgRNA
  Ms4a7
caaatttggtcaagt

SEQ ID NO: 27635 - DNA, 15 bp, Artificial Sequence
  dgRNA
  Sugct
cgagtgagactgagg

SEQ ID NO: 27636 - DNA, 15 bp, Artificial Sequence
  dgRNA
  Sugct
cctgggcggaagcgg

SEQ ID NO: 27637 - DNA, 15 bp, Artificial Sequence
  dgRNA
  Sugct
aagcggagggcgtgg

SEQ ID NO: 27638 - DNA, 15 bp, Artificial Sequence
  dgRNA
  Sugct
agcggagggcgtggt

SEQ ID NO: 27639 - DNA, 15 bp, Artificial Sequence
  dgRNA
  Lhfpl5
ccaagtcgcccctcc

SEQ ID NO: 27640 - DNA, 15 bp, Artificial Sequence
  dgRNA
  Lhfpl5
cccgaactctggcgc

SEQ ID NO: 27641 - DNA, 15 bp, Artificial Sequence
  dgRNA
  Lhfpl5
ctctggcgctggccg

SEQ ID NO: 27642 - DNA, 15 bp, Artificial Sequence
  dgRNA
  Lhfpl5
acgcgtttcgcagag

SEQ ID NO: 27643 - DNA, 15 bp, Artificial Sequence
  dgRNA
  Jkamp
acctcaatgcagggt

SEQ ID NO: 27644 - DNA, 15 bp, Artificial Sequence
  dgRNA
  Jkamp
tgcagggtaggagcg

SEQ ID NO: 27645 - DNA, 15 bp, Artificial Sequence
  dgRNA
  Jkamp
gtaggagcgaggcct

SEQ ID NO: 27646 - DNA, 15 bp, Artificial Sequence
  dgRNA
  Jkamp
ggcgacttgaatgca

SEQ ID NO: 27647 - DNA, 15 bp, Artificial Sequence
  dgRNA
  Zfp266
actgctcccccttca

SEQ ID NO: 27648 - DNA, 15 bp, Artificial Sequence
  dgRNA
  Zfp266
ctgatctcgacctct

SEQ ID NO: 27649 - DNA, 15 bp, Artificial Sequence
  dgRNA
  Zfp266
gaacccacccgaaaa

SEQ ID NO: 27650 - DNA, 15 bp, Artificial Sequence
  dgRNA
  Zfp266
aacccacccgaaaaa

SEQ ID NO: 27651 - DNA, 15 bp, Artificial Sequence
  dgRNA
  Sun3
cctgtcattgagccc

SEQ ID NO: 27652 - DNA, 15 bp, Artificial Sequence
  dgRNA
  Sun3
gcatgatcaagtaga

SEQ ID NO: 27653 - DNA, 15 bp, Artificial Sequence
  dgRNA
  Sun3
tcatacttgttaagg

SEQ ID NO: 27654 - DNA, 15 bp, Artificial Sequence
  dgRNA
  Sun3
ccagggctcaatgac

SEQ ID NO: 27655 - DNA, 15 bp, Artificial Sequence
  dgRNA
  Tmem222
gcctgcaccacgtgc

SEQ ID NO: 27656 - DNA, 15 bp, Artificial Sequence
  dgRNA
  Tmem222
ccacgtgccggcatg

SEQ ID NO: 27657 - DNA, 15 bp, Artificial Sequence
  dgRNA
  Tmem222
cggcatgcggaaccg

SEQ ID NO: 27658 - DNA, 15 bp, Artificial Sequence
  dgRNA
  Tmem222
atgcggaaccgcggt

SEQ ID NO: 27659 - DNA, 15 bp, Artificial Sequence
  dgRNA
  Pgm5
caaagtcaggcgagc

SEQ ID NO: 27660 - DNA, 15 bp, Artificial Sequence
  dgRNA
  Pgm5
aaagtcaggcgagct

SEQ ID NO: 27661 - DNA, 15 bp, Artificial Sequence
  dgRNA
  Pgm5
agctgggcgatcctc

SEQ ID NO: 27662 - DNA, 15 bp, Artificial Sequence
  dgRNA
  Pgm5
actctgggacgttga

SEQ ID NO: 27663 - DNA, 15 bp, Artificial Sequence
  dgRNA
  Tek
cagcttagcctgcaa

SEQ ID NO: 27664 - DNA, 15 bp, Artificial Sequence
  dgRNA
  Tek
tcgcataccatacat

SEQ ID NO: 27665 - DNA, 15 bp, Artificial Sequence
  dgRNA
  Tek
cataccatacatagg

SEQ ID NO: 27666 - DNA, 15 bp, Artificial Sequence
  dgRNA
  Tek
accatacataggtgg

SEQ ID NO: 27667 - DNA, 15 bp, Artificial Sequence
  dgRNA
  Bcar3
ccggctcgctcgctg

SEQ ID NO: 27668 - DNA, 15 bp, Artificial Sequence
  dgRNA
  Bcar3
tcgctgtggttacct

SEQ ID NO: 27669 - DNA, 15 bp, Artificial Sequence
  dgRNA
  Bcar3
taattaaataacgcc

SEQ ID NO: 27670 - DNA, 15 bp, Artificial Sequence
  dgRNA
  Bcar3
taaataacgccggga

SEQ ID NO: 27671 - DNA, 15 bp, Artificial Sequence
  dgRNA
  Lrrn4
ggtctatggaaagag

SEQ ID NO: 27672 - DNA, 15 bp, Artificial Sequence
  dgRNA
  Lrrn4
gggcagccgggaacc

SEQ ID NO: 27673 - DNA, 15 bp, Artificial Sequence
  dgRNA
  Ccdc97
ttttaagaggactcg

SEQ ID NO: 27674 - DNA, 15 bp, Artificial Sequence
  dgRNA
  Ccdc97
tttaagaggactcga

SEQ ID NO: 27675 - DNA, 15 bp, Artificial Sequence
  dgRNA
  Ccdc97
gagggtctatgcgat

SEQ ID NO: 27676 - DNA, 15 bp, Artificial Sequence
  dgRNA
  Ccdc97
agggtctatgcgata

SEQ ID NO: 27677 - DNA, 15 bp, Artificial Sequence
  dgRNA
  Mfrp
ggaactgatgcgaga

SEQ ID NO: 27678 - DNA, 15 bp, Artificial Sequence
  dgRNA
  Mfrp
gttggttggggcccc

SEQ ID NO: 27679 - DNA, 15 bp, Artificial Sequence
  dgRNA
  Mfrp
caccggttctctctc

SEQ ID NO: 27680 - DNA, 15 bp, Artificial Sequence
  dgRNA
  Rtf1
ccggacagctagatc

SEQ ID NO: 27681 - DNA, 15 bp, Artificial Sequence
  dgRNA
  Rtf1
cggacagctagatca

SEQ ID NO: 27682 - DNA, 15 bp, Artificial Sequence
  dgRNA
  Rtf1
tagatcagggagcgt

SEQ ID NO: 27683 - DNA, 15 bp, Artificial Sequence
  dgRNA
  Rtf1
cagggagcgttggtc

SEQ ID NO: 27684 - DNA, 15 bp, Artificial Sequence
  dgRNA
  BC048507
ggctccccacctcag

SEQ ID NO: 27685 - DNA, 15 bp, Artificial Sequence
  dgRNA
  BC048507
actgctgttgcttga

SEQ ID NO: 27686 - DNA, 15 bp, Artificial Sequence
  dgRNA
  BC048507
cccgctgaccctctg

SEQ ID NO: 27687 - DNA, 15 bp, Artificial Sequence
  dgRNA
  4930432K21Rik
gcagtgtgacgtctg

SEQ ID NO: 27688 - DNA, 15 bp, Artificial Sequence
  dgRNA
  4930432K21Rik
gcacatcgttctgtt

SEQ ID NO: 27689 - DNA, 15 bp, Artificial Sequence
  dgRNA
  4930432K21Rik
tcccgtctgtggcgc

SEQ ID NO: 27690 - DNA, 15 bp, Artificial Sequence
  dgRNA
  4930432K21Rik
gtggcgcaggtcttc

SEQ ID NO: 27691 - DNA, 15 bp, Artificial Sequence
  dgRNA
  1810037I17Rik
gtaatgcaccctgca

SEQ ID NO: 27692 - DNA, 15 bp, Artificial Sequence
  dgRNA
  1810037I17Rik
cctctgaacaccgca

SEQ ID NO: 27693 - DNA, 15 bp, Artificial Sequence
  dgRNA
  1810037I17Rik
ctctgaacaccgcaa

SEQ ID NO: 27694 - DNA, 15 bp, Artificial Sequence
  dgRNA
  1810037I17Rik
tctgaacaccgcaag

SEQ ID NO: 27695 - DNA, 15 bp, Artificial Sequence
  dgRNA
  Krtap4-8
atgactcttaccacc

SEQ ID NO: 27696 - DNA, 15 bp, Artificial Sequence
  dgRNA
  Krtap4-8
aaaaatcccctaatt

SEQ ID NO: 27697 - DNA, 15 bp, Artificial Sequence
  dgRNA
  Krtap4-8
aaaatcccctaattt

SEQ ID NO: 27698 - DNA, 15 bp, Artificial Sequence
  dgRNA
  Krtap4-8
ctaactaaattatga

SEQ ID NO: 27699 - DNA, 15 bp, Artificial Sequence
  dgRNA
  Gimd1
gcttgcgataagacc

SEQ ID NO: 27700 - DNA, 15 bp, Artificial Sequence
  dgRNA
  Gimd1
cattcgattgtgcca

SEQ ID NO: 27701 - DNA, 15 bp, Artificial Sequence
  dgRNA
  Gimd1
agttgaacaatacgt

SEQ ID NO: 27702 - DNA, 15 bp, Artificial Sequence
  dgRNA
  Gimd1
ggtgttaagtaatcc

SEQ ID NO: 27703 - DNA, 15 bp, Artificial Sequence
  dgRNA
  Ggt5
ggccatgggatcaac

SEQ ID NO: 27704 - DNA, 15 bp, Artificial Sequence
  dgRNA
  Ggt5
gggatcaactggcga

SEQ ID NO: 27705 - DNA, 15 bp, Artificial Sequence
  dgRNA
  Ggt5
gttaacagcggcagc

SEQ ID NO: 27706 - DNA, 15 bp, Artificial Sequence
  dgRNA
  Ggt5
gcacccaggggaact

SEQ ID NO: 27707 - DNA, 15 bp, Artificial Sequence
  dgRNA
  Ankrd35
attaactggtaaaag

SEQ ID NO: 27708 - DNA, 15 bp, Artificial Sequence
  dgRNA
  Ankrd35
tgacatcgaagcttg

SEQ ID NO: 27709 - DNA, 15 bp, Artificial Sequence
  dgRNA
  Ankrd35
catcgaagcttgtgg

SEQ ID NO: 27710 - DNA, 15 bp, Artificial Sequence
  dgRNA
  Ankrd35
ggcgggggcggaact

SEQ ID NO: 27711 - DNA, 15 bp, Artificial Sequence
  dgRNA
  Ctrl
tacttgataattcca

SEQ ID NO: 27712 - DNA, 15 bp, Artificial Sequence
  dgRNA
  Ctrl
aattatcaagtaccc

SEQ ID NO: 27713 - DNA, 15 bp, Artificial Sequence
  dgRNA
  Tmem63b
accgcgttaacagcc

SEQ ID NO: 27714 - DNA, 15 bp, Artificial Sequence
  dgRNA
  Tmem63b
ccgcgttaacagcct

SEQ ID NO: 27715 - DNA, 15 bp, Artificial Sequence
  dgRNA
  Tmem63b
gggaatctcccgcca

SEQ ID NO: 27716 - DNA, 15 bp, Artificial Sequence
  dgRNA
  Tmem63b
ccacggacccccgct

SEQ ID NO: 27717 - DNA, 15 bp, Artificial Sequence
  dgRNA
  Ppt2
tcgccagcagcccgc

SEQ ID NO: 27718 - DNA, 15 bp, Artificial Sequence
  dgRNA
  Ppt2
cgccagcagcccgca

SEQ ID NO: 27719 - DNA, 15 bp, Artificial Sequence
  dgRNA
  Ppt2
aggagcagtttgtcg

SEQ ID NO: 27720 - DNA, 15 bp, Artificial Sequence
  dgRNA
  Ppt2
ttgtcggggtcgctc

SEQ ID NO: 27721 - DNA, 15 bp, Artificial Sequence
  dgRNA
  Nars
ctgcgcaacccaacc

SEQ ID NO: 27722 - DNA, 15 bp, Artificial Sequence
  dgRNA
  Nars
tgcgcaacccaaccc

SEQ ID NO: 27723 - DNA, 15 bp, Artificial Sequence
  dgRNA
  Nars
gaccgcaccccgccc

SEQ ID NO: 27724 - DNA, 15 bp, Artificial Sequence
  dgRNA
  Nars
accgcaccccgccca

SEQ ID NO: 27725 - DNA, 15 bp, Artificial Sequence
  dgRNA
  Wbp2
actaaacgcagggcg

SEQ ID NO: 27726 - DNA, 15 bp, Artificial Sequence
  dgRNA
  Wbp2
cgcagggcgaggccg

SEQ ID NO: 27727 - DNA, 15 bp, Artificial Sequence
  dgRNA
  Wbp2
cgaggccgcggttgc

SEQ ID NO: 27728 - DNA, 15 bp, Artificial Sequence
  dgRNA
  Wbp2
cggaccactgcctgc

SEQ ID NO: 27729 - DNA, 15 bp, Artificial Sequence
  dgRNA
  Comt
gcccgtgtccgcggc

SEQ ID NO: 27730 - DNA, 15 bp, Artificial Sequence
  dgRNA
  Comt
gccggaagcgcctgc

SEQ ID NO: 27731 - DNA, 15 bp, Artificial Sequence
  dgRNA
  Comt
ccggaagcgcctgct

SEQ ID NO: 27732 - DNA, 15 bp, Artificial Sequence
  dgRNA
  Comt
ccaccatcgccgcca

SEQ ID NO: 27733 - DNA, 15 bp, Artificial Sequence
  dgRNA
  Vit
gtggaaattcgaaag

SEQ ID NO: 27734 - DNA, 15 bp, Artificial Sequence
  dgRNA
  Vit
taagcccagtatgag

SEQ ID NO: 27735 - DNA, 15 bp, Artificial Sequence
  dgRNA
  Vit
tagtgctgaattagg

SEQ ID NO: 27736 - DNA, 15 bp, Artificial Sequence
  dgRNA
  Vit
gcttagtgctgaatt

SEQ ID NO: 27737 - DNA, 15 bp, Artificial Sequence
  dgRNA
  Olfr472
cagtttgcacattgc

SEQ ID NO: 27738 - DNA, 15 bp, Artificial Sequence
  dgRNA
  Olfr1018
gcttaattgggcatt

SEQ ID NO: 27739 - DNA, 15 bp, Artificial Sequence
  dgRNA
  Spata21
gacctgaggattccg

SEQ ID NO: 27740 - DNA, 15 bp, Artificial Sequence
  dgRNA
  Spata21
tgaggattccggggt

SEQ ID NO: 27741 - DNA, 15 bp, Artificial Sequence
  dgRNA
  Spata21
gaggattccggggtt

SEQ ID NO: 27742 - DNA, 15 bp, Artificial Sequence
  dgRNA
  Spata21
attccggggttggga

SEQ ID NO: 27743 - DNA, 15 bp, Artificial Sequence
  dgRNA
  Msl2
gcgcgcacttcctcc

SEQ ID NO: 27744 - DNA, 15 bp, Artificial Sequence
  dgRNA
  Msl2
cgcgcacttcctccc

SEQ ID NO: 27745 - DNA, 15 bp, Artificial Sequence
  dgRNA
  Msl2
ccgggcctccctttc

SEQ ID NO: 27746 - DNA, 15 bp, Artificial Sequence
  dgRNA
  Msl2
ggcctccctttcggg

SEQ ID NO: 27747 - DNA, 15 bp, Artificial Sequence
  dgRNA
  Ifnlr1
aagcgatgtcctttc

SEQ ID NO: 27748 - DNA, 15 bp, Artificial Sequence
  dgRNA
  Ifnlr1
accgcgttgcagctt

SEQ ID NO: 27749 - DNA, 15 bp, Artificial Sequence
  dgRNA
  Ifnlr1
cttttaccgcgatgt

SEQ ID NO: 27750 - DNA, 15 bp, Artificial Sequence
  dgRNA
  Ifnlr1
ttaccgcgatgtagg

SEQ ID NO: 27751 - DNA, 15 bp, Artificial Sequence
  dgRNA
  Myom2
gagtaccctgggacg

SEQ ID NO: 27752 - DNA, 15 bp, Artificial Sequence
  dgRNA
  Myom2
agtgatttatgatac

SEQ ID NO: 27753 - DNA, 15 bp, Artificial Sequence
  dgRNA
  Myom2
ttatgatacaggtat

SEQ ID NO: 27754 - DNA, 15 bp, Artificial Sequence
  dgRNA
  Myom2
atatagcacctcctc

SEQ ID NO: 27755 - DNA, 15 bp, Artificial Sequence
  dgRNA
  Syce1
ctatcacgtttaaat

SEQ ID NO: 27756 - DNA, 15 bp, Artificial Sequence
  dgRNA
  Syce1
aatcggacttgtatt

SEQ ID NO: 27757 - DNA, 15 bp, Artificial Sequence
  dgRNA
  Syce1
cggacttgtatttgg

SEQ ID NO: 27758 - DNA, 15 bp, Artificial Sequence
  dgRNA
  Syce1
cgcagcgtactgcgc

SEQ ID NO: 27759 - DNA, 15 bp, Artificial Sequence
  dgRNA
  Olfr1494
tgaatatcccaatat

SEQ ID NO: 27760 - DNA, 15 bp, Artificial Sequence
  dgRNA
  Olfr1494
tttcaatcccaatat

SEQ ID NO: 27761 - DNA, 15 bp, Artificial Sequence
  dgRNA
  Olfr1494
gcccgaggaaaatca

SEQ ID NO: 27762 - DNA, 15 bp, Artificial Sequence
  dgRNA
  Olfr1494
gttgcttcaagcccg

SEQ ID NO: 27763 - DNA, 15 bp, Artificial Sequence
  dgRNA
  Pdss2
gagcgcctagatcca

SEQ ID NO: 27764 - DNA, 15 bp, Artificial Sequence
  dgRNA
  Pdss2
gatccagggctagcg

SEQ ID NO: 27765 - DNA, 15 bp, Artificial Sequence
  dgRNA
  Pdss2
ctagcggggtgccaa

SEQ ID NO: 27766 - DNA, 15 bp, Artificial Sequence
  dgRNA
  Pdss2
cggggtgccaaaggg

SEQ ID NO: 27767 - DNA, 15 bp, Artificial Sequence
  dgRNA
  Plbd1
acagaatccgaccta

SEQ ID NO: 27768 - DNA, 15 bp, Artificial Sequence
  dgRNA
  Plbd1
cagaatccgacctac

SEQ ID NO: 27769 - DNA, 15 bp, Artificial Sequence
  dgRNA
  Plbd1
agaatccgacctacg

SEQ ID NO: 27770 - DNA, 15 bp, Artificial Sequence
  dgRNA
  Plbd1
atccgacctacgggg

SEQ ID NO: 27771 - DNA, 15 bp, Artificial Sequence
  dgRNA
  Prss46
ggtcggattggtcac

SEQ ID NO: 27772 - DNA, 15 bp, Artificial Sequence
  dgRNA
  Prss46
gcaaccatcccctta

SEQ ID NO: 27773 - DNA, 15 bp, Artificial Sequence
  dgRNA
  Prss46
taaggctgcatcagc

SEQ ID NO: 27774 - DNA, 15 bp, Artificial Sequence
  dgRNA
  Prss46
cttgccctcgggcag

SEQ ID NO: 27775 - DNA, 15 bp, Artificial Sequence
  dgRNA
  Tmem114
ttttgtagtcagcag

SEQ ID NO: 27776 - DNA, 15 bp, Artificial Sequence
  dgRNA
  Tmem114
cttgaaggtgcattt

SEQ ID NO: 27777 - DNA, 15 bp, Artificial Sequence
  dgRNA
  Tmem114
aatcaaaagcgcctc

SEQ ID NO: 27778 - DNA, 15 bp, Artificial Sequence
  dgRNA
  Tmem114
caaaagcgcctcagg

SEQ ID NO: 27779 - DNA, 15 bp, Artificial Sequence
  dgRNA
  Celf2
agcgcttatcagtcc

SEQ ID NO: 27780 - DNA, 15 bp, Artificial Sequence
  dgRNA
  Celf2
cttatcagtcctgga

SEQ ID NO: 27781 - DNA, 15 bp, Artificial Sequence
  dgRNA
  Celf2
gataagcgcttgtcc

SEQ ID NO: 27782 - DNA, 15 bp, Artificial Sequence
  dgRNA
  Tmem47
gcgcgcagtgaccaa

SEQ ID NO: 27783 - DNA, 15 bp, Artificial Sequence
  dgRNA
  Tmem47
gattagtggcgagac

SEQ ID NO: 27784 - DNA, 15 bp, Artificial Sequence
  dgRNA
  Tmem47
tagtggcgagaccgg

SEQ ID NO: 27785 - DNA, 15 bp, Artificial Sequence
  dgRNA
  Tmem47
agtggcgagaccggc

SEQ ID NO: 27786 - DNA, 15 bp, Artificial Sequence
  dgRNA
  Slc7a4
ctctagtctcgatgt

SEQ ID NO: 27787 - DNA, 15 bp, Artificial Sequence
  dgRNA
  Slc7a4
agtttactcgcttag

SEQ ID NO: 27788 - DNA, 15 bp, Artificial Sequence
  dgRNA
  Slc7a4
gtttactcgcttaga

SEQ ID NO: 27789 - DNA, 15 bp, Artificial Sequence
  dgRNA
  Slc7a4
ttctgatacgtgacg

SEQ ID NO: 27790 - DNA, 15 bp, Artificial Sequence
  dgRNA
  H2-M10.2
ctatgtcactaccct

SEQ ID NO: 27791 - DNA, 15 bp, Artificial Sequence
  dgRNA
  H2-M10.2
tgagtccttgactag

SEQ ID NO: 27792 - DNA, 15 bp, Artificial Sequence
  dgRNA
  H2-M10.2
tgcaatctggtattc

SEQ ID NO: 27793 - DNA, 15 bp, Artificial Sequence
  dgRNA
  H2-M10.2
gagattaattcctgg

SEQ ID NO: 27794 - DNA, 15 bp, Artificial Sequence
  dgRNA
  Phox2b
gcgtgattgaattaa

SEQ ID NO: 27795 - DNA, 15 bp, Artificial Sequence
  dgRNA
  Phox2b
cgtgattgaattaaa

SEQ ID NO: 27796 - DNA, 15 bp, Artificial Sequence
  dgRNA
  Phox2b
ttagaagggaggatc

SEQ ID NO: 27797 - DNA, 15 bp, Artificial Sequence
  dgRNA
  Phox2b
gggctcggtgcgtaa

SEQ ID NO: 27798 - DNA, 15 bp, Artificial Sequence
  dgRNA
  Fbxo34
tgtaggcgcttgtcc

SEQ ID NO: 27799 - DNA, 15 bp, Artificial Sequence
  dgRNA
  Fbxo34
tccccacagcgctcg

SEQ ID NO: 27800 - DNA, 15 bp, Artificial Sequence
  dgRNA
  Fbxo34
ctcgcggccgcccgc

SEQ ID NO: 27801 - DNA, 15 bp, Artificial Sequence
  dgRNA
  Fbxo34
tcgcggccgcccgca

SEQ ID NO: 27802 - DNA, 15 bp, Artificial Sequence
  dgRNA
  Pglyrp3
tgcagaatatggctc

SEQ ID NO: 27803 - DNA, 15 bp, Artificial Sequence
  dgRNA
  Pglyrp3
ctagatacagacaat

SEQ ID NO: 27804 - DNA, 15 bp, Artificial Sequence
  dgRNA
  Pglyrp3
actgacatctccagt

SEQ ID NO: 27805 - DNA, 15 bp, Artificial Sequence
  dgRNA
  Pglyrp3
gggacctagagagta

SEQ ID NO: 27806 - DNA, 15 bp, Artificial Sequence
  dgRNA
  Tbx2
tcaatgctttgcact

SEQ ID NO: 27807 - DNA, 15 bp, Artificial Sequence
  dgRNA
  Tbx2
cttggggccggcatg

SEQ ID NO: 27808 - DNA, 15 bp, Artificial Sequence
  dgRNA
  Tbx2
ggccggcatgcggct

SEQ ID NO: 27809 - DNA, 15 bp, Artificial Sequence
  dgRNA
  Tbx2
gccggcatgcggcta

SEQ ID NO: 27810 - DNA, 15 bp, Artificial Sequence
  dgRNA
  Cfh
caagaacaatccagc

SEQ ID NO: 27811 - DNA, 15 bp, Artificial Sequence
  dgRNA
  Cfh
aaacgcccatgctgc

SEQ ID NO: 27812 - DNA, 15 bp, Artificial Sequence
  dgRNA
  Plscr2
tattggtggtcctac

SEQ ID NO: 27813 - DNA, 15 bp, Artificial Sequence
  dgRNA
  Plscr2
cctaccggctcctgc

SEQ ID NO: 27814 - DNA, 15 bp, Artificial Sequence
  dgRNA
  Plscr2
ccagcaggagccggt

SEQ ID NO: 27815 - DNA, 15 bp, Artificial Sequence
  dgRNA
  Plscr2
ctactgagtaccagc

SEQ ID NO: 27816 - DNA, 15 bp, Artificial Sequence
  dgRNA
  Trim39
aagaactagccacgt

SEQ ID NO: 27817 - DNA, 15 bp, Artificial Sequence
  dgRNA
  Trim39
aatacatcacccaac

SEQ ID NO: 27818 - DNA, 15 bp, Artificial Sequence
  dgRNA
  Trim39
atcgtgatgacttac

SEQ ID NO: 27819 - DNA, 15 bp, Artificial Sequence
  dgRNA
  Trim39
ggtgatgtattagcc

SEQ ID NO: 27820 - DNA, 15 bp, Artificial Sequence
  dgRNA
  Ubiad1
acgccctgaaatccc

SEQ ID NO: 27821 - DNA, 15 bp, Artificial Sequence
  dgRNA
  Ubiad1
ctaatttgttgaacc

SEQ ID NO: 27822 - DNA, 15 bp, Artificial Sequence
  dgRNA
  Ubiad1
taatttgttgaacct

SEQ ID NO: 27823 - DNA, 15 bp, Artificial Sequence
  dgRNA
  Ubiad1
gttgaacctgggctc

SEQ ID NO: 27824 - DNA, 15 bp, Artificial Sequence
  dgRNA
  Kcna4
gaagctaagcagtcg

SEQ ID NO: 27825 - DNA, 15 bp, Artificial Sequence
  dgRNA
  Kcna4
agctaagcagtcgtg

SEQ ID NO: 27826 - DNA, 15 bp, Artificial Sequence
  dgRNA
  Kcna4
gctaagcagtcgtgg

SEQ ID NO: 27827 - DNA, 15 bp, Artificial Sequence
  dgRNA
  Kcna4
gggggctgggccgac

SEQ ID NO: 27828 - DNA, 15 bp, Artificial Sequence
  dgRNA
  Ilkap
ggccaaaagcctgtc

SEQ ID NO: 27829 - DNA, 15 bp, Artificial Sequence
  dgRNA
  Ilkap
cataacaatttatca

SEQ ID NO: 27830 - DNA, 15 bp, Artificial Sequence
  dgRNA
  Ilkap
cgggacctaatgccc

SEQ ID NO: 27831 - DNA, 15 bp, Artificial Sequence
  dgRNA
  Ilkap
ccgcgcgtagcactc

SEQ ID NO: 27832 - DNA, 15 bp, Artificial Sequence
  dgRNA
  Fam151b
gctccacaccagaac

SEQ ID NO: 27833 - DNA, 15 bp, Artificial Sequence
  dgRNA
  Fam151b
tggaccactgcacta

SEQ ID NO: 27834 - DNA, 15 bp, Artificial Sequence
  dgRNA
  Fam151b
ggaccactgcactat

SEQ ID NO: 27835 - DNA, 15 bp, Artificial Sequence
  dgRNA
  Fam151b
caccttttacatcac

SEQ ID NO: 27836 - DNA, 15 bp, Artificial Sequence
  dgRNA
  Pigo
gtcgaacttccctgc

SEQ ID NO: 27837 - DNA, 15 bp, Artificial Sequence
  dgRNA
  Pigo
cggcgacaaatctcc

SEQ ID NO: 27838 - DNA, 15 bp, Artificial Sequence
  dgRNA
  Pigo
gacaaatctcctggt

SEQ ID NO: 27839 - DNA, 15 bp, Artificial Sequence
  dgRNA
  Pigo
acaaatctcctggta

SEQ ID NO: 27840 - DNA, 15 bp, Artificial Sequence
  dgRNA
  Sult2a3
ttcattaccccaaac

SEQ ID NO: 27841 - DNA, 15 bp, Artificial Sequence
  dgRNA
  Hoxc13
tagcatcacgtgcag

SEQ ID NO: 27842 - DNA, 15 bp, Artificial Sequence
  dgRNA
  Hoxc13
cacgtgcagcggctg

SEQ ID NO: 27843 - DNA, 15 bp, Artificial Sequence
  dgRNA
  Hoxc13
gcggctgtggtcacg

SEQ ID NO: 27844 - DNA, 15 bp, Artificial Sequence
  dgRNA
  Hoxc13
cggctgtggtcacgt

SEQ ID NO: 27845 - DNA, 15 bp, Artificial Sequence
  dgRNA
  Gbp5
gactgtatagttgaa

SEQ ID NO: 27846 - DNA, 15 bp, Artificial Sequence
  dgRNA
  Gbp5
atgaaacgcaagaac

SEQ ID NO: 27847 - DNA, 15 bp, Artificial Sequence
  dgRNA
  Gbp5
ataacggccagccct

SEQ ID NO: 27848 - DNA, 15 bp, Artificial Sequence
  dgRNA
  Gbp5
aataacggccagccc

SEQ ID NO: 27849 - DNA, 15 bp, Artificial Sequence
  dgRNA
  Dnajc13
cgcgtacttcccgag

SEQ ID NO: 27850 - DNA, 15 bp, Artificial Sequence
  dgRNA
  Dnajc13
gtacttcccgagagg

SEQ ID NO: 27851 - DNA, 15 bp, Artificial Sequence
  dgRNA
  Dnajc13
tcccgagaggcggaa

SEQ ID NO: 27852 - DNA, 15 bp, Artificial Sequence
  dgRNA
  Dnajc13
cgagaggcggaacgg

SEQ ID NO: 27853 - DNA, 15 bp, Artificial Sequence
  dgRNA
  Ppp6c
ctgaagatactttac

SEQ ID NO: 27854 - DNA, 15 bp, Artificial Sequence
  dgRNA
  Ppp6c
gatactttacagggt

SEQ ID NO: 27855 - DNA, 15 bp, Artificial Sequence
  dgRNA
  Ppp6c
tagttaaccacttca

SEQ ID NO: 27856 - DNA, 15 bp, Artificial Sequence
  dgRNA
  Ppp6c
cgcggcagagagcta

SEQ ID NO: 27857 - DNA, 15 bp, Artificial Sequence
  dgRNA
  Serinc2
tgcccctgtcgttgc

SEQ ID NO: 27858 - DNA, 15 bp, Artificial Sequence
  dgRNA
  Serinc2
catctcaacctcttt

SEQ ID NO: 27859 - DNA, 15 bp, Artificial Sequence
  dgRNA
  Serinc2
gccagtacctgtccc

SEQ ID NO: 27860 - DNA, 15 bp, Artificial Sequence
  dgRNA
  Serinc2
caggtgagtcctagg

SEQ ID NO: 27861 - DNA, 15 bp, Artificial Sequence
  dgRNA
  Ikbkg
ccgcacttacgacac

SEQ ID NO: 27862 - DNA, 15 bp, Artificial Sequence
  dgRNA
  Ikbkg
tacgacaccggaagc

SEQ ID NO: 27863 - DNA, 15 bp, Artificial Sequence
  dgRNA
  Ikbkg
cgtaagtgcgggatc

SEQ ID NO: 27864 - DNA, 15 bp, Artificial Sequence
  dgRNA
  Ikbkg
cggtgtcgtaagtgc

SEQ ID NO: 27865 - DNA, 15 bp, Artificial Sequence
  dgRNA
  Unc119b
accctcgcaccttcc

SEQ ID NO: 27866 - DNA, 15 bp, Artificial Sequence
  dgRNA
  Unc119b
ctcgcaccttccagg

SEQ ID NO: 27867 - DNA, 15 bp, Artificial Sequence
  dgRNA
  Unc119b
aggcggctcctccac

SEQ ID NO: 27868 - DNA, 15 bp, Artificial Sequence
  dgRNA
  Unc119b
cgggcctcgcccccc

SEQ ID NO: 27869 - DNA, 15 bp, Artificial Sequence
  dgRNA
  Homer2
gaagcggcgactgcg

SEQ ID NO: 27870 - DNA, 15 bp, Artificial Sequence
  dgRNA
  Homer2
gactgcgcggcagcg

SEQ ID NO: 27871 - DNA, 15 bp, Artificial Sequence
  dgRNA
  Homer2
actgcgcggcagcgc

SEQ ID NO: 27872 - DNA, 15 bp, Artificial Sequence
  dgRNA
  Homer2
ctgcgcggcagcgcg

SEQ ID NO: 27873 - DNA, 15 bp, Artificial Sequence
  dgRNA
  Pkig
tggcataaacatccg

SEQ ID NO: 27874 - DNA, 15 bp, Artificial Sequence
  dgRNA
  Pkig
ggcataaacatccga

SEQ ID NO: 27875 - DNA, 15 bp, Artificial Sequence
  dgRNA
  Pkig
atgctcatctttcac

SEQ ID NO: 27876 - DNA, 15 bp, Artificial Sequence
  dgRNA
  Pkig
agtcgcgtcccttcc

SEQ ID NO: 27877 - DNA, 15 bp, Artificial Sequence
  dgRNA
  Prss32
ctagagctaggccca

SEQ ID NO: 27878 - DNA, 15 bp, Artificial Sequence
  dgRNA
  Prss32
tctggtggacagcga

SEQ ID NO: 27879 - DNA, 15 bp, Artificial Sequence
  dgRNA
  Prss32
cagcgatggacacga

SEQ ID NO: 27880 - DNA, 15 bp, Artificial Sequence
  dgRNA
  Prss32
acacgaaggctcccg

SEQ ID NO: 27881 - DNA, 15 bp, Artificial Sequence
  dgRNA
  Mdn1
agtcactgtgcgctt

SEQ ID NO: 27882 - DNA, 15 bp, Artificial Sequence
  dgRNA
  Mdn1
ttaggtcgcacgcgc

SEQ ID NO: 27883 - DNA, 15 bp, Artificial Sequence
  dgRNA
  Mdn1
cggcagctcctcgtt

SEQ ID NO: 27884 - DNA, 15 bp, Artificial Sequence
  dgRNA
  Mdn1
gaaggatcagtcaac

SEQ ID NO: 27885 - DNA, 15 bp, Artificial Sequence
  dgRNA
  Casp8
gtcattctactactc

SEQ ID NO: 27886 - DNA, 15 bp, Artificial Sequence
  dgRNA
  Casp8
gaatgacactggcta

SEQ ID NO: 27887 - DNA, 15 bp, Artificial Sequence
  dgRNA
  Casp8
gtagtagaatgacac

SEQ ID NO: 27888 - DNA, 15 bp, Artificial Sequence
  dgRNA
  2700081O15Rik
aacaagcgcccgttg

SEQ ID NO: 27889 - DNA, 15 bp, Artificial Sequence
  dgRNA
  2700081O15Rik
cagccccccgcgagc

SEQ ID NO: 27890 - DNA, 15 bp, Artificial Sequence
  dgRNA
  2700081O15Rik
cccccgcgagctggc

SEQ ID NO: 27891 - DNA, 15 bp, Artificial Sequence
  dgRNA
  2700081O15Rik
ccgcgagctggcagg

SEQ ID NO: 27892 - DNA, 15 bp, Artificial Sequence
  dgRNA
  Vmn2r74
tatagtattaaatag

SEQ ID NO: 27893 - DNA, 15 bp, Artificial Sequence
  dgRNA
  Vmn2r74
ttaaatagtggcacc

SEQ ID NO: 27894 - DNA, 15 bp, Artificial Sequence
  dgRNA
  Vmn2r74
tatacctcctactaa

SEQ ID NO: 27895 - DNA, 15 bp, Artificial Sequence
  dgRNA
  Zfand1
cgcctcgccccatcg

SEQ ID NO: 27896 - DNA, 15 bp, Artificial Sequence
  dgRNA
  Zfand1
gccttgccccactac

SEQ ID NO: 27897 - DNA, 15 bp, Artificial Sequence
  dgRNA
  Zfand1
aggacgccccgccct

SEQ ID NO: 27898 - DNA, 15 bp, Artificial Sequence
  dgRNA
  Zfand1
cacttgcgcgcttcc

SEQ ID NO: 27899 - DNA, 15 bp, Artificial Sequence
  dgRNA
  Ints10
ccgggctggaatcaa

SEQ ID NO: 27900 - DNA, 15 bp, Artificial Sequence
  dgRNA
  Ints10
ccagcccgggtttga

SEQ ID NO: 27901 - DNA, 15 bp, Artificial Sequence
  dgRNA
  Cpe
atttggcttttgacg

SEQ ID NO: 27902 - DNA, 15 bp, Artificial Sequence
  dgRNA
  Cpe
tttggcttttgacgt

SEQ ID NO: 27903 - DNA, 15 bp, Artificial Sequence
  dgRNA
  Cpe
acccaacatccctgg

SEQ ID NO: 27904 - DNA, 15 bp, Artificial Sequence
  dgRNA
  Cpe
tcccgctccccgggg

SEQ ID NO: 27905 - DNA, 15 bp, Artificial Sequence
  dgRNA
  Nuak1
gtctgcgcgtcctcc

SEQ ID NO: 27906 - DNA, 15 bp, Artificial Sequence
  dgRNA
  Nuak1
cgcgtcctcccggcg

SEQ ID NO: 27907 - DNA, 15 bp, Artificial Sequence
  dgRNA
  Nuak1
gcgtcctcccggcgc

SEQ ID NO: 27908 - DNA, 15 bp, Artificial Sequence
  dgRNA
  Nuak1
cgtcctcccggcgcg

SEQ ID NO: 27909 - DNA, 15 bp, Artificial Sequence
  dgRNA
  Edem3
cacttcggctctacc

SEQ ID NO: 27910 - DNA, 15 bp, Artificial Sequence
  dgRNA
  Edem3
acccggaagtagcct

SEQ ID NO: 27911 - DNA, 15 bp, Artificial Sequence
  dgRNA
  Edem3
cctagactacgacac

SEQ ID NO: 27912 - DNA, 15 bp, Artificial Sequence
  dgRNA
  Edem3
acgacaccggaaagc

SEQ ID NO: 27913 - DNA, 15 bp, Artificial Sequence
  dgRNA
  Abhd6
atattttttgaaccg

SEQ ID NO: 27914 - DNA, 15 bp, Artificial Sequence
  dgRNA
  Abhd6
tttttgaaccgggga

SEQ ID NO: 27915 - DNA, 15 bp, Artificial Sequence
  dgRNA
  Abhd6
ttttgaaccggggat

SEQ ID NO: 27916 - DNA, 15 bp, Artificial Sequence
  dgRNA
  Abhd6
tttgaaccggggatg

SEQ ID NO: 27917 - DNA, 15 bp, Artificial Sequence
  dgRNA
  Kcnh1
tcccgctgcacccag

SEQ ID NO: 27918 - DNA, 15 bp, Artificial Sequence
  dgRNA
  Kcnh1
cccgctgcacccaga

SEQ ID NO: 27919 - DNA, 15 bp, Artificial Sequence
  dgRNA
  Kcnh1
cagagggtgccgctc

SEQ ID NO: 27920 - DNA, 15 bp, Artificial Sequence
  dgRNA
  Kcnh1
tccagcctcaccccg

SEQ ID NO: 27921 - DNA, 15 bp, Artificial Sequence
  dgRNA
  Slfn4
tccggttatacttcc

SEQ ID NO: 27922 - DNA, 15 bp, Artificial Sequence
  dgRNA
  Slfn4
ttgtgccctagtgac

SEQ ID NO: 27923 - DNA, 15 bp, Artificial Sequence
  dgRNA
  Slfn4
gcatttcgtcactcc

SEQ ID NO: 27924 - DNA, 15 bp, Artificial Sequence
  dgRNA
  Gm8298
aacctgttgtaatta

SEQ ID NO: 27925 - DNA, 15 bp, Artificial Sequence
  dgRNA
  Gm8298
gtgcttaaacttcac

SEQ ID NO: 27926 - DNA, 15 bp, Artificial Sequence
  dgRNA
  Gm8298
gtccataattacaac

SEQ ID NO: 27927 - DNA, 15 bp, Artificial Sequence
  dgRNA
  Doc2b
cgccgtgtgagcgcg

SEQ ID NO: 27928 - DNA, 15 bp, Artificial Sequence
  dgRNA
  Doc2b
gtgagcgcgaggaag

SEQ ID NO: 27929 - DNA, 15 bp, Artificial Sequence
  dgRNA
  Doc2b
cgcacactcaccgct

SEQ ID NO: 27930 - DNA, 15 bp, Artificial Sequence
  dgRNA
  Doc2b
ccgcttggttgctgc

SEQ ID NO: 27931 - DNA, 15 bp, Artificial Sequence
  dgRNA
  Cnep1r1
gctgctcgctattct

SEQ ID NO: 27932 - DNA, 15 bp, Artificial Sequence
  dgRNA
  Cnep1r1
ttgaacatctagcgc

SEQ ID NO: 27933 - DNA, 15 bp, Artificial Sequence
  dgRNA
  Cnep1r1
tgaacatctagcgct

SEQ ID NO: 27934 - DNA, 15 bp, Artificial Sequence
  dgRNA
  Cnep1r1
gcgctgggttcccga

SEQ ID NO: 27935 - DNA, 15 bp, Artificial Sequence
  dgRNA
  Mks1
accaactttcacctt

SEQ ID NO: 27936 - DNA, 15 bp, Artificial Sequence
  dgRNA
  Mks1
aactttcaccttggg

SEQ ID NO: 27937 - DNA, 15 bp, Artificial Sequence
  dgRNA
  Mks1
gagctttactcacac

SEQ ID NO: 27938 - DNA, 15 bp, Artificial Sequence
  dgRNA
  Mks1
tcccgctgccaggct

SEQ ID NO: 27939 - DNA, 15 bp, Artificial Sequence
  dgRNA
  Lcn10
ggagcagcctccata

SEQ ID NO: 27940 - DNA, 15 bp, Artificial Sequence
  dgRNA
  Lcn10
gaggtgtccatcttc

SEQ ID NO: 27941 - DNA, 15 bp, Artificial Sequence
  dgRNA
  Lcn10
cttcgatgggtgggg

SEQ ID NO: 27942 - DNA, 15 bp, Artificial Sequence
  dgRNA
  Lcn10
gctgcttcgatgggt

SEQ ID NO: 27943 - DNA, 15 bp, Artificial Sequence
  dgRNA
  Pkn1
aacttgccctagagc

SEQ ID NO: 27944 - DNA, 15 bp, Artificial Sequence
  dgRNA
  Pkn1
tggcgcagaggatgc

SEQ ID NO: 27945 - DNA, 15 bp, Artificial Sequence
  dgRNA
  Pkn1
ctagggcaagttttt

SEQ ID NO: 27946 - DNA, 15 bp, Artificial Sequence
  dgRNA
  1700049G17Rik
agttccccgcagaac

SEQ ID NO: 27947 - DNA, 15 bp, Artificial Sequence
  dgRNA
  1700049G17Rik
gtaacttttactcaa

SEQ ID NO: 27948 - DNA, 15 bp, Artificial Sequence
  dgRNA
  1700049G17Rik
aagcgcgcacccccg

SEQ ID NO: 27949 - DNA, 15 bp, Artificial Sequence
  dgRNA
  1700049G17Rik
agcgcgcacccccgt

(The sequence listing continues in the following parts.)

What is claimed is:

1. A vector comprising
   (i) a first expression cassette comprising a nucleic acid sequence encoding a dead-guide RNA (dgRNA), and a MS2-loop-containing chimeric backbone sequence, under control of a first promoter, and
   (ii) a second expression cassette comprising a nucleic acid sequence encoding a fusion protein of Thy1.1 and one or more transcription activators under control of a second promoter,
   wherein the dgRNA consists of a nucleotide sequence selected from the group consisting of any one of SEQ ID NOs: 1-83600 and 83601.

2. The vector of claim 1, wherein the one or more transcription activators are selected from the group consisting of MS2 bacteriophage coat protein (MCP), transcription factor p65 (P65), and heat shock factor I (HSFI).

3. The vector of claim 1, wherein the dgRNA expression cassette and the MS2-loop-containing chimeric backbone are driven by a U6 promoter.

4. An engineered immune cell comprising the vector of claim 1.

5. The cell of claim 4, wherein the cell is selected from the group consisting of a T cell, a primary cell, a CD8+ cell, a CD4+ cell, a T regulatory (Treg) cell, and a CAR-T cell.

6. The vector of claim 1, further comprising one or more additional components selected from the group consisting of a long terminal repeat (LTR) sequence, a T2A sequence, a linker sequence, a nuclear localization sequence (NLS), and a short PA sequence.

7. The vector of claim 1, wherein the first promoter is a U6 promoter and/or the second promoter is an EFS promoter.

8. The vector of claim 1, wherein the cassette expressing a fusion protein of Thy 1.1 and one or more transcription activators is driven by an EFS promoter.

9. The vector of claim 1, wherein the vector is a lentiviral vector.

10. The vector of claim 1, wherein the dgRNA consists of a nucleotide sequence selected from the group consisting of SEQ ID NOs: 55168, 55169, 55170, and 55171.

11. An engineered immune cell comprising the vector of claim 10.

12. The cell of claim 11, wherein the cell is selected from the group consisting of a T cell, a primary cell, a CD8+ cell, a CD4+ cell, a T regulatory (Treg) cell, and a CAR-T cell.

13. The vector of claim 1, wherein the dgRNA expression cassette comprises a dgRNA that targets one or more genes that, when upregulated, enhance degranulation of T cells,
   wherein the one or more genes is selected from the group consisting of Prodh2, Ccnblip1, Sreklip1, and Wdr37.

14. The vector of claim 13, wherein the dgRNA expression cassette comprises a nucleotide sequence selected from the group consisting of SEQ ID NOs: 55168, 55169, 55170, 55171, 79364, 79365, 79366, 79367, 55044, 55045, 55046, 55047, 55671, 55672, 55673, 55674, 25546, 25547, 25548, 25549, 34631, 34632, 34633, and 34634.

15. An engineered immune cell comprising the vector of claim 14.

16. The cell of claim 15, wherein the cell is selected from the group consisting of a T cell, a primary cell, a CD8+ cell, a CD4+ cell, a T regulatory (Treg) cell, and a CAR-T cell.

17. A composition comprising a plurality of the vectors of claim 1, wherein the plurality of vectors comprises at least 100 different vectors each encoding a different dgRNA according SEQ ID NOs: 1-83601.

18. The composition of claim 17, wherein the plurality of vectors comprises at least 83601 different vectors each separately encoding one of the dgRNAs according SEQ ID NOs: 1-83601.

19. A vector comprising
   (i) a first expression cassette under control of a first promoter, comprising a dead-guide RNA (dgRNA) and a MS2-loop-containing chimeric backbone sequence, and
   (ii) a second expression cassette under control of a second promoter, comprising a fusion protein of Thy1.1 and one or more transcription activators, wherein the vector comprises a nucleic acid sequence of SEQ ID NO: 84602.

* * * * *